United States Patent 7,750,207 (ZEA MAYS RIBULOSE BISPHOSPHATE CARBOXYLASE ACTIVASE PROMOTER) - sequence listing, part 7

SEQ ID NO: 8783 - DNA, 5062 bp, Zea mays
  misc_feature (1206)..(1206): n is a, c, g, or t
aacgtgttaagacgtccgctcttatcggtgaaatattaatggaggtgaacaatttaagttgctcgccttcattaatgagcgatcgacagaggcagtcgctcttatgttgctcgtcttcgtccattcctacgtataaatgcagctccccaaccatccccatttttttgtccaccatctaaccctctccttttagcgaggtttgaactctcaaactctaaaaaaaatcacgatttttaggtgaggattgctcttggattatttgaagaggacatcgtaggaggttgctatgcattttcacatcattgttctgctctcacaacattttttcataaagtgatcgcctttgttgatgaggttaacaaaagcggttataacattcgcttccgcaagaccgcatcaacacaggcttttgtggacgccttcgttaacctaaaacgattgcatgcaaaaacatttatatactagtgcaactcgccaccgctacccctcacaccccctccttataagcctggatagttgcaaaatctaaaccccaacctttgttgttgttgttgccgcctggtccaccatccagccatgtcaacctcgctagccattttgcccatcgtttgtccccttcttcatcgactctaattacatgtgcgttagtggtacattccaaccctataaaaattgagagcatatgaggtgcacttgatcttttggtgcatatattgaatcgttgtcatacatctatctaacaatgctgtcattcctcttattttctacacagggaagagtgcagttagcaagggtattctttatgaaatatacaaaactaaaggtgaagatatggaagcgcgttaaatcttatacggatgatcgtgatttaatatgtatccatgtatacctgatatcctagaaggaatttggtcttttttagctgcccaaaactgcatgaggccctagatcgttctatgcggcggtgtagaagccgtccaaatctcaccgtggatcacaattcacgcagcgttgcgggcttgcggcgtccccgtctttccccaccggcaggcgccagcttcagctaaacgacgccgcaccaggaaaaaggtctaccttccgatattccactgtcttgtttccattctcccctcctctccggctctccctcccccgacagctgcccccgcatggtgtgatcaggccatctggtgcgggaagaaaagngcgcggacacagcgagccatgctcccgccgcgcgccgccgccgtgccgctgctgctgctggccctggcggccggcgcggcccggggcgccgacgacctggcatcggacgccgcggcgctgcaggccttcctcgcgcccttcggatccgcgaccgtgtcgtggaactcgtcccagccgacatgctcctggacgggtgtcgtctgcaccggcggccgcgtcacggagatccacctgcccggggaaggcctccggggcgcgctccccgtcggcgcgctcggcgggctcaacaagctcgccgtgctgtcgctgcggtacaacgcgctctccggcccgctgcctcgggacctcgcctcctgcgtcgagctccgggtgatcaacttgcagtccaacctcctctcgggggagctcccggtggaggtgctggcgctaccggcgttgacgcagctcaacctcgcgcagaaccgcttgtcggggaggatatcgccggccattgccaagaacgggcggctgcagctgctcttcctgaacggcaaccgccttaccggagagctaccgaacgtcagcatgccgtcgctcaccgcgctaaacgtctccttcaacaacctcagcggcgagatacccaagagcttcggcggcatgccgtccacgtctttcctcggcatgccgttgtgcggcaagcccctcccgccgtgccgagcgccgggttcggaagcatcgccgtctcagcctcccactcccacgcttcggcccgaggcaccggccccgactgacaaccgcggacggggcaggcatcacctcgccggcggcgccatcgctggcattgtggttggctgcgcgtttggcttcctcctgatcgcggccgtcctcgtcctcgtgtgtggcgcgctgcggcgggagccgagaccgacataccgcagccgtgacgccgttgcggcggagctggccctgcacagcaaagaggcaatgagccccaacggctacaccccacgtgtctcagacgcgcgaccgccgcccccgccttcagtcccgccaccgccagccgtctccgccgcagccgtggggcggaagaagctcttcttcttcggtaggattccccggccctacgacctcgaggacctgctccgcgcgtccgccgaggttcttggcaagggcacgcacgggaccacgtacaaggccgcgatcgagtctgggccggtcatggcggtgaagcgcctcaaggagacctcgttgcccgaacgcgagttccgggacaaggtcgcggccatcggcgggatcgaccacccaaatgtcgtgcccctgcaggcctattacttcagcaaggacgagaagcttatggtgtacgagttcgtggccatgggcagcctttcctccatgcttcacggtacgtgctctgttcttgccaagcgacctgcgaatctgcgatccctctctgtcctgttttgatggccgaattgaatggtttttttttctttcttttctgacggggtttcttaccgcaggcaatcgcggctccggccggtcgccactgagctgggagtcgaggaggcgcatcgctttggcctcggcgcgcggtctcgagtacatccacgccacgggctccatggtcacgcacggcaacatcaagtcgtccaacatcctcttgagccgcaccgtggacgcgcgcgtggccgaccacgggctcgcgcacctcgtcaacccggcgggcgcggcgacgacgacccgcgtcgcggggtaccgcgcgcccgaggtggtggcggacccgcggcgggcgtcgcagaaggcggacgcgtacagcttcggcgtgctgctcctggagctgctgacggggaaggccccggcgcacgcggtgctgcacgacgagggcgtggacctcccgcgctgggcgcggtccgtggtgaaggaggagtggacgtccgaggtgttcgacacggagctgctcaggcacccgggcgccgaggacgagatggtggagatgctgcggctggccatggactgcaccgagcccgctccggaccagcggccggccatgcccgagatcgtggcgcgcatcgaggggctcggcggcacggcgtcgacgtcgacggcgacggcgcggtccggccggagtgcgtccgtggacgaggcggacgaccggccgctgaggaccaccggatcgatccgtcagagctgaggtccgtccgcgtccgatcacttgtgttattgtcactgacggaaggttctgaacaagggggaaaaaaagaagagatctttctgttctgtcttcttgcgcttgtcgtaggggcgttgtcgtgtgctgtttattctttcatgcgtctcttgacgcttgttcgccctcagatgaattctttcgttttagcagcggtgatgagtgtgcgctgatggtgtgtgaattggtggtgatagtaatgcaatgtgtaattgcttctagtacctgaagggtgttcgattgaaaagtttagcctcgagtcctgcctcagcagatttttcatgtccgatcgtgcgtgcgtgtcatgttcacctgccacctgcaccacggaactcggagttgcttctctgcccagtaccactgctcgctgcattgacaggagtaataacgacctcatcaaatcacaagctgcaaaaaaaaaactgtttctctgcagtcaatgacggcgtcgtcccaacctcgcaggcatcatccagagccacagacgacttgttcctgaacaagcgaccgagtcgggcgaagacgacagaccagacgcgaaccgaatgacgtaacgctggttgtacactgcgagacacaggagagattgccgagcaagcaaacgcgaacatggccgcgctcgtagtcgtagtaccccttctgggccgtacctgcctgccgaccacgaaccgacggcatgttgcgtgcatcaattctcgaaggggggaaaaaatagagaagagggatggatgctgggggagctggatagatagatcatgcacgggcacggcctgccatgtttggttgtcaggctttataaaaaagaaagaaaggcggggcgatggagccgagtcgctcccccactacgagtccacaaacaatcactggtcgatctcccggcaataatgctcgccgctgcattattgctggcctcgccggatcgccggcgcagctgcagctccatcgcttgcttcccgttctcgtccacggcgcgctcttccgggcagcgaaggcgttttgccttttgcttcgacgccgctggatctgaagcgacgagtcgcgcaggggcacagcgaccacagcagcactgtaccggcgggttactacgagctggcaactggcaggcgcacgaacaggcgcgacgcgtccaaaagaaggaactgatgtgcagcacggcaaggtaccggcaggcaggcgtcgtgcgctgcagtaactgatgccggcctgcaccgcaccgcaccgcacggcctgatcggtctactccttcgccttttttcgctgcgtacaggctacagggtccctgccagccggctgggttgggacgtgcacatcagatcagcgcctagcttccgtcgtgggtgggggcaggcgtcggccggcccggaaccggaaccggcggagggaagggtgcggtggtggagcccccggccagcctcagcagcggcacttggcaaagtgcgtgccaccacgtgccgtgcgggcggtgggtgtcccctctggaacagcgcggcggccggccaccacggctaggccaccgccagtccgccacggccacacctcctgcgagtgagcgcggcgtcggtgtttaaggctattcacagtagaggtttcatgggtgtttcatgtattaattagcctgctacatcagctattttgatgacatgtcacatc

SEQ ID NO: 8784 - DNA, 2422 bp, Zea mays
aggtctaccttccgatattccactgtcttgtttccattctcccctcctctccctcccccgacagctgcccccgcatggtgtgatcaggccatctggtgcgggaagaaaaggcgcgacacagcgagccatgctcccgccgcgcgccgccgccgtgccgctgctgctgctggccctggcggccggcgcggccgggggcgccgacgacctggcatcggacgccgcggcgctgcaggccttcctcgcgcccttcggatccgcgaccgtgtcgtggaactcgtcccagccgacatgctcctggacgggtgtcgtctgcaccggcggccgcgtcacggagatccacctgcccggggaaggtctccggggcgcgctccccgtcggcgcgcttaggcgggctcaacaagctcgccgtgctgtcgctgcggtacaacgcgctctccgggcccgctgcctcgggacctcgccacctgcgtcgagctccgggtgatcaacttgcagtccaacctcctctcgggggagctcccggcggaggtgctggcgctaccggcgttgacgcagctcaacctcgcgcagaaccgcttgtcggggaggatatcgccggccattgccaagaacgggcggctgcagctgctcttcctgaacggcaaccgccttaccggagagctacccaacgtcagcatgccgtcgctcaccgcgctaaacgtctccttcaacaacctcagcggcgagatacccaagagcttcggcggcatgccggccacgtctttcctcggcatgccgttgtgcggcaagcccctcccgccgtgccgagcgccgggttcggaagcatcgccgtctcagcctcccactcccacgctccggcccgaggcaccggccccgactgacaaccgcggacggggcaggcatcacctcgccggcggcgccatcgctggcattgtggttggctgcgcgtttggcttcctcctgatcgcggccgtcctcgtcctcgtgtgtggcgcgctgcggcgggagccgagaccgacataccgcagccgtgacgccgttgcggcggagctggccctgcacagcaaagaggcaatgagccccaacggctacactccacgtgtctcagacgcgcgaccgccgcccccgccttcagtcccgccaccgccagccgtctccgccgcagccgcggggcggaagaagctcttcttcttcggtaggattccccggccctacgacctcgaggacctgctccgcgcgtccgccgaggttcttggcaagggcacgcacgggaccacgtacaaggccgcgatcgagtctgggccggtcatggcggtgaagcgcctcaaggagacctcgttgcccgaacgcgagttccgggacaaggtcgcggccatcggcgggatcgaccacccaaatgtcgtgcccctgcaggcctattacttcagcaaggacgagaagcttatggtgtacgagttcgtggccatgggcagcctttcctccatgcttcacggcaatcgcggctccggccggtcgccactgagctgggagtcgaggaggcgcatcgctttggcctcggcgcgcggtctcgagtacatccacgccacgggctccatggtcacgcacggcaacatcaagtcgtccaacatcctcctgagccgcaccgtggacgcgcgcgtggccgaccacgggctcgcgcacctcgtgaaccccgcgggcgcggcgacgacgacccgcgtcgcggggtaccgcgcgcccgaggtggtggcggacccgcggcgggcgtcgcagaaggcggacgcgtacagcttcggcgtgctgctcctggagctgctgacggggaaggccccggcgcacgcggtgctgcacgacgagggcgtggacctcccgcgctgggcgcggtccgtggtgaaggaggagtggacgtccgaggtgttcgacacggagctgctcaggcacccgggcgccgaggacgagatggtggagatgctgcggctggccatggactgcaccgagcccgctccggaccagcggccggccatgcccgagatcgtggcgcgcatcgaggggctcggcggcacggcgtcgacgtcgacggcgacggcgcggtccggccggagtgcgtccgtggacgaggcggacgaccggccgctgaggaccaccggatcgatccgtcagagctgaggtccgtccgcgtccgatcacttgtgttattgtcactgacggaaggttctgaacaagggggaaaaaaagaagagatctttctgttctgtcttcttgcgcttgtcgtaggggcgttgtcgtgtgctgtttattctttcatgcgtctcttgacgcttgttcgccctcagatgaattctttcgttttagcagcggtgatgagtgtgcgctgatggtgtgtgaattggtggtgatagtaatgcaatgtgtaattgcttctagt

SEQ ID NO: 8785 - DNA, 1376 bp, Zea mays
gtgaaatcgccaaacacctgagatctgctttttcggtctggtggaacgtggaattgcagcagacctgggcgggtaaagcgtgaacgcctgtacgacgcaacacgccgaggcggtggctgcggcggcggcgcgccggtatttcgattgtgaattccctcctgtctcctgaagcaagcgcagcaatgccagcgcttcccgcttttcccctcacccgccgcccatccgatgccagacgccgcggtcgcctcgtcctttccctcgtcgtcttcgttgctgtctccgccgccgcagccctcgcctacctatctttcccctctgccgggcggacatcgcccccggcggtccggacggaggccgactgctgcaggggtatggagggcctcgagctctggggcccggcggtcaagtggggctcagaccaccgcctgccctccgccgccgcctgctgcgccgcctgcaaggccatgtgccctcaccctaaggacggggcctgccgctgcgactcgtgggtcttctgcggtgacgagcgcaaatgcaaggacaggctcggggagtgctggctgaagaaacagaaggatgtcatggcccctgctgttattgcaaagggggaggacgtcatgtggacttctggtctaatctttggaaaaggagaggggattgtggggcttgaaacaaatttagggacacttcatattcaattgctgcctggttgcgcgccccgttcagtggaccacttcatcgagctcctgggcttgcgcaactgtgctggatgcagattttatcgtgcagaaggacgtgggaacgtctgggatgcaaaaggcgaccatgaaaaaaatgttgcatttggccccccatatgcattgcttcaaggaacactggaagttgatggtgtgcccttcaagaagataccaagagaagcatgtccggcggtgaaaagagggtccgttgcctgggtagggtcagggccagagttcctgatcagcttagcggaccacgaggagtggagggacgcctacaccgtgttcgggaatgtgcttcccatggacatggcgatcgctgaggagatgacactgctgccgacaagcacagacgtgtggagcaacgtgaaagtgaaggtgctgaaagatcctgtctacttcaaggtcaagagaagcagcaatgctagcgctgtctaggtgatgggcatatttcttcttgcttgtttggatggaaggctgtggcaacaccggcaaatggttgtttgaccatgaaaacctgtgttataactcacaggagacgatggtctcgcttcattgtgcaaagaaaggggagagttctaatacaacagtaatatactagcacagtagtaatatactagtagaaaaaaaaaaaaaaaa

SEQ ID NO: 8786 - DNA, 1770 bp, Zea mays
aggtagagaggatgccccacagacgttacacggagaagagataaattgcagaaacgcaaacacatttgaagttttgaaccgcatttcttaaaaaaaaatcatgtacaatctggtggattatcctaagtaaacattccattgacaaatactgtaacgttcaacatgtcttcgcataagaaaaatgacagcacacaacggcgatgttgacgccgaaactgcggcaggaattaaacccgatgggggcagcttgcattacaaaaccgtcaagacttttatcataataaaacaaggaataaccaccaggctcgcagtccatggaatggattattccagcaacttgcaggaaatgctcggtagatacagcagataaactgtaacatgtatactagactcgcatgtcaacaggaatgggcatggtatatccttgtttcgtttgcccacacatacaagtatacagcacagaatcgtcattcccaataagtatttgcatcggttcagatggctgtcatcataaacagagggaggcagactaatgaagaggtacacaagtaagtgaatctggactcaggactcgactcctactgagcagcaagctattgagtgagagggacgcactcgagctccatctcaagctggccgcgctcgacgttctggagcctggcattcaccacctgcttcaccttgccgttgatgatggagatggcgctgtccctcgggatccagatgccatctttcgccagccatttgttgagctgcgcggtatctgcgatagcagaggtctcgtgcgctttggctgcagcaaccagtggctggatgttgatctcggcctcccccatccggtcgtcagtggtgaacgtgtccttgtcgtagacttgctgtcaggggggggggggttctcaagcacataaggtaggctagctaggctggctggtagccaaagtaactaagcgcatttgataaaatcttcttctgtgtatcttaacaacctcaaaataaataaataaaacgcttaccagtttaagcagcggcactgggtcgggtatcgaaagcatgagcctttcattccatacaggatttagactgctctttaccactttcgttttcattgtctgcataggtgaaacaaaagagtcatgggctttgcatagccctagctaggatgcatgtttggtgaattttggagttgcttaactacctggtgtcctaggttaatgataacgtaaggatcactcgacatgacatcacggatagctagatttgtgcctcttatgatgtcgatcttaatcaatccgacaaactctaccatgcccacctcgatctagaagagatatataaagcaaagagtcaaatagtttccaacatttaaagtatttatactaaagacaggtgtgcgaatttcggcaatcgtactgttttctttgttgatttggcctcgtgctcttttctcctccagctgttcctgaatgaatggcctaaaccatgtcgacttgaactagtactatgctgttggtgattatgtttctcgttgcgtcgtggaggacatgaaagctgggggttagtcaaaaattgttgagcctcgtattttctcctgcacacacacacacacatgtatataaattaaagaaacctgctatgcatgtgtcagtaagacatcaaaagattgcaattaacgtctacctaataaaatcattgcgctcctccgctgaacaatcttgccttggcttcgcgtagttttcgggcacaaatgcttcatatatcatgtttactgca

SEQ ID NO: 8787 - DNA, 1099 bp, Zea mays
gagcaccacaatcagcacagtatctgtttgctggttggttcagaagatgatctaacctctcagctgtcttaaagggacatgtaacaaaaccttggttgctgcattgataattagcatctgtcttggttggcattccactggctttggagccttggtgatcggcatggtcgttaacatccatcttggctgctatcccacatactttgaaggtttggcaatcgccttggtcactagtatccatcttggttgtcaccaccccacatactttggagcctttgtggtcgcattggtcagtagcatccatcttgttggctgtcaatccacaagctttcaaaccttcgcatacgccacctccactagcatccgacttaggttgcagtagtccacgggctttcaaaccttgacggacggggtggtcattatccatcttgcctggcaattcacaggcattgcctttcgattcgcaggctttcgaaacttgacgatcggcatggttgttgtccatcttggctgggaattcgcaggctttcaagcgttgacgatcggcacggtcgttatccatcttgcctggcaattcttcacaggctctcggaccttggcggtcgccgtggtcactcgaatccatccttgtttgcataccgcgcgctttccttctgttgtatggctttgggctatcaacgaatctctgcacgggattgcgcccctccatctcgtccccgtcgtccccaacgccgcctcccgttcttgcgctcctctacatcgtcctcgtgccaggcagcgggcgggcgggcgggctcagcgcgggcggtcagcgagcaaaacggaggcagaccggccggatgaacaatggcgtccgatccatccaaggaaacgacggaggtccggagcgatcacgtacgactccttgggggcgaaggcgacgacgtcgaggaggacgtgttgcggcaggaggagggagagaggcgcgcgcggttgcggtcgaaggatacctggacgtgcgcggagggcggcgcagggcctgcgctgcgccgcgcctgcgctgctaggctggggcgaggaaggagcggtggtcgttggcccggccccggggtccccgtgg

SEQ ID NO: 8788 - DNA, 3496 bp, Zea mays
  misc_feature (3489)..(3489): n is a, c, g, or t
ccggccgggaaggcccacggcatcgccaaccccggccggcatcctaacatccgcaacgccatcctcgccgccgccgcagcctcctgcgctccgctccactggtggtggtagggagtgcagcggatccatcccgtgtcccgatccgaccccttcgctgctagtttaggattcatccttcgacgtttgggattggttcggttgggatggcgcgtcgcctgattagccccgcagcggcgtgccgaggctgcggtttggttaggaccgggtttctgcccgccatctcctccttccattatcgagccttgccatcgtgctcaccgaagaggacttcatcagtaaagaattgctttagcaacacttacaatataaggaaagagggttcacgttggatacaatccggtcctcccttgttgctaaatagggtaaagtttgttggcaagaggacatcctgttctgttgcaacagagccgccgcctgctgccactgaagaaccaggcatggatgtccccaaggagatattcttgaaagattacaaggcacctgattattattttgacacggtggatttacaatttcaacttggtgaagaaaagaccatagttacatctaaaatagttgtatctcctggagttgaaggcatctcagctccactagttcttcatgggcatgacctcaagctcatatcaatcaaagtcaatggcactgaattaaagggtgaagagtataaagtcaattctcgccatctgatgctttcaacacctcctgctgttgtattcaacttggaaattgtcacagatatatatccccagctaaacacatcactggaggggctgtacaagtctactggtaacttctgcacccagtgtgaagcagaagggtttcggaagattacctactttcaggaccgcccagatgttatggcaaaatatacttgccgcattgaagctgataaaactttgtatccggttttattgtccaatgggaatcttattgagcagggagaccttgagggtggaaagcattacgcactgtgggaggatcccttcaagaaaccaagctacctgtttgctctagttgctggtcagctgggatgccgggaggattcatttgttacatgctctggccgcaacgtaacactaagaatttggactcctgcccaagatttaccaaaaacagcacatgctatgtattctcttaaagcagcaatgaaatgggatgaggaggtctttggtctggagtatgatcttgatttattcaacattgttgttgttcctgatttcaatatgggagcaatggaaaacaagagcttgaatatatttcaatctagacttgtgttggcatcaccggagactgccactgatggtgattatgctgctattttgggtgttgttggacatgagtatttccacaactggactgggaatagagtaacttgccgtgattggttccagctaaccctgaaagaaggactgaccgttttcagggatcaggagttctcttcagatcttggctgtcgtacggtaaaacgtattgctgatgtctccaaacttagaatctatcaattcccacaggacgccgggcctatggcacatcctatccgtccccattcttatatcaagatggacaacttctatactgttacggtttacgagaagggtgctgaagttgtcagaatgtacaagaccatgtttggagcatcagggttccgaaagggcatggatctttattttaaaaggcatgatgggcaagctgtcacttgtgaagacttctatgcagccatgtgtgatgcaaataatgcacaactgccaaactttttacaatggtactctcaagcaggtacgcctatagtcaaggtggcatcttcatatgatcctagttctcagacattctctttgaaacttagccaagaagtaccacccactcctggccagccggttaaggagcctatgttcatacctgttgctgttggacttgttgactctactggaaaagatatgcccctcacttccgtttacagtgatggaagtctccaaacagtctctactgatggccagccagtcttcactactgtgcttcagtttaaaaagaaagaagaagagtttatgtttaaaaacattcctgagaggccagttccttctttgttaaggggatatagtgctcctgtccgtctagattctgatctgagtgagggtgacctatttttcttgcttgccagtgactcggatgaatttaacagatgggaagctggccaagttttggcacgtaagttgatgctcagtctcgtagctgatttccagcaacagaaaacactggttctaaatccgaaatttgttgatgggattagatcaattctgcgcaacacaagcttggataaggaattcattgcgaaagcaataactttgcctggtcaaggggagattatggatatgatggaagttgcagatcctgatgcagttcatgctgtccgtaactttattaagaaggagcttgccgtgcaacttaaagatgatcttcttgcggctgtgaaaagcaacaggagttctgaggcttacacatttaaccatgatagtatggctcgccgtgcattaaaaaatacatgccttgcataccttgcgtcattgaatgagccagatttcgttgagcttgcactgcatgagtacaagtctgcgactaacatgacagagcagtttgctgcattagcagcattatcccaaaatccaggccaagttcgtgatgatgccctcttggatttctataacaagtggcagcatgaatacttggttgtaagcaagtggtttgctcttcaagctacttcagagattcctggaaatgttgcaaatgttcagaagctgctgtctcaccctgctttcgacctgaggaatcccaacaaggtgtactcactaatcgggggattctgtggctcacctgtgaacttccacgcgaaagatggttctgggtacaagttcttgggtgagatcgttttgcagcttgacaagataaaccctcaggtggcctcccgcatggtttcagcattttctcggtggaggcggtacgacaagaccagacaagctcttgctaaggcccagctggagatgatcgtgtcggccaatgggctctccgaaaacgtgttcgagattgcttcaaaaagcttggcggattagcttgggcagttccgaggaattgcgagtgggagtgcttaactgaatctctcttttgttggtaaaatgacaagtagagataataaacaggcgggccgaatttgcatgaactgataaaatataagtgtgatgatgcccgctttgtggggggctttggagcatgcatgcgcgctcgtctgttggaatggaactgctgtttttttttacgttctccgctcagcggaccgctgtggggcagaaaacatctgaagcacgacggctgctctctgtctcaaaaaaaaaaaaaaaaaaaaaaaaaaaaaaaaaaaaaaaaaggccggccgctcgcgtnctagaac

SEQ ID NO: 8789 - DNA, 3477 bp, Zea mays
gtcagaaaagttaggcaaaatgtggcaagttagacatcaaaccaaacagacccttaattagtttcgtatatatcacagacctttttgacctggcttataccacttttagcttctcccctaccagtactgtcacaatttataattcgtttgattcaccggtgcccctgttttaaaagtgtaaatgtagatttggctctattttttttaaactttacgtgtttatctctgtttttaaaataaaactgttgtatgcccctctccgttaagtgttaaaccttgttaaaaagacaagaaattgcgctagtgtcctagttttgaagtataactgtagttttgctcctatttttagtctttacattttttttatgacaattcgaactattttggcaacaattcaaattattttaacaaaataaaaatttaaaagcttcatctgtgtttctgctactagtagtgaagtcaaagcccgtggttgtcttttgttttggcaaagaggctctacgttttcaattcactgccgtcatccgcacaccccttggagccagcagccagccatctgcaagcaacaccacgatcgcattcacagccacgccgtcaatccgccatagtatttgccaaatccccgctatgcaaaataagctactcccttccctgctaacaacaactactacgtacaaaatacatgttatcaacaaagctccaccacgccacgccctccaaccacagccctcctgcatcggagttcacaagaacgcatcccaccagccgaccgccaggctgagcgcgaggccaaggagggcggcggcggtggcgccgcgcggcgtcgcggaggcggcggccgcggaaccgcccgcgctggcggtgcgctcgaactgcagcgagtccacggcaagcggcatgttctcctggtcggggctgcaccgcggcgccgcgccgccgctgccggactccgtcgggcgcgcggtgtagagcatggcgcgcagcacggcggagacggtggggatgtaggccgtcttgttcttggccagcagccacgtgaggcccatcagctggcagtcccgccccagcatccgccgcgcgcggtcgccgccggcgccggagacctcgcggctcacgttccccttcagctgcacaagttggtgggtgcaagtgcaaccgaggaagctgcaggttagcaagtgcagttaatgtggttcatgcagcaggggacgttctcgcgatgcaggcagtgcagtttccactttccaccactgaacgttgcatttggcttgctcgacctctcagtaaatgctccccatgcacaacaaactgttcttgctacgcgcgcccgaccgatttggttgcaggttttcgcaatgcaagaaagagaacaatgtcaaaaaagttttgagtgcatgattggactgttcgtcatgatcatgtccttgagagattaatacaatgccaatctggatgcaggacatgcaagtcggggactaggtctgctcatcaatccacggctttcgaagctgcaagtggtggctaaccagctaaaagcattcataattgaaaaagacactgcccattgtggttgtcctccggctaggatggtttgtccccacaaatgtgtgttcaagctttcaaggaatggtcctatccggtggttacctggtggcgggattgccctttcccagggttgcttccagagagaaaggcaatcaagtaggaaatgattagtgggtgatggtaagctcaagaacaagcagatcagttcgaaagttgaaacaatgatgcggatagaaagcgcagtggaaaccctttgtgggaaaggggataccatcaaaatggccaccttttgctagataaaaaaaaacaagcaaagaaggagcgagggcgtcgcttgaagcgccgcactattgctctgcaggagtggtacgtataattgacaaaattgttgaaggttttcgtctatatataagcaggggtagaaatcgatcagtggtttgaatccaagaaggcaagatatgcgtggacgcgtggtgtaacatttcaaagattagttatatagggaaatgcaagaccaaaccaaaagagacaagaacggaaaagatgagcaaaagcaatggcattaggagagaaagctagcaagaaaggtttaccttttgcagggactgcacgcatcgcgagcagccggcgtaggaggcgttgcggcagctcttctccagggccttcaccgcggcggtgggcgtggcgttcctggccgcggcgccagctttgacggcgaacgcagcggggcagcggagcgagccgatctggtggagccggatgccgcagaagcagagcaccgtgtcgcacgtcgcgttgggccggggcagcgccaccccgcgccgctccagcgcggcgcccagcgcgtcgacacacctctggttgtcgtacggtaccatgggcccgtcgtcgccgccgtcgggccccattccctcgtcccccgctagcgccgagggtggaggcgccgggggcacggacagcgcggtgcgcgcgtgcgccgcgaagagccaggccgccaggaccgggcagcagcggccgcggtccagcgagcccgggcccccgccggcgccgcacgccgcggctaccccgccgaagagctcggccgagaggtccaggtggcacggccgcgaggcggcgttggacggggacgaggagttggacggggactgcgcctgcgacagcgggaacgaaggcacgtcggagccgcgggccgggggagccacggctaacgccacgaacagcgccacggccaggtgggcccacattgccgccggcgacgtggaccaggtggtggtggcggctgtgcgagtgcggctgtgtgtggcctttctttgggaccgggtgttgttgtatgtatatatggcaacccgaactgcgatcgcgaggtcgggggtagggactccggattagagacggtaagaaccagattactcgtaatgatactaatatttaaaatacactatacaaacaatataatttatagtacaaaacaacgcaaaaagtgtttttgacgatcaatatgagtgaactgtacaatatacatatatgatcactaaaacaccattttatatcgctttacattgtagattgtaatatttatacaatgtagtttgaatatagatatgtatgtggttaagctgctggaaatggtctaataattagtctcccgtctggacaattacacgagaatgaacttgacaacggagctccagctctaaatccaaccccagattacccaaagcttctccttgtattgtgtagaatctactacttcctctaatcctttatatataatctatccgcattgttgtacgtcattttttaatttaaatggttattgccccattcatatgattggagtacgaccaacgttaatccataattgttattgcctcttattctgaactaatgaatcttgagccattatataacccagtcgtatctaagtctacc

SEQ ID NO: 8790 - DNA, 1566 bp, Zea mays
tttttttttttttttttttttttttgttccgggccccccctcgtgtctgctttctgttgttcatccaaatggtgcattagcacttcttcatccacaaaaacaaaagtggtcaatcgcacacgattagaaaccaccgagattagaaatgtcaaaagccacatcaacattccccttgcagaggccagccatctgcagcaccacgatcgcattcacagccatgcatgccgtcatctctgccaaatcctcgctatgcaaaataagctacagtacctcctgctaacgactagcactacaagatacgtctatcgacaaggttccaccaccgaccctacgccctgcagcggtccagccctctttgcattggttcacaagaaccagaacgcatcccaccggccgatcgtcaggccgagcgcgaggccgaggaggagggcgccgcgcggcgtcgcgttggcagccgcggatcccgtggtgctgccggtgcgctcgaactgcagcgagtccacggccagcggcatgttctcctggtcggggctgcaccgcggcgccgcgccggcggactccgtcgggcgcgcggtgtagagcatggcgcgcagcacggcggagacggtggggatgtacgccgtcttgttcttggccagcagccacgtgaggcccataagctggcagtcccgccccagcatccgccgcgcgcggtcgccgccggcaccggagacctcgcggctcacgttccccttcagcttttgcagagactgcacgcatcgagagcagccggcgtaggaggcgttgcggcagctcttctccaggcccttcacggcggcggtgggcgtggcgttcttggccgcggcgccagcgccagcgccgacggcgaacgcggaggggcagcggagcgagccgatctggtggagccggatgccgcagaagcagagcacagtgtcgcaagttgcgttgggccggggcagcgccaccccgcgcttctccaaagcggcgcccagcgcgtccacgcacctctggttgtcgtacggcaccatgggcccgtcgtcgccgggccccagcccctcctccccggcgaccgccgagggggcgggtgccgggggcacggacagcgcggtgcgcgcgtgcgccgcgaagagccaggccgcgaggacagggcagcagcggccgcggtcgagcgagcccggccccccgctggagccgcacgccgctgccacgccaccgaagagctcggcggagaggtcgaggtgacacggcggcgaggaggcgttcgacggggacgaggagttggacggggactgcgcctgggagagcgggaacgacggcacgtcggagccgcgggccgacgcggcggctactgcgagcaacagcgcgacggtgaggtgcgccgacattggcgccggcgacgtgatccagatggtggcggcaggagtgagcgacactgcgagagcaagaagtggggggtgtccgggtgtgtgtggcctttctctagggaccgggcgtagccgaaccgagaccgcgaggccggtactcgggactcgggagcggggagcggatgtctgttcgagttctcct

SEQ ID NO: 8791 - DNA, 3268 bp, Zea mays
cattgggtacctcgtcgccacggcccacggcatcgccaaccagtgaaatcatcctaacaaccggcacgccatcctcgccgccgccgcagcctcctgcgctccgctccactggtggtggtagggagtgcagcggatccatcccgtgtcccgatccgatcccttcgctgctagtatcgagccttgccatcgtgctcaccgaagaggacttcatcagtgaagaattgctttagcaacacttacaatataaggaaagagggttcacgttggatacaatccggtcctcccttgttgctaaatagggtaaagtttgttggcaagaggacatcctgttctgttgcaacagagccgccgcctgctaccactgaagaaccaggcatggatgtccccaaggagatattcttgaaagattacaaggcacctgattattattttgacacggtggatttacaatttcaacttggtgaagaaaagaccatagttacatctaaaatagttgtatctcctggagttgaaggcatctcagctccactagttcttcatgggcatgacctcaagctcatatcaatcaaagtcaatggcactgaattaaagggtgaagagtataaagtcaattctcgccatctgatgctttcaacacctcctgctgttgtattcaacttggaaattgtcacagaaatatatccccagctaaacacatcactggaggggctgtacaagtctactggtaacttctgcacccagtgtgaagcagaagggtttcggaagattacctactttcaggaccgcccagatgttatggcaaaatatacttgccgcattgaagctgataaaactttgtatccggttttattgtccaatgggaatcttattgagcagggagaccttgagggtggaaagcattacgcactgtgggaggatcccttcaagaaaccaagctacctgtttgctctagttgctggtcagctgggatgccgggaggattcatttgttacatgctctggccgcaacgtaacactaagaatttggactcctgcccaagatttaccaaaaacagcacatgctatgtattctcttaaagcagcaatgaaatgggatgaggaggtctttggtctggagtatgatcttgatttattcaacattgttgttgttcctgatttcaatatgggagcaatggaaaacaagagcttgaatatatttcaatctagacttgtgttggcatcaccggagactgccactgatggtgattatgctgctattttgggtgttgttggacatgagtatttccacaactggactgggaatagagtaacttgccgtgattggttccagctaaccctgaaagaaggactgaccgttttcagggatcaggagttctcttcagatcttggctgtcgtacggtaaaacgtattgctgatgtctccaaacttagaatctatcaattcccacaggacgccgggcctatggcacatcctatccgtccccattcttatatcaagatggacaacttctatactgttacggtttacgagaagggtgctgaagttgtcagaatgtacaagaccatgtttggagcatcagggttccgaaagggcatggatctttattttaaaaggcatgatgggcaagctgtcacttgtgaagacttctatgcagccatgtgtgatgcaaataatgcacaactgccaaactttttacaatggtactctcaagcaggtacgcctatagtcaaggtggcatcttcatatgatcctagttctcagacattctctttgaaacttagccaagaagtaccacccactcctggccagccggttaaggagcctatgttcatacctgttgctgttggacttgttgactctactggaaaagatatgcccctcacttccgtttacagtgatggaagtctccaaacagtctctactgatggccagccagtcttcactactgtgcttcagtttaaaaagaaagaagaagagtttatgtttaaaaacattcctgagaggccagttccttctttgttaaggggatatagtgctcctgtccgtctagattctgatctgagtgagggtgacctatttttcttgcttgccagtgactcggatgaatttaacagatgggaagctggccaagttttggcacgtaagttgatgctcagtctcgtagctgatttccagcaacagaaaacactggttctaaatccgaaatttgttgatgggattagatcaattctgcgcaacacaagcttggataaggaattcattgcgaaagcaataactttgcctggtcaaggggagattatggagattatggatatgatggaagttgcagatcctgatgcagttcatgctgtccgtaactttattaagaaggagcttgccgtgcaacttaaagatgatcttcttgcggctgtgaaaagcaacaggagttctgaggcttacacatttaaccatgatagtatggctcgccgtgcattaaaaaatacatgccttgcataccttgcgtcattgaatgagccagatttcgttgagcttgcactgcatgagtacaagtctgcgactaacatgacagagcagtttgctgcattagcagcattatcccaaaatccaggccaagttcgtgatgatgccctcttggatttctataacaagtggcagcatgaatacttggttgtaagcaagtggtttgctcttcaagctacttcagagattcctggaaatgttgcaaatgttcagaagctgctgtctcaccctgctttcgacctgaggaatcccaacaaggtgtactcactaatcgggggattctgtggctcacctgtgaacttccacgcgaaagatggttctgggtacaagttcttgggtgagatcgttttgcagcttgacaagataaaccctcaggtggcctcccgcatggtttcagcattttctcggtggaggcggtacgacaagaccagacaagctcttgctaaggcccagctggagatgatcgtgtcggccaatgggctctccgaaaacgtgttcgagattgcttcaaaaagcttggcggattagcttgggcagttccgaggaattgcgagtgggagtgcttaactgaatctctcttttgttggtaaaatgacaagtagagataataaacaggcgggccgaatttgcatgaactgataaaatataagtgtgatgatgcccgctttgtggggggctttggagcaaaaaaaaaaaaaaaaaaaaaaaaaaaaaaaaaaaaaaaaaaaaaaaaaaactcgaagagggg

SEQ ID NO: 8792 - DNA, 1299 bp, Zea mays
  misc_feature (1249)..(1249): n is a, c, g, or t
acaacaactactacgtacaaaatacatgttatcaacaaagctccaccacgccacgccctccaaccacagccatcctgcatcgggagttcacaagaacgcatcccaccagcggccgacccccaggctgagcgcgaggccaaggagggcggcggcggtggcgccgcgcggcgtcgcggaggcggcggccgcggaaccgcccgcgctggcggtgcgctcgaactgcagcgagtccacggcaagcggcatgttctcctggtcagggctgcaccgcggcgccgcgccgccgctgccggactccgtcgggcgcgcggtgtagagcatggcgcgcagcacggcggagacggtggggatgtaggccgtcttgttcttggccagcagccacgtgaggcccatcagctggcagtcccgccccagcatccgccgcgcgcggtcgccgccggcgccggagacctcgcggctcacgttccccttcagcttttgcagggactgcacgcatcgcgagcagccggcgtaggaggcgttgcggcagctcttctccagggccttcaccgcggcggtgggcgtggcgttcctggccgcggcgccagctttgacggcgaacgcagcggggcagcggagcgagccgatctggtggagccggatgccgcagaagcagagcaccgtgtcgcacgtcgcgttgggccggggcagcgccaccccgcgccgctccagcgcggcgcccagcgcgtcgacacacctctggttgtcgtacggcaccatgggcccgtcgtcgccgccgtcgggccccattccctcgtcccccgctagcgccgacggtggaggcgcggggggcacggacagcgcggtgcgcgcgtgcgccgcgaagagccaggccgcaaggaccgggcagcagcggccgcggtccagcgagcccggccccccgccggcgccgcacgccgcggctaccccgccgaagagctcggccgagaggtccaggtggcacggccgcgaggcggcgttggacggagacgaggagttggacggggactgcgcctgcgacagcgggaacgaaggcacgtcggagccgcgggccgggggagccacggctaacgccatgaacagcgcgacggccaggtgcgcccacattgccgccggcgacgtggaccaggtggtggtggcggctgtgcgagtgcgactgtgtgtggcctttttgttaggcaattaagtaggaaatgattagtgggtgatggtaagctcaagaacaagcagntcagttcgaaagttgaaacaatgatgtggttaggaaaaaaaaaaaaaaaa

SEQ ID NO: 8793 - DNA, 3679 bp, Zea mays
cattgggtacctcgaggccggccgggcccttcttttcacttccctccctccctccctttcctctcctccccgctccatggcccccgcggcgccagcgggcctggcctccgtcgcggtcgcggtcgcggttgccgtgctcgccgccgcggcgtcggcggccgtcacctacgaccgcaaggccgtcgtggtgaacggccagcgccggatcctgatgtccggctccatccactacccaaggagcgtccccgagatgtggccggatctgatacagaaggccaaggacggcggcctcgacgtcgtgcagacgtacgtcttctggaacggccatgagccctcccgtcgacagtactacttcgagggtcggtatgatctggtgcacttcatcaagctggtgaagcaggccggactctacgtgcacctccgcattggcccctacgtctgcgccgagtggaatttcggtggtttccctgtttggctcaagtatgtcccgggcattagctttaggactgataatgaaccgttcaaggctgagatgcagaatttcaccacaaagatcgttgacatgatgaagtccgaagggctctttgaatggcagggagggccaataattctttcccagattgagaatgaatttgggcccttggagtgggatcagggagagcccgccaaggcctatgcgtcatgggcagctaacatggcggttgcgctcaacacaagtgttccatgggtcatgtgcaaagaagatgatgccccggatccaattattaatacttgcaatggattttattgtgactggttctccccaaacaaacctcacaagcctacaatgtggactgaggcttggacatcttggtatacaggatttggtattccagttccacatagaccagtagaggatctagcatatggtgtggccaagtttattcagaagggtggctcttttgttaattattacatgtatcatggtggaacaaattttgggcgcacagctggtggtccattcattgcaactagctacgactatgatgctcctattgatgaatatggtgtgctgagacaaccgaaatggggtctacttgaaggagttgcataaagctatcaagctttgtgaaccagcattggttgcaggagacccaattgtaacttcacttggcaatgctcagcaggcatctgtttttagatcaagcaccgatgcctgtgtggccttccttgagaacaaggataaagtatcttatgctgcgcgagcattcaatggaatgcattatgatctacctccctggtccataagtattctcccagactgcaaaacaacagtctacaacaccgccagcgttggaagtcagatttcacaaatgaaaatggaatgggctggaggattcacatggcaatcatacaatgaggatataaactccttgggtgacgaatcatttgcaacagttgggttactggaacagataaatgtgacaagggataacacagactacttatggtatacaacatacgttgatattgctcaggatgagcagtttctcagcaatgggaagaatcctatgctaactgttatgtcagctggtcatgctttgcatattttcgttaatggacaactaccagggactgtgtatggaagcgtagaagttccaaaagtgacatatagtggaaatgtgaaactttggtcaggcagtaacactatttcatgcttaagtatagcagttggtctcccgaatgtgggagaacattttgagacttggaatgctggaattctaggtcctgtgacactggatggcctaaatgagggaagaagagatctcacatggcagaaatggacctataaggttggtctgaaaggtgaggctttgagtcttcattcacttagtggcagctcttcagtagagtggggagaacctgttcagaagcagcctctgtcatggtacaaggctttcttcaatgcacctgatggtgatgagccattagctttggatatgagtagcatgggtaaaggtcaaatctggataaatggacaaggtattggaaggtactggcctggctacaaagcttctggaacctgtgggatctgtgattaccgtggagagtatgatgaaaagaagtgccaaaccaactgtggtgactcttctcagagatggtaccatgttcctcgttcatggcttaatccgacggggaaccttttggtgatatttgaggagtggggcggtgatcctaccggaatttcgatggtgaaaagaatagcagggagtatctgcgctgatgtctccgaatggcagccatcgatggcaaactggcgaacaaaaggctatgagaaagccaaggtccacctccagtgtgatcatggacggaaaatgactcacataaaatttgccagctttggcacaccacagggctcctgcgggagctactctgaaggcagttgccatgcacacaagtcatacgacatattttggaagagctgcattggtcaagagcgctgtggggtaagcgtggttccagatgcatttggtggagatccatgccctgggactatgaaaagagccgttgttgaggctatatgcggctgagtcatatgatccatataacgtactggtttctacaataatgttaccctatatcaagctggcaagaggtgaaagtggcggcaactgcgacacacggattgccagggtttacaggaattagttgtatgttagatttaagcatcgtatgtgtatgtaacttaggtcacatgagacttgcatggaagaagtggttaggaccctagctgtgagaaactaagtcttgtagctctctacacagtagaattggtctggcaggtgagggtgcagatgagactctgctttattacctgagtccatgtgcgcggtggctcttgggttggagattgccaaaaggccagcaattggctttgcattatctggtcattcatttttttggtcattggagggtgcaatgtaaatgttcagggtcaatcatttatgaatttttctagctagtaatgaaacagtaaagaaaatgttggttcagattaaaattataaaacaccagttatcttccatttgcctgagatcagtgttttgttggacatggtttgcatggatgccatcttgctgaatactttaggccctgtttgggaacacagtttttctaaactgcagtttttcaaatactaaagtataatttagtcatgacattactacagtttacaatgcttcagttttcgaatacaacagtatccaatacatcaaggtgtttgggaaaaactttggttgagaccaatcagccagagcgggacctagctggcgctctctttacagagaaaaactttggttgagaccaaagtttccaaaactgcaaaacaagtgcagtatttacaatactacaatttagtatacagagatttcagatgaattgccaaacacctcaaagtatataataccacagtattgctcaatactacagtattgtttcaatactgcagaaaaactttgttcctaaacattcccttagttgcttacatcataaacaaatcatgaccatgcaagatgcaagagtacttggtttgtttcctgcaagttatggtcagggatataaaaattcggttttgaccggtcgagaaaggcgaatgaaattgaaggggttactggttcggtcggaaagttagccaaaccaa

SEQ ID NO: 8794 - DNA, 1017 bp, Zea mays
attgggtacctcgaggccggccggggaggtttctggtgggtggccggccgggagtgcttccacttgcagccaagccaaccgaaaccgatggcgtcgggctcccgcggcggcggcgggagcgacttctccgtggtcgtggtgggctccgacgccggcgccggcgcagcgctcctcgttccctccgaccgccactcgtggcacgactgcctcgccgaggcggacgcctgcttctccgacctcgaggagcgccaggtcgtgcgcgtccagggcaccgatcgggcccgccgaaccatcgtccgtgtcgtcggcaagttcttcccggctccagcaattgacggtgaacgtctgaaaaagtatgtgttctacaaactccgcaccgaattgcctgtgggtccattctgcatcttgtacatgcacagtactgtgcagtctgatgataacaaccctggagtgtcaatcttgaggacaatttatgaggagctttcacctgagtacaaggaaaggcttcaggttttctacttcttgcatcctgggcttcgctccaggctggccatcgccacacttggcaggctatttttaagtggagggttgtattggaaaatcaagtacattagtcgactggagtatctctggggcgatataagaaagggagaggttgaaattccagattttgttattgaacatgataaggttcttgagcaccggccactcactgattatggcatagaaccagatcccctacatcttgctgatgtacctgctgaggaagtggggtactcgcttggaagatacgaagataaatggactccagaagatcgatggtattcagggaattacatgtgattttttctgctgtcgctgaagcctaaaagattattattgtatagtaacacgataatatgagatctgtatgtcagattgctgtgaaaacattggcaaactgtgtttccaacttcatgattcaaattcttttgaggggccggccctatagggaaactcctacaacggaattttatt

SEQ ID NO: 8795 - DNA, 839 bp, Zea mays
acagacggagtgcttgcagttgcagccaagccaaccgaaaccgatggcgtcgggctcccgcggcggcggcgggagcgacttctccgtggtcgtggtgggctccgacgtcgccgaggcgaacgcctgcttctccgacctcgaggagcgccaggtcgtgcgcgtccagggcaccgatcgggcccgccgaaccatcgtccgcgtcgtcggcaagttcttcccggctccagcaattgacggtgaacgtctgaaaaagtatgtgttctacaaactccgcaccgaattgcctgtgggtccattctgcatcttgtacatgcacagtactgtgcagtctgatgataacaaccctggagtgtcaatcttgaggacaatttatgaggagctttcacctgagtacaaggaaaggcttcaggttttctacttcttgcatcctgggcttcgctccaggctggccatcgccacacttggcaggctatttttaagtggagggttgtattggaaaatcaagtacattagtcgactggagtatctctggggcgatataagaaaggaagaggttgaaattccagattttgttattgaccatgataaggttcttgagcgccggccactccctgattatggcatagaaccagatcccctacatcttgctgatgtacctgctaaggaagtgggatactcgcttggaagatacgaagataaatggactccagaagatcgatggtattcaaggaattacatgtgatttttttagcatgtaaccaaaagcctaaaaagattattgtatagtaacacgataatatgagaatctgtatgtaaaaatactgtaaaaaccttggcaa

SEQ ID NO: 8796 - DNA, 1415 bp, Zea mays
ggccggtcagtttattttactcttaagttacatagacggagtgcttgcagcgggcggcaggtaagccaaccgaaaccgatggcgtcgggctccggcagcgggagcgacttctccgtggtcgtggtgggatccgacttcgcggtcgacgccggcgccgcgctcctcgcccccgccgaccacgaggtgtggcacgactgcctccccgtcctcgctgaggcggacgcctgcttctccgacctcgaggagcgccaggtcgtgcgcatccagggcacggatagggcaggccgaaccatcgtccgcgtcgtcggcaagtttttcccggctccagtaattgatggtgaacgtctgaagaagtatgtgttctacaaactgcgcaccgaattgcctgtgggtccattctgcattttgtacatccacagcaccgtacagtctgatgataacaaccctgggatgtcgatcttgaggacaatttatgaggagcttccacctgaatacaaggaaaggcttcaagttttctacttcttgcatcctgggcttcgctccagactggccatcgccacacttggcaggctatttttaagtggagggttgtattggaaaatcaagtatattagtcgactggagtatctctggggggatataaaaaagagagaggttgaaattccagattttgttattgaacatgataaggttcttgagcaccggccactgactgattatggcatagaaccagatcccctacatcttgctgatgtacctgctgtgggatactcgcttggaagatatgaagataaatggactccagaagatcgatggtattcaaggaattacatgtgaaattttctgttgtagcttaaaagatgattgtatagtaacacggtactatgagatttgtattagattgctatgaaaaccttgtcaaggtcctgtatttccaactaaatttatacctgtttgaagatttttgagcagacgctatatgctgtctgtggttaacccgccgtataaaactgtggccgatgtgtctgcttatgaatgtccttaaggtcttaaggtaaatgcgtgcttaattctctgggctgtgaaaaactagaaacaaaaatcgcatctgccccaatttttggatttattgttaaggcttgccgtttgaccatataatggtgacaccaagctttagaagggagcatgtacttatcatatcacatgattctgaagccacccagtacattattagtctactattccagaagatttgcaccttgcataccaacgcatgtatatcaacaaaatgcagccttgtttcgaactctatgacagttcgcggcagcgctttgcggcagcaacaacagcactaatcagcgttccacggaatgcgcccttctcgagctcctgaatcccggcaatggtagtacctg

SEQ ID NO: 8797 - DNA, 2738 bp, Zea mays
tgcatgcctgcagaaagtgatttgtttgacatgtttgattctgaagttcatcatttgtgccgcaatgtggataatgatcttacctgtaaagctgcaaaacccgagaattcaaatagagatgtacctgaatcctctgttcgtcttggttcctcttcatctttcaattcagtggatgacaagttcccttattctgggatcttctcactaaccgataccgaccaacttttggatgcggttgtctccaatgtcaatcctggtggcaagcagatctctggtgacagtacttcttgcaagacttcagcggcccatattcccaccgcttcgtagggtcgcttaaaagagccaaagcagtccgaatcatcttcacctttgctaatcaagaatgagttagccgtttcaaattttgtcaaacagtcatctttccaagaaaaggcagaggatggctgtctttctcaaaataatgcaatacagaagtctcagatacgcctctggatagagaacggacagaacatgaaatgtgaaagtgcctcagcctcaaacagtaagggcgttgatatgtcaagcaaggcaagtcgaaagaggtctcgaccaggagagaatcctaagccacgaccaaaggaccgccagcttattcaggatcgtataaaggagctccgggaactcgtacctaatggggcaaaggtatcctcttcttctactcacgcatttcaaacgtgttttagtaatttagggttatttaatgttcaattgcacttgtttcaaacttcatacacttgtacgatgactgttagtctcacagcattttttgtcaacagtgtagtattgatgcattactggagaagaccattaagcacatgcttttcttgcaaagtgtgacaaagcatgcagataacctcaaggactcaaacaaatctgatgtatgcatgcacttattaattttgtcatctactccctccgtcccaggatataaggcgtaaccacctctggttcaaagaccaagaaatgcatttaattgtctctataccactgcatcgatatacgtatgcatagagagagcacgccttatattgtgggacaagaataaaaagtggttacgccttatatcttgggacggagggagtaatttgcagcctttttgagaaggtaatagttactaacctcatgcaatgcgttgtgtggctatgggtaaactccaaacagattcttggtggtgagaatggtccactcaaagactacttcgaaggtggtgcaacttgggccttggatgttggtagtcgatctatgacgtgcccaatcattgtcgaggatctcgagcggcctcgtcagatgcttgtggaggtaaatgattctgctattgctggttctttcaactctttttattgccaacgcatgcatatttctgatggtgttgcctctgtagatgctttgtgaggatagaggtatcttcttggagatagctgacttcattaaaggactaggattaaccatcttaaggggcgttatggaagcacgcaaaaataaaatctgggcacggttcactgttgaggtaagcagttcagtgcattatgaaggttctctaggttggttgagtactcagaaggctagagtagttttcccttatagcatgttatagtttgtgtgtgtgttatctttcatgagtagatttttttttgcttcctcaactcaactgtctgctttatggacgttcttgttttactttgtttattatgcaggccaacagaaatgtgactagaatggaaatcttcctttccctaatgcgcatgctggaaccgagttgtggagcaggagagaattctaataacaacataaaaatgcctcttgggattgtgcagtatcccataatccctgcgacaggtcatcttaggtgagccagccagcacaaagataacaggatgcatctttgaaatgctaagagcggggggaggtccacccacttctgccatgactagcattgccaacccaggacgagctggaatctcgtgacatgcggtgcatcgtccctgcagtgtgcattcggaaagcctaacagtagacgggaacatcgacatggatagttggttcgccggatgatcgacgttttgactgtaatcttagtttatgtttgttgctgatgctttagccttttgttagtctgcatattagtgagtgaattttgttatgttctgctgctgaatggaaattctgagttgaattgtaggccttgttttggtactgactcgaactcggaattctctgttttgaatggtcggggtagccctaaccgaaattcccaaatcaaacggaaaggagttcgggttaggtaacgctaaccctagtttcgaaattggaagaaagaagaacggaaagggattcggtacagaaacacaaaccccaatccccaaattagaagaaatggcaagaacagagaggcttcgggatagaaatcctaacccttagtttcaaattgaacaacactgagggctttaggtagaaccctaaattccaactcatcaagaatcggggagagggctcgagataatagatcccaagtcctaatcacagatcacagaacctcgagaagattagggttgaaaccctgatcaaaaccctctcaacaaaccgtgaatcggtcaaattagcactggctgagccacacagtagatagaaaattcagatcaaagaacacagaaacactaattcgtacaccagaggggattccccaaattggccatagatcg

SEQ ID NO: 8798 - DNA, 1460 bp, Zea mays
cctgaatcctctgttcgtcttggttcctcttcatctttcaattcagtggatgacaagttcccttattctgggatcttctcactaaccgataccgaccaacctttggatgcggttgtctccaatgtcaatcctggtggcaagcagatctctggtgacagtacttcttgcaagacttcagcggcagatattcctaccacttcgtattgtcgcttaaaagaaccaaagcagtccgaatcatcttcacctttgctaatcaagaatgagttagccgtttcaaattttgtcaaacagtcatctttccaagaaaaggcagaggatggctgtctttctcaaaataatgcaatacagaagtctcagatacgcctctggatagagaacggacagaacatgaaatgtgaaagtgcctcagcctcaaacagtaagggcgttgatatgtcaagcaaggcaagtcgaaagaggtctcgaccaggagagaatcctaagccacgaccaaaggaccgccagcttattcaggatcgtataaaggagctccgggaactcgtacctaatggggcaaagtgtagtattgatgcattactggagaagaccattaagcacatgcttttcttgcaaagtgtgacaaagcatgcagataacctcaaggactcaaacaaatctgatgattcttggtggtgagaatggtccattaaaagactacttcgaaggtggtgcgacttgggcctttgatgttggtagtcaatctatgacgtgtccaatcattgttgaggatcttgatcggcctcgtcagatgcttgtggagatgctttgtgaggatagaggtatcttcttggagatagctgactttattaaaggactcggattaaccatcttaaggggcgtcatggaagcacgcaaaaataaaatctgggcacggttcactgttgaggccaacagggatgtgactagaatggaaatcttcctttccctaatgcgcttgctggaaccgagttatgatggcggtggagcaggagagaatcctaataacaacataaaaatgccccttggaattgtgcagtatcccgttatccctgtgtcaggtcatcttaggtgagccagctgcccagccagcacaaagatcacaggacaggaggcatctttgaaatgctaagagcgggaggtcgacccacttctgccatgactagcattatcaacccaggacgagcgggaatctcgtggcatgcagtgcatcgtccctgcagtgtgcattcggaaagcctaacagtagaggggaatggagacatggatagttggttcggcgggtgatcattagacgatcgatgttttgactgtataatcttaactgttgctgatgcttttgccttttgttcttctgcatattagtgaattttgttatgttcttctgctgaatggaaattctgagttgaattgtagacctaaaaaaaaaaaactcgaggaggggc

SEQ ID NO: 8799 - DNA, 1964 bp, Zea mays
gactttttatcattcaagccaaacatcaataaggtccggatacaggttcgaatggctccaacatcaatcaaactggcgatccatacacgatgctagtgtctcgatctatcaatcagtacccaacaacatattcggatacatgtcagtacacacgaatatagatcccggtagcatcttatatccatgtaacgggtatgaaaaaaaaatattatccgcagccaaatatccgaattacccgtaatggcgcatctcacatcagacccaaacacccaagtccccaacggcccaaccccatccactcctttcctcccacccgccagccgtcacccgcgcgtgcagccagcttccctgctacccccgcgcgccgccagccgagcggacgccggccctgccccgcacgccggcacgcggcacgcgcagccagctgccccacacgacgccggccgccctcgcactccccaccgcgctacccggcagccccgcgctacccggtcctcgctcggcgtccttgattcccaccgcacggcggcccttcttctgccaccgcacaccgcgcaggagcactgcccttcgccccttgtttagctgcagcaggagcgccgcccagccggccaccaccaccgcagcttgagagttgagacctgcagttgacgaccagaggccagagggcgttgctgcgctgcttccgctcccctttttctgctgcgacgacggctggtcgagcgccgccacacttcgcagcttcgctggctcttcgcaggtgacgagcacccaccagacatggggcaaggtggacaagagaagtcgttcaatttccttcaagttttgctcgagggcagcatagctggaggaactgctggtgttgtggtggaaacagcactttacccgattgatactataaaaaccaggcttcaggctgctcgaggtggaagccggattgaatggaaaggcttgtattctggattagctggaaatctcactggcgtccttccggcctctgcgatatttgtcggggtgtatgagccaactaaaagaaaattactggaaacacttcctgaaaatctgagtgcagttgcccattttactgcaggggccattggaggtattgctgcttccctcgtccgtgtccctacagaggtggtcaaacaaaggatgcaaactggtcagttcaagtctgcacctgatgctgttcgtctcattgttgctaaagaaggatttaaaggactgtacgctggttatggttcctttctacttcgagatctaccatttgatgccatccagttctgcatttatgagcaacttcgaattggctacaaacttgtggcgaaaagggagttgaatgatccagagaatgcacttatcggtgcttttgctggcgccatcactggagctataacaaccccccttgatgtcatgaagacaagattgatggttcagggacaagggaaccaatacactggaattgtaagctgtgctcagacaatcctcagagaggaaggccctaaggcattcttgaagggcattgagccgcgagtgctgtggatcggcatcggtgggtccatcttctttggcgtgctggagaaaaccaagtcgatgctagccgagaggaggaaccgcgagcttcgggccgtcaaggacgaatgagtggagatcagctcttttttggcgttgagtccttaccctgaaacaaaatacacaattttacttgccgggggaggcagggggacaacctcgccggcccgtacctgtactccacggcgttcacgttatcacgtacgtagaaatcatgagcatgactgacggtttctacagattgaaaaccaaaacgtcttacatgcgctggcaaaaaaaaaaaaaaaatttacgttgggagtttttacaagtattttcagttcataacactatgctacatttggttgggggacaagtagtacaatgaacgcctcttttatctttccaatttt

SEQ ID NO: 8800 - DNA, 785 bp, Zea mays
  misc_feature (744)..(744): n is a, c, g, or t
ctgttttgttctccttctcattcgactctgatgatgacgagacggttatcgttccccttctggttcggtggagatcgccgccgttggcgtttcgatcgccatatttaaccaagtctccaaggtctgcatctaccctctcgttagcgtcacaacgtcgttcgtcgcggaggaagacgcgatcatcagtaaggccgtccgaggaaacagcagccaggaggaggacgtggagaaagcctcccacgtgggctttgatccggagaccagcaatctgcatgcatctggccctgcaggtatggcagaatgcgtgaactcgtgtatccctacggagtgcgcagcagatccctctggcaggcaagggcggtgcgagaagaggtacgtgccgtcggtcacgtcggcgctaatagtcggttccattctcggcctgcttcaggccgtcttcctggtcctttcggccagattcgtgctcaacatcatggggtgttaagtccggatccccgatgcaagggccctgcggtgcgctacctaacgataagggcccttggtgcccccgctgggctgctggctctggccatgcaaggggttttccgggggttcaaggacaccaagacaccgtcatggcaggcttccgtgggtgccgccgccagctctggctggccacgtctcttctcgccgatggattggccgtggcaggacaggcggtgcttgcaagcgcgttcgccaagaacgacagtaagaaggtcgcgngtgacgttctgcgtcacgcttggcggcgtccctggccgcta

SEQ ID NO: 8801 - DNA, 1832 bp, Zea mays
  misc_feature (1824)..(1824): n is a, c, g, or t
gacgagacggttatcgttccccttctggtcgaatcgttattatcagtgggctagaacatactaatgcgagtgctgtgctgctaaatctaatctgcgtgcgattggtcgatgggcaggttcggtggagatcgccgccgttggcgtttcgatcgccatatttaaccaagtctccaaggtctgcatctaccctctcgttagcgtcacaacgtcgttcgtcgcggaggaagacgcgatcatcagtaaggccgtccgaggaaacagcagccaggaggaggacgtggagaaagcctcccacgtgggctttgatccggagaccagcaatctgcatgcatctggccctgcaggtatggcagaatgcgtgaactcgtgtatccctacggagtgcgcagcagatccctctggcaggcaagggcggtgcgagaagaggtacgtgccgtcggtcacgtcggcgctaatagtcggttccattctcggcctgcttcaggccgtcttcctggtcctttcggccagattcgtgctcaacatcatgggtgttaagtccggatccccgatgcaagggcctgcggtgcgctacctaacgataaggtcccttggtgcccccgctgtgctgctgtctctggccatgcaaggggttttccgggggttcaaggacaccaagacaccgttatacgctactgtggttggcgacgcggcgaacatcatactggacccgattttgatgtttgtttgccatatgggcgtcactggtgcggctattgctcatgttgtttctcagtacatgataacgttgatactgctgtgccggctcgtccagcgagttcacgttatcccacccagcattaaatctctgaaatttgggaggtttcttggatgtggattcctgctgctcgcaagggttgtcgcggtgacgttctgcgtcacgctggcggcgtccctggccgctcgccatggacccaccgtcatggcaggcttccagatctgctgccagctctggctggccacgtctcttctcgccgatggattggccgtggcaggacaggcggtgcttgcaagcgcgttcgccaagaacgacagtaagaaggtcgctgccgcgacatcccgtgtgttgcagctgagcattgtcctgggcatgggtctcaccgtcgtgctgggacttgctatgaggttcggggctggcattttcacaagcgacgtgcccgtgatccaagtcattcacagaggcatcccgtttgtcgccgggacgcagaccatcaattccctggccttcgtgtttgatggcatcaactttggagcgtcagactacagatactctgcttactccatggttgctgttgcgtctgtgtcgataccatgcctgctgtacctttctgcgcataacggattcatcggtatatggatcgcattgacgatctacatgagtctgaggaccatagctagcacctggaggatgggggcagcgaggggaccatggacgtttctccggaactgatgatggattggcttggaactgatgatctgcggcacactgctgacagataaggctgcgccgcgctgcgcatgcgcctctcatgtagcatcagcgaagtatagtacgtgttctgctggtgtttaaagcttcggatatcggaggtagatgtagctatgggactatcccctcctgatcgtctgacttgtggccttgcgtggagagtttacgttgctccgttgatttatgttgtatcatgccaggatgtcagtttaataccatacatcggtaaagtgtctctctagaaaaaaaaaaaaaaaaaaaaaaaaaaaaaaaaaaaaaaaaaaaaaaaaaaaaanggggggcg

SEQ ID NO: 8802 - DNA, 4063 bp, Zea mays
  misc_feature (555)..(555): n is a, c, g, or t
tctagttgtctggtgacttggcgtgttcgggcggacatagacccccaagcaccaacaagattttgaggcctaaagccaaaaatatatcgcttgtggatttgatgcccaaaccatcaaaaccttttgcaaaactatatctgctatgcctccttctcgatctctacacgtgtcatcgtccatcctcatccgtccggtcaccacgtcatccggcgtctctatttgacttggtcaacacagactactactcgacatatatactcgcttgtcacttggtccaagcctctcgtttatccttcgtagcccactatacgtttgcacgacatgaccctacttaatcttctccatagctgttgaccatcttagtgctcctcacctgtacatcaatataagccatgagacatgttgcccacacactcacgtctatgtttagtttgaaactcaaacaaagcctgattatcttctgataatcactcatcattaatcgacacatgtggatacatatcaaccatgtgttcgcacaagttagtatgaacttaggggggggggggggggggncaacgatcttccaaatagctggaacataaaccggcttaactcatgcaagtgtgatcactgaggtctgagtacaaggactgaactcctaataggcttttattggtgaagaatttcaagatgttaggcgtcaagcagtggtcggggtctttattgtgatgctcatcaagtcaacaaacatccctcgaagattgaaaagaatatatgagattagagttataagcccaaatggtctcgtcgctattgaaaaatgatgcattcagctatctggactacaaggcccctcccacattatactcatcagaccctgagacacagcgctactaactaaaattaaaacgtaaacatgaggttctctgtatgacaacaatctgctatagtgctattcttttcatttgcagccacacatagaggccagagtagccaagctagagtgtccactccagagtccagaccagttatctttcccaaagcacaccttcctaccgttaccagaagaaaaccaccaatctttgtgcacgctgcagttgttcaatgcacttgggtttgtggagcagagtgaagaactgttccatgataaacacctacagctaaactgttgcataaaactctcacggtaccttgtgtggtgcggctggcctgtctctcttcacctcatccaggggcgaacaacgctgctctagcctcctaattcagaaaatccagtttggaaattcgaatattttccccgggaaattagcagcacaggataaagactcggacgatgatgcatcccaactcccaagtgttacctggagacgaagagcgtcactgctgttcaaatttctttgctctctcactctcactggcagatgaacaggaaacgcccatcgttgcccttttctttttccctgacggacagcaacgcttttcttgtcgccttcgcaggtcactgtcctgtcggaatcatgctgcagaacagcttcagatttagttgctagcatgagtgttagagcggcaccaagccccaatgtctctgtggatggatgatgccaaggcagcagctaccgtctcaaatttctgatcataaaacatacggccatctgtgctccagccgtactgtgcaagcaaacttgacatcctcctcatctcctccttgttgtcgttgcagtttcttcacgcagacaaatcggcaattaggtttgtctgctgaattatttgtgatagtagtagttttcgtacaaagaacagtcagctggtgatatttatgtgtccatgcatttcttaatctttattttatttcggtgatgtgtactgtgatgtgatgtctttataagtgcgcctattcacaacatctcctgtggctcgctgcaccatggagatggggcgatcgggaaatggtggccggaaggtggtcaccttcgacgacgccatcaccgggatgcgccggaacggttccctgtcctcgtaccttgacatgggccgggcggcgccgcggccgttgccggcgattagcatgggcagccgccggcgcacgtacgccgacggcgagctcgacgtgttctctgccgagcggtacttcaaaggcgcaatggacggcgacggggaccgcaaggaaggcgccagtgtcggtgtcatcacccccgcggtagcggtgcaggtggagcctttagtggagacggccgccgcgaggccgccgccggcgacggaggccgtggtaatgactaagccgtcttcgacgacggtgagcttcaccgcgagctcggcgttcagcgccaacagccagacggcgctcttcgggttcgggggcaggcttcgtccacggcgcagctcccgcgacagcaagtgctgcgtccaggtcggcgtgctcatgcgcacgtgctccgggaagcggtcggtgcgcgtggacggctgcgcggccaaagaagcccccaacgccgccgccgagccagcggcgaccgggatcgactggtacaaggagctgaggatgcgcaaggccgcgcttgggctctctggggctgccaataggcatgacctggtggcggccggtctcccgccaagcttgaatcttgggaccgcgaaagtggcagccatcgggagggaggttgttgggggccttcgtcctccgaaggtcctcaaaaacatgatttgacaatgctttccaagtgaattatatgaacaggtattttccggattcagaattatggatatggagcacgaccaggacgaaggctgagccaggcgaaggtcgaaggcagccgaagctgtacgcagggaagcttcggcgcgatagcacaagggggaaccgacttaaagataaaaagacttcggggtcctcaatagatttccataaaccgttaacaaatgtaatggacatggatgtaattttacgtgggctgcgtcccgcgtctataaatagatgaacagtactcccgtactgttcacgcggacttgtcattttgcttttggtgtcacgcttgtactctccaccttctctcaggaccgaaggtacatttgtaatttgggatcatttctgtttttccatgttaataaaatagaaatgattctttggtgatgcttatatcatatttcatgctttatgtgagtccttcgtcattacttgccatgtttacgaaggtatgtccctcatgaccttcgtccgagactcattatttcccgaggggatataatgcttcgaaggacgaaggaccctaacatttaacactttttatgttgccttgttcttaactcttagaatttgagaacaagtctccaacattggcgcccacctccggtgaactcacttccacttcaagtcttcgtgaacaccttcggaagctatagaccttcgctatggcgccgaagaaagcttcagcggctggggctgcagcattacaaccgctggaccacaaccaggagaccgtctctcttcgggaggccagaagccagaagagaaaagctgttagcccgacgcttgaggaagaagagctggaccaagaaatcagagagatggagatgctacatcaacaagtgcagaggaagaaggagaagatggcccgcctagctgagttgcaaaggcaaattgacgaagcttctgaggaagttcgccatctcactcacgatgagcagaacagaaggcctcagcagaaagaccttcatcaggagggcttcgtcaacgaagacgactggtatgataatttccatcagggaaattttgtttttgatgatgcttctcctctgtctgctgagctgcaggctactccttggcctccatcttataagccaccccagctccccatgtttgacggccactccgacccgaagcaattcttgatgagctacgaagcaacagtgtcttcgtacgggggcaacgctgcagtcatggcgaagtctttcgtcatggccgtcaggaatgttgctcagacctggtattcctcccttcggccaggaacgatcacttcatggcagaagctgaaggatatgttactgaccagctttcaaggatttcaaacgaagccggttacagctcaag

SEQ ID NO: 8803 - DNA, 1541 bp, Zea mays
cattgggatccctctctagtctctaccctttccgcctcggcacctccccacccctctcgccttcgcttcgtcgccacggcgagccccacgccgccgatcggggcgccgccagcggcggcggcgcccgatccgatggaagcggaggtggggccgccgaatccgccgcggccggagccagccggatcggagcccgacgacgcgcgcctctccccgcctcctcctgctcctgctccgccgcctccgcccccgcctcctcccgccgccgaggctgccgccgcgcccaccgcctccgcggccttctcgctgcaggctccagctccggcgccggcggaggcgaacggcagctccgacaggaagaggaggaggaaggcggaggacggggacgggtgcaagacctgcagctgcaagaagtccaggtgcctcaagctttactgtgtgtgctttgcttctgggttacattgtactgaatcatgtggatgtgaaccttgtcataacaagccacaattgcaaggtactctgcggatggcaacagttttacctctgaaacctgtccaaacattcgaagctggccaagatatagtggaacaagtcataaggtctcctatggatcttattagaagaaaatgcacatgcaagaagtcaggctgccttaagaagtactgcgactgctaccagggaggggcaggatgctccatcaactgtaaatgcgatgattgtagaaacccatttgggagaaaagtcggcgttattttggacggtaaaagcagtcttactgcacctatactgcacgaaagaaacgggactgaagttgactcaagcgacgaggaagacgacttctacatgaatcgacagctctccccaatacctccgtctccggtgtctagggagtcttcgttccaacaggagactctagtcggcgtcgaggtccagaccatgaacgggcacctgtaccccaaaccactgacccaggtgcgccccgagccgtcgtcctggcagctctcccggaggcccatcgaggaaccgcgcggggagatatggcgcttctcgaggaggccgagcgaggacgggacctctgatgccatggaagtgcacgccgtcgccccgagagagagcaagaaggcggcagaggtccgcggggacaggttcggcatcccgcggtgcatcgaggtgatgagcgccatggcggagctgtcgccggtggagaagtcgctggcgcccgacgtcttcttggacgcgagcaaccgggagatcttcctctcgctgagtgtagatattaggccaatctggctgaggcgcaagatgaagagccttgtctagctagacgctacaacagagatagcctgaggaattttcgtcgtcggcgtatacctaataaacccgtgctgtactgtagatatataatatatgtgccttagattcagagttgagttctggaccgatgggtgtaatataccttagtgctaatttatggtgcatgctgttatattggagttcttcctatggtaagttcgttatgatttcagccaaaaaaaaaaaaaaaa

SEQ ID NO: 8804 - DNA, 3363 bp, Zea mays
gttaaaaataataagggggttttttcaagcgtttaattccggtaccttcaagctgttgtacgcaaggctgtctgcgagatcctctttcgtcatggcacttaacccagcttcaagcttcggaaagcctatgcttctcgccatctctcgacagacagatagttccttattatccggtaggcagtataagaagtcatcttcatttgtcccattgaatattactgcccccttcggatatttcagctcctttgcataatggttggcctcataagcttcttcctcagatagctttttccccgaagcatgtcgtatgatgtaatcatgcatgccggcaggtgcttcggggatgacggtgcccgtttcttcaactaatattggttccggaatttttactgcttcggcttcaaaaggttgttctttgaagggctctgaaggcccagcttcagcttcagcttcagcttgttgagccgaagctccagtagaaccttcagcaacatcaacactcttttttgaaattgtacttgaagacttaatcgtctccaagacgtctagtacatttaccattcttttcctttttggggtcactaatggccccttttggtgttttgctgtcccaacgattgctgtaggactcaaaacttctaatgttttggagccctcagttgcttctcttacttcctcaattttttctgtgagcggcgcttcggttttctcttttgtttctgacaacaaaatgtctgattgttctgattcaatctttggtggcacttcggccgtttctgcgatctctggcaacaaggctgacttgattagtttttcagcttcggtggctgaagaagttttcccggtaaactccggcaccgaagctggttcaatatggcgtggtcgatgtgtgaagaccttcaacctttttccttttggttctggctcgctaggagcggtttcagcttcttctttttcagaggttatatttttccttttttgccttcggatgggataacaataatcagggtagaagaacccgattgcatcaaacactcggttcagtctcttcttctttcggcctccgaaggctgctgatagtgcagtattttcagccttcgagtatgccccaagtaattcatcacttaatgtttcaatgcttttcagccagtcatcatcaggttcaataaatttatctgcatatttgaatgtgtattttaatctgactagtccgccttcgtcggactctttgatggtttctttcggcatttcccacttttctgcaagtggccataccctgaaggcaatgtgctcctggaccaagtcccttgtcccaatgaaggagcagactgcgccgaaggctctttggcattcttcggctgcctcatccatttcaaccttcggccttcgaagtccgaagcgttgccaaattgggtacataatgatacttttgacattattttgcgctgttagatcatttttcacataaaaccattcagacatccaggctccgggccacctcttccgaaaggttggcacagggtagcttgacccggagcgggcgccgaagctgtagcacccaaagttgttgtggtattgctcctttccccagggctttgtctcatacaataactcgtgtatgttgcagaagcttttagcgtttggctccaaaccttggcttctcacagcccagacaaaaatccccattcttataatagcttcgggagtgagttgatgagggtagatttggaatgttttcagtacctcaacaacaaaattgctcagggggaatcgaagcccagccttgaggaagcttcggaaaatcacaacttcatcctcttcaggggtggcacgaggcttttccccggcatcagctctcacaatagatatgtctcggaagtatcgccccctcatattatcaatgtgactctgcttgatggttgttttcccaaaaactgagtgacttggtcgccacggtcgatcttcggcctcttccccatcactttctacatcatagctgtcgctgtcatcagtatcttcggacaaaccttcgagaatctccttcgtgattttctctgtattagtctctgccatcgctatcaggaaccccagattcttctcctcctcgagactcagcttcgtctcagcagggatcttcttgtcttcagacatcttcggaaacactaaaaatttgttcccgaggccgaagcttcgaaatcaaaaagaccagcaaatctcaatgagcaagagctaaaaatttttagtgggccgaagcaaaaggcaagcgtgtgtaccaaatgaattcacgatgtgttcttatttatacgcctagggcgttgaaagttaaaaggccccgcttgtcagtgaatgttgctattctagcaaagggaaggtgttttttcggaccttcggctcaaggccttcgtccatatcgcaatctgaatttattatttacaaattaatattgcgaggggctactgttgggggccttcgtcctccgaaggtcctcaaaaacatgatttgacaatgttttccaagtgaattatatgaacaggtattttcggattcagaattatggatatggagcacgaccaggacgaaggctgagccagacgaaggtcgggggcagccgaagctgtacgcagggaagcttcggcgcgatggcacaagggggaaccgaccttaagatgaaaagacttcggggtcctcaatagatttccataaaccgttaacaaatgtaatggacatggatgtaattttacgtgggctgcgtcccgcgtctataaatagatgaacagtactcccgtactgttcacgctgactttacatttgcttttgcgtcacgcctgtactttttaccttctctcaggaccgaaggtacatttgtaatttgaaatcatttctattttcccatgttaataaaatagaaatgattccatgatgatgcttatattatatctcatgctttatatgagtctttcgttattacctattatatccaccaaggtatgtctcttatgaccttcggccgaaactcattatttcccgaagggacataatgcttcgaaggacgaaggactttaacacttaacacttttcatgttgccttgttcttaactcttagcatttgagaacaagtcaccaacacttatatttgttacttttaccttctccttgaaatttgcacctttcttattctgctgtttgatatacgcaggatgacgaagctggagaatgacgaagttgaagtttgacgaagcttagcctgaagcttgatagttgtttacaatatactttcctgcaaaaattctagagaaacttttgtaatatagttatggaacaacttatgtaaatttgtacataccttgtaatatatttgtttct

SEQ ID NO: 8805 - DNA, 4492 bp, Zea mays
gtagttaatgatgaagttggcgattctttgcatcgaagcatccagccgaggaaatcaacggttacaattggatgcgtggcccgccgccggccgatcttagtcgcacaacgcgcctccctgctccagttttccattccttgcgcccccttcagatccgatctgatccacgccggcgagacaccggaggaccgccatgacgctcagcctccgtcgcaagcagctcgatgttatcgtgcggatgctgcacctgaaccagcagcagttgccgaacggcggcgagggacagggagaggacgatgcgtacaagatcctggttatggatccgccctgtatctccatcctctcgcctgtgctcaagctcggcgacctccgccaccaaggtgtcaccctcaccctcgccatcgatcgtccgcggcaggcggtgcccgatgcgccggccgtctacttcgtccggcccacccccgggaacgtggaccgagtagcggccgacgccgccgcggggctctacgggtctttccacgtcaacttctccacctccgtcccgcgacccctgctggagcgcctcgcaaccgcctgcgccgccgctccgcccgcgtgtgcgggccgcgtggcgcgcgttgctgaccagtacatcgacttcgtctgcatcgaggatgacctcttttcgctagcgcagccccgggcctacgtcgcactcaacgaccccgccgctgccgacgccgacatcactgccctcgtcgacgccgtcgcgctgggcctcttctgcgtagtcgccacgctcggtgttgtgcctgtcatcagttgtgcgcgcggcgggccagcggagatggtggccggcgccctcgacgcccggctccgcgatcacctactcgccaagcccaacctcttcacggaggctgcatctgccgctgtcacgtcattccagcgccctgtgctgtgcctcttcgacaggaatttcgagctgtctgtaggggtgcagcacgactggagctaccgcccattggtgcacgacgtgcttggcttgaagcagaacaagctgaagttgccggcagagaagtacgaattggatgactctgataaattctgggtggcaaacagctggtctccattccccaaagttgctgaggaaatcgaagcgcagcttgccaagtacaagcaggatgtggatgaggtgaaccagcatactggtggtggcaaggttggggttgagtttgatggtactgatctaattggcaacactaagcatctcatgaatgcggtgaactcactgccagaactgacagagcggaagaatatgattgataagcacaccaatattgcaacatctttgcttgggcatatcaaggagaggtctctggatggatactgcagctgtgaaaatgatatgcttgtgagtggcactgtcgaccggaatacactgctgagtctcatcagagggaagggtaccaaggaagataagcttcggctagctgtgacctacctgctgtcctttgcgacaccaccatcatctgagctggagcaggttgaggccgctctgcgggaatcggaagttgacatgtctgcatttcagtatgtgaagaggataaaggcattattgaatacccaatttgcagctgcctcaggcacagcaactaagagcaacatcgtcgattgggcagagaagctgtatgggcagtccattggcgctgtgaagaatctcttgtcagatagtaggcagctggccttgacaagaacagttgaagctcttatggaagggaaaccaaacccagaggtggatgactaccttttgtttgatccacgggctcctaggtcaggaactagtgggcagtttaaaggacccttcagagaagccgttgttttcatgatcggtggtggaaattacattgagtacaagagcttgatagagctaaagcaacgctcacagccttccaaacatgttatatatggtgcaacagaaattcttagtggggccgagtttattcaccaactggcagaattggggcagaaagcagggttgggtggtggcagcagcaacataccaccaggttcagcacaataggtaggatgctcttacaagaccttttaatgttaaggagtgattcgagcttcagggactacggtaaatacgctcataccccacattttattttaaggagcgttccaggctgcatagattagtgatatcaaatttcatgaaaagtttatgccccttcgattgattagttgtcaatacatagctttgttgtttcaatttgggttttgatattgcccatgtatgactatttttacttttctgtactctatttccttgcccccctccctttattttactaagaaatttttcttggaattctgtttgcacactcaaagaaatccgttcatgaatatttgtaacagaaacctagttctgatgtttggataatttgattttggttgaaatcttcatagttccaggctgttacatcttttacttgtagtgcatggccatatgtgggttcttgaaaccccatatatatgactaaccatctcaataatatgtatgcagggtggcgtaatatataaattcattttgtgtgttggggatataagtttattacttgttttatctacaatagttggatacttggattgggaaaatgcattgtagcaatggcaagctgaaggtttgtgccactggttctcaaaagttgatttattcatgcgaatggaatctaaacatcttttgtactgaagcgctgcgattaaataaaggctatcaatagttaatagccccggtggtacatatggtatagaactatagacagtgtacaaccttaggctcactccaacgatccactcgatttatcactctccctctatattgcgtgtacatactcccaccattgctccaacgcttcaccctcttcctctccttgttttccgcgtgtcagaaatctccgtgtgtgaagagggggagcactaatcctcccctcttcactaatcaatgatattcaatgagaaattaattaattttaattttaattatcaaataacaatgtatatcacggtactacaaatagtcgtttttttgtatgctcaaaccttgtattattgatttcttagagggctgtagaccttacttgagtgtggattcaactgctttgaacgacaaatggaatggtcacctaccgtctgctacaaccgttgatggacacaattggatgttccttgttgcttttggattgtttgagtccaaaacggaggacaatcggcattggttcatgcagcagttacgcaagaccattggggatttttctttttgctagcagtttgttctgatgcttgtaaagacttaaccaatgcaattatgtcaaatagtccacttaaagtataaagggagctaaataggggattgattggagaggacctgaaatagggggagaaatgagagagggggaggtatttaaaaatgcatacaaattacaaataaggggatatgagagggggaatggttagagtgagcctaagtcgatgcactgtgatggcggcaacttcgtttcctgctatgttgcttgacttcgctccgcatgccataatcccaggttcagctaggcctgacgttgaagcttagggagtcatagctgggccagaccttgaagaacaggaagtcattgtacaacgacaagaataatgacccatcgcacgatatatggtcgggactagcatgtcgttccacaccttagaggaacttcaacaactcctcaaattatagctcccaaaacaagggagtcaggatctccttaaaagtaataaatccaataaaaaagacaatgtttcaataactccctataatttccccaaaattcctttgaagtctgttgttgtgggcctcatcggatttctgttttaccgatcttcctttggcgcaaaatgtcgaacatcatgactgcgtccggatgcaaagcgccgagtcgccgacctcatctgcaccatcgtgcagcgtggcgtgaggtgggaggggcagcccttaagcatccgcgggccccagatagctgtgagctgcaagacacggttatagagcagcccatgcgtgagctcaggttcgctccatggaccaagcgagcaggaggcgccttccatggaccaagttggggactaatgggaagcgaggagactcatggaccatggatcaagtggagctagaagcatctagggcgttgggagcattcaaagcaagcttggatactcatgggaattctagcgcaggaaggaagattgggaggagagacggctgcaagaatttacgcaggcgagcagcttcttttcgcatgcggaataaaacggtggttgctgttggagaatagttttttcacttttcctaaattaaagattgagattagaattattggtatccgttatagatgatcttaggccatctccaacaatttctctatatttatcactctaattttactttctattatattttactatatctctctaaaagatatcc

SEQ ID NO: 8806 - DNA, 4725 bp, Zea mays
gcttgcatgcctgcagggcggcgctcaggtccagtgttgctggccgcttggatgattgacttccagctcagcagtcgcagctgcgagggaggttgcgacgactagtagtttattacacattcgtgccccatacatgtaatgtaatgtaatgtgtgcgtggcacaaactactctgctcggtgggaggaatgcatgcatgcatgtgacggcgagcagcagagcagctatactgttccaaaactactctgctcggtcgtggcaaaagtacaggatttttgaaggttgattgagcttccaacacggcataatctacatattagccgtggcgtatttggatagaaccagtggcccgctggttagtactccctccgtccacaacaacctgtcaattttagtttatcctaattcaatcactgtcaactttgaccagttatttttagatttttcataagattttataacataaaagtaaaaaaattactagattcatcgtgacttaaacttttataataactttttttagtttaaaataatttagtcttatatatattgttggttaaagtttaaatattttaatttaggataaatcttactccgtaaaagacaaaactcacgtgaacagaccagtaacaatctgtctatgtaatgtactaccagagtagccagagacatgcctatgcatgcagcagctagcaggtgcatcgatttcagcttcggtaccacccgcccggccgacgaagaagattctttgcaggatggacggcaaaatggctagctggacaggacggaaggcggcaggttcatgtatccaaggacgaacggcccccgccgggccaaccgggcgtgcgcgtcctcgccgtgcgtcgcgaacgccttggcatcgcatgattgcaggcggagaaaaaccgacgctgcgggtcgggtcgttttactctaggacacgcggccgctggtccagggcctgacgacgctcactgcatgcgtacgtgctggggcacgaggcaggcaggcagccaacaacggccgccgggccggcttggggctacagaagcgtcgtcgtacgctgatgcgatctgctgcgcaaatctatgcctcccgtaccgtattcttgctaaagattggcaagagtaccactcgcatcctcaaaaaaatacattgatcgtcagccgtgtacggattacttacgtacattgacagactgaaagttcattaggtgttccgtccgtcagcaaagaagctagcatcgctgaacctttttttttcaagtgtacaattcacttggtataatgcactaagcacgataaaataccgttgcgataaggaaaacaaaattaaattaaaatgcgcacagcaccattctcgacggaaaatgtaataaagaactgagagcatcattgagcaagcggcgatccatatgtcactagactgactaggcaacaaggcaagagcaacgtattctatttcagcagggacgtagaccacgtaactgacgctactggaaataatcaatactccttgttcttgaggaggcggatatggattggactacacattgaatgaataattatggagatgctgcccccagcctaatcgcctacagtagtacgcacgtagctagcagctggacgaacgttatagtagtagatagactagtagtagtggctaacgcattcaaaaatccggtaggctcaacacaattaatcgaggttacattagcacgacaagattttttttttaaaaaaaaaccctgtgatgttacgtttgttgttcattttaatacggaaagccgttgcgtgttcattgaatccgcccaacaacatgctcagtcattcagtgtaatctgtaatatctcgtcaacaagtgctctaacagtcatcaaaccgatcagttaccggtttgattagctagcctttccacaggtacccgtcattgctttgaaagaaatatatttaaaaaaaattctggtgcatccatggacacttgttcctcttcatcccagaggagacacctgttggcagctgcaggtcgaccctaccggctgaagtatgcagcaaaaacaaaactatgtatatatatattttaaaaatagtatagtatatgccgatatttttgcggaaaggctatgctgaaataattcgttaaaaaaacttttctgatgagatccaacatccaaatcaccagtgcgcttctaaattaaacggtatctattgtgtcttcttgttgtgtcgcacacgctgttcacgcaggccatagaacaaatctctagctacacctttatcggatacatctgtttctgcttccgacagccacaaatacctggccagagaatatccaaaacagtagtggcaaaagaaggcagactaccggtccaggtgcatgcatccagcgcctcatcgtgtcctatataaactgcccaaggttgttcggtggtgtcacagcaaaggcggcactgcccaaaccacctctttggccacacacacgcatactgccaccgctactgcttcatcagcagctagcagcaagcggtcggtggtgcagcgctgcgccgggcaatcgaacacatatggctcagatgatctccaccatgcccatgctggacgccgccccggcctcgtcagccattatgcccaagctgccgcccgccgcctgcctggacgcgccgccggcctcgggcatcaccgtcgtgtcgaggcagcacgttcgcccggacgccgcgtcggcggtcggtgacctcacgctgtccgtctccgacctgcccatgctgtcgtgccactacatccagaaggggctcttcttcccggcacccgacctgcccatgtcctcggtcgtgtcgctgctcctgtcctcgctgtcgcgggcgctcgccgtcgtcccggccctcgccggccgcttcgtcacgctgcccgacgaccgcatcgtcatccgctgcaacgacgcgggcgtggacttcctccacgccgtcgcacccggcctgtcgcttgacgactttctcgtccctgacgccgacgtgccgaccaagcacacaaaggacctgttccccatggaccggaccgtgagctacgaggggcaccgtcgcccgctcacgtcgttccaggtcaccgcactcggagacggcaccgtctttatcggcatcgtcgccaaccacgccgtcgtggacggcacctctttttggcaattcttcaatacctgggcggccatctgccgcggcgagtcccccaaactgccggacttccgccgaagcttcttcggcgagtccactgccgtcctccgcttccccggcggcgtcggcccgtccgtgaccttcgacgtggacgcgcctctccgtgagcgcgtctttcacttcagcgctgacgcaattcgcgagctgaaagcgattgccaaccgccgtccgagcggtggccaagacgccgaggtttacggcaagatggcgcaggaccccaagaatccccaagtgcgcggggagatctcgtcgttccagtcactgtgcgcgcagatatggctctcggtcacgcgtgcccggaaacgcctggcgcccgacgcgacgacgacgttccgaatggcggtgaactgccggcaccggctgcagccggccatctcccctgtctactttggcaacgccatccagagcgctgcgacgatggcgacagtctccgagctggctcgcagcgatctaaggtgggcggcaggcaagctgaacgcgacccttgcggcctatggcgacggcacgatccggcgcgcggcggccgcgtggcaggccgcaccccggtgcttcccgctgggcaaccccgacggctcggtgatcacgatggggagctccaaccggttcccgatgtacgtgggcaacgatttcggctggggccggcccctcgctgtgcggagcgggcgcgccaacaagttcgacggcaagatgtcggcgttcccgggacgcgccggggacggcagcgtggacatcgaggtgtgcctgcctccggagaccatggcggcgctgctccacgacgccgagttcatgcactacgtgtcgtgcccgtcgcatctgttgtgatgtactgcagccgtgcgggcgggcgggcgcgagtgggggccatcggccgtgacatgccatcaggcacctgttggattgctcggtcgtccactcgtccttgcctttcgggattcaggaatactagctagttggtgtcaagacattgtatctgtctcgctttttcggagtgctgcgtgtaatcgtgtgttagcagctactagtagtagtacttggaaattggataaaaaaaaaaaaaaaacagccatcaaacgatgcaacagcggggagaatatgaaccctgtagcaagagtcagaaacaagtttctgaaaaatattggcacaagagagcttgacatctccagagccttcaactccataaattagacatatctccttatgtgttaagagccctcggtttctcccaaaggtggcgtgattggatcgctataattctgggttcatcttcttccaaaataataatcaacggagagcaaacaaacagaattaaccacaagtgtggcgtacgacaaggggatcctctttctccctttctattcattttagcaatggatcctctccagcggatgatcgaaaaggcggcacaggccgggctattgggaagtgtcctgccgaaaggggcaaagcttcgttgttccctgtatgcagatgatgtcggtgtgttcgtgagagcagacaattcggacc

SEQ ID NO: 8807 - DNA, 2180 bp, Zea mays
tacactgacaaaaatctctatataatcacagtgtccggcatcttggccccttccccacccttcgccctctcaaggaggccggccacgcctcacactcccgcccgcctccggcgattcatccacccaataaagtatccaaccctaacgatccggatcgccttaccccgcgtcatccacgcgaattgtttcgattatcctcggatttccccgtttttttgtgggtttcctatcttcttcgatcggagtgctagggtttgggcgcgctcggtgggcggcgtactccagggtcatcgttagttggacgggctagggtgctttctcaccgggggaagggaagcgaatccaaacaatggagaagaagaaggtggcgatcccgctggtgtgccacggtcactcgcggccggtggtggatctcttctacagccccgtcacacccgatggttacttcctcatcagcgccagcaaggacacaaatccaatgcttcgtaatggtgagactggtgactggattgggacttttcaaggtcataaaggagctgtttggagctgttgccttgacaggaatgctctgagggctgcatctgcttctgctgacttctcggctaaagtatgggatgcacttactggtgatgaactacattcatttgaacataagcatatagttcgggcatgtgctttctctgaggacacccaccttttactcactggaggcatggaaaagactttgcgtgtgtatgatattaatcgtcctgatgcagctccaagagagcttgacaaatcacctggttctgtccgaactgctgcctggcttcatagtgaccaaactatattgagttcctgcactgacatgggtggagtaaggctatgggatgtgagaacaggtaaaattgtccaaactcttgaaaccaaggcttctattactagtgcagaagtaagccaggatggcaggttcatcactacagcagatggctcaagtgtaaaattttgggacgcgaatcacttcggccttgtgaaaagctatgatatgccgtgcaatgtggagtcagcttcacttgaacccaagtctgggagtaaatttgtagctggaggagaagatttgtgggttcatgtattcgatttcttcactggtgaagaaatagcttgtaacaaagggcatcatggaccggtccactgtgtccggtttgcacctggtggtgaatcatacgcatcgggttcagaagatggcaccattaggatctggcagcttagcccagttaatgctgatgacgacgaggcggccaatgcaaatggcaaggcaaatgctgcagtgaacgaggttacaaccaagctcgagggcggcttccacattcccaaggagggacaggctggggggtaggacctcatgtgctttgttgtggtgcttgtggttcttattgcgaggagattgcccatagggctgccacggtcattcagtttctccctgcagagccatcaacacctgtttgcgatccaagggtatcatggcttcaagagtcatcaccctggtaactggggaaaaaccatacccctcgtaagcatggtggtgggtttttggatggggccttcgctttgatagaacatagcaactgtagtgtcaaaaataaacaagagaatacaacttgggtaggtatcgtgtcttcggtcattaaagtgaagtattctgtatcgccgccagtaatttttgtggcttttgatgttggaacgccgattttcaaatcaaagctgacgaccacttcttgatcatgaggcaatatagatagcgtcatgcccatatcaaatgacagatttctctgctctactggacatgcttttttggtggcatccgcggacacgatacgtgaaatttagttttatgttattgtacacctacccgaaattcatgattggtttaggaatcccataaagtcgacctttcccagaggacatctgggatataagggcactgacgcatgttgcgttttgcagcaatctcgtcactgctttcgcaaaagggaatcgcgtcacatgcccctccttgcgacctgagacttggctgattgcatctgatcggccttcctaaaatgttaccatctcatgataggcaccaccgttactgttactaagtcctcgtttaataattgtttcgtccagcaaagagacgggaatttctgctgcaggtcgac

SEQ ID NO: 8808 - DNA, 1777 bp, Zea mays
tcgagcgcccccctgccccacactttagcccaaggaggccggcctcgcctcgcctcgcttcatacgcccgcccgcccctgccgatccatccacctaataaagcgcctgtacagatccaacccttaggatccggatcgccttacccccccgcgacgatttgcgcgattcgattcgattatcctccgattttccccggtttttgtaggtttcctctctttttcgatcggtgtgctagggtttggacgcgcggaggcgtcgcattccagggtaatcattggttcgacgggctagggtgctttctcacccggggaacggaagcgaatccagacgatggagaagaagaaggtggcgataccgctggtgtgccacggccactcgcggccggtggtggacctcttctacagccccgtcacacccgatggctacttcctcatcagcgccagcaaggatacaaatccaatgcttcgtaatggtgagactggcgactggattgggacttttcaaggtcataaaggagctgtttggagctgttgccttgacaggaatgctctgagggctgcatctgcttctgctgacttttcagctaaagtatgggatgcacttactggggatgagctacattcatttgaacacaagcatatagttcgggcatgtgccttctctgaggatacacaccttttactcactggaggcatggaaaagattttgcgtgtgtatgatatgaatcgtcctgatgcagctccaagagagcttgacaaatcacctggttccgttcgaactgctgcttggcttcatagtgaccaaactatattgagttcctgcactgacatgggtggagtaaggctgtgggatgtgagaactggaaaaattgtccaaactcttgaaaccaaggcttctgtcactagtgcagaagtaagccaggatggcaggttcatcactactgctgatggctcaagtgtaaaattctgggacgcgaatcactttggccttgttaaaagctatgatatgccatgcaatgtggaatcggcttcacttgaacctaagtctgggagtaaatttgtcgctggaggagaagatttatgggttcatgtatttgatttcttcactggtgaagaaatagcttgtaacaaaggacatcatggtccagtccactgtgtccggtttgcaccttgtggtgaatcatacgcatcgggttcagaagatggcaccattcggatctggcagcttagcccggctaatgctgatgacaatgaggtggccaatgcaaatggcaagacaactgctggggtaaacgaagttacaaccaagatcgaaggcttccacattcccaaggaggggcagaccgaggggtaggatctcatgtgttttgtggtgcttgtggttcttattgcgaggagattgccaccagagctgcagtggtcattcagtttccctctgcggagtcatcatgtctgcgatccaagggtatcctggcttcatgagtcatcatccactggggaaaaacaagcaagcaaatggtggtgggtttttggatggggccctcgctttgatagaacatagcaattgtagcgtcaaaaataaacaatagttgggtagtttaggtaccgtgtttgcgttcattaaagtgaagtattctgtatcccctaaaaaaaacacttgaggccttcatcgttggaacaccgaccttcaaagctgtagaccacttcttgatcctgaggtagttctggagcgtcatgcctatcaaatgacagatttctgtccaaaaaaaaaaaaaaaa

SEQ ID NO: 8809 - DNA, 1978 bp, Zea mays
tgggtacctcgaggccggccgggcccccctgccccacactttagcccaaggaggccggcctcgcctcgcctcgcctcgcttcatacgcccgcccgcccctgccgatccatccacccaataaagcgcctgtacagatccaacccttaggatccggatcgccttacccccccgcgacgatttgcgcgattcgattcgattcgattcgattatcctccgattttccccgttttttgtaggtttcctctctttttcgatcggtgtgctagggtttgggcgcgcggaggcgtcgcattccagggtaatcattggttcgacgggctagggtgctttctcacccggggaacggaagcgaatccagacgatggagaagaagaaggtggcgataccgctggtgtgccacggccactcgcggccggtggtggacctcttctacagccccgtcacacccgatggctacttcctcatcagcgccagcaaggatacaaatccaatgcttcgtaatggtgagactggcgactggattgggacttttcaaggtcataaaggagctgtttggagctgttgccttgacaggaatgctctgagggctgcatctgcttctgctgacttttcagctaaagtatgggatgcacttactggggatgagctacattcatttgaacacaagcatatagttcgggcatgtgccttctctgaggatacacaccttttactcactggaggcatggaaaagattttgcgtgtgtatgatatgaatcgtcctgatgcagctccaagagagcttgacaaatcacctggttccgtccgaactgctgcttggcttcatagtgaccaaactatattgagttcctgcactgacatgggtggagtaaggctgtgggatgttagaactggaaaaattgtccaaactcttgaaaccaaggcttctgtcactagtgcagaagtaagccaggatggcaggttcatcactactgctgatggctcaagtgtaaaattctgggacgcgaatcactttggccttgttaaaagctatgatatgccatgcaatgtggaatcggcttcacttgaaccctaagtctgggagtaaatttgtcgctggaggagaagatttatgggttcatgtatttgatttcttcactggtgaagaaatagcttgtaacaaaggacatcatggtccagtccactgtgtccggtttgcaccttgtggtgaatcatacgcatcgggttcagaagatggcaccattcggatctggcagcttagcccggctaatgctgatgacaatgaggtggccaatgcaaatggcaagacaactgctggggtaaacgaagttacaaccaagatcgaaggcttccacattcccaaggaggggcagaccgaggggtaggatctcatgtgttttgtggtgcttgtggttcttattgcgaggagattgccatcagagctgcagtggtcattcagtttccctctgcggagtcatcatgtctgcgatccaagggtatcctggcttcatgagtcatcatcagcactggggaaaaacaagcaagcaaatggtggtgggtttttggatggggccctcgctttgatagaacatagcaattgtagcgtcaaaaataaacaagagttgggtagtttaggtaccgtgtttgcgttcattaaagtgaagtattctgtatcaccacaggtaaccttgattgtggtgactatttttttttggtttgcctcaccgtgttccagtcccctaaaaaaatacttgaggccttcatcgttggaacaccgaccttcaaagctgtagaccacttcttgatcctgaggtagttctggagcgtcatgcctatcaaatgacagatttctgttcacatggcttgagctctctagacatgctcttgtggtggctctctactaaacatgctcttgtggttgcttccccggtattgaagaccaggacccgccgatacccgaatcatgtgttattgtgtt

SEQ ID NO: 8810 - DNA, 1681 bp, Zea mays
  misc_feature (516)..(516): n is a, c, g, or t
  misc_feature (637)..(638): n is a, c, g, or t
  misc_feature (802)..(802): n is a, c, g, or t
gatcgccttacccccccgcgacgatttgcgcgattcgattcgattatcctccgattttccccggtttttgtaggtttcctctctttttcgatcggtgtgctagggtttggacgcgcggaggcgtcgcattccagggtaatcattggttcgacgggctagggtgctttctcacccggggaacggaagcgaatccagacgatggagaagaagaaggtggcgataccgctggtgtgccacggccactcgcggccggtggtggacctcttctacagccccgtcacacccgatggctacttcctcatcagcgccagcaaggatacaaatccaatgcttcgtaatggtgagactggcgactggattgggacttttcaaggtcataaaggagctgtttggagctgttgccttgacaggaatgctctgagggctgcatctgcttctgctgacttttcagctaaagtatgggatgcacttactggggatgagctacattcatttgaacacaagcatatagttcgnggcgtgtgccttctctgaggatacacaccttttactcactggaggcatggaaaagattttgcgtgtgtatgatatgaatcgtcctgatgcagctccaagagagcttgacaaatcacctggnntccgttcgaactgctgcttggcttcatagtgaccaaactatatttgagttcctgcactgacatgggtgggagtaagggctgtggggggatgtgagaacctgggaaaaaatgtccaaaactcttgaaaccaagggcttctgtcactagtggcagaagttagccangatgggcaggttcatcactactgctgatggctcaagtgtaaaattctgggacgcgaatcactttggccttgttaaaagctatgatatgccatgcaatgtggaatcggcttcacttgaacctaagtctgggagtaaatttgtcgctggaggagaagatttatgggttcatgtatttgatttcttcactggtgaagaaatagcttgtaacaaaggacatcatggtccagtccactgtgtccggtttgcaccttgtggtgaatcatacgcatcgggttcagaagatggcaccattcggatctggcagcttagcccggctaatgctgatgacaatgaggtggccaatgcaaatggcaagacaactgctggggtaaacgaagttacaaccaagatcgaaggcttccccattcccaaggaggggcagaccgaggggtaggatctcatgtgttttgtggggcttgtggttcttatcgcgaggagattgccatcagagctgcagtggtcattcagtggggattgccaatcatgtctgcgatccaagggtatcctggcttcatgagtcatcatcccctggggaaaaacaagcaagcaaatggtggtgggtttttggatggggccctcgctttgatagaacatagcaattgtagcgtcaaaaataaacaagagttgggtagtttaggtaccgtgtttgcgttcattaaagtgaagtattttgtatccccccaggtaaccttgattgtggtgactagttttttttttggtttgcctcaccgtgttccagtcccctaaaaaatacttgaggccttcatcgttggaacaccgaccttcaaagctgtagacccctttttgatcctgaggtagttttggagcgtcatgcctatc

SEQ ID NO: 8811 - DNA, 1802 bp, Zea mays
tttttttttttttttttggaaacactgacataatatacatgtacaaacattattccaagttatatagccatcttacataaagacttgttacttgtctagaaaagattgcaaccttgcatatacgacacgcctatagaacgtccttgttctgataaacaacacaaatgccacagcggacccaaacatacagacaccggccatgatcatgaaagagagtgcaaagcattgcttacctacacaagagtgctcgtccggtggcgattcaatatcgtatatgtagcccacgatgcgcaccgagaggatgtaggacccaacagggcttgcaacagccaccatgttgaatatggtgccgaaatggctcagcccaaagatctcagatgttatgctcggcatcagggcccactgacacccatagcacatgccgatgagcaccgacccaatgtagagcgacgcagggagaccggaggagatgatggcatggccgacgctcatgaccagcagcgtgatgcttataaagaatggcctgccaactcctcgcaggcgaaggaaatggtcggatatgaagcctgcaccaaaccgccctgaaaagttccatatgctccatagagacacgagtgtgctggtctccttggtcgtgtagccaagggagccgccgatctggctgatattgttcaccgtggccagacctgatcccattccacaagccattgccaggaagagcaaccagaagttgagcttgcacatggcctgtaatacgttcaggttttctttgcctgaagacaggtcttggttagatcccccaagcgcagtagtgcttgagctagcattttcagaatcctctgtgacctctttgcggagcagtccagccctttgttctgagattgatccttgatgagctattgattctggcgtctgggcctttgcagccacagctattggagacatcactagtagcaggagtaccacgaaacaaacgctctgcacagctgagcttattgggaaaacttgaccatagattatgagaatcatcaagtatccagcaacagtaacagcaatgagggagaaagcgtctaggaatttcttctcataccgttcatgtggattgtggacatccacaaaatacatgagcaccaaggtgacggacgtgggtaaaactgccagcatcagtatgaaagagctgggatcaatgccaagagtgcggtaaatttcgacaagtattgccccacttaggcctagaaaacccttcatgatgccgatgacagtgcctcgtcggtcggggaagttctcgacggcggagacaacatcggcggtgttgaagaaggtctgcgcctgcgcggcgagcagcatgtagaggcagacgagcgggagcggcgcgggcgcgacccccgcgacggctagccacatggggaggtagcccgcggcgcagagcagggagccggcgaggaggacaatccaggggcgcctgcggccccccggcgcccaagcgacgaggaagcccgagaggaccccggcgttggcgccgacgtccttgaagaaggcgacggcgtcgagcgcggactggtcgtagcgctgcgaggccttgagcgtctgagagtagacgccgaagcagtaggagctccccgcgcagcattggatgagcgcgctggcggctagcgccgaccaccgcgtccgcgcccgtggcatcggcatcggcatcggcatcggcatcggcatcggcgaggaaggggaattggacgccgccgaaccgtggtttgctgcgactctggcatcccatatgttcgcagcaataaataattaaatat

SEQ ID NO: 8812 - DNA, 2002 bp, Zea mays
agagattgtggaagacctgggcccctcctaaatgcaagtttttcctttggttggcaataagaaacaaatgttggacagctgacagattacagttgaggggattgccacacccagatgtttgcccaatgtgtgatcaagcccaagagacaattcagcacctccttactgcgtgcatttttgcccggcaattttggcatacaattcttgctgctattggcttggggcatctcactccgactgctgatgaggagaaaggtgagccttagagttatcaagaccaggaaaaaaaggaaaaaaggaactctctgatcatcctgggggcttggtgcctatggctccagagaaacagagcagtgtttcatggggagtctccttccttgcccaggatttttaggtgtttctcagatgagtgtgcttgctgggttttagcaggagctaaggagatcggtagtatgggcttagttgctgccctgggcgaggtcgggtctagtttcagttctactatgtaattcccttcgggataatgtgggtctttgggagatttgctctgcaacatctcctcttttgtaatgtttcctttcctctttaatatataagatgcgaagttctcctgcgcgttctcaaaaaaaaaagtcccactgtttggcaatttagagactaaataagactaaaatgaagggactaatctttagtccctcaaaccaaacagggctttaatcatgtcccataacattagtcagggaggttcaaatctcctcgattattattgtagtgctctgattcagattcatcatgctgttcttctagtcatattctggataaactcgaaagcttcttatttcagctctcctggttatcgttattgactacaatgtgtttagcttgattctttttgtctgactctgttgtactgtctttgattcttgaaaacagatatggcagtgcaaatgtctggaagatcttcactgatctttttgattattttccgttgacagcattggtggaatcagaaattttctgcctccatggtggtttatctccatccattgagaatcttgataacgttcgcagtttagaccgtgtccaagaggtccctcatgagggacctatgtgcgaccttctgtggtctgatccagacgatagatgtggctggggcatatctccacgtggtgctggatacacttttggccaagacatatcggagcagtttaatcacaccaacaatcttaaactcgtagctcgggctcaccagttggttatggagggatacaactgggcacatgaacaaaaggtggtgaccatattcagcgcacctaactactgttaccggtgcggcaacatggcgtccatcctcgaggtcgatgactgcaggaatcacacatttattcagtttgagccagctcctaggagaggtgaaccagacgtgacgcggaggacacctgattatttcctttgagttatctgccaggccatttttggattttgcccaatgttggaatagtgatgctggccagtaacaatttttgttggatctatatgataacttaaccgaccagcaacagtaagaaaatgtggaacttaaccgaccagcaacagtaagaaaatgtggaagctgcatttgtcattgcaagaggtgctcgctaacttaaccccaagctgtcaaaagatccgcttgtctacccaacccacccagtggtgcctcccttgggctttgggacgtcgagtttacgctttcagcgtagagttgcctcagttctgtcttgtgtgtcagctagttttgtgtttgtgtcttgtgtggttgctcgttgtagcttctgtggtctcgagtgttgcaagaattggaattctgctagctcctcctctgtttggttgtccatgcccttggtacacgagtgttggccacccttctcatgtagcaccaaccacgttacagtcaagctgttcgcatcttatttttgtcatgttaatactcctgtcaattaaatgaacaatgtttgctccc

SEQ ID NO: 8813 - DNA, 1815 bp, Zea mays
  misc_feature (52)..(52): n is a, c, g, or t
  misc_feature (253)..(253): n is a, c, g, or t
ttttttttttttttttagaaagtgacggatttctactattgcaacgactcanccgattatgtgtttatgttgtttttgaatggtttttagtcaaacgaattttatagaagctgactagaaagctgaacgtttggcagtctacagcagcttttggtgaccagaagctccaaaaagctgagggctaattccgtgccaaccgaacaagcccgacaaatctacgtttctcactgtcacttggtcccgttgataccgngagccactgacgggcccgccccgccggcccccgcccttcttcctcttcattacaccctttcctccgtgccgccccacttttctactcccgcgcccctccgcgagctccctacccctcgcgctcacgccggcgacaagtttccgccagagttaggtagatcaggtgctgcgccggcagccgtggaagggatggaggacctcgcgagttcgcgtggcggcgggggatgcggtggtcttgatgcgcagatcgaacagctcatggagtgccgcccgctcccagagacggaggttaaaacactgtgtgagaaggccaaggagatattaatggaggaaagcaatgttcagccagttaaaagccctgtgacgatttgtggtgatattcatggccaattccatgatcttttagaacttttccggattggtgggaagtgtccagatacaaattatttgtttatgggtgattatgtggatcgtggctattactctgttgagacagtaacgcttttagttgcacttaaggtgcggtacccgcaacgcattacaattcttcgtggaaaccatgaaagtaggcagatcacacaggtgtatggcttctatgatgaatgcctacgaaaatatggcagtgcaaatgtctggaagatcttcactgatctttttgattattttccgttgacagcattggtggaatcagaaattttctgcctccatggtggtttatctccatccattgagaatcttgataacgttcgcagtttagaccgtgtccaagaggtccctcatgagggacctatgtgcgaccttctgtggtctgatccagacgatagatgtggctggggcatatctccacgtggtgctggatacacttttggccaagacatatcggagcagtttaatcacaccaacaatcttaaactcgtagctcgggctcaccagttggttatggagggatacaactgggcacatgaacaaaaggtggtgaccatattcagcgcacctaactactgttaccggtgcggcaacatggcgtccatcctcgaggtcgatgactgcaggaatcacacatttattcagtttgagccagctcctaggagaggtgaaccagacgtgacgcggaggacacctgattatttcctttgagttatctgccagaccatttttggaatttgcccaatgttggaatagtgatgctagccagtaacaatttttgttggatctatatgataacttaaccgaccagcaacagtaagaaaatgtggaagctgcatctgtcattgcaagaggtgctcgctaacagtaacaggtcgacgacctatacaccccaagctgtcaaaagatccgcttgtctacccaacccaccaagtggtgcctcccttgggctttgggacgtcgagtttacgctttcagcgtagagttgcctcagttctgtcttgtgtgtcagctagttttgtgtttgtgtcttgtgtggttgctcgttgtagcttctgtgattaaatgacaacagacaagctggtctcgagtgttgcaagaaaaaaaaaaaaaaaaaaaacaaaaaaaaaaaaaaaa

SEQ ID NO: 8814 - DNA, 1678 bp, Zea mays
ttttcttagctaacacatagtaccaaagactaataatacttaggttaattaatctagtatacctcggactagaataacaattagtagctttacaattagctttaaaattactattccatagtctcgtaagtagagtattatcaaggactgtagatctttataagactataattttaaggcctaatgacttaaaacattaatgtagaccatttattatgaaattctcatattttaatcgaaacagagttgtcgatgctattcatttaaattattccagtagcaatcaacattcatccatgacactcagtctattactaaatatagaatacaataactacccgataaaatcattgactttatcatggggcttctcgtatttcgactgaaactggctcgctaacgctactcgcttccaatttatttttgtttgtcgcttctgtgcagaatacctaaaatagtaagaatatggagctgatcacacatcacgcctgctaaacacgagaattatcacgactaataaatctagctaatccaatgatcgaactaataatagaaatagcgaatcaactcactatattgtaatttgactcaatcatcacatgaacgatgacgaccttcgattgaagtctttggccaagcacttgatgagcgatgcacacgggcctcgctttcttcacccacgcacacaaattgcaccgatgagcagtaaggtcagagagactcggtgttggggaaaaaaatactaggaacggtcagtgatggagctggtagatgacgatggtgatgccgcgaagcgaacaaggttagacgacggcgtggtctaccgcgagggaaagccggcatacaacacggcgtaaggccggagtcaatcggcgtgatccaaataccgcgcaatgtgcatcagggacaagcgcgcgcggcagcgaccatggttgaatagcctaacgatacagggccaagcgacgtcgacggccagaacacgcggcgaggagaccacaggtgaggggacctggccggcaaatcgcgcgcaccagagaagccgagcagcagtggccagcttccacggcaaggaagggggaacggcgaactggagcgagatccgagctgggccgggcgtgagctgaaggacagcgagcaggccccgagctcgatgcggccaggcatggaaacagcgcagccggagttgagagaaaggaaggacggctgggcgaaacctcggcagggaaatggatggtcggtagaggaacgcggctgcgtgcagaggagcagggcgcgcggcgcaggcagccatgggagtgacgcgcggttgggagaaaggaggaggagcgccagggagcagcgcacgcagggcggggccgagctggagcagaggaggcgccgtgaggaggagaggaacaccggccaacagagagccgagaggtagaggacggccatgggaagtgaggttggccggcgttgaagataagcaggaatcaacacggcggccaggatataacgaagccagaagaaaaattctgcgtagcgcgcgtgaagagataaggagagagagcacggtgagaagatttttcttttttttagatttttctatttttttaaaggaaatcgcagatattttagattgagatttttagtgatgtatagtgggtcgatacgctatacggatacatattcctctccg

SEQ ID NO: 8815 - DNA, 1943 bp, Zea mays
cctcggaagcataatatcctttaggatataatgatcttcagacgaaggtcatgaaggacgtaccttcatcatagcagcatatattaatgaaagaagaagtatatgaaacatgaggaatgacatgaatgatcatatgacatccttaatatatctctattatatcatcatgaatgaacatgaacaatattgaattacttttgtaccttcggcttgacagaaggcaaagagtccaagcgtgacgcacgagcgaatacaagtcagcgtgaacagtacgggggtactgttcatctatttataggcacagagcgtagcctgtgtaaaattacattcatgtccttcatgtttacaattgacttaaggacaatctatcgaggactagatagcattttcctctttaagtcggttcctttttctgttactgagttgaagctcctttgcgcgtagcttcggagttgattcgaccttcgtcccgaccatgctttttatattgtgaacagctttgttccgagtctgaagggtcccccagcaaccgcacatgatgagcacttgcgtcatgctttgggaaggagaagcttccccaaccaacggaactcgatgaatggagtcccaggcataatccccaaccgcacgtgaatgctctgttcatactaaaatgacaatggagtcccaggcataattatgattatgatcaaccataataccagactactccatgattttttttgtttcattaaattgaacaatgattataaatgtggacagcaaaagagagttaggaacaatcaccactcctcaagctttgcagcagatctaagtaaccacgagaatctgggtttatgtacccatgacggaaaaggaagtcgatgatcacaaggttgcagttcggcttgaaaaaatctgtcctccttataatgtttgcagcatgtataacagggactagtctgaagctatcaacctcaccatcttcattattaggaacaaaatcagcaggaagttggaggtcatagcagaagagaacatcccttttgtatctaaagccttcaatatccatataagaaaccgctccaacagaagtagcatttgttgatatggatcttgtgattccagcttcctcctcacattccttgatgatattctctttgcaggacattccgtatggcaggccacccgcaacaagatgatcaagcattcctggatatgtttgcttcacatcactccgtttaccaatccaaagaaatttctgaccatccttctcaacatacccattcatatgaactccataagcttttataccaaagtaaggagcagcagcacgttccagagagaagtacacaggcatgccataagatgacgtcactgggtagagctcatttcgaatacctggaatcaattctccaaggcttttaatgacacttccaatagcatgtgttcggtcttctggagtccttagtgatgactggagagacacatgctccacagtgttgctgccattgtcatccatgacaatggtaaaaacatcatgaaagtctctgatgtgttcgataaatcccttgtggatgtaccccacgacctgatcctccacagagaactccacgaactgcccttttttgtccattccgcggttgcagctcttgaccttccggaagtacccggagaggtcggactcgtcgccgcgcccgccgtccccagcgacgcggagggcgtcggcccaactgaaccccgctacagaagtgggcggcgcggcagaggaggcggggaagcaaaagcggcggctggtgaggaactggagacgggcggggaagctccagcgagcggcggcagtgatggtggccatggcggatatcgccggtcccggtcgaagtttgcacggtacttatgttccagaagagaaatgtgccccggcccggcccgcctcgagcaataatattagtctctttcttctc

SEQ ID NO: 8816 - DNA, 2213 bp, Zea mays
cttccgctttctcccttactcgcgctcagcacgcaggcgacggcgtcggcgctcaggtcgggctctgggcgacggcgtcatcggcttctcctcccgcctctctccagtcgcctcgcgccctcgcctccggtcctccgcacaccggccggtgaccctgcaaaaggaaattttcatggctgttaatgaggagtctgagggggagcaagctggggcaacactggaggatctgtttttctttaatggtgaagaggatgatgacagtgattgggaacctgctagtcgccttgttgtgaatagatggttttgcttgaactgcacaatgccaaatgtggacaagattacatattgcatgaattgccgtgagcttccaggatctgttgtagatggatatgatgtcttcaaaaagcaaattgcacaaacagctttgttatctgctgacacagggttgctgccagtgtctacggcgattggttttgatgaaagaatgctgctccacagtgagctagaagttaaaccaaatccacatccagaaagaccggatcgccttcgcgccattgctgcaagtcttgctgctgcagggatctttccctcaaaatgtgctttggtacctcctcgagaaatcacgaaggaggaacttcttatggttcatagtccagaccacattgaaagtgtcgagcagacaaagaacatgctttacagttacttcacttcggatacttacgcaaatggacattcagcatgtgctgccaaacttgcagctggattatgtgctgatcttgctagtttgatagtatctgggcgtgttcgcaatggctttgcgctggtaagacctcctgggcatcatgcaggggtgaagcaagcaatggggttttgtcttcacaacaatgcagcagtagctgcgttagctgcaaaaagagcaggtgccaagaaagtcctcatagttgactgggatgtgcaccatggaaatggcacacaagagatattcgacggggacaaaacagtcttgtacatatcattacatcgtcatgaggatggaaacttttaccctggaactggagctgctcatgaggtgggagttcttgatggtcaaggattctcagttaatataccttggagccgtggtggtgttggagatgatgactacatctttgcttttcagactgtggtgcttccaatagcttcagagtttgccgcagacatcactataatatctgcaggattcgatgcagctagaggtgaccctctgggttgttgtgacgtcactccaactggatactcttggatgacatccctgctagctggttcctcaaatggaagattgttggtgatacttgagggaggatacaatctccggtcgatatcctcatcagctactgaagttgttaaggtcctacttggggagggtcccaatcgtgcttcatttgtagtttcaccatcaaaagaggccttgcgtactgtttctcaagtcctgaagattcaacaacaattttggccagttttaggtccaacatacgcatcactacaggcgcagcaggggtcggtttcttccaatcatagcaatgagctgaagaaaaggaagcgttcaggaggaggaccagggcccttctggtggaagatgggaagcaaaaggcttctatacgaagcgcttattgagcctcgcagccgtccgaggaaactcaaggggtcaactggttcagcagcgccttagatgtgggcagtttgctggccgttgatcttctagacatgaacagggtagctcgctgaccgcgtttcctcaagcagagtaggctgcgtttacctagaaaacctagttttggctggttacttgcatgatggtcgaccgtttcagatggagtttgacagcaaacccgttgtgttaaccatgcgtggcgtatcagccgatgtttcatgcatgctactgtctttttctttggttggtttcgtaccatagatagacgtgtgtagcgaccatcgatggaaaaaaaccttgcacatctggaacggcatgcatctcagttattagcccctgctgttgcacatgcattcttttcttgccgattttctcgtgcggtcaacttgactgccccgtctgaatgtgcctttgttacacatcagacgtctgaaatggattttactgactttgaggagctggtgcattttctatatgcattttttattgttcagctaaaaaaaaaaaaaaaaaaactcgagag

SEQ ID NO: 8817 - DNA, 2581 bp, Zea mays
cggcacgagcttccgctttctcccttactcgcgctcagcacgcaggcgacggcgtcggcgctcaggtcgggctctgggcgacggcgtcatcggcttctcctcccgcctctctccagtcgcctcgcgccctcgcctccggtcctccgcacaccggccggtgaccctgcgtgcgtgcctctctctctctctctctctcccttcccgcctccggtggatcgtcaacaccgcccggcccgggtggcagcaccgcgcgcgacctgaggggtgagggcagcgggagccagcagccgctgctccaccaaggcggtcgcgccgcttttggagcgcttatgcccccggtccgctgagcgcttagtgcagttttttggaacatgagacctcctagcagtggcaaaaagactgaggtctcccatagcgtggggaaatgtggggtttctgatcaagcttgtcatggcaaatgccaaagctgtggcattgatgcaaaacctttttgtgctggagtgaacgaagtctccttgttgactggcagtcacactgatgtggaggcctcaaaagagaaccgtggagcatgcagtttgaacaatgatcgtgctgatgctctagaagaagaggccaatgtttccacagctaggataggtcatgttgagagtgctgaccctggtggctctgtgggtgtagaaaaggaaattttcatggctgttaatgaggagtctgagggggagcaagctggggcaacactggaggatctgtttttctttaatggtgaagaggatgatgacagtgattgggaacctgctagtcgccttgttgtgaatagatggttttgcttgaactgcacaatgccaaatgtggacaagattacatattgcatgaattgccgtgagcttccaggatctgttgtagatggatatgatgtcttcaaaaagcaaattgcacaaacagctttgttatctgctgacacagggttgctgccagtgtctacggcgattggttttgatgaaagaatgctgctccacagtgagctagaagttaaaccaaatccacatccagaaagaccggatcgccttcgcgccattgctgcaagtcttgctgctgcagggatctttccctcaaaatgtgctttggtacctcctcgagaaatcacgaaggaggaacttcttatggttcatagtccagaccacattgaaagtgtcgagcagacaaagaacatgctttacagttacttcacttcggatacttacgcaaatggacattcagcatgtgctgccaaacttgcagctggattatgtgctgatcttgctagtttgatagtatctgggcgtgttcgcaatggctttgcgctggtaagacctcctgggcatcatgcaggggtgaagcaagcaatggggttttgtcttcacaacaatgcagcagtagctgcgttagctgcaaaaagagcaggtgccaagaaagtcctcatagttgactgggatgtgcaccatggaaatggcacacaagagatattcgacggggacaaaacagtcttgtacatatcattacatcgtcatgaggatggaaacttttaccctggaactggagctgctcatgaggtgggagttcttgatggtcaaggattctcagttaatataccttggagccgtggtggtgttggagatgatgactacatctttgcttttcagactgtggtgcttccaatagcttcagagtttgccgcagacatcactataatatctgcaggattcgatgcagctagaggtgaccctctgggttgttgtgacgtcactccaactggatactcttggatgacatccctgctagctggttcctcaaatggaagattgttggtgatacttgagggaggatacaatctccggtcgatatcctcatcagctactgaagttgttaaggtcctacttggggagggtcccaatcgtgcttcatttgtagtttcaccatcaaaagaggccttgagtactgtttctcaagtcctgaagattcaacaacagttttggccagttttaggtccaacatacgcatcactacaggcgcagcaggggtcggtttcttccaatcatagtaatgagctgaagaaaaggaagcgtccaggaggaggaccagggcccttctggtggaagatgggaagcaaaaggcttctatacgaagcgcttattgagcctcgcagccgtccgaggaaactcaaggggtcaactggttcagcagcgccttagacttagatgggcagtttgctggccgttgatcttctagacatgaacagggtagctcgctgaccgcgtttcctcaagcagagtaggctgcgtttacctagaaaacctagttttggctggttacttgcatgatggtcgaccgtttcagatggagtttgacagcaaacccgttgtgttaaccatgcgtggcgtatcagccgatgtttcatgcatgctactgtctttttctttggttggtttcgtaccatagatagacgtgtgtagcgaccatcgatggagggcgccttgcacatctggaacggcatgcatctcagttattagcccctgttgttgcacaaaaaaaaaaaaaaaaaaaa

SEQ ID NO: 8818 - DNA, 2630 bp, Zea mays
acaatgatttatcccagaataagatcactcgtggagatgctctgctagcacctggacactcatcagtctcagagactgaggagtgaagtagctaccatctcgcctcgtttctcccagtctgccgttgctgctgctgccagatcccagagttcgtggtaggtggcaatggcctcgtcaccgcttgcaatctcggggacgcagcctacctgggtcccctatgaaccaaccaaagattgctctcagggcctgtgcagcatgtactgcccccagtggtgctacttcatcttccctccgcctccgccgttcgacgtgggcgggcccagcccggacgactcctccggccccgtcttctctccgctcgtcatcgctatcatcggcgtcctggcgatcgccttcctcctcgtcagctactacactttcatctccaggtactgtggcaccttccgttccttccgagaccctgatcagcaagatcgccctgtgcaagtacaggcgcggtgacgcgtcgtcggtccacgccacggactgccccgtgtgcctcggcgagttcagggacggggagagcctgcggctgctgcccaagtgcagccacaccttccaccagcagtgcatcgacaagtggctcaagtcgcactccaactgcccgctgtgccgctccaacatcacgttcatcaccgtgggggcggggcagatgctgccgacgccgcaggacgctgcgggccgccgtggtccaggcgagggtgttgggagagatgccgccgccgccgccgccgccgccgcccatgaggtggttgtggcgatggacgacttggagatcatgtgcgaagagcagcagagcatggcgggcagcacggacggtgatgagcgggaggcgagtggtggcccggagggaccggacgaggccgacagcaaggccgaggagatcagagaagagcgcccgccgccgccgccgatgaagctgtgggggccttcgtcgtcggagccagacccgatcagccacgacgtccgcatgtccatcgccgacgtcctgcatgccagcatggaggacgagcggatggcggccagggacggcggcgccggcacgtcgaggcggtggtgccatggcgagaacagcaaggggggacgcagcagcagccggcgtgcgctgcaggacggcacggacacgaagcggttgcctcctgctgggcggtcctgcttcagcagcaacagcaagagcgggagggggaggggcccggatcatccgatgtgaggaggctcagagctgtttcagattttacctaggattttactgggcgggttcttgtccgctcgcaagtcgcaacatggagaatgtggacggggaaaagcagggaccgacaccacagtctatggcgcctcgtgagacgtgggtcgtgacaatgttcatccctacgtacaatgtggtgatcgatgccagggtccaatagttcgtctgcattgctcggtgaggcctctgcagctggttcttttctcttgtcatatttttttttggttggctcttccacctctcatgtattgccaagacccacattccattatttcagagaacatgttactggctttgccataaaaaaaaaaaaaaaaactttctttgcacttaaacacacagcagtttgcgttcggaatttcccatcgtcatagccacccacgtaggctctgttgtcgctgaagttgcctgtggcccgtcatcacacccccacccatgaggccatgcatgaccatgaaccaaagcttactcccaagaagcaacaaagctgcaaaccgactgcgcttcagggtgtgtttggatggagggacgaggaaggatgaagaggatgagatgagatcattttaatttgacccgcgtttggtttggaggtccagagtcagggtcaagcaatattgttcaaaaatggtggatggggctatccctcaaaaaaataagggacagagtcaaccaagggttgatctcgtcccatccctcgttgacaccgaaccaaacactaccttacctaccggtcccggccggggctggagcgacttgtttgtttgtgtctacccttatcatactcctgcactgcactgttactgcatgatccgtgctcagatcttagcctgtgacgggcgatcagaatctgatccccttccgctttgccaaagtggcctcttttttttctgtggttcgttccttgaggcgagcagtacagatgctcgagttactgtgacagaaacgatgctggaatcttagattagatattagtattaggtgatgcccctggctggacaacatgtggggttcatattccaaacccgtggctgtggggggaggggttagggttagggttaggtctggtcgacgcaacaggagccgccgatggtcgtttttttcaactttatgtatcattttcctctcgctctttttatattttttgaaaagaaagaagaagctatggggacttttgtgctggagccacgagcccacgatgatttccggtgtttgttttagcggcggcgaggagtcgtcatggaacggctctactgtactgactgatgaagtgtcgacatgacatacgatacgctactactgcacatagcactattgtttgcagcagaggcagcagataggtagcacg

SEQ ID NO: 8819 - DNA, 2818 bp, Zea mays
aaaatgttcactcatatatttggtgtgatattgcaatctaataacatgatgcttggtgtgaaaaaaggagattgtaattgacaacatgttcctgtcaaaaatacgatgacaaggttgtggtacagacgaattctgaagattatactatggccaagtgctgtgaaaaaagagagacgaattctgagagccaagggctgtgataaaaactgtgtgaattgcagatagtgtctccatgcagatgtgtgctgagataatccatttaaccatcaaaactgatgtgtgctgagataatccatttaaccatcaaaactactaaatgagggctccagtctcagtaggaagcccaggcggctgcttcagggaatgagagacctggaggagcaggagctgatgcaccaccctgatcaatgataccgaagtgtgctaggaccttcgtgaggaggacgcctgcgacgtacgacagtccggagctgctgaatccaatggacaggtagtagaggagggttgtgaggtatgtcctatgcctcttaacatgtgccttcccgattgcgagcagcgcaatgcacaggagagatgcagcagcgaccaccagcactttgttctctctgttgtcgctcgtcctgaatgacagtccgtagatgactggtggcagcagcccgaagaggatgtatgacagtatggctatcaccatgtgcaactggtacttggatcgccttcccagctctagccagtaatgccccacttgctcactgctttcagctatatctcctgtgtttcgtagatcagcaatattgtggtaaagtacaggaagaccaccaataaggtttgctatgcccaggatgaatatatccaaagtcttggcaccacttgctgcagctgctgatacaactgagaggctcgtgattgattcaacaaggccaccatacactacggctttcaggatatcccattcatccctctcagctgatggtgcaggaactagtgcctcggcctcagggactgccaatactctatgaggtggagcttctggctcagctggctgacgaataactgaagttggtttctcaaccgtctggttgtcctccccaggcaaaacttttattgggattgtaagtactggtttaacaaacgatgggctgaaaaatgtgctgttatcagagggcgccattatatcttccagaatatcttgtttgtggccaaggtgcattgaatcattcgcagtatcaccagaaggctgcgagagaggaatttgctcttggcgtgctccatttcgctgcacagttaccacatgtcctgcttctgtttgcgtgaattcttctttgtggcctagatgactggtatcagttttagtatcaacagcaggccgtgagagaggaatttgctcttggcgtgctccgtttcgctgcacagttaccacatgtcctgcctctttttgcgtggatcctgtcacgtctttagatgatgcatggaattgactgaaggactcctttacttcatacgtcgcagctgtggtttgggatccagttggtgatggtttgtttgattgttctgctttacctattgtgttatcactatgcaatggtgtgttctcttcaactgaagttatattgtcagtcctctgcgaatcacttactagaggttcctccaatgaatctgcattatttaatggctttggactatctattgtccggaaacaagaaagaagccaacttccacaattttcaacagacgcagaagaatgctgaggttgaacttgttggtctacatccctcctttcaaatatgcggaatatattaaacccgcaacctgttgggatgaagaaagtgaagcacgacaagcatctaaatacttccggcgagtcttgattgattgtttggcttggagcattggcgggaggctctacaagctgtggtctttttggtggttccttgcctgtttcttgccttactgttctctttctctttttaaggatgacccttcgagttatgcacgatttgcagttggggcaatagaggtcatgggtttcttgctcgtccagaatcttctcaagatcatactcttcaactttgacgtcgcccttactgacttccttctcaacttcaatttcatgaacctgagatgtgctcgtgctgccaccagaaacgtggtcaagagagccactccaacttggcaagatgtgctgcctgccctcgcggatggttgtgatcagtttgagtccgtccgcaatggtcgtcacgatttcactgctgctggagatctcatgcacaccattagagtgtgaaccattttccaagttgccattactcgaactgtagttagtttgttgagcgctgacattgtcctgtttctcaacttggttttcagcacccagcccagtagcatggtcagaggcttgtgttggatccaagaagatgctctgctgggccgccgccgcctcctcctctactgctgatgctgctgcgttggagtcggagtcggagtcggaggactccatctccaggtccaggtccgccatcgttgtcgtcatcttcttcctcatgctctctctctccctagtgtataggagggcggaggtgtcttcctcctcctcatagtcatcctcctcggcctccatgagcagctgcggcggctcctcctcctccttgagctcccacatcggcctctccacctccatcatcttttcttttcttttcttgtgtgtttactgtaggagtaggagcaggagtgcagtcgtgtagatggagattgagatgcagcctactgcctactgcctagatgggaaatgggattgagtgttgccacacaacctccattttgt

SEQ ID NO: 8820 - DNA, 1806 bp, Zea mays
agggtgtctcgcagctccagacggccacgcggccagccgtcggccactcgcttcgactggcaggctcctacccttgcagacaacattcgctacctcgaggccggccggcgaaggttcgttcagttcaagaccagacgaggaggaagagaggcgcgcaagcggtccggtctcatggcgcccttccccgccctccgctcatcgtcgccggtggccgccgccgcggcgccgtcgctcggtcgcgtgtccggccacgcatctgcggcgcccagcaagaggcgcgtcgtctcctgcagggccgtcagcagcaggtcgctgtccatcatcaggtgcgagcagagcgcgaagaagggcggcgggccggacacatggctgggccgcgcggccatggtcggcttcgcctccgcgatcgccgtcgaggtggccaccggcaagggcttcctccagaacttgggcgtgggtactccggcgccgacgctggcgctggccgtgtcggggctcgtcgtcggcctcgccgtcttcttcctgctgcagtcgggaggaggcacgcgagactgacggctgatggaaccccatgagctgagagcacgcgcacgtcgaacatcgtctccccactcgacatcagttgctgtaatggttggtgaagtgaggatgaaaacccagggcatatatcatcatcatcatgtcatgtgtaacaaagacgataactctcatgtgttgttggtgttgtctgctgctgttgtacgacatccgccgctcgcttgtacgatcgtactgcacgtctgcacttcatctgccgggcggccggccgggcgagcacagccgttctttaataacatgacgggcgcatgtacacgccagctgactcttcatgtcgattgcgtccagacaattttgttattaggagcagacctgccgtttccatgtgcttgcttcacggagcacggcagctctgtaaacggcagactcgacgtagcttgcacgcacaggggttttcagctaaaaaatcctctagcgacagttcattggttgcccagttcaccgactgcctttataaacagggagctcgagctcgagtggtagcagcacaggcacaagtgcggtgccataagtgacagccacctcagtctctgtctgtggaactctctctcgcgcgctgccatctcgcaggttcttcatctcgtcgctctgttcaggttcatcggctggcgttagcgtttgttctctctcatacgactagttcatgcgtcctctgctgcatctcttcgattcatccgtagtatcttctttttacagctagtttgggaacccattttcttagtatttctgtttttttcaagaaaaaatgaactaattttctttaataaaataaaaggtttctaaactagtccttaagtaaaaaaaaaaggcggtcccgagcaaagtcaaacggtcccgagcaagcaagaaaccgtggcgtcgattctcttttctctccggctttccgtggcagcaagaagcgatcaaggaccggaccccgtccgtccgtccggccggcctcctgatcgcgtggggtcgcgcgcgcccctcgaaaagccacaccccgccgtctgacctcgtggtgaccggtcccgcaggcggcgacaggagatggacggggagcaggcggcgcggtgggcggcggcgcaggagggggttcccgccggggcggaccttgtcgcggcggcgctgcggcagatgagctttctctggttggggtaccgtgacagttgggtcttctacgagggcacgatgacatattgagatttaagcatttactatgcaccccaa

SEQ ID NO: 8821 - DNA, 1949 bp, Zea mays
cctgttactgtccatttctttactatcataacagatgtacatcttgtcttcctcatatgatgcctatgtgtcagtgtgtcaaagagagcatcgaggtttaaagaggaaagcaacagcagcaggggcaaaggaaaaggcctcgggggcctggcccgcggcgccaaaaacaaaagcaaataagatgagggcccccaaccaccaccatctccacgtctccttccatccaccctgaacacgcttccctgcctctcagagtctcaaatccagcagcgtcatctgatctctccccccatatcctctcacaattcccgacaccgagaaaggagcatggatccaaggcacctagcatgtcctctctcttccgaccacaatgatttatcccagaagaagatcactcgtggagatgctctgctagcacctggacactcatcagtctcagagactgaggagtgaagtagctaccatctcgcctcgtttctcccagtctgccgttgctgctgctgccagatcccagagttcgtggtaggtggcaatggcctcgtcaccgcttgcaatctcggggacgcagcctacctgggtcccctatgaaccaaccaaagattgctctcagggcctgtgcagcatgtactgcccccagtggtgctacttcatcttccctccgcctccgccgttcgacgtgggcgggcccagcccggacgactcctccggccccgtcttctccccgctcgtcatcgctatcatcggcgtcctggcgatcgccttcctcctcgtcagctactacactttcatctccaggtactgtggcaccttccgttccttccggggccgggtcttcagttccagctcaggtggtggcggtggtgcccgcggcagcggcggcggcggcggcggaggaggaggccagggacagtccaggagccaagagtcgtggaacatctcgccgtcgacggggctggacgagaccctgatcagcaagatcgccctgtgcaagtacaggcgcggtgacgcgtcgtcggtccacgccacggactgccccgtgtgcctcggcgagttcagggacggggagagcctgcggctgctgcccaagtgcagccacgccttccaccagcagtgcatcgacaagtggctcaagtcgcactccaactgcccgctgtgccgctccaacatcacgttcatcaccgtgggggcggggcagatgctgccgacgccgcaggacgctgcgggccgccgtggtccaggcgagggtgttgggagagatgccgccgccgccgccgccgccgccgcccatgaggtggttgtggcgatggacgacttggagatcatgtgcgaagagcagcagagcatggcgggcagcacggacggtgatgagcgggaggcgagtggtggcccggagggaccggacgaggccgacagcaaggccgaggagatcagagaagagcgcccgccgccgccgccgatgaagctgtgggggccttcgtcgtcggagccagacccgatcagccacgacgtccgcatgtccatcgccgacgtcctgcatgccagcatggaggacgagcggatggcggccagggacggcggcgccggcacgtcgaggcggtggtgccatggcgagaacagcaaggggggacgcagcagcagccggcgtgcgctgcaggacggcacggacacgaagcggttgcctcctgctgggcggtcctgcttcagcagcaacagcaagagcgggagggggaggggcccggatcatccgatgtgaggaggctcagagctgtttcagattttacctaggattttactgggcgggttcttgtccgctcgcaagtcgcaacatggagaatgtggacggggaaaagcagggaccgacaccacagtctatggcgcctcgtgagacgtgggtcgtgacaatgttcatccctacgtacaatgtggtgatcgatgccagggtccaatag

SEQ ID NO: 8822 - DNA, 750 bp, Zea mays
ggccggccgggacgtcggtcactcacttcgactggctcctactcctagtcctactacccttgcagacaaaatccgcgaacgcgagggcccggccggaggttcgttcagttcaagaccagacgaggaggaagagactagagaggcgcgcaagcggtccggtctcatatggcgcccttccccgccctccgctcgtctcaggtggccgccgccgcggcgccgtcgctcggtcgcgtgtccggccacgcatctgcggcgcccagcaagaggcgcgtctcctgcagggccgtcagcagcaggtcgctgtccatcatcaggtgcgagcagagcgcgaagaagggcggcgggccggacacatggctgggccgcgcggccatggtcggcttcgcctccgcgatcgccgtcgaggtggccaccggcaagggcttccttcagaacttgggcgtgggtactccggcgccgacgctggcgctggccgtgtcggggctcgtcgtcggcctcgccgtcttcttcctgctgcagtcgggatcgggaggaggcacgcgagcctgacgactgatggaacccatgagctgagagcacgcgtcgaacgtcgtctccccactcgacatcagttgctgtgctgtaatggttggtgaagatgaaaacccaggatatatatcatcatcatgtcatgtgtaacaaagacgacaactctcatgtgatgatgcaaaaaaaagcagaaaaaagcggccaaaaaaaaaaaagcggccc

SEQ ID NO: 8823 - DNA, 874 bp, Zea mays
ggtgtctcgcagctccagacggccacgtcggccagccggcggccactcgcttcgactggcaggcttctacccttgcagacacattgcgcacccccggggccgggggggaaggttcgttcagttcaagaccagacgaggaggaagagaggcgcgcaagcggtccggtctcatggcgcccttccccgccctccgctcatcgtcgccggtggccgccgccgcggcgccgtcgctcggtcgcgtgtccggccacgcatctgcggcgcccagcaagaggcgcgtcgtctcctgcagggccgtcagcagcaggtcgctgtccatcatcaggtgcgagcagagcgcgaagaagggcggcgggccggacacatggctgggccgcgcggccatggtcggcttcgcctccgcgatcgccgtcgaggtggccaccggcaagggcttccttcagaacttgggcgtgggtactccggcgccgacgctggcgctggccgtgtcggggctcgtcgtcggcctcgccgtcttcttcctgctgcagtcgggaggaggcacgcgagactgacgactgatggaacccatgagctgagctgagcacgcgtcgaacatcgtctccccactcgacatcagtcgttgctgtaatggttggtgaagcgaagatgaaaacccaggacatatatcagcatcatgtcatgtgtaacaaagacgacaactctcatggtgttggtgttgtctgctgctgttgtacgacatccgccgctcgcttgtacgaccgtactgcacttcatctgccggccgggcgagcacagccgttctttaataacatgacgggcgcatgcacacgccagctgactcaaaaaaaaagcaaaaaaaaaagcggccggcc

SEQ ID NO: 8824 - DNA, 703 bp, Zea mays
  misc_feature (670)..(690): n is a, c, g, or t
  misc_feature (692)..(702): n is a, c, g, or t
ttcccgggcaaacacgagcatgcccaggaaggttcattcggctcaagaccagacgaggaggaagagagaggcgcgcaagcggtccggtctcatactctcatggcgcccttccccgccctccgctcgtcgccggtggtcgccgccgcggcgccgtcgctcggtcgcgtgtccggccacgcatctgcggcgcccagcaagaggcgcgtctcctgcagggccgtcagcagcaggtcgctgtccatcatcaggtgcgagcagagcgcgaagaagggcggcgggccggacacatggctgggccgcgcggccatggtcggcttcgcctccgcgatcgccgtcgaggtggccaccggcaagggcttcctccagagcttgggcgtgggtactccggcgccgacgctggcgctggccgtgtcggggctcgtcgtcggcctcgccgtcttcttcctgctgcagtcgggatcgggaggaggcacgcgagactgacgactgatggaacccatgagctgagagcacgcgcgcgtcgaacatcgtctccccactcgacatccgtcgttgctgtaatggttggtgaagtgaagatgaaaacccaggacatatatcttcgtcatgtcatgtgtaacaaatacgacaactctcgatgtgattggtgttgtctgctgctgttgtacgnnnnnnnnnnnnnnnnnnnnnannnnnnnnnnng

SEQ ID NO: 8825 - DNA, 818 bp, Zea mays
gccacgtcggccagccgtcggccactcgcttcgactggcaggctcctacccttgcagacaaaaaacgcaaacacgaggacgaggacgaaggttcgttcagttcaagaccagacgaggaggaagagaggcgcgcaagcggtccggtctcatggcgcccttccccgccctccgctcatcgtcgccggtggccgccgccgcggcgccgtcgctcggtcgcgtgtccggccacgcatctgcggcgcccagcaagaggcgcgtcgtctcctgcagggccgtcagcagcaggtcgctgtccatcatcaggtgcgagcagagcgcgaagaagggcggcgggccggacacatggctgggccgcgcggccatggtcggcttcgcctccgcgatcgccgtcgaggtggccaccggcaagggcttcctccaggtagggaccgtcgtagagtatgagtatcaacgtaacatcgacagcagcgaggaacgccgaaacgcgtgcgtaacaaacataccacgagtttgttgtggatggcgtgcagaacttgggcgtgggtactccggcgccgacgctggcgctggccgtgtcggggctcgtcgtcggcctcgccgtcttcttcctgctccagtcgggaggaggcacgcgagactgacggctgatggaaccccatgagctgagagcacgcgcacgtcgaacatcgtctccccactcgacatcagttgctgtaatggttggtgaagtgaggatgaaaacccagggcatatatcatcatcatcatgtcatgtgtaacaaagacgataactctcatgtgttaaaaaaaaaaaaaaaa

SEQ ID NO: 8826 - DNA, 4829 bp, Zea mays
  misc_feature (2713)..(2713): n is a, c, g, or t
gatactggaaccatataccactaaaaaaatctaggttttccaaatacggcactaagtacatccgatcatagttagatgacattttgtcttgtaactagctactttttgcactccgaaaaacgacatctacttgtggctggagggtgcagtacagaattttctccttaatggcatatttctccttgtataaatagtagctgcttatctcaaaactgtagaaattataataacggtatgaatctcttaatcaccctgtttagctctccacggcattgccccctcgtttcattccttacctgtcatacaaaatgtattgtgctgtagtatgtatgcactcatttccagtttcttgcagctctaatggctaaagaacaggatggatcccccaaggtgcgccacccagaattccaaaggatgcgcgtaactctcaccataggtgtcattggcctctgtgtcacagcatacattcttggtgcttggcaaggtacctcgaacggcattagttcccccttaataagtaccagaacccagtgcaaagatcccgtgcgatcatctggtgctcgcctggatttccaagcccaccaccaggtgggcttcaatgaatcggcgcttgctgtggagaaattcccaccttgccccccccagtgcagtgtcgataccccctgccaagatccaaggaaagctaggaagttcccaaagaaaatgatgcagtacagggagcggcactgcccaaagaaagaagacatgctccggtgcttgatccctgcgcctccaaactatagcaaccccttccagtggccaaaaagtcgcgactatgcttggttcaataacattcctcatcgggagctcagtattgagaaggctgttcagaactggattcatgtcgagggagacctgcttagattccctggaggtggcactatgttcccacatggtgccgatgcttatattgatgacataaatgcccttgtaccattaaatgaaggcaacatccgaactgcgcttgatactggatgtggagtgagtgaccggaccaatgtttctatgatactgtctgtgattccttctcaaaatttgtggatgatagtatctttgcttgtgtgtgcaggttgcaagctggggtgcttatcttatgaataggaacatcatcaccatgtcttttgcgccaagggattcacatgaggcacaggtacagtttgcattagagcggggggtaccagccatgattggagtgatggggactgagagaatcccatatccggctagagcatttgacatggcacactgctcgagatgtttgatcccatggaataagcttggtaaacttgtttccttatttgttactgcttacagttacatgacatcaaacacaaactgactaagataattccacttgattggtccaaacagatggtgtctatctaattgaagtagacagggttcttaggcctgggggctactggatcctctctgggcctccaatccattggaagaggcactaccagggctgggagaggacagaaggagacctgaagcaagagcaagatgagattgaggacttggcgaaacggctctgctggaagaaggtcgtagagaaaggtgatcttgctatatggcagaaatctatcaaccacgtagaatgtgttgacagtaggaaggtttatgatgctccgcagatttgtaagagcaatgatgtggattctgcttggtaagatttctgctgctttactctcttttcgtgaaatgttttctcaatttgattgcagcagctcaccctgatttgaacaatttaggtacaagaaaatggacacttgcatatctcctctcccagatgtgaagagtgaagatgaagtcgctggcggagtccttgagacatggcccaaaagagcatttgctgtccccccaagagtaatccgcggttcagttccaggcctcacccctgagaagttccaagaggataacaaggtgtggtcagagagagtggatcactacaagaaattgattccacctctcggcaaaagacgatacaggaatgtgatggacatgaatgcggggataggtggcttgccagcggcccgggcgaagtaccctctttgggtgatgaatgttgtgccttcaggcttggcccatgacaccctgggtgttatttacgaacgagggtttattggcacgtaccatgattggtgtgaggctttctcaacgtacccgaggacctacgacctcatccatgctgataaagttttcagcagttaccaggacaggtaaagaatgcctttgctgtttaattctgctctagaaattttctttaccgttcactaagtcgtatggttttttgtatgatgtcttccttttgtgggcggccttatttggtaacaaggttttaaaatgcccacagcttaagcaagtagatactaactatggagtggtcgcaggtgtgacataacgtacatcctactggagatggaccgaattctaaggcctgaggggactgtgatcatcagggacaacgtagaggtgttggtgaaggtacaagctatcactggaggcatgaggtggaagagccaaatcatggaccatgagtccggtccattcaacactgacaagatcctagtggctgtcaagacttactggaccgggaagctcgtgcaaaaacaataatcgtcgccttgttactgtttttcgtctgcgaaaatgtaggcatgacttgcctgtnagttctgtcttcattgccatttttttatcctaacttcaggatatctgtatataggaggcatgtgaaccatgtagctggaattggtatcaaacatcattagccacgtagcgtatgtgacacattgcaatggtgtataagatgttcactcatatatttggtgtgatattgcaatctaataacatgatgcttggtgtgaaaaaaggagattgtaattgacaacatgttcctgtcaaaaatacgatgacaaggttgtggtacagacgaattctgaagattatactatggccaagtgctgtgaaaaaagagagacgaattctgagagccaagggctgtgataaaaactgtgtgaattgcagatagtgtctccatgcagatgtgtgctgagataatccatttaaccatcaaaactactaaatgagggctccagtctcagtaggaagcccaggcggctgcttcagggaatgagagacctggaggagcaggagctgatgcaccaccctgatcaatgataccgaagtgtgctaggaccttcgcgaggaggacgcctgcgacgtacgacagtccggagctgctgaatccaatggacaggtagtagaggagggttgtgaggtatgtcctatgcctcttaacatgtgccttcccgattgcgagcagcgcaatgcacaggagagatgcagcagcgaccaccagcactttgttctctctgttgtcgctcgtcctgaatgacagtccgtagatgactggtggcagcagcccgaagaggatgtatgacagtatggctatcaccatgtgcaactggtacttggatcgccttcccagctctagccagtaatgccccacttgctcactgctttcagctatatctcctgtgtttcgtagatcagcaatcttgtggtaaagtacaagggagatcttgtcagatgtgtgtcatcgcagagactcgagattgagaggcaagaagcagtatgttacattgtggtaaagtacaggaagaccaccaataaggtttgctatgcccaggatgaatatatccactgcaaacggacgacataataatagcattaacaaacaccatggggatctgggtgatggcatccattaatggaagaaccaagaaagaaacttacaagtcttggcaccacttgctgcagctgctgatacaactgagaggctcgtgattgattcaacaaggccaccatacactacggctttcaggatatcccattcatccctctcagctgatggtgcaggaactagtgcctcggcctcagggactgccaatactctatgaggtggagcttccggctcccctggctgacgaataactgaagttggtttctcaaccgtctggttgtcctcccctgcaggccatcgtcatttactatgtatacaaaataatctcaaatactgtggcacgatactgttagagccaaatgtaggttaattaattctgagcatatgaacaccacatgtaaaatgagccttgaaatactgtgaacgagatactcctatgacaagcaaatacaccataccaggcaaaacttttattgggattgtaagtactggtttaacaaacgatgggctgaaaaatgtgctgttatcagagggcgccattatatcttccagaatatctgtaacaagaaaataaaaatcttaccaatgcaagcatgcatattctgttgatatagtttatacaaattaacagatctaccttgtttgtggccaaggtgcattgaatcattcgcagtatcaccagaaggctgcgagagaggaatttgctcttggcgtgctccatttcgctgcacagttaccacatgtcctgcttctgtttgcgtgaattctgcataagaggtttatacttcttgttacccattttcatcacaggtgtcttaaactaattgtggtgctgcaaataatgtgggtaatgtgggtacgttaatgagtctgacttccttacaattgtgtctaactaatcaataataccttctttgtggcctagatgactggtatcagttttagtatcaacagcaggccgtgagagaggaatttgctcttggcgtgctccgtttcgctgcacagttaccacatgtcctgcctttttttgcgtggatcctgc

SEQ ID NO: 8827 - DNA, 2358 bp, Zea mays
  misc_feature (2352)..(2353): n is a, c, g, or t
  misc_feature (2355)..(2357): n is a, c, g, or t
agagggtcctgcgttcccttcttctgctgcggcggcggaggctctttcagttccatccatcttctccctcgtggctctccttcctctctcccgtagtcccgccgaccccccgcgccggccaaggaaatcaagcgaagggccgcagaacgccagattttgattgttccacatcttctttcatctctgaggggtttcccgtcttcctcgcctgctctaatggctaaagaacaggatggatcccccaaggtgcgccacccagaattccaaaggatgcgcgtaactctcaccataggtgtcattggcctctgtgtcacagcatacattcttggtgcttggcaaggtacctcgaacggcattagttcccccttaataagtaccagaacccagtgcaaagatcccgtgcgatcatctggtgctcgcctggatttccaagcccaccaccaggtgggcttcaatgaatcggcgcttgctgtggagaaattcccaccttgccagctcaagtacagtgagtataccccttgccaagatccaaggaaagctaggaagttcccaaagaaaatgatgcagtacagggagcggcactgcccaaagaaagaagacatgctccggtgcttgatccctgcgcctccaaactatagcaaccccttccagtggccaaaaagtcgcgactatgcttggttcaataacattcctcatcgggagctcagtattgagaaggctgttcagaactggattcatgtcgagggagacctgcttagattccctggaggtggcactatgttcccacatggtgccgatgcctatattgatgacataaatgcccctgtacccattaattgaaggcaacatccgaactgcgcttgatactggatgtggagttgcaagctggggtgcttatcttatccctcgcgtccgcatcaccatgtcttttgcgccaagggattcacatgaggcacaggtacagtttgcattagagcggggggtaccagccatgattggagtgatggggactgagagaatcccatatccggctagagcatttgacatggcacactgctcgagatgtttgatcccatggaataagcttgatggtgtctatctaattgaagtagacagggttcttaggcctgggggctactggatcctctctgggcctccaatccattggaagaggcactaccagggctgggagaggacagaaggagacctgaagcaagagcaagatgagattgaggacttggcgaaacggctctgctggaagaaggtcgtagagaaaggtgatcttgctatatggcagaaatctatcaaccacgtagaatgtgttgacagtaggaaggtttatgatgctccgcagatttgtaagagcaatgatgtggattctgcttggtacaagaaaatggacacttgcatatctcctctcccagatgtgaagagtgaagatgaagttgctggcggagtccttgagacatggcccaaaagagcatttgctgtccccccaagagtaatccgcggttcagttccaggcctcacccctgagaagttccaagaggataacaaggtgtggtcagagagagtggatcactacaagaaattgattccaccactgggcaaaagacgatacaggaatgtgatggacatgaatgcggggataggtggctttgcagctgcattgatgaagtaccctctttgggtgatgaatgttgtgccttcaggcttggcccatgacaccctgggtgttatttacgaacgagggtttattggcacgtaccatgattggtgtgaggctttctcaacgtacccgaggacctacgacctcatccatgctgataaagttttcagcagttaccaggacaggtgtgacataacgtacatcctactggagatggaccgaattctaaggcctgaggggactgtgatcatcagggacaacgtagaggtgttggtgaaggtacaagctatcactggaggcatgaggtggaagagccaaatcatggaccatgagtccggtccattcaaccctgacaagatcctagtggctgtcaagacttactggaccgggaagctcgtgcaaaaacaataatcgtcgccttgttactgtttttcgtctgcgaaaatgtaggcatgacttgcctgtcagttctgtcttcattgccatttttttatcctaacttcaggatatctgtatataggaggcatgtgaaccatgtagctggaattggtatcaaacatcattagccacgtagcgtatgtgacacattgcaatggtgtataagatgttcactcatatatttggtgtgatattgcaatctaataacatgatgcttggtgtgaaaaaaaaaaaaaaaaaaaaannannna

SEQ ID NO: 8828 - DNA, 935 bp, Zea mays
tccgttgggatcaagctcacagctgggggaactgaaaaagcccccttgaaaacttcctcccgggatgccgccccttcctgcacctcctaccgtggttgaaaagtctggaacaaaacctggcctccccaatgcagtaaaagcctcaaatgggcctataggtgctccgatggttcagggtgctcccatggctcaaggtactcctggggcacaaggaatccccatgaatcaagttactccatcacagggcagcgacgaggcaaagccattagaagctacagtggttgatgcagctcccaccacttcagaaggcactgcagctcccgcagctgcagaaggcacagcagctcccagcagtgaggaagctaaagcagcacctggcagtgagggaggcacatcgcatccaatcaacgaggaagccacagcagttgcagtttcagatgcaccaggcagccctgatgctgcggctgcggctgctcttgctcctgcagctgataccagtagctcggatgcacctgctgttactcccagtgaagtaaccgtctctcccccttcaaccgacgcacccgagttgaccgataagccatcaccaacagaggcatcgttgccgcctccacctagtgtttctggtgtatagaacatttcagattatttttgcagtgtgccatttttttttgtatgctgccgcgttcgttccactgtaatttttaacccatacatactggtataggcatttgctgccccatggttcaggtatcgcagacgccaggcagtatgtgagtagccctgtacatctgctgtctgcgtctcgcgagaacttgctgccattgtgtcagttgtgtgggcatagcttatgttgtttgtgatcaatccgtaggaccacagtttaattttttgcttgatcagctgcatcaccgataaaaaaaaaaaaaaaaaaa

SEQ ID NO: 8829 - DNA, 4517 bp, Zea mays
  misc_feature (1402)..(1402): n is a, c, g, or t
  misc_feature (1552)..(1552): n is a, c, g, or t
  misc_feature (1628)..(1628): n is a, c, g, or t
  misc_feature (1653)..(1653): n is a, c, g, or t
  misc_feature (1793)..(1793): n is a, c, g, or t
  misc_feature (1797)..(1797): n is a, c, g, or t
aaataagtttttcgagtttaaaaaactatacaatatttatagtactgcaatacacattgttatatataattaatataaaattaattaattttacagttggcactaattaaaaaatggaggagattatgactccccgtgtatgaagtggtttccccctctctcccgtggagagtggcactctagtttggaagtccaaataccggagaggattggagaggctaaaatcttctccggttctgtggctcccaaattagctctaagagtggattgttcaacggattcgaggatcagttacattgtacccgtttaaagggacaggaagcgtgagcgggaatggttgaagaatgtctaagggtccgtttgaaactgctttacctttaaaaagtttggtgaattcggtgaaacatgtcattagaagtttcaaaaaatcgtgaagttaaagttgtgcgactttagaagacatttagataagttattttttttattatttacagctaaaataatttttaaaactatttagatttaaattataaactatttagaagctaagagtgctggtagtctggtactatttacacggcattttagctaaaaaaaattgtctaaatatggtgctaattaacagggggggtctatcagagtctaggtcgccgattgcatttgccgcagtcgcaggataggtctccaagacgataggctgaatgcccaaagaaagacgcatattcgagctcccttgagagctgagacaacgttgatgggcgacgagcagcatagcattgaaaaaggtgtcgtttccaaccaaactaaccgaacccacagctagcacaccgggcttacctgcgtgccggtcttcttggagctaaaatcgagctactagtaccgcgctcgggcaaggttggctcagttgggtgagccaacggtgcctgatgaggagatccctgtttcgctgaccttcccgtcttgaagcctctcagtacagtagtgcctcgtcgtggctccagcacggcagccctcagttttctcgcttcgtcaaaactactctgacggcctttgtaaaggcgctgtcagaccagagcagaccaacagttggccagcttcatcaccgccccggtcgtccgctagcatggggtgggggtggccacctgacctgccgcttgtccattgcgagtagatacgatgcagccaccatacatacaggcgtcatccctcgatcacctggcacgtctcgtctcgtctcgtcgtgttcagcagcgtcgccgcgggtagtcgcgcgtacgtacgtcttggtcagtcagactagctagtagctaggcgggcatgctgcgcgcgtacgtacgtgtgtgttggatggcctgcgcggcgacggcgacgatcggcagcaaagcaagcagctaatataatngatgacaacaccacccctctctcgtagtatatattcaatgtgcccgtcgcgtcgcgtgcattcaagggtctccccgcgcaagtaggtgaggaaagccgaggctccagctgcccgtcgggtttggagcggtccgctcgaccaaccaacganccctgacggcaatttatgggtgggttagttccggtccggtccggcttcagtcgactccacgcagcagcagccactntggtacgtgcggcgcacgggatggnatcgatcgtccatggattcattctataactgctgctgctgctactactagctaggggcagccgtcggtcagtggagtgttgtgggtattgattgccgtccgtcgacggcttcaatcgctgcccgttccggtgcgactgcncgantgctatataggcatgcacatcgccgcccgccggcccggaaccctgcactgcgtgcgctccatgtgactctcacttatttctcctgtcagcgcagcagcagcagcagcagcctactactactactactgcttttaccggccggtggatcggatcaccaaaccggaacgacagcgatggaggccgggacgtgggcggcggcggccgtggcggccgtggcgctgtacgtggcctggttctggcggatgtcgcgcgggctcagcgggccgcgggtgtggccgctgctcggcagcctgccggggctcgtgcagcacgccgaggacatgcacgagtggatcgccgccaacctgcgccgcgcggggggcacgtaccagacctgcatcttcgccgtgcccggggtggcgcgccgtggcggcctggtcaccgtcacgtgcgacccccggaacctggagcacgtcctcaaggcgcgcttcgacaactaccccaagggccccttctggcacgccgtcttcagggacctgctcggggacggcatcttcaactccgacggcgacacctgggtggcgcagcgcaagacggccgcgctcgagttcaccacgcgcacgctccgcaccgccatgtcgcgctgggtctcccgctccatccacgcccgcctgctgcccatcctcgccgacgcgcgcgtcgtcgacctgcaggacctcctgctccgcctcaccttcgacaacatctgcggcctcgccttcggcaaggaccccgagacgctcgcccggggcctccccgacaacgccttcgcctccgcgttcgaccgcgccacggaggccaccctcaaccgcttcatcttccccgagtgcgtctggcgctgcaagaagtggctgggcctcggcatggagaccacgctggcgcgcagcgtccgccacgtcgaccgctacctctcggccgtcatcaaggcgcgcaagctcgagctctccgccgccacgaggaaggacctcctctcggccacgccgcacgacgacctcctctcgcgcttcatgcgcaaggggacctactccgacgagtcgctgcagcacgtggcgctcaacttcatcctcgccggccgcgacacctcctcggtggcgctctcctggttcttctggctggtctccacgcaccccgccgtggagcgcaacatcgtgcgcgagctgtgcgccgtcctggccgggtcccgcggcgtcgaggacccggcactgtggctcgccgcgcccttggacttcgaggagctcgaccgcctcgtctacctcaaggcggcgctctccgagacgctccgcctgtacccctccgtgcctgaggactccaagcacgtcgtcgccgacgacgtcctcccggacggcacgttcgtgccagcgggctcctcggtcacctactccatctactcggcggggcgcatgaagacggtgtggggggaggactgcctccagttccgccccgaacgctggctgtcggacgacggcaccaggttccagccccacgactcgtacaggttcgtggcgttcaacgccggcccgcggatatgcctgggcaaggacctcgcctacctgcagatgaagaacatcgccgggagcgtgctcctccgccaccgcctaaccgtcgcgccgggccaccgcgtcgagcagaagatgtcgctcacgctcttcatgaagcacgggctccgcatggaggtgcgcccgcgcgacctcagcgtcgtcatcgacgagctccgcggcgccggggagtacgacgcggcggcaagagccaccgcggcctccgcatagaggttcgtgcagtgcaggtcgggaaggaaaccaacggacagattggaaacgtcaaatgaaaagttatgtagatattgacagtaagtaattaaagagtttggtgaggtatattactcaattgggaacaaaaatgcatgtgtaaaaagtccatatcattttgatttgcatttgaatgggaggacgaagaaaagcgggccggagagcaataataactctctcatgtaacctgacggggaggcgccaaattggtttcggcagcttgtgttaatgggccgccaaaactgttgttgtttgtaaaaacaaaactcaagcgatcattcattcgatcacttttaccctttatttggatccactagtttttttaaaaaaaatttgatgtatagcttcttccataaataatgactaaccatccaaaactggttttagttggaagtaatcagttttttggtttttaagaaaccagaaaactagttttttttgtttagaaactggataaaagtcgacctgtttggccttgtttggaagccatatagtttttaagaatccatttctatcttcggtttctagaaactggttaatgatgtttggattcatcttaatttctataaactagtttagctaggaaagactagcttcttggtttgaaaccggtatgtttagaaccaatcccgttttcataaactagtttcttaaaacccgagagctttcaaacaggccattagaggccttatagttttaaaaaaacagtttctaataaagagggtggatccaaacaaggcttagtctttcattggaacgttaattagctttaaataaaagtttaatagtattgatttatatatatacagaaggactcacgtggtgcagataagagaatcatcttagtcattgctttctctctcccctaagattgcacgcgttcaagacgtcgccgca

SEQ ID NO: 8830 - DNA, 6587 bp, Zea mays
  misc_feature (4778)..(4778): n is a, c, g, or t
  misc_feature (4889)..(4889): n is a, c, g, or t
  misc_feature (5462)..(5462): n is a, c, g, or t
atggtactatatggaagcgttgcgctgcgctagtgtgactttttatcgtgttggacttagatgatatcctacgacacacgaaactagtgctttacagaaatagagatagatggccgcatcatcgattcatttgcaattcaggtgctgccatgtcatagtagtaccacgaactgccgccatagcgcgctcctaggtaaaatgagttacaagaccccacaggatgacaaggactactttaaggccgtggtgcttgctacttgctagggttggttggtcaactagtccaaccataatcaccatacatatcgatcgatctattagcccctcaacaaacatccagttagctaaagacgctctaaccaactatacctgttggcatgcttgtgttgtaggtaagaacgtgtaagctgacgactgacgatatcccggatttgacatgttgtagctaaacacgcacgatgcgttgggctgaggattttgaagcaagccaagttgtcaacagacgttcgtgggtatgggccgttcgcccaacaccaccaaactactgcgaactccagccgggagcccaaccaacgtatcctcccccgttcatcttcttctccctcccacacccacaccacctcatggtcaaaacacacggcgccgcccgggcctgggcgtacgccggcacggctccacggccatctatttatgccacaggtctcgtccaagcccgtctcgatggcacgccacatgcttctgctacctcatctctccggatcagccagccaagccaaccaggcgaagcagcagctagcattcactccacctctgcatcgcggtcgcgtttctacagtgccactactatctagctccaccacactgatcggtcggtctcggatccactgagtccactcgcgccatcctcgatcgatcggtggatcccccgtgctgtacgacaagccaagccggttccagctagctgcgctcgctcgtcttcaatgcctccccggccgtgcattcaatggccttggcacggttagttgcgcgacgtcgcggcagattggccagtgcgatcgagcccgcggatcggaggccagctgttggcgggtaagacgccgcgcgcggcccggccagcgaacgtcccccggcggcaatttatgggcgaccgcccgtgccgtttctcgttccaccgcctactagccgccaccaaccggccgcctcttcgccttcgccggtgaagtgttttgctttcgttcatcagctgctgatgctcgatcacccgtccacagtacatgtgatgtacagtacgcacgcgtacgctgctgccgcatcaggaacggcagtttttttacacgctggtcgttgccttgcctgttgcctgtagtgtaggaaagctttgcagcttgagctaggggactccgggagggagtatagtagtggtagtagtgtgtgtacgtacagtactgtgccagcaattaatcaccatccctctcaactgtgcaagctcgatccgaccagttctataaaacctcgcctgcagcacccgccgggccggcacctcccatatcgtcattgcttgctccatgtggagtcactttattactgcattacactagctagctagctagccacagccagcttcatcttcacgtcgattcgatccatcggtgctgtgtgtaccgtacgccagcttgctgatccatcgccggccgacgatggaggtgagcacgtgggtgatgctggtggcggccgccgccgcggtacatggcgtggttctggcggctgtcgcgggggctcagcgggccgcgggtgtggccggtgctcggcagcctgccggggctggtgcagcacgccgaggacatgcacgagtggatcgtgggcaacctgcgccgcacgggaggcacctaccagacctgcatcttcgcggtgcccggggtggctcgccgcggcgggctggtcacggtcacgtgcgaccctcgcaacctggagcacgtcctcaaggcgcgcttcgacaactaccccaagggccccttctggcacgccgtcttccgggacctgctcggcgacggcatcttcaactccgacggcgacacgtgggtggcgcagcgcaagacggccgcgctcgagttcaccacgcgcacgctacgcacggccatgtcccgctgggtgtcgcgctccatccacctcaggctgctgcccatcctggacgaggcggccaccgagaagacgcacgtcgacctccaggacctcctcctccgcctcaccttcgacaacatctgcggcctcgcgttcggcaaggaccccgagacgctcgcgccgggcctgccggagaacgcattcgccacggcgttcgaccgcgccacggaggcgacgctcaaccggttcatattccccgagtgcctgtggcggtgcaagaagtggctgggcctcggcatggagagcacgctggcccgcagcgtcgcgcacgtggaccagtacctcgccgccgtcatcaaggcgcgcaagcttgagctcgccggcaacggcaagtgcgacgcgccggcgcacgacgacctgctgtctcggttcatgcgcaagggctcctattcggacgagtcgctgcagcacgtggcgctcaacttcatcctcgccggccgcgacacctcctccgtggcgctctcctggttcttctggctcgtgtccacgcacccggacgtggagcgccagatcgtactcgagctgtgcgccgcgctcgccgcgtcccgcggctcccacgacccggcattgtggctggcgtcgccactcacgttcgaggagctggaccgcctggtctacctcaaggcggcgctctcggagaccctgcgcctgtacccgtccgttcccgaggactccaagcacgtcgtggccgacgactacctccccgacggcacgttcgtcccggcggggtcgtcggtgacctactccatctactcggccgggcgcatgaagacggtgtggggggaggactgcctcgagttccgccccgagcggtggttgtccgccgacggcacccggttcgagccgcacgactcgtaccggttcgtggcgttcaacgccgggccgaggatctgcctcggtaaggacctcgcgtacctgcagatgaagaacatcgccggcagcgtgctcctgcgccaccgcctggccgtcgcgcggggccaccgcgtggagcagaagatgtcgctgacgctgttcatgaagcacgggctccggatggaggtgcacccgcgcgacctggccccggtcatcgatgagctccgtggcgcgggcgcggcaaggccggccatggcgccatgctgcgcgtagaagatcccccctccgtgctgcgggggagacgctgggaattcaatgtgtagataagcgtacaagtacaagacaggagtaaagtaaaaattaaatgggtttggtgaggccaaacaaaaaaaaaaccttttatccggaatttaccattattctgggagcagcgagatgagaaattttttgcgatctagctggatttggatctgagcttttacaaattacaaggagtgggaggaaggaaaaaaaacagagagtaataaataattcgtgagaacgctgaagatttgatttgctacgattctttgaaattcgtcatagttttttcaagcctactaatatcctatttttagagggggctgtaaaatttaccaagaaacgtgtaagtaaccatgtattgtaagtttatttgcttctttgataccatcacttcttcatgtgcaagcggtcgaggcatcatcctgtagcgtgttggctgcgttgctctcttgccctttttgcattcatcgtgcatcctttttcggtcgtgctgtgcatgctcatgctcacaccggtgtcttgatttgatgacatttgtagttggcgccgttcgttctggtggaagggtcaagacctttaggtagactggtagagctagctactgagagaattgccggcgcataataaaggcgacgtcgctgactgaccacggcctgcagctgcgggttcgttatgcatacactcttctcgtgacgacaacgatgttctgtttcaaaaaatttaatatacgtactccatattctggatgcgtaggagtatagtgtacgcattgtggatcgtgagacacgcgacgatcacgttcggatcaaaggttctgacgagacaaaagtccagacagttagttcagtcgttgagatgtggttgctcaaccatatgatctaccacttgcaccaattaaattcgtcttttacgtgtaactcaaaagataatctatgtcgtggttcatcggctggaagaactaacgctgcaataaacactctttgtttctcgatcgaggaacgcgcgggtgcaggaacaaggtcgtgcgaggcaccagttagcttttatttggtggtgcaagcctgtaatttgctcgtacgtccaacaggaccatctacctgcctctcgtagtggtagtaccagtacacgggcatacggcacagtcgttaatggacggccagcggatcaggattcagggacaccgccaatgtgggaatcatcgtaagtcggtgaatgaaaatgagtaccagtttggttcgagtgactaaaacagactaaaaaacattaattggagcaaataatgattgcattacccctattaattagtagacgtttgctgcactaagaaagagaagagagcaaataaggtaaaaatcttactttaacctcttttagttacccctttggtgactaaagaacttaagtttaatcaccccactttagtcaccatgtttgcttctttaagnactaaaaatgactaaagtttagtcgccccaaaccaaacggggcccgagaacaaaagacataaggattgatactaaatggtatagacaagctagtgtggtagatctcgtcanataaaataaattcaaaattagagtaaattttttccataaaaataaaaattaaagttggacataatattaaattacaaatactacactttatcttatccaaaaggtcgaaaatggtttcgtgttgtgttggatttagtattttctcacgacctatgtgggaggtaacggtccatgttacttgactacgcacgacgacggtggaatcgtgaaaactgatgcttataatagtagagaaagattgtattgattgttgtatgattaagtgacgaacaagcaatggcgaatctataaatggatcaaaggggctaataagataagactaaaattcagtataaactaaatgatataataaaatagcaagctataattcaaatcttcaagaaccatatagaccacataagtagatataaaatctataaatacaatactcagtacatatcgctcatgtattgtgtttgcgatgtaaatttgtcttccaaaaaaacactttaaaatcttcttgtcgataatgtctacaaaaaaaatatctcgctcaatatatcataacatgttattattcatccactcatcacntagtttgtttcttctttcggtcttgaatcttgatgatcttcgtgacagaggaaggcaagagtacaaagcaatggcgacccacactcggctaaccatggcactagcgacatggtgacaagcgattggtaccttgaaatgggcaacctagccgaatagctaatgtcgcctatcgtcctggagcctgtgcctacctttcatggccactccatggaggagatagatggcaacaactagacaaacaatgacaactgatgcagagcaatgacatcaggcatcaggcgactagtgttagaacgcaaacagagatgaggctggtgtcgtggtacgcatgtgtcagatgcggatgtggctaatgcgcggtgggttgtggaggtgggcatttaggctgctctgaatagttgttcttacaatttttattccacgaccaaaatttccgctcgcaatcgtcaccaaccatggctgactacccgctaaagagacccttgatctcttcaagaagaagttagagtttccttgtccaaaccaagcattccctatcaagcacttgtacaaggattgcagggttacgaggaaattcttaagcaggccgagggagggacggctacgtgaaaaggggaccccgaccaaagacgatgccgacaatcgggagggagacaaaggttttccgaagttggacgcttgtctctaacccgcgtcgatggcgtatgatcattgctaaaagcggtgtcacgctcgctagcttccccgatgttgtgggactcaaaggtcggatgagtggggggactagtgttccacctataactgtgatagacaccaaagtttgccatcacagtaggtttgccctctttgatacgtaaagttggacgagcaggggtacgacattctagccagactgttatgaacacgaagctccaccaccttgccgagttcaagttttgcgaaacatagggtcaaacaagttgtagcgggagcattgcagctagaaccattgtggacaacaaggtctgccaccctagcgagttcaattcttacatctactcacactttgtcattcagagaacaagctgatcgacccattatcatgttcttgtgaacatgaatggtctcgacatcgacgcactgcag

SEQ ID NO: 8831 - DNA, 4419 bp, Zea mays
aataaagaagtctcctaggtgcacaccacacgcacgtacacttgccatgttatgtgccgcaagcaacaagcaagtcgtgacgacgggccgaaccgaacgacatcttcctccggccggtttcttggcttgtttactcgtcagcgaatgaaagagaaaaaaaaaagaaagaaaaaaaaagagggggctgggcggctggcacgagaggcgtggtccacctgcccacccggcgccaactgggcggtccggtcggggtatatttgcggtggccggggggcggtcaggaccgcgttgccgcctccttccttccttctcacgaaaaggcaggcaagggaaaggcaaaggacaacccatcccctgcctcctccgttgctctgctgctccccctccttatctaatcctctggttcctggacaccggcctgcaagctccagcagcagcggcgccggcgacgaaaggaggaggattgctaccatcctatatcatatcatacatatacacaaggaggaggagaaggtgtgtagcgaggttgaggtccggaggatgccttccagtgccatgagttccgggctggagccggtgctctgcgcgcctcggccgcgcagggtccagcagctgcacccctgcagcgccgacctcatccttggcgcaccgcccttcccgcgcaacgccaacagcaagggacgtacgcgctcgctcgtcgctcctcccccccaagctcttgttgttcgccgtcgcttacaaagccgtgctcttcctcgctctcgttacaggccagcggcagcagcagcagggaaggaggcaggaagacgaccaggccggcggcggaggacgaggactgccgctgggcggcgttcggcgggtcgccgccggcgcgcgcggacaacccgctggtgcacgacccccggttcctgcggaacccccgccacccggcgccgctggagctcgggtcgccgaaccaccggcggccgacctacagcagcggtggcgacggcagcgggtttgcctcgtcgtcgttcgcgccggccgtgaggatccagggcttcgacgtcgccgcgtgccgcgcgtgagagcgagctccggccgggcggggctttggcttttcgatctattaaattaaattaacagcaggtgaggtcaggtcagatcagatcatagtagggaggaaggcgaggagggcgggagggatgggatgagatctcctcttcctcctcctcgcgagggaggcgatccagtcgtatgagtgaagtaaagaagagtactccagtcgtactataggttgatgttcgccgataccacaccacacagcagccggtcaaagggagtgaaaactgattttttgtttacggggttttgtcagcaaggttattaggttttgtgtttgtgctgtagcctgtaagatgtaagctactactagcacgggtctcttgttcgttgctgctgctctgctctggcctctgggtgcccctgtattgtagatataaatcagcacccagttcgggcggtcggccagcgttcgtttttcttctagttgacgaggaggaagaagatgtccgctcctcgccatgtaatgtaaccatggctgtactcctacatacatgcaatcatgtataaagatgaaaacgtgtacatacacaagatgaaagtggcatgcagtgatgatctatcagaaaatgagaatcctcgtcgtcctcccgtgttttggttccagcagttggatcccctccggcccctgggccccgctgacggtagggtagaggcctttgagccgtcgaggtggtgcgatgcgattagtaggcgactaggcggaggagtggtgacccttcccccgtgcgtcgccaccgcggccattgaccgaccgccgcgccacgacgaggggggggccgggggaggaggatagagtagcgttgattgtggcctcggcttcgaccggaccggcggacggcgaccggcccccccccctcccccgcgcacgcaaccacgtcgcggcagcaccgcccgcgtcgccgtcggatggcccggccacgggccacggcagggcagtacgtacggcctcttgttttcgcctcgcgtctggaggggccgcggagggagacccagcgagcgaaggatcagatcagggatgggatggaatcatggaagcgtcgctgtcggcggcgaaggttcccatgccaggtcctcgggctatgccgaggccgagcccgaggcggaggcggcgaggcaaaaggccagagcccagaagggtttgacgtgacgcaccgcttgcctgtgtccgcctctgttgtctccgcctggcgcctgctcgtcccgccttcccctcctcttccttgttccggccgtttagggtttagcaattctcaccggtggactaaacgaaccgttcaagtattaaaaacaaggggctggggtgtcaggtgtcagcagatccgatcatacggtcatatcccgattagtttgaccaggccacgccacgagcgaggccattgactatgctaatacacgattgagtttgtcgatgatgaaggacgatgattcctgctccaaaattttaaaaaaaacaagtcggtgatgatggatgatgattcctgctccacatttttttttaaaaaagaaacaaagagcgaggaacagggaaaaaggcgggcacgggcttgtgctcgcgtgcactcttggcctgggtgtttgccccactcccactggtgtgccgacatcatcgataggaacggcggatgcatgcaccgcgcgctcccttgtcgccctcggggcccctcaatttcgtgacgatttccttcccgttctatattttattattattttaaaaaaggagccacaagaaggaggaggaggagcattctatttggcaggcgagaaacgaggccatttccaaaggagattaagtgcggtatggctgataatcgacgctatccactggacctaatcctctcagtctcagccgtgactccctctgctcatgagctcatctgcttgctatcaccttctaacgtgcctggcaccgccacgtggcacgacgaaaggagaagagcgatttcactagcagtacctaataaaagcgaaaacggaatggaactgctttgtaatgtacctgcactacacggggggagagaacaaagcgagaaatgagcccactcgtaaaagacaaggcacaccattcggttccggcttctaatgcttcttcagtatttttatacagctatagcagtcgactttaatccgaagttatacacacattccaccgtgtggtgaatggtgacactgagagcgacgtccatagacaacaaacgcatatcagacaatctctccaactatactttgctctctcgtctcgaggtgagctcagtcatagtttacggtgtccaaattcgcaaatagaaacaaatcatgatgtttagagaagtagaaaccacgtctcgtgcaaaggaaaaacatcagagtcaaaagaggaatcggaccaaagagctgaaacaaatgctggaattgacgctccatttatgttggcgtatgaaaaccgacgccaaaataatctgggggaaaaaaaggtgaggcccaataaaacgcctcaggggatgggctgcccacaggtctggctaagttaccaaaccagcccgacgtttatggttctgttgatcattcggtgcattggatctgtacccccaatagcagacttaacagagaaacagcttaccaaacccaagtcctggagccgaaagctgcatgtaacaagtcatcactaaacccttcttaaaaaaaccccgtcactaaatcgtcattatgtagttctccttgagttcgtccaagtccaaacacgtcctttctaagccctgatagggacacctgagagagcaaccagacctagagaaagtaaatcagcagaattaatcttacgcgtttactacttctcaatccactggccacgctgcacgtagtaaaaataaaagattaaaaaactttgaaagttcaactcacttgcgcacacggtcaatgatcttatccccttcggtcattcagcttgccaatctttccgagcaattttcacacgcttggccgcaggtggtaaatattccagaaggctagaagccattatcacgaagacttttctctgcacggatcctgcgcaataaagaatggtcaaagtccgtggtgcaggcctgcaggacagcacgaaagggagttaaaaccaccgagtgacgaaagaacacttcggctcccccatgttttcattccagcaatagctgtccgtagtattgaagtttccaagtcaatattgttggcagtttggccgttacacactgtactaatatcacgactgtttacataatgggaatgcaaattcaaacttgcataaatgaatctccaacttcaacaagtaggaaagcaaagttcactgcatagggaggtggaaag

SEQ ID NO: 8832 - DNA, 908 bp, Zea mays
cctcgaggccggccgggccgggccgtgtgcatagcagcaaatagtggttggcctgttggtactctatatcgtcccttccagtgtacccgtcctccagcccattatacatcatacttgctccagataagaccaagagcgtcatggccaacgccttgcctctcatcgtcgcgctggtcgccgccgccgggtgcgcggcgctggcttcggccacgtcgtacaccgtcggcgactcgcagggctggacgaccaccggcgtcgactacagcagctgggccagccgcaacactttcgtcgtcggagacacactagtgttcaactacgtgagcaaggcgcacacggtgacggaggtgagcaaggccggctacgacgcctgctccggcgccaacgcgctcagcgacgacgacaccggctccaccaccatcacgctccagaccccgggcacgcactatttcatctgcaacgtccccggccactgcgccagcggcatgaagctagcggtcgccgtctccgcctcgccctcgggcacggccccttccaccggagccctgcaggttccggcgatggcatccgtcgtcgccgcggccgcgggcgctgccatcaagctcgcgctcttctgacggagcacggccgggtcgtctcaggggagagacagtgcatgcagactacgttcttggcggttgatagtttcccgctggcgattgttcgccgcgcagttcatgtacgtatgtatgtgtgtatgctactctgcggtggcgaatgctttttctgatgcctctgtcgttgtgtgttcatcaccgtcgtgtgcgattgttctttgggttgtctttgcctcaataaaactgcttcattctccagtattcaaaaaaaaaaaaaaagcaagtccgcaccccaccgcactgagtacaaaa

SEQ ID NO: 8833 - DNA, 2515 bp, Zea mays
tcgcacgcagcacggcctccgatcgatttcctcttgtccgcgtgtcccagcgaatcgccgccatgccgcgcccgatggcctcctcctccgccagggaccgggcgaaggattccgacccctcatcatcctcggcagcggcggattcctccatggcatccctaatcgagcgcgccacctccaccacggcgcacgccgtcgacccggtgctcctccgcgccatcaaatcttcggcccgtgcctccgatgccgccatccgggacgcgttccgcctcatcctctccctcatgtccaagccccactcccacgtgcggctcctcgccttcagcatcgccgacgagctcttcatgcgctccaagctcttccgctccctccttgctgactcgctcgacggcttcctcccgctcgccgtcgggttccgccgagcaaaccccctcccgccgccgaccacgtccgctgccttactccggaaggccgccgtccaggcgctcgagcgctggcaccatctctttggtgcgcactaccgccagctccgcctggccgtcgagtacctcaaggagtccgcgcgcgtccagttctctggtctgcgggccaccgttgatgctcgtgcagctcgtgaggctcgcatgcaggagatctatgctggcaaggttgagcagttgcgtgaaaaccttgcgtcaatcaaggcggagattcggtccacgattgatgagattcgcaatggattggagatcatccgtgctgaacataagaaatttgagggttattatgtggatgacgaggaggagattgcatccttgtcaatgcggagcattagaacagcatcattgatggctggggagtgggtgcctgagactcaggagaatgaggcagtttttgatgcactgagggaagcacaccggttgcttgtgtcaaagcatttggtcacagtacaggagtggataactgtgcttgtgagggtcaaccttccagacaaccgtttccgagattctgcattgaaggatttcattgatgttaagaatgagataagggctgtgagagatcattgcagtgagcttggtcttgaccttgataattttcataggcggaagggtgaccaggaggaagaggacaatgagttctgggtggagggaaacatagaggcaccaaatcgtgctagagtccagagcagtttagatgttgcgagcactagcaaggacactgagaagggaaagtgggtggttggtggagtgtctcacattggcaaggcaccagttgcggctaatggaacgagaaatcttgatccagaaaaatcaaaactcctcgctgaagcccctgtgctgccatggagctctgtcttggatcgctggggctcaagtggggatgtacacgtaaaccagaggggacttgaggtcgagagtcattggggaagagtggataatgatgccactatacctgcagcaaagattgcagagttgaatgttcattgctcaatttatagagaagacccagttgagatcctaccatgccacgcccctctaaaaaaaggaggactttgccagagaagggatcttagggtatgtcctttccatggaccgattgtcccacgtgatgcagaaggaaatccaattgagcagaacagtggtagttctgatgcagaagtaaatcctgttgagcacttagacattggaggacattcaaatgagcttaatggaatcagtgatgatgattgtatggagggaacctcttcaagaatggcaggtgtcaataatgattatggtgacatagctggaacttgtgatctaggtaagattactgcagagcagttagcaagacaatcagttaaaaatgtccggaaaagagaaatggatcgcaaggcacaggaaagggcccaacgtgcaagaatccgtcagcacaatgaagatgtcctgcgaaatgcggctcttgcttcaacttcctattctgcagcagcctatgagcagcctacagaagcacatggtcggcgaggacgccgaggtaaggcaaaggcaccaacgctggcatcgatgctgaaaaagaaagttaccaccaaagacagaattgcagagaggcttctgaacactcgagccacagatgccacagtaagggatgtttctcataatgaagatatgagctacagggaagcatttccaaatcagtggtagcagaagcagttgagttgttcttgtgtaggctggataaacacgttaggaatggaatcgatgttgtttattggttcatactgtcagctaaataatacatattctgttgctatctaaatcagcacagaactgtgagtatgtttcctgatattctgttcttgtacagttagtaggataagttccttgtacatttcccaatgttcagtcttactatgtgtttttgaacttacactgctattgcttgcatttcaaagtgatcttgtttgtaaaacccgtaaaccgtgccctgttaagatgtactccttacataccaaataatcaaattggcaatggattgaacagtaaaaaaaaaaaaaaaa

SEQ ID NO: 8834 - DNA, 1157 bp, Zea mays
gggtacctcgaggccggccggggcttcagagaaaagagagaaaagtaataagaccgtgctgcgcctgcgctgcgcagctccagcaccacagcaccagagctcgatcgacctccctctccaatgccgtctttcatcgacggccccactttccgggcgctgctccggccgtccaccaacgggcgccggaccaagatctcggacagcggcggcggcggcgggggcatcttcaagatgttcaagctcatgcccatgctctcgtccgggtgcaagatggtggcgctgctgggcaagcacaacaaccgggcgctgctggccgaccacgcgacgacggtgacgctgttcgggccgcgccggggccgcgtgagcctggccatccacgaggacacgcgcgcgccgccgctgttcctcatcgagctgcccatgctgacgagcgcgctgcaccgggagatctcgtccggggcgctcaagctggcgctggagagcgacacccgcagcgcgcgccgccgcctcgtggaggagtacgtctgggccgtctactgcaacggccgcaaggccggatactccatccgcaggaaggaggcctccgacgacgagcgccacgtgctgcgcctcctgcgcggcgtgtccatgggcgccggcgtgctcccggccgcccccgagaaggagggcggcgtgcccgcggggcccgacggggagctcacgtacgtgcgcgcccgcgtcgagcgcgtcgtcggatccaaggactcggaggccttctacatgatcaaccccgaggagggcgggaacggcgccgataataacgggggcggtggaggcgccggcggcgcgccggagctgagcattttcctagtaaggatgaaatgaataaaccgtcatattattactgctacagcataaatatatataaatataatagggtgctatattgttttttacacacacccttgtgccttgttgcacacagcagatgtgttctatgaaactgtccatagatcgagtttgtaatctaactgatgtatatctccatgttagataattgattttgtgaatcgtgctgagatcaaaacaaggaaaaatattgttcttagcggagtagcaagaacattattatatatgaaagagagcggtacttcattcggttgaaaaaaaaaaaaaaa

SEQ ID NO: 8835 - DNA, 1014 bp, Zea mays
tcagctacgtaggccccccccccaaataaaatgacaaagccttcaagttccaagcaagttaaggtaggctaaagtaatcctatggatcaagaaaagatacaacttttgaaggggcaaatattaattattgaggcctaagtttgaactgaagatcctccaaacagacgtagtcatatgttggagtaatatataaccgtgtaacagtattcccccacgtttaagatgcaagtttttgacatatgtaggattttgaagatacttatcttcatatatgaaccagcttgtccatactgatgattgcctgtcgacctaacagcttagagttgatggtgtactgatgaggttgagagacactcggttacattgcctgtttggaaacggcgacggagccaagccagtggtacttcgtgagtgctgctggagggaagcaacatttgctactttgtctgcgaaaggatatccttcggactctgcagcgtacgcggacccgaaccttattgcccataagcttcctattgtgacgcagaagacccaaaagctgaaaaatcctacctgactgacacaaaggcgccctaccgcgtgtacatcatgactgtcctgtcctatcgttgccttttgtgtttgccacatgttgtggatgtacgtttctatgacgaaacaccatagtccatttcgcctgggccgaacagagatagctgattgtcatgtcacgtttgaattagaccattccttagccctttttccccctcttcttattctctctgtctaccagtctataaaacgtcttacatttgttgacctgaacaaaaaaacgagtgcgccccccggggccgtcctatcagagcttctgaagaacgtcatacatagcctcacgagtcgtacacaaagcctccagcggaacagccttgggcatcgtcagtccgctgccctcgctcatgtcaacctccacgccatcgactctgctccagtggaagcactggatgagggaccccagcgccaccccaaccgtctgca

SEQ ID NO: 8836 - DNA, 6468 bp, Zea mays
ctgcagttgacgtgtagcagtgaatcatagccatcggattctattgaacggtcgacaaataacagccagagtgccaggtgctgtagtagtagtacaacggggcagcactgcactgcactgcaactgcgaatttccgtcagcttggagcggtccaagcgccctgcgaagcaaactacgccgatggcttcggcggcggcgtgggagggtccgacggccgcggagctgaagacagcgggggcggaggtgattcccggcggcgtgcgagtgaaggggtgggtcatccagtcccacaaaggccctatcctcaacgccgcctctctgcaacgctttgaagatgaacttcaaacaacacatttacctgagatggtttttggagagagtttcttgtcacttcaacatacacaaactggcatcaaatttcattttaatgcgcttgatgcactcaaggataggcagcgtatttaaccaattcgtgtgtgcttttcctgtctgtcataccctccctctctccctccctttgatctgattaatcatgtcacattagttctttgttcgtcactcatggaatccacatacgtttcaattttgtcacactatgcttgtcttggcattcaatttccacatggtggggactggaggtgatgctacaactgtgaatcctccgccgtcacatcaatggatcctccctggtcacataaatgataattgatcattagccaatcgtgtcattatatcaacttttctattgttacattcagtcaggaaaatgtgcacagtaaaattagaattgctttattaaatcattgctactttaaagcaagtgcggtatgctgctagtaatattggacctatcaagtgtctactggtgttacatctgtaaaatctttagtattaaataaatgaatattgctgctagggaaagctaatgctaaattctttaatgtttgctatatttttcttcagctttgaagatgaacttcaaacaacacatttacctgagatggtttttggagagagtttcttgtcacttcaacatacacaaactggcatcaaatttcattttaatgcgcttgatgcactcaaggcatggaagaaagaggcactgccacctgttcaggttcctgctgcagcaatgcggaagttcagaaggtcatctataactgtaattcattttagtactcaattcagtactaccgagcatttgtagtgaaagatgttaggttagtttggcatcacccaccctgtttgaaagcagtccactttgtcttaaagttttcaaggttatgttcacaatacagatttgtggatggaaataattaaataaatttatttactttgtatcttgcattgtttcaagaaaagtacaatagcacacagtttgaggtgtttatattggtcttagctgaaaaaagaagttcagataattaaaacatcatgcgttaatttgtgagttcattaaaaagcctaagcacgggttgttttaacttgttttcttgcagtaagccttctgaccaggttatacttgactacgactatacatttacgacaccatattgtgggagtgatgctgtggttgtgaactctggcactgtatggacctgatctctgctgaattagtttgatcagttttgaaattttttatatctactcccctgccctttcacattttagtggtataatccactgacaaatagttcttgttcatatactttcctttccagccacaaacaagtttagatggatgcggcactttgtgttgggaggatactaatgatcggattgacattgttgccctttcagcaaaagaacccattcttttctacgacgaggtatggagatggaacagatggttcataatttatctggatactggtttacccctgacaggatgtatgtaggttatcttgtatgaagatgagttagctgacaatggtatctcatttcttactgtgcgagtggtatgtggaccccaatgatgcttttctgtcccctcgtcctcaactgtaatgtgtgtgtgacaacattgtcttttttgttcaactcattgactaatatgcttcttgattgtatgtgtgtgcagagggtaatgccaactggttggtttctgcttttgcgtttttgggtatgttctaataccttgcttttttttggatttgatgcctcattaacatgaagacaatttctgagggtgatgtattgctaataagatggaacctgttagatttgtagtgagtttgtgacaattcagactcagatggttgcccagtgttctgttcctcttaagccgatatttttttcaggaaaacttgtgaagagctgttcattaaataacttcactactcttgtgactgactttatgctgatcccttcgaaataaaatgacaaagccttcaagttccaagcaagttaaggtaggctaaagtaatcctatggatcaagaaaagatacaacttttgaaggggcaaatattaattattgaggcctaagtttgaactgaagatcctccaaacagacgtagtcatatgttggagtaatatataaccgtgtaacagtattcccccacgtttaagatgcaagtttttgacatatgtaggattttgaagatacttatcttcatatatgaaccagcttgtccatactgatgattgcctgtcgacctaacagcttagagttgatggtgtactgatgaggttgagagacactcggttacattgcctgtttggaaacggcgacggagccaagccagtggtacttcgtgagtgctgctggagggaagcaacatttgctactttgtctgcggtatgcaaatcgctggaaccaagcactttctttgaatgagattaagtgggcaccatcttttatctcttttctataatgcagaaaggatatccttcggactctgcagcgtacgcggacccgaaccttattgcccataagcttcctattgtgacgcagaagacccaaaagctgaaaaatcttacctgactgacacaaaggcgccctaccgcgtgtacatcatgactgtcctgtcctatcgttgccttttgtgtttgccacatgttgtggatgtacgtttctatgacgaaacaccatagtccatttcgcctgggccgaacagagatagctgcttgtcatgtcacgtttgaattagaccattccttagcccttttttttttcctcctcttattctctgtctgccagtctataaaacgtcttacatttgttgacctgaacatgctcacgagtgcgcactccgtgaatgtcctatcagatcttctgaagaacgtcatacatagcctcacgagttgtacacaaagcctccagcggaacagccttgggcatcgtcagtccgctgccctcgctcatgtcaacctccacgccatcgactctgttccagtggaagcactggatgagggaccccagcgccaccccgaccgtctgcagcgcgagcctctctccggggcacttgcgccgccccatcccaaacggcgccacgaacagcccctcggctttcccgccctcgaaccgctccggcacgaacctgcccggctcctcccacacagccgggtccctgtggatcgcgtacacgttcaccagcagcgccgtgccgcgcgggacgtcgtagccgccgaccttgcagtctgccgacgactcgtgcgggagcagcagcggcgcggcggggtacaggcgcagcgtctcggcgatgatgcacctgaggtagccgagacgcggcaggtcgcccgcgttgagcaagcgggagtgccccacggcggcgtcgatctcttctcgtgccttctcgagtgtccctggattgttcagcagcagcgacatggcccattcgacggtggtcgaggtcgtctctgttccagctccaaataggttcttctcaaaaaaacgatccgacgttcaaccatcgtcagtgacagagaagagaaccaacgtctctgtactaggctagccagtcgagtatccggtgaaaaatgaatcgaacgaaaaaaaaatgaatccctcaccgaacagaaagccgtgatcacggtgtcggtgtaaacctccggctccagcttctgcagggcgagcagcacggcgatcaagctcttcttctcgccgcagacgccgtcggccatcctccgccgctccgcgtcgatcagccgccgcagaaacgcgtccctcctgctcaccgcggccaggatcctgctcctcacgccggccacgtcgaaccaccgcagcaccggcaggtagtcccacagcaccgagctgacgtacgggaagacctcgtcgatgacccgcttgaactcctgcgcttccggcgacatgtcggtggtgccgtccgcgtctggctccggctccgggtcccggcgcgccgccttggtctccgcgatggcctccatgaggacgctgagcgagagctcgaacagcctgcgcttcagctcgacccgcgcgccggcgcccgcggccgcggcagccgcgcggtgcaggcgccgcaccatggcgcgcacctcgccgcagatgacgcccgacatgcagccgacgcggtgcgccgagaggagctgcaccacggcgacgcggcggaggtcgcgccagcgcggcccgtagctggccgtgccgagcgcggcgccgtcgaaggtcacgagcctctgcgagggcagcagcgagcggttggcgaacgtcacgtcgtgctccgtgaagcactcccgcgcgcacgccggggacgtcaccaccgcggcgtcgcgggagcccaggcgcagcgtgaagaccggcccgtggcgctgcgcgaggccggacagcgtggcgtggaacggcttcttgatcaggtggaggtggccgaggaaggggacggcgcctggagggctcggcggcggccgccgcatgctcctgctcttgccgtcgcgtctggcgagaccatggacgcggcgtaggaggaagaggaagactaaggagagaatggcgatgtaggccgccagatccatcatgcttgttaagcttaagcttagacgtgttgcgtttgcgtagcagcagcgtgcatcatgagccatatatatagccacgtaggaggagggagactacgacacgtacgacgcgagtacaaaacacgtcgttgcatgtggaagtgcaaggaacagtgcgcggtatcgtatcggtatggacgatctcctggcgtgtgcctctcggtgcctgacgacatccgagccgcgagcggcgagtgccgagtagtggcgagcgcgcgacagggaagttgcaggggggacggtagaggccgggcatgcgagtcccattgacatcagtggctcacgctagctctcgtgtcatctgagtgcagttttctctgcgccgacgtcaccacgaattgtacttttctctcctgggagtcttgttccaactttccggttggttgggctcactccatgttctctggacgaattacccatgttaacgaatatattattgcactacatacaacagtggtccttgtgtgttgctccatgtaaagcgatgagtagccgcggcaacgtcaaaaattaacaaactacttacttaggagcatttcattaatgagttaatgaatgagcggcctttgaacttgtcgatagatgtcacttagattcacgaactttgaagatgtattaagtggaataatggtcggtatgaactagcacctacagaaagaaagagctagggataccgtattgggataccttgaacactttgtagaaaggcactcgaagttccagattagcataaataagttcctaaatacctaccaaacatataggcgacattttgcatgatagttggtcaaataagccttaagatggttgattaaaccatagaacaaacacatcctagtgctaatttcgattaggctctcactctactacttgcaaacatgtcataacctctagttgattaagggtcataccttgattgagcatcgggcgtgattgacaaaggttgctcatggttttgtcaccattcatgtcgagaatccgtctttagacttcgagagcgcgagtaaatataggtactcataactctcaagcatcttgataggttaatctaatgtattgtggtgctacaaagactaaaaatatttagattaaattaaatacatggtagcccccgagtgtctcaaaggatgttaagaataccttttgggacattcaaaacactactaacaattcttattttgttgcatcatactgttttacaatgaaataaaaataaatgtattcacaaaaaaaacacatagcaggtctatgttccacatgatcatgaagactttgtcgtccatcatttgtatcttgtaagtcaccgagcatagtactttagtcacgataaatggtcccttccaaagaggaaaaaaacttgttcatgttccttatcgactgtacatgccaatggaccaagtcacccactttaaagctaagagaccgaatattctaagcatcttgtagttaaacttgtataaac

SEQ ID NO: 8837 - DNA, 1308 bp, Zea mays
gcacgagaccattacctagaacatcctaatcgaagaagtagtacaacggggcagcactgcactgcactgcaactgcgaatttccgtcagcttggagcggtccaagcgccctgcgaagcaaactacgccgatggcttcggcggcggcgtgggagggtccgacggccgcggagctgaagacagcgggggcggaggtgattcccggcggcgtgcgagtgaaggggtgggtcatccagtcccacaaaggccctatcctcaacgccgcctctctgcaacgctttgaagatgaacttcaaacaacacatttacctgagatggtttttggagagagtttcttgtcacttcaacatacacaaactggcatcaaatttcattttaatgcgcttgatgcactcaaggcatggaagaaagaggcactgccacctgttgaggttcctgctgcagcaaaatggaagttcagaagtaagccttctgaccaggttatacttgactacgactatacatttacgacaccatattgtgggagtgatgctgtggttgtgaactctggcactccacaaacaagtttagatggatgcggcactttgtgttgggaggatactaatgatcggattgacattgttgccctttcagcaaaagaacccattcttttctacgacgaggttatcttgtatgaagatgagttagctgacaatggtatctcatttcttactgtgcgagtgagggtaatgccaactggttggtttctgcttttgcgtttttggcttagagttgatggtgtactgatgaggttgagagacactcggttacattgcctgtttggaaacggcgacggagccaagccagtggtacttcgtgagtgctgctggagggaagcaacatttgctactttgtctgcgaaaggatatccttcggactctgcagcgtacgcggacccgaaccttattgcccataagcttcctattgtgacgcagaagacccaaaagctgaaaaatcttacctgactgacacaaaggcgccctaccgcgtgtacatcatgactgtcctgtcctatcgttgccttttgtgtttgccacatgttgtggatgtacgtttctatgacgaaacaccatagtccatttcgcctgggccgaacagagatagctgcttgtcatgtcacgtttgaattagaccattccttagcccttttttttttcctcctcttattctctgtctgccagtctataaaacgtcttacatttgttgacctgaaaaaaaaaaaaaaaaaacgcgtgacgagttctctctctcaaaaaaaaaaaaaggcggcc

SEQ ID NO: 8838 - DNA, 1676 bp, Zea mays
cattgccgccctcgcggcacgtccccgtcggccatcgtccacggatcctatcggtctctcctctgtcctcttcagtctccacgccgttccagaagtcgccaaccttccctcgccgccgcgccgcaacagccgcctcccctccaaggtagcccaatcgaaaccactcgcccgaccaccatggcctttgccagctcgctgcttcccgtgccgccctcccgcgtctgcgcgacccccgcgtcggaggtcgccgccttctcgccggccaagaagagcgtctcgctcgccgctgcgcgccagcgccgaggatcccgtcacggagtgagggcagaagtaaatgaatctggaagtgttttggctgttgatgcactctcgcaagttaaacatgttctgcttccagtccttgatcgcaacccttacctttctgaaggcacaagacaggctgcagcaacaaccgcttccctcgcaaagaagtatggagcagatattactgtagttgttattgacgataaaccaaaggagtctgtcccagagcatgatactcaaatgtcaagcattagatggcatctctcagaaggcggattttcggagtttagattgatggagcgtcttggggaagggcagaaaccaacagttatcatcggggaagttgctgatgagtgggacttagacctggttgtgctaagcatggaggcaatccactccaagcatgtcgatgggaatttgctcgctgaattcatcccttgccctgttctactgctcccgctctgacatagagctgatttgcatctgtcatgtttttttgagacaaatgatctgtttgtccttgaagatgtaactcccgcatgttccctggatacgaggggtttgcgtcagctgatgattctattatgttgatgcagtttttttcgaatttgtgtgcctgtgaatattgctaagaaaattatgttactcttttctttatttcttctgaatgagcagtttcaggcatatgctgctgctgcggttgggcggccatgcgttttttggggtgtttaaaagaaccagcatgtttaaaagaataaatcagtattaatgtcagacaaacagagaaaacaaataataaaaacatttggagatgcggggtatcgatccgttattcattgcattgcatgcagtaattaatctagagaaaactttctttctcctcgaatcttttttgccaaccatgtcatgtttccatccgtgcagtccagagacttgatcgccatggacgacatcgtatcgccatcgccgtgctgcgatgaagtagcagtgcttgtaggaggagcaggacaacgacccgttctgactgttgagcttatattgacgatgtgacgttttcattatgctggctatagcattttagtagctcaggggatgtagttcagatggtagaacgctcgcttagcatgcgagaggcgcggggatcggtaccccgcatctccataatcatgttttttaatcttccattatgtttttaatccgtcattgcattgcatttagtgattaatctagagaaatatttctttctcctcgaatcttttttgccaaccacgtcatgtttccatccgtgcagtccagagacttgatcgccatggacgacatcgtatcgccatcgccgtgcgcgatgaagtagcagtgctgtaagaggagcaaaa

SEQ ID NO: 8839 - DNA, 683 bp, Zea mays
  misc_feature (652)..(656): n is a, c, g, or t
  misc_feature (658)..(658): n is a, c, g, or t
  misc_feature (660)..(660): n is a, c, g, or t
  misc_feature (666)..(667): n is a, c, g, or t
ggggttataatgaattctttgattgggtgcaggtgaagcataaatgcctgatcctgtggggagaggatgatggaataataagcagcaaactagcatataggttgcatcaggaactcccagacgcgattctgaggcaggtccggcagtgtggccatatccctcacgtggagaagccgagggaggccgcaaaacatgttcttgaattcctcgcaagaaacacgtcaaacaagtcagaccagtctccttccgagccgtcagtagtcgtgaaccgctgagcagatcacagatccttgaagggtaggctgtacaaagtggaatgtttggccatggatgatggacagtcgctaactcgctatgctcagccaagctgctgctgctgaaggctgaagctgaactcggcgatgtttctcagcgacactagaagataggttgttggtcatttaggactaactgtactgtacggtagcactgtaatgcaagggacgtagtggatgggagcgtgccaatttcggccgttgccagtactgtaaattagtccctctattttattttattttagtctctaaattgataaatacagaaactaaaatatgtcgcatttagcaatttaaggactaaaatagaataaaatgaaaaactaaaaagtagttcnnnnnananaaaaannaaaaaaaaactaaccc

SEQ ID NO: 8840 - DNA, 931 bp, Zea mays
  misc_feature (877)..(877): n is a, c, g, or t
  misc_feature (892)..(892): n is a, c, g, or t
cattgggtacctccctgcggccggcggacacagctccaggccacgagaccgtccagcgcgcgggcaggcgcgccgctaaactaaacccgaccaaatgccgcctctcctcacctcctcctccgtaccggcgctgccgctggccgcgtggtccaggtaccgcctcagggttgcggcttccaacgccgcctccgccccggacggggccggcgccactgccagatgcaccagcaccggcgggttcccgtccttccttcccggggcggtggagcgcatccgcgacggcgctgccatccgcctggccaagcgaatcgagcgcgtgcccgtccagaccagtttctcgggtagcgcgatatcgagcagctgtgtgaggccgctcaagcagcaacaggacggtgatccggtcgtgctgctgcatggattcgacagttctgttctagaatggagatacacctacccattgctcgaggaggccggattggaggcttgggctgtggacatccttgggtggggcttctctgatttggaaacacggccgccatgtgatgttgcatccaaacgcgagcatttttaccagttctggaaatcttacatcaaaaggcctatggtgttagtcgggcccagccttggtgctgctgttgccattgatttttcagtcaactaccccgaagcggtctcgaaattgatcttcattggtgcaagtgtatactctgagggcccaaaagatatgaccaggatgcctaaatttgtttcatatgctggggtgtttatattgaagagtcttccactgcgatttttagcaacaagattggcatttaaaaaactccaaatgaattctttgattgggtgcaaattgggcgtctgcgccgcctcctgtggngaggaggatgatggnaataataagcagcaaactagcatataggttgcatcagga

SEQ ID NO: 8841 - DNA, 1288 bp, Zea mays
gaagaaaaccagatggcaataaacaggcttcagatagtcaagaatgagagttcggaaatcgaagagttggtgagctctgtgagaaagatgtttcaacgattaatgaaggagaaaggatattccaaaagcatcataatgaacctaacaaaagatatggaagccatgaatagattgcatgagcagcaacttgagcaaattggaagaaaggcaaaggaaatggaggaacaattacccaccagggtaaaagaagtagagtatctcttgctacaatcgaataagaaagttgaagaacttgagattgcttctaggctaaaatcacagttatgggatcagaaagagaacatttttcagagttacatggataatcaacaactagttatcaaggacataagaatattgtcgcgatcatgtgaaaatgatatgtatgcacttcaaatgcagtggagaaatgagatctctaacttaggatctgggttaaaatgtttggttgatgccgctgaaaattatcataaagtcctggcggagaaccaaaagttatttaatgaagtgcaagaactaaaaggtaatataagagtatattgtcgtgtgaggccatttctttccggtcaagacaaaaagtccaccacaattgactacatgggggaaaatggtgagcttcttatatcaaatccatttaagcaagggaaggacggacatagaatgttcaagtttaataaagtgtttactccatttgcttcccaagctgaggttttttctgacatacaaccactgatccgatcagttctggatggattcaacgtttgtatttttgcatatggccagactggttctggcaaaacttacactgtgagtgggcctaccactgtctaaacacaagatagtggggtctcggtgggcgggctggagttgatttgtttgatatttcactaagtaggagaaatgccttctcatatgaggtgggggtacaaatggttgagatatacaatgaacaagtccgtgatctgctatcaaatgatattgcacaaagaagacttgggatttggaacacttctcaacccaatgggcttgttgttccagatgcaagcttgcactcagttaagtcgacatctgatgtattagacttgatggagattggacaagcaaatagagcagttggttcaacagcgctaaatgaacgaagtagtcggtcacacagtattctaactgtacatgttcgagggatggatttgaagaatggatcaacctcttgtttaaacacaataaagttggaactggaggggggaaagta

SEQ ID NO: 8842 - DNA, 2997 bp, Zea mays
  misc_feature (68)..(68): n is a, c, g, or t
cgcgcgcgcccgcgcgggcgcgggggggcggggcggggccgggggggggggggggggggggggggggngggggtgggggggggccgggggggggggggggggctggctaggcccccccccccccccccccccccggaaaagatcccctgcagaggacatgagaaacggcgttgcagattccaaaacccatcagaaaacttctgtcttttctggacaaaaggttcgtgaagttttccaattaaaacgcggaacatattcagatcttactgctgccaagatttcagagatgatgcactctaatagcttagataatgcaccgacacagtcgcttattagtgttgttaatggtattttggatgaaagcatagaaaggaaaaagggagaaataccacatcgtgtagtttacttactgcggaaagtcgttcaagagattgagcaccgtctctgtattcaagcagagcacataagaagtcaaaatgttaccatcaagacaagagaacaaaagtactgttcaaaaattaaagcacttgaaatgttggtaaatggcacaaatgaagaaaaccagatggcaataaacaggcttcagatagtcaagaatgagaagtcacaaatcgaagagaaaaaagaactctgtgagaaagatgttcaacgattaatgaaagagaaagaatattccaaaagcatcataatgaacctaacaaaagatatggaagccatgaatagattgcatgagcagcaacttgagcaaattggaagaaaggcaaaggaaatggaggaacaattaaccaccagggtaaaagaagtagagtatctcttgctacaatcgaataagaaagttgaagaacttgagattgcttctaagctaaaatcacagttatgggatcagaaagagaacatttttcagagttacatggataatcaacaattagttatcaaggacataagaatattgtcacagtcatatgaaaatgatatgtatgcacttcaaatgcagtggagaaatgaaatctctaacttaggatctgggttaaaatgtttggttgatgccgctgaaaattatcataaagtcctgacagagaaccaaaagttatttaatgaagtgcaagaactaaaaggtaatataagagtatattgtcgtgttaggccatttctttccggtcaagataaaaagtccaccacaattgactacatgggggaaaatggtgagcttcttatatcaaatccatttaagcaagggaaggacggacatagaatgttcaagtttaataaagtgtttactccatttgcttcccaagctgaggttttttctgacatacaaccactgatccgatcagttctggatggattcaacgtttgtatttttgcatatggccagactggttctggcaaaacttacactatgagtgggcctaccacatcaaaacaagattggggtgtcaattatcgagctttaaatgatttgtttgatatttcactaagtaggagaaatgccttctcatatgaggtgggggtacaaatggttgagatatacaatgaacaagtccgtgatctgctatcaaatgatattgcacaaagaagacttgggatttggaacacttctcaacccaatgggcttgttgttccagatgcaagcttgcactcagttaagtcgacatctgatgtattagacttgatggagattggacaagcaaatagagcagttggttcaacagcgctaaatgaacgaagtagtcggtcacacagtattctaactgtacatgttcgagggatggatttgaagaatggatcaacctctaggggttgtttgcatcttattgatcttgctggtagtgagagggtagagaagtctgaagtaaccggcgatagattaaaagaagctcaatacattaacaaatcactctctgcgttaggtgatgttatttttgctttgtcacagaaaagtgcccatgtgccttatagaaacagcaagttaacacaagttcttcaaagttctttaggtggacaagcaaaaactctaatgtttgttcagataaatcctgatgttgagtcatattcagaaactataagtactttaaagtttgctgaaagggtgtctggagtagagttaggtgctgctagaagtaacaaggagggaaaagatataaaagagctattggaacaggttgcgtctttgaaagacacaattttgcgcaaagatatggaaatagagcagatccaggtcatcaaagacaaagtaaaatccccaaatttgttgttagatagaaatgtgcctggcttgacgaagactacagcaaaccaacctagccaactattatcaggcgaacgaatgcttaagtctagtgacagagttctatcggatcgtcagagttacggcgaggtgaatgtagatcctaaccaccatgtgatggatactgcaccagtgagcatagatgaagcaggatatgagaacaatgcatcggatgatggtttatcgggtgaaaccgagaatgataattcagctgctgagatgacagcggaacggctgcatagatttccatcaagaataagcaggttcactctcacaaagaacgggcagccatctatgtctagatcgaacccaaaggatgctaagactccaagcaatacgaaagctccatcgagccggttgacaggaggctcttcagccaggtctaaaagacggcagtagagcacgatcatgttgctcgttttgatgtgcattgtagttgaaatgtgaatttggtgggtagttgtaggaccgttttatgattgtaactttagaaaatgtcagacactgatggcagaatatttgagacatttgtttgatcatttgcttatgccgagcaaaacagcaaacaatgctcgattgtatgtgaaacactctgacctgtgaccatttgaatgtcggtgcgcctccggaagtccggagttgtgtatataccaccaaattaccggcctaaaaaaaaaaaaaaaaaacctcgagggggggcccggtaccca

SEQ ID NO: 8843 - DNA, 1548 bp, Zea mays
gacccgactcccttctctcccaattctcagcgggcgatgcaggcgaagaagctgaccctgctgcagacggtggcagctgcgggagtcttctctgccgtctccttttggtatggcttcatgtttggaagggagtccgcgcggcgcgagcttggtggcatcatagacgacctccgcagcaacaagcccaccaatacccctgccggtcccgatgctcattcgaagccatagtggggtccaggtctgcagtgcgaaggataagatcgtgtggggatcataaatgatgtggttagctgctagaagtgttcagcgaggacaaagatcgttagaggaaggtcaaagaaccaggcatatgtttttgtaggtttatgtcttagggaggccgcacttttgaatttgaagaaatgagagacgatatcattgttcgtatggcgcgcaggcgcggctaccagtcctctctcttatcaacaatacgctgtgcatcagtcttcgggcatagtgttgccgttgatgaaaagaaaaaaaaaaaaaaaattagtttgttccatgacgtcactgcttaggaatttgctttgttcatcgctacgtctttccagagatttgtttgtagatttggtaaaggaaaaaatagtgccaagggtgtgttgacggcagcgttactcccgcttgctcatacatgtcaaaagtgcggccggtattggacattgataatttcaaggtcaaaagtgccctcgaggctggcgcggtaggctaattaggttgaatagatagatagattcgtcttggtctgtatctctggaaggacgcaggcccagcccacagctttccgttccagcctgcaacggcccacagctgagaaggaggaggcggcgcccacggcccatcagaggcgtccacgtccccggttcggtccagcccagtccagtccgcctgctgcaccggcggcggcgtgtccgcctcctccaccacgtcgtccccatcctccagttcctcctctcctcctcccgtgcgcgtgcggcgtgccgccgtcgggacccacatcccgtggcgtggcgtggggagccacccgcaagcagaataaaacgtgtggctgtccctcgtctcccccaactccagcacagcacaatggacgccgccgtctccctctccctgcccctgcaccaccacgcccacgcccacggcccgctcccgcacccgcacccggcgccccaccacctccactgcgcggtcccgctcaggcaccacgccacctccgcgtccgccgtaaccgcgccgccgcccaagcctgacgttcaggctcctccagcggcgcgcctgagccccgccctcgccgcgccagcgccaccccgctcgtccccgaccgccgcgcgctcctccagccgcgccgccacgggatacgcggcagcgctggccgacgcgtgcgtccgcgcgggcacgctgcgccgcgccgcgcgccacgcgcgcgcgcccctccgcctccggctagagcggcccctggaagagggcgccgccgcggtcgaggctgccgtgacggtcgcggggcagcagggg

SEQ ID NO: 8844 - DNA, 856 bp, Zea mays
gtgcccggcggcccgcgttactgtgcagccgtgtgcattactgcatttgtagacagcgcagctactggctgacccgactcccttctctcccaaatcccaattctcagcgggcgatgcaggcgaagaagctgaccctgctgcagacggtggcagctgcgggagtcttctctgccgtctccttttggtaccccctcaatctcccgccccctgaggattctcgctggttctgagcattctagatctcccgtgccatgcctcttgtgctgcaggtatggcttcatgtttggaagggagtccgcgcggcgcgagcttggtggcatcatagacgacctccgcagcaacaagcccaccaatacccctgccggtcccgatgctcattcgaagccatagtggggtatggtattctgttgttcctcctttgccgtactaaatctaaatgtggtcaagcttgtcttgtggatcctgctaggctgtagacggaagaactagccttggagctaccagttttttgtccccttctttcataatgtgtatacggcttgaacatcagtttttagactgaaaaaaaaaacaagttaacctgccacaaaagtaacaaggaagagaaacaagttaaaacctcctttggttcagaaagggaatgggggtattaatgcatttttcttgccgttgtgcggctcattgtttgttttcactaacgcgtgccgatgaagatacaccatttcatattactttttcagacgaaaatgcttgttttaatatcaaaccatgcctatacagtctagtgaggtccaaggaaactaatctctggctggcccattgccctgttttgaacccatggcaggcaggtttcact

SEQ ID NO: 8845 - DNA, 1075 bp, Zea mays
aatccgccacgcggcttcgctcccctaggtcgcgagcgagcgacggccgactgcgcgagaccgcgagtgaccgccggtcgagccccgaggccggagcggctcccccgcaggcctgccctcgtctggtcgccgcctcgccgcgcagcaaccccgcgacccgctgcccggccggcccgcgttactgtgcagccgtgtgcattactgcatttgtagacagcgcagctactggctgacccgactcccttctctcccaattctcagcgggcgatgcaggcgaagaagctgaccctgctgcagacggtggcagctgcgggagtcttctctgccgtctccttttggtatggcttcatgtttggaagggagtccgcgcggcgcgagcttggtggcatcatagacgacctccgcagcaacaagcccaccaatacccctgccggtcccgatgctcattcgaagccatagtggggtatggtattctgttgttcctcctttgccgtattaaatctaaatggtggtcaagcttgtcttgtggatcctgctaggctgtacacggaagaactagccttggagctaccagtttttttccccttctttcataatgtgtatacggcttgaacatcagtttttagactgaaaaaaaaaacaagttaacctgccacaaaagacaaggaagaaaaacaagttaaaacctcctttgattcagaaagggaatgggggtattaatgcatttttttgccgttgtgcggctcattgtttgttttcgctaatgcctgccgatgaagacacaccatttcatattactctttcagacgaaaatgcttgttttaatatcaaaccatgcctaaacagaacccattgccctgttttgaagccatggcaggcaggtttcactgccacattgcatattcagaaatcagaaccaattgttataaatctaatgaccttagctcgtaacactagccactagaaacggcagatcgtaggattataacttgggagttctggaaagatgctattaggtcgaagtctggcgagcatggagtggtcagcacgacggcggtggtcttcctttcaataa

SEQ ID NO: 8846 - DNA, 1007 bp, Zea mays
  misc_feature (943)..(943): n is a, c, g, or t
  misc_feature (995)..(995): n is a, c, g, or t
gtctccggcaaccgggaattttggcatgagaatatgcggccgtggcgtcccgccggctgtgactgtcgtcccgtgccctcgcgtccctttcccttcttcccatccacgccagccaagttcaccgccgcgctcttcggcggcaactactgttggatcgtagggcgaaggaaggaaggaaggggagccatgggaaacgcgtcgtccatgctgacccagtacgacatcgaggaggtgcaggagcactgcagctacctcttctcgcagcaggagatcgtgtcgctgtacgagcgcttctgccagttggaccgcagcgccaagggcttcatctccgaggacgagttcctctccatccccgagttctccctcaacccgctctccaagaggttgctccgtatggttgatggattgaacttcaaggattttgttgcgtttctttctaccttcagtgcaaaggccagccttcgtcagaagatcgagtttatattcaaggtttatgacatcgatggcaagggaaaaattaccttcaaggatctgctagaggttttacgggacctaacagggtcattcatgtccgaggaacaaagagagcaagtggtaactgaagttctggaagaagcagggtacacgagggattacgcattctcgcttgaagattttatccagatcatcgaccatcctggccttaagatggaggtggaagtgccaatcgactagtgaaatgtggaaaacaagcttccggttttgtctgcagaacatggttagtgtcatgtagcagggcaatgaccgttcactttcgtcatcttatttgtttccggtccacttgcctaaacttttgtaatctttgttggcttggccttttcgaatatatccaaaacaaaaaaaaatgtcctgcgatgagattttcgtcggttctatgctgaagaaaaaaaaaaaaaaaaaaaanaaaaaaaaaaaaaaaaaaaaaaaaaaaaaaaaaaaaaaaaaaaaaaaaaaanaaaggggggggg

SEQ ID NO: 8847 - DNA, 767 bp, Zea mays
tttttccaactttttaccagtcattttcctggagtccggcccgggaactgacccacgtcgtagcggcgtggaacgcttccacacaaaggcaagggggagagagcgatggctgtgtctcgtgaggcagcggtggcgaagtgctaaggcggcgggccggcggcagcagcagcaggctcacaacaacggcggcctagatccctgcaaggcacacagcaaggttgatttccctaggtaaccacatcctcctcttcctttcgtcgtcggtgaggcgaaactggaagccgatgggcagatccgtgccggacgcacccggcgggccttccatcaccgtccgaaggtttttgtatgtgtgtggcctaatcgatctacgtagctgatcgatgtcaggtagtagaggcgactagatttttggttgtgctgggatgagaaaggtagatctagattcgtcgctctcagctagtcgtatactcgtattatcaggtatcttgttatgtagtagctgcttctatggacctcagtaggtactagcagtgttcgacaactagcaggttgtttggatgtagtggtgggaaatctgaactccacgcctccaccctctacacgtcagctttccttgattttagcgtgaaagaaggaacgcttgaagtgtttagatgcaaacacatcctcgtttgtcatgtgtgtaaattattccaatgtttttaacttggtcatccagctaattgttggtcaatgaagaatatatttatgcaaaaaaaaaaaaaaaa

SEQ ID NO: 8848 - DNA, 827 bp, Zea mays
gtgttcaatctcgttgcccgttgtgctctctctctctattcgttccccgcctcaccccgagccagccgtctcgctagggtttcgccgccgccgccgccgccgccgccgctatgcctcgccgcagctcaggaaggtctgccccacgcccagctacccgtgctgctccagtgaggcagcggtggcgaagtgctaaggcggcgggccggcggcagcagcagcaggctcacaacaacggcggcctagatccctgcaaggcacacagcaaggttgatttccctagattgctcacccgcgctagaaattggagaacaggctaccactgtcctagcatctgataccctctcatttagttagcaatgaatgtggaattaaagggccatcttagaaagtgaagagatgagaaagcgaacgagaaattttcattgcctgagattctgtgctatataggtgagtattagataatattaggcacattttcttttggtagtatcttacttgatgttggccgttggcattacatcgtggtgttgctttaagctagttagcaactcaggtggtgttggtgtcttgagactagaagggaaaacttgactgattgtcatgttgcattgttaggtttgatagcaatgtttgtgaaagtcagagttgttgttgtagcatagtattgtgcaggttgtggtgtttggctcattggtacttcagtaggcttagactgaaggacagtgtctaattgtaataataagtttgtacatgtgccttgtgtgttgtacataagttatatatgttttaatttattgcacaaaaaaaaaaaaaaaaaccccccccac

SEQ ID NO: 8849 - DNA, 896 bp, Zea mays
acacacataagtcaaatcgtcgactggtgttcggttagcaagggattggcagggaatatggtccaatccacgtggataatctccacctagaaaaaatcccgacccacgatagaaattgtgttcgtttagcccaccgaggattcttttccaactttttaccagtcattttcctggagtccggcccgggaactgacccacgtcgtagcggcgtggaacgcttccacacaaaggcaagggggagagagcgatggctgtgtctcgtgaggcagcggtggcgaagtgctaaggcggcgggccggcggcagcagcagcaggctcacaacaacggcggcctagatccctgcaaggcacacagcaaggttgatttccctagattgctcacccgcgctagaaattggagaacaggctaccactgtcctaggatctgataccctctcatttagttagcaatgaatgtggaattaaagggccatcttagaaagtgaagagatgagaaagcgaacgagaaattttcattgcctgagattctgtgctatataggtgagtattagataatattaggcacattttcttttggtagtatcttacttgatgttggccgttggcattacatcgtggtgttgcttgcacctgatgcaatgatgagtcattctactggaaagaactctttaccctcagaaactcaaaacaaattaaatcatagatcattttagcatggaaggaacaagatatttgtgatatcatctctttttgcatattttgtggatcatatatctataaatcttaccctgcactattgtatcatacatctttgaattgtaccctgcttgtgaattgtatcaaatctaagttttatgtgtgtggattgtgaaaaaaaaaaaaaaaaaaggccccta

SEQ ID NO: 8850 - DNA, 1326 bp, Zea mays
tctgtgatcatcttgctaacaaccttccattatcttttcctccttcttcttcttcttttgctccctgctttctctagctctcagctcagctcagcgcgctcacaaacaaatatctgtcctcttcgatcggatccacaactactaaagcaccaccgtaccaccattaccagaccggcgcccgtatgcgattacccggcaaattagcacccgggttctgatcgatcatcgtcagcccttggattcattccatcctcgttccattgatacggtacggtggccaagctaaattaagaagcccacacccagcgtcgtcgtcgtgcttgcaattgcatcttcttccacatgtctccttcaccgccgccaagcagcggctgcagcctagcagtactagtaggcggcacgagtactgcagggtcgtccaacatgagcctgcgcgagaggagggacgccgtcaggcacgccgccgacgccgccctcgccgccgcgcgggccgccgcgccgcgctggggccgggctttggcggcggagctctcgtcgcagtcgcagtcgcagcagcatggccggtggcactggcacgacgacgacgcgccccacctgcttgtcgccggcgccgatgcacggccttcgggccatcagacgtgcttgccgtgcgggacggcggcggcggtggcagcagccggctgcaggaagaccgtcccgaggcggcggaggctccgggtccgggccaggcccaagagcggagccactacggcctggtccgctggcgctgtcgcgcgggtcgtggcgaggcggcgggcgcgggccggggcgctgaggaggatggtgccgggagggcgagggatggcggacgagtgcacgctgcttggtgagaccctagactacgccgtgtcgctcagagctcaggtcgacgccatgcagctcctgttgaggacgctccagcctccaggccacgccaacaacaacccttaatttgctgaagcagcagtagtgaggggaattcgaactactacacatatatatacgtactgaaatgtgatcaagaccgtccatcgttcatggatataatataagacttgcatcatgacggaatggagagcttttccccggccctctcttcctttattctcctcttgcatacgtgctgctagcagctctcttcctgtttgtttcttcattctgtagcactgagagagatcatgaggcgtggaagaaggtcatgtgtgcgtgccgtatatatatgtacagtacagtactagtgtgtgctacgtacgtgctactccgacacaaatatatatatgcatgtacataagtttttggttactcttt

SEQ ID NO: 8851 - DNA, 2208 bp, Zea mays
agtctactatacaagccgtgccaggtcccaccggtcatcaacggtggaatggaaccgctcaatggcaggtgccggtgcatggcgcgcgccagcacctctatataaacctagcgggttcagtgttccagtgcacactcgcttgagcatatagtgtgctcttctcttcctcttccagttggtattctttatctgaaacatagtacagaggaggagaggagaacgagagctaagaagatgaccggcaaggttctccttgtggccgtccttatcttggtgggcgtggcctctcgatgctcgggcagtaggggcctgcagggcgatcacgttgctgaacagaagtgtacgtgttgtgtctcgtaatccgatgtgcttggcttttcttagtgtaacagagtaacaaacgcctgcatgtgtcaatgtgtgcctggtgtcgtctgttgttctcagtcggtggcggtggctatggaggtggcggtgggtacggaggctacggcggcggtggaggaggaggtggtggtgggtatggcggtggcggcggcggcggcggcggtgggtacggaggcggtggcggctacacacccggctactctggcaccggcacctgcgagtaagaagcaaaacaaaagatagctagatctatgcattcaaaaatcaagatacatctatatatatatgacatttgttgagtacacacccggctactctggcaccggcacctgcgactactggaagagccacccggacgccatcatctcgtgcatcgggtcgctgggcagcatcctcggctccttcggcgacgtgtgcagcgccttcttcgggagcaagctgcagacgctgcaggacgcgctgtgcaacacccgcaccgactgctacggcgacctcctccgcgagggcgccgcggcctacctcaactccatcgccgccgagaagtacgcctacagcacgcagcaggttcaggactgcatcgccgtcgcgctcacttccaaggccgccgccgtcgcgcaggccgccatgttcaagaaggccaactacgcctgcagctactagctaggcctcgcgcatcatcagcgtataacgtacgcacgcaatgttcgttatataattccatacgtatatgggtgtgcaaggtccagaccgaccagctgtatgtcttcatcgttgccttcgtttctgcgtcgtcctcccatgcatgtttatgcatgatgccgtgccgtctcgttgtcagctggttcagtagtgatgcttactttcttgtcgttgttgctaatgtaagaaataagacgatgcgttgactgcttaaaaaaaaaaaaaaaaaaaaaaaaaaaaaaaaaaaagaaaagctcgcgcgcccgggcgcaataccgcaacagagtccttttgaggagtgccgcaggctcgataatactcggcaaatgctttgtcatcgagtgtagcactcaacaaagaggttttgatgaactagttatcggcaagggtctctttgccgagtattttatgtcgagcattccacaaagaaaagtcgtcgtaaagatgattaagcctttgccgagtgtccgtcttaccgatactcggcaaagggagctctcgtgggccccacatcgtttttatgcggagtgtgcaagacggcactcggcaagaaagagccttttgtcgagtgcccggcccacaggcacttggcaaagccccacgttgttttcagtgcctagtgtgcaagacgccactcgacaaagaaagagcctttgccagtgtccggcccacgccgttttctgtgccaagtgtaaaagctagcacacggcaaagctttcttctttatcgagcgccacgaccatgacactcactagagaagctttaccggttctcagatgtcccttctttgccgagtgatttagtcattgcactcgacaaagtagctctttgccgagtgtcacactcgacaaagtaaccagatacccacctttttatttattttgttattccatccaaacaaacaaaagatatatatcgttgatatcacataatcatcacatgtatcaccatcagtaccacatattttacaaagagcacaaagctcacaagtttttcataaacatcactaagttcagaccaagtattatgaacatcaacaagtttcacaaacatcagtatcaccaatactcacaaacataagtatcacaagtttcacaaacataagtttcgaatcaccactaa

SEQ ID NO: 8852 - DNA, 1054 bp, Zea mays
acactcgcttcagcatatagtgtgctcttctcttcctcttccagttggtattctttatctgaaacatagtacagaggaggagaggagaacgagagctaagaagatgaccggcaaggttctccttgtggccgtccttatcttggtgggcgtggcctctcgatgctcgggcagtaggggcctgcagggcgatcacgttgctgaacagaagttcggtggcggtggctatggaggtggcggtgggtacggaggctacggcggcggtggaggaggaggtggtggtgggtatggcggtggcggcggcggcggcggcggtgggtacggaggcggtggcggctacacacccggctactctggcaccggcacctgcgactactggaagagccacccggacgccatcatctcgtgcatcgggtcgctgggcagcatcctcggctccttcggcgacgtgtgcagcgccttcttcgggagcaagctgcagacgctgcaggacgcgctgtgcaacacccgcaccgactgctacggcgacctcctccgcgagggcgccgcggcctacctcaactccatcgccgccgagaagtacgcctacagcacgcagcaggttcaggactgcatcgccgtcgcgctcacttccaaggccgccgccgtcgcgcaggccgccatgttcaagaaggccaactacgcctgcagctactagctaggcctcgcgcatcatcagcgtataacgtacgcacgcaatgttcgttatataattccatacgtatatgggtgtgcaaggtccagaccgaccagctgtatgtcttcatcgttgccttcgtttctgcgtcgtcctcccatgcatgtttatgcatgatgccgtgccgtctcgttgtcagctggttcagtagtgatgcttactttcttgtcgttgttgctaatgtaagaaataagacgatgcgttgactgcttaatttgcttgtgaaattctatagtccgtggccttacgaaacgcacgggcactcgggcgcaataccgcaacagagtccttttaaaaaaaaaaaagaaaaaaaaaaaaaaa

SEQ ID NO: 8853 - DNA, 543 bp, Zea mays
ctgaaacatagtacagaggaggagaggagaacgagagctaagaagatgaccggcaaggttctccttgtggccgtccttatcttggtgggcgtggcctctcgatgctcgggcagtaggggcctgcagggcgatcacgttgctgaacagaagttcggtggcggtggctatggaggtggcggtgggtacggaggctacggcggcggtggaggaggaggtggtggtgggtatggcgccggccgtcgcgcaggccgccatgttcaagaaggccaactacgcctgcagctactagctaggcctcgcgcatcatcagcgtataacgtacgcacgcaatgttcgttatattattccatacgtatatgggtgtgcaaggtccagaccgaccagctgtatgtcttcatcgttgccttcgtttctgcgtcgtcctcccatgcatgtttatgcatgatgccgtgccgtctcgttgtcagctggttcagtagtgatgcttactttcttgtcgttgttgctaatgtaagaaataagacgatgcgttgactgcttaaa

SEQ ID NO: 8854 - DNA, 831 bp, Zea mays
acgcgcatgtcatctccttccagaaaagacaggcactagtgacatacttgaaaacaacagagccgggatcaccgtgttcggtttcacgctggaccgttcgtacctgcacacgatatttatgctcgagtggactctgttcctgtggctgctcggtaagaccatcggcttctcgtgaagaagacggcgatgaaaagaagagaggtggcctgtgtccaacgtccggatggtcgtttttgagaggtttcgcatgtcgcggttgccctttttggggatggatttggatgtgctttgtttttcggtcatcgtggaagggctttttttcgcgtgagcctggctgttggcacgggagcgttgcgcgtgtacacctcaacgcctgtgtatgatagcgattttgtatgatgtgtgtgtataaattgtgaaccgtaattgtccttgtaaatgagcgttgtacagtcgtacactggtaatgctgttttttacaatctcgttgtaagccaacatgttgtagcgagaatttagattgtaaagataaagattcttgtttttttaaatcttaggagggtatgaaattagttcgagctttgctagtttcttatgtttctcttgtctcttttatagatactagatattgttagggccttcgtcttccgaaggtcctcaaaaacataatttaacaatgttttccgagtgtaatacgtgaacagacgccttctgtctcggatcagaatcacacggtgtgaagagcatgaacaatacgaaggttgacgcagcgccgaagctacatgcaagggaccttcggcataatagcagaaaatgggaaccgacttaaaa

SEQ ID NO: 8855 - DNA, 2197 bp, Zea mays
  misc_feature (2193)..(2195): n is a, c, g, or t
cgccagcccgcccacagaaaagccgttctcccctctttctcgattcgacgaggggaagactcgtcgagccgccggccagcccatctcggcgcattcccggagaatccctccggaaaccggtcgatcctgggtcatccaacacacagcacttcgcttctcccgcgtccccgacccgcgcgcaagccctcatgcggttagggctgtaacgatctcgtctcgctaccggcggccggctgcggaacgggccaccccacgcgctcctctgagttcgttcgactaatctaccgctgactgtactttgggctgtcgccaccagaaagccctcacgagtcctttgcctcctcactccgtcaggctcgtcgccacagggttttgttcctaactttttagcttcaatttttgtcttgaatggcaacacctctggatgttccactggatgatttgattaagagcagagctgggaggggaacaggaagaggcaggggacaaggagggggtcgaggcagaggtgatggccaaaggttggctcgtggttcgtggcgtgggcgtggtactggcaacttccgtgaaaggggacttggggtgtcttcgcggaggccacttggtgttaatacttggtcctcatcatttgctattgccaaggcaagcacacaactataactgtttttctgttaccttcgagaatccaaattgcagtaggtacctgatgagaagtggctataaacttattaaaatggcacagcccaactgttccattcagaccatatctgtgaccatttaactgtggagcttcaaagaggatccaatggctttttcattgagacctgtctcttctctgccgagtatgtagggtggtgaggcatatgttggtttgtgctggctattgcttcaaagttcaaactgataactttgtctctactcgtgagcaagctgatggactacttaataatctgtggataaggccttttcatgtatacagaaatagcaccattatgtggaatggtatagggttttatgattttgctgatgctagttgcttcatcaagtactgtggattgatgagttttgagattttatgctaatacttgctcgtcacaacatcgacatgcatgatatggaatattacagtcattcaataaagcaaaggattttgtgtggagacatgatctctttgaggatagcatggtagcagctgggctttctgggatagaatctggaacaaagctttacatttcaaatttgcactatggagtgacaagtgaagatctacaggagcttttttcagaaatgggtcatttgaagcactgtgctgttcattatgacagttatagacacccaactggttcggctgaggtgatattcaccaggagaagtgaagctctcgcagcactgaagcgatataataatatgcgccttgatgggaaggccatgaagattgaagtaataggagcagaattgggtctatcagctgctgccgtaccccagattagtgttgttcctggtgcaagcagaagagggcagagagaagttgttatgatgcctggtggaagtgggtttggacaaggtgcatctggcccatctagttcgcttcctgggtggaagcgtggaggctttgttcgaagaggacaagggcgtgttagttttcctcaaagagggcgagggcaagtgcgcagccgtggccgtggccgtggccgcagtagctttgttcagagccgtggacgtggctatgtgcgcaggggtaatgcagagaaatcagccaaacaattggacaatgaacttgacaactacaactctggtgcgatgaatgtcgactaagttaatccatcgtgacatcattcaatccaacctggaagttggaactatgttgaagctaagcttgttttctgtcggtattctgtcaaatgtgcacacttctgtcatgctctagtggcatcagttgaagattagatattccattattcctactgcaatagtcttgtgatatcagaatttgctgtaattgaatgatgaattatgttttcaaccgttgaaaggtttgctgtcaaaatttcaatattatcctagttattgtcagaattttcagtaggcattagccaaaaagattggtgctgactactggtatatcagaatttgctgtaattgaatgatgaattatgttttcaaccgttgaaaggtttggtgtcacaatttcannnaa

SEQ ID NO: 8856 - DNA, 1720 bp, Zea mays
ctggccgggaaaagctggccccgccagcccgcccacagaaaagccgttctcccctctttctcgattcgacgaggtgaagactcgtcgagccgccggccagcccatctcggcgcattcccggagaatccctccggaaaccggtcgacccggggccggccggcacacagcactccgtttctcccgcgtccccgacccgcgcgcaagccctcatgcggttagggctgtaacgatctcgtctctctaccggcggccggctgcggaacgggccaccccacgcgctcctctgagttcgttcgactaatctaccgctgaaactgaactttgggctgtcgccaccagaaagccctcacgagtcctttgcctcctcactccgtcaggctcgtcgccacagggttttgttcctaactttttagcttcaatttttgtcttgaatggcaacacctctggatgttccactggatgatttgattaagagcagagctgggaggggaacaggaagaggcaggggacaaggagggggtcgaggcagaggtgatggccaaaggttggctcgtggttcgtggcgtgggcgtggtactggcaacttccgtgaaaggggacttggggtgtcttcgcggaggccacttggtgttaatacttggtcctcatcatttgctattgccaagtcattcaataaagcaaaggattttgtgtggagacatgatctctttgaggatagcatggtagcagctgggctttctgggatagaatctggaacaaagctttacatttcaaatttgcactatggagtgacaagtgaagatctacaggagcttttttcagaaatgggtcatttgaagcactgtgctgttcattatgacagttatagacacccaactggttcggctgaggtgatattcaccaggagaagtgaagctctcgcagcactgaagcgatataataatatgcgccttgatgggaaggccatgaagattgaagtaataggagcagaattgggtctatcagctgctgccgtaccccagattagtgttgttcctggtgcaagcagaagagggcagagagaagttgttatgatgcctggtggaagtgggtttggacaaggtgcatctggcccatctagttcgcttcctgggtggaagcgtggaggctttgttcgaagaggacaagggcgtgttagttttcctcaaagagggcgagggcaagtgcgcagccgtggccgtggccgtggccgcagtagccttgttcagagccgtggacgtggctatgtgcgcaggggtaatgcagagaaatcagccaaacaattggacaatgaacttgacaactacaactctggtgcgatgaatgtcgactaagttaatccatcgtgacatcattcaatccaacctggaagttggaactatgttgaagctaagcttgttttctgtcggtattctgtcaaatgtgcacacttctgtcatgctctagtggcatcagttgaagattagatattccattattcctactgcaatagtcttgtgatatcagaatttgctgtaattgaatgatgaattatgttttcaaccgttgaaaggtttgctgtcaaaatttcaatattatcctagttattgtcagaattttcagtaggcattagccaaaaagattggtgctgactactggtatatcagaatttgctgtaattgaatgatgaattatgttttcaaccgttgaaaggtttggtgtc

SEQ ID NO: 8857 - DNA, 2459 bp, Zea mays
gtcagaacagtatgcttggaatgatttaagttcaccgcgcaaactggttgtccgaattgttgatacacctgcattgcgtgaaattaaaatagataaaatcagcccatggaagccatttttgaagatgcgccaaaatagcaggctttaatctggattttctcattcagtggtggactcaattcgagaaaacagagatttgatgaatcatttggcttgagagtgttcaaaattggctacgaagtgtatgccgatggtttaacaagagttttacgaatttgtgaacatgcagataatcccaaaattgagaaaattcaatggccaatagcaaatatacagttcagaatttcttatgtgtgtattcatcttcttgacaaggaccagaatggggaaaatgtccaattgccatctacaattttagcagcaagacttcagcatgtttcttctgattcagttgtcacaaatagattcaagcaagtatctgttgcaattcattcattgaatgtggatgaaaaatgggaaggggcttcaattgggacaattcttaggaggaacaagcttcaggatgctactctcgatgaaaatattcttcgtatgatctttgtactgaattcaactgactccagtgtcaaacaaatacagtattgtgccatcatcctacagcctgttgatcttaagattgatgaggaaacgttaatgaagctagtaccattttggagagcatctcttgcaccttcaggcacgacaagcacacaattttatttcagacgttttgaagtacatccaattaagatcatagcaagctttcggcctggtggccgacgcacaacatatagttctgctcaagaggctctgagggcactacttcatagtgttataaaggtgcctgaaattagcaactcagctgtggagctcaatggggttctcctaaatcatgctttagttacatttcgtgagctacttctaaaatgcgctcagcactactcatggtatgtattaagggcaatttatgtaacaaagggaagcaaattgcttcctccatcttttgcctcaatttttgatgactctgcttcatctgttcttgatgtcttcttcgacccttctgatggatcgctcaacgtccctggccttaccataggcatgtttaaatttataagcaagaacatgaagtcgggtggtttttctggaacaaaacggtaccttggtgatctcgggaaaactgttaaaactgcaagttcgaacgctctctttgctgctgtcacagaaatttcagatagtgttgttagaggagcggaaacaaatggtttgaatggcatggttactggtttccaccagggcatgttgaggttggcgatggagccatctgtcttagggcaggctataatggagggaggtcctgacagaaagatcaaacttgatcatagccctggacttgatgagctatacattgaagggtacctgcaggctatgttggatgtcatgtataagcaagaatacctccgtgtcagggtgattgatgaccaggttatactgaagaatctaccaccaaatagcgccctgataaacgaaatcgtggacaacgtcaaaagctttcttgtgagcaaggcactgttgaaaggagattcttccacagttcgaccgatgcgccatctgcgaaatgaacctgaatggaggattgccccaacggtgctcaccctctgcgagcacctttttgtgagcttcgctgtgcgtgtgctgcaccgggaagccagcaaggccatcgctggagtcatgtcgagagtgaagaaaccgaccggagaggaggtcgaaggcgactcgcccgcatctggtggcgtcctgtgtaagcggaataggctgtggactgtcgggaggtttgccgtctcgggcatggtcgcctatgtagatggccggctgtgccggcacatacccaaccccatagcccggaggatcgtcagcgggtttctactgagcttcatcgaaaacaggggcaacgaataagcgggcagccggacaggtgataaaagggctcgccttctgccacctgctaataaggcgtaccatggaccatggtaaataggcgtgcacgttgtacaaagaaccgaggtgtggtagtgctcttgagccgtaaccgatctctgcatagagctgtgcatcaattttgaccgccttcaggcccacgtttggtgtacagaaacactgggacagtaattccgcagatgctacttcctgcctacatttcgttgacatggactcgtgcttagagtaagtttaatagtccacaacgagccttttcacataacaaactcggttagaggccctttcacatagtctatctatatcatcttattatacttgttctacatgcaaagtgataaatagcatggctatgataaacgtatggagccgttggtgtgttgatcatgagtcactccactgggtatatctctaattttattgtttct

SEQ ID NO: 8858 - DNA, 4441 bp, Zea mays
  misc_feature (2980)..(2980): n is a, c, g, or t
gaagatgaagcttcctttttatcggtacttcatatgcagccattattattatttgccagctaaaggttggaatctgccatcataaccaggggcatgttcaaaaggcactcttcctaaaaacttcgccaaaatttgcaaatttgcctaaatttgctctgccatgtggtcatgtagcccacaacgaaccaggctggtacacactaaataaccttttgcccctttctcctttcatgcaagccagcagcaaccccagggacacatcctgcttctcctcttccaaatcccagccaccatctttctctctttcctccattttctttgtccccaaattccagggccagctccagaaacacaactgcctgtccacctcatctctctctgcgccaatatttacagactaaccatgattagtagaacctaggcaccatgggaccaaggcgactaaccgcaattatttgttgaccagatacatgctatatatacttgtgagaggtgatttctgcactgtgccacatctgcgcgtatatacaacaccagtgcagcaccttaggatggagcaccagcaatcactggcgccatggagcagtaactcatcaatgccgtcaaacacgtgtccctaggaagagtgagctctgagctccagcaatggatctgttgcgatggacttgtgtggccatggtgggaggtgttggcttgccagagaacgagaaaggaaagaccgaggaaggaggggggtaacacggtaattttgcatgtgttgctcatgtgctttgggccacttgttgcaacccaagccttttttggcaaaaatactgagttccggtggtctctgaatggccattcggtctttttttttggaagaatggaaaaagggcaattgtcccatagatgttgcttaaagcctgccgctcatatttcataagaacaacgatgctaaacagatgttttatagtttgttgtgaactcattaagtagaaacttgcttgactttaatttcaatgttcattattactagctggatttagacaagcattatgcataaaccacctctttaattttggacattctgtctatttcaaatgtgcaggcctttgattctttattggctgccctcgatacacgtggcgcccgggaggcacagctgcattcaatgttgcaagtgatcgagccaaccttcaaggaagctattaaaagaaatgtgagtatagaattatctgctggaaggtatccaaagaatggagctactgacatgataagggcaaattatcacagtgaggttggaagctcaagcagtactcctagtgctacatctgacagtataacagcatattctgattcttttaaagtagagcttgggcgtaatgattttgagaagacagctatctcaaaaagggcagatatatttttaaaatggatgtggagggaattctacaatcaggaattgacatgtgccatgaaatacggcaagaaaagatgctctgaattgttgcattcgtgtaattgctgctatcagatttacctagcagaagaaaggcactgttcttcttgccataagactttcaaatccatttacaatttttctgatcatacaacacaatgcgaagagaaacagagaacagaacctttctggaacatgcaaaacactgattattctgtcccaataggaatggtattactcaagcttcagttagtttcgattgaggtgaactcatatgttttggtggttccttagtttttaaaaataatcttgccactgggccgcaagtaacttattagtcctttttacaggcatatataccatcagaagcacttcaaccattttggactgatgtgtatcgaaaatcttggagtgtgaagctgtacactaccaaatctattgctgaaatattccaggttaagtatttttccccactactctggcttcccctcctttcctgttttgggagtgaaactctcgttacttgcatttaagtttcatttgcctcgcagatgtatgtatagcttaagacctgcttggtttctctcgtggcgttgcttgccttgtcttgctgcgccggtgcaagctacgaagcgctcgcttggccagatgagctgatttggctctcccatgggagcaagcaaaatcttactcacacggttcccaaaacacccaagcaagagaactaaacaaacatcatcagtcatcctggctgagcaaggcgaaacagttgtcggcggaggaaccaagcagacccttagctgttaatgggtttccagcaccttagctagaacacttgcagcacatggttgatgccttattcaaaactgtgcactttttttagaagcatataactaccttcttaagttattatgagttaataacttacccagtctccaccttcagctgtcatcgtttagaaggtgatttgggaaactgcttctgatgaggacttgccatgatcaagagcatggtgccttgattaatgtgttctttagaagttcacaaattatgctctggtttgccagtccgccttgcatctgatctaaaccttctctaatgaagggatggtgtgacagataatactagcataactagcttaattttccctttaattcaaagtgtattactagttttgtggttaccagttttctttataaagatctgagtcacagttgatgggttggtacttgtctcatatatcttcggtgatactgacatctgactaccatagattgttttttattctcttgcagcttttgactgttctggaaggtgcaataagaccagattgcctctcttctgattttgaaacaagtgagtgtctaaactcacaggttggatctgcttctgtccttccatgggttcccgacactacttcagctgttatgctccgaatgttagaccttgactcagctattttgtatgttcaaaatcaaaagatggatagagatgatggaggtttcatggtaagtttaattttgataatactatttctttttntgttggaagtatggtatggctgttgttggacttacacatgccatcagattgatagcttcatgttttggtcaaaacctacctcactgctctgctaatacaccttcaaatcgtgaaatgtttttatgtgcttgattattgtgtgtgtgtgtgcaaattatataattatgtatttatgtttttccttacctgcagaaatttccgtcaaggtatacagttgctaagagcaaacaagaaacaacacctgaaacagctggtttggatctgtatgatggaaggtggcttcctggtagtggccgtaggggtcgtggacgtggaagtagaggaggtagcaggggaggcagaggtcgaagtcgaggtggaaggatcccaagaggtgttagcagctcatcaaggatcgagtgcacgggcgcgtgccgtgctgcttctgataaagcgccaaggaagaatgtacgccgagggcgtggtcgtggtcgtggtcgtagacgtggacgtcgaactgtgaggcctcggcagccatctgttggcagagccagatcaattccaaaggaaaatttgttgggaagctttagcatgcttagcagctcaaaggctgctaccattgaggagtctccacgaagctctggcgcagacgagtggggcttggagaccagaacgacatacactgaatgtgatgagaacagctctggatcacagtcagaagataacgaggaaaatggccagcccatggatgatgattatgaagatcaagttccagattactcaataggctattctaccggctcgaggcaccatgtaatgatgtccatgatggaccatgatagtgacgaggaggatgaagatgctgaaggtgatgagaatgtggaagaagatgcagaccttgcagttgacgatgccgatgttgagatggacgaagatgatgaaattggtgatgatggagaggatggtggcgttggaggggagatgaatgcggatgaggatccggatgctacttcatattcatccgattacagcgactaagaaagcagaaataagggaaccttatcccagattcctccctcggcatggaatgcatgtagtaccgagtaggcattcccccccgttgtgagccaaaagggagcttagatgcttaggttcgaaggagcgaggaactgttttttaggcaccgcaggttttaatagaatttctgacgcattcgacgaagtgtttggttgtaccgtggtagttgtgttactggggaattccccgagttattatacaatgtgttaagacaaaatactgtcatatcgcatctggttgccatgcgtctaactggttcacggttttaccgttattgtagtccctctccacatattagagcatctccaacaacgtgacctataaaaataccttataatttaaaaataagtaaattttatagaatttagggcaccaacaaaacaccccgctccaacagtaaagcct

SEQ ID NO: 8859 - DNA, 1082 bp, Zea mays
gcatgcctgcagctgcgggttttctacctgcttggtcagtgtcacgtgtcagtctgcctccctgtgctgtgcatgccatttcctacaaatcctagcgcgagtggttacggccaagtcaggttgttcagggggccatggacagctggtacgcgtggctgtcgcggacggggctggcgccgtcgctggcgcacgagtacgggcgcctcttcagccggaacgagctggagccccgggacgcgccgcacttcgaccacgacctgctcaagagcatgggcatcgccgtcgccaagcaccgcctcgagatcctcaagctggccaggaagcaggacgccggcgcctcgtcgtccgcggcctcgcggctcgggcgcagggccaccaggtgcctgtcccggtgcgcgcgccggctggcaggaggcggcgcgtggagggccgcgtcgtcatcggtcaccgtcgtcccgaggatctgcggcggcgaagacgccgtccgcgtcggagcagtgcagcggaagggcactggtagcggcaccaccaagaagatggtgctcatgatcaccgacggcggcgtcgccggaggagggtatggctacggcctcagaggccgtggcggcgcgaggctgtcgtcggcgtcgtcgcagaaggcgagcctgatgtttcatgactggtaccaagacgaggaggaggagatggcagacgacgaggacgagcacggcggcgccggtgacggcgacatcaagtgggactccatgtttcaggacctcaaacccacgtgaggatgaagttctccgatctccggactccggctgctggagtttgatgttgctgcgtgagtgagtcggtcgtcatggctttgcttgtggtgtgagagaattttaacaactctcctcatgctgtctgtcgttctcccttccctgagaagagaacgtaatgtcgaaaatgtgtattttcctccactggttttgcggtgttaaagcttgagcaagaaccataggtgcctgatcacttcaattgcaagaccatatttaaatgttgtcgggtttttttaaaaaaaaaaaaaaaaaaaaaaagcaaaaaaaaaaaaaaaa

SEQ ID NO: 8860 - DNA, 884 bp, Zea mays
tcttgctgctggtcccatcatccaagcaagaccgacatggcttcagctgttgctgctgtgaaggaggcctgcctgctcgccgccgtgtgcgtcgtgctgctccactcctcgtcctcgatgggacagcagccgttggcgcctgaatcgtcgtccgcttccccttactactacacgggccagcagccaccgccgccgcccgcatcaccggtcgactgcccttacactgggcagcagcccactccaccgccagtggtggtgccgccggcgcccacgccgaccccgaccccgaccccggcgccggcgccatcacccaccatcaactgcagctacagcgactgcggcgcgcagtgcactacgtcctgccaagccagctacaacgccaccgccaggaactgcacggcgttgggcgccggcgccttccaagggtgctatggcagctgcaccaacaacagctgccctggcaagtcctgtgtgcacagtgtgtgcgacagcagctgttcctgcgacaacccccacgcaagcagctgctgtcagtcttgccgtgccgctgttaacgcagccatggggcgtgtgggtggcgagtaccagcgatgcctgagctacaacgacaggtatatggggtactgcatgatgagctgcgtcgacagctgctacaagaactgtacccagggcgcgtaaagctagctagagagatggccggccgtcgtggacgagtgccgcgcgcttgaattcagtctcgtcgcggacgggcggcaagctgcaagacacctagtagcgcgcggcccagaataatgttatctcatgtaatgttcaataatacgcatgtatactagctagcgctagctatatatgccaaactaagtgaataatgttactttacgttc

SEQ ID NO: 8861 - DNA, 1049 bp, Zea mays
  misc_feature (43)..(44): n is a, c, g, or t
  misc_feature (52)..(52): n is a, c, g, or t
  misc_feature (77)..(77): n is a, c, g, or t
  misc_feature (103)..(103): n is a, c, g, or t
cggacgcccggactcctcctccctcccccgtacgcatccactnnactgaaanccttcctgtgcgaaggaaatctccnggtcccccgcccccgcccgggttttnaagtgttgcttgccccgccggagttttcctctaacccgcaagtccaattggctaagaagttgatgggatcggggggacactggaaggctgtgtgagatcgcgaaggggaccgtgaattccttgcagggctgcggcgattcggctgcgctgctgtatgaactgtttcttgaacctgggactcaactcgaactcgaaccactacgtcgcctgcctcctcatcttcctgctgcatttctcccctcagttgttaaatccatccgattttaattctcatagtaattgtgaaggagaacaacagagctgcacagatggcgaacaacagctcatatggtgaaaatgctaggagaaagccacacacaccatctgctattgttattggtggtgggtttgctggtcttgctgctgctgatgctctcagaaatgcatccttccaggttattctactggaatcccgtgataggattggtggcagagttcacactgactactcttttgggtttccggtcgatttgggagcatcttggcttcatggggtctgtgaagaaaatcccttggcaccaataattggaaggcttggacttccactgtaccgcacaagtggtgatgattctgtgctgtttgatcatgatctagagagttatgcactctatgacactaacggacgccaagtaccacaagagttggtagaaaagcttgggaaggtgtttgagaagatactggaagagactggcaaattgagggaagaaatcaatgaagatatgtctatcgcaaaagccatcgcaattgttatggctagaaatccgcacttgaggcaagaagggattgctcatgaggttcttcagtggtatttgtgccgtatggagggttggtttgccaccgacgctgattcaatttcactacagggttgggatcaggaggtgctgcttccaggtggccatggcctcat

SEQ ID NO: 8862 - DNA, 1079 bp, Zea mays
cattgggtacctcgaggccggccgggagctaggcaccctaccccgtgggcgcccgccggccgggaccacatcgccccgaccaaagcttccccagacggcaggagacagcagcaggccggacgccggactcctcctccctcccccgtacgcatccactgagatccttcctgtgcgaaggaaatctccagttcttcggccccggccaggttttcaagtgttgcttgccccgccggagttttcctctaacccgcaagtccaattggctaagaagttgatgggatcggggggacactggaaggctgtgtgagatcgcgaaggggaccgtgaattccttgcagggctgcggcgattcggctgcgctgctgtatgaactgtttcgtgaacctgggactcaactcgaactcgaaccactacgtcgcctgcctcctcatcttcctgctgcatttctccccccagttgttaaatccatccaattctaattcaaatagtaattgtgaaggagttcaacagagctgcacagatggcgaacaacagctcatatggtgaaaatgctaggagaaagccacacacaccatctgctattgttattggtggtgggtttgctggtcttgctgctgctgatgctctcagaaatgcatccttccaggttattctactggaatcccgtgataggattggtggcagagttcacactgactactcttttgggtttccggtcgatttgggagcatcttggcttcatggggtctgtgaagaaaatcccttggcaccaataattggaaggcttggacttccactgtaccgcacaagtggtgatgattctgtgctgtttgatcatgatctagagagttatgcactctatgacactaacggacgccaagtaccacaagagttggtagaaaagcttgggaaggtgtttgagaagatactggaagagactggcaaattgagggaagacatcaatgacgatgtgtctatcgcaaaagccatcgcaattgttatggctagacatacgcacttgatgcaagaagggattgcttatgaagtttttcagtggtatttgtgccgatggagggttg

SEQ ID NO: 8863 - DNA, 1137 bp, Zea mays
  misc_feature (3)..(3): n is a, c, g, or t
tcncacgcgtacgcggccgagacgaagtatctcaggttgcgaggtgcgacaaaccgacaagccaacaatggcgtcgtcagctgctacgaccgcgaagccgatcgcgctcccgccggcgccaacccgcggcggctgctgctgctggaggacacgcaggcccgcgatccccgcggcggcggcacgcctcaaggtctccgcctccgccgcctcgtcggacgtgccggacttcctctcgtccaattggcttgaaacccgcaagagaaagcccttcggtcccaggttgaattttagtgcagaagaagcagtcgaataccagcttgagtccttaaagtacaatgatctgccccgcccagattatgggatagaggtcatgtaccggtttgcaggctttgaccctttcgagaggtcaacttactttggacgacagtttgatctaggacagttcgagcgcttccggcgtctgtttcaccactcaacctacagagtgctgctgggccacagagagagaagaatattgagcagtttatgggttgaagagaaccagttcaagcaaagagtttgggtacaaggagcccgtcccgaggaagaagagatatttcaattcacaatggttcagagggtcggaggatcatgggatggttactggctgacagagagcttaataaacgatggagacgcgttctcgggtgggattgcttactgatgtagtgatgattggtgtaaatcgatcaggtgcagactagcaggtggcgtgaaaaagctgagagacatgttggtgtgtagaatttgccctggctttctggagatgtttggcactgtcggacacgctagtattgtacaggaagacctctcacggcgcccatagcaccagatggccaagcatgcatatctgtggaatacttttctgttgtacgcctgctgcttgcctggtttggtaagaggaagacggcgctgcacatcttgcgccttcatctgcagcgagttacggcgcggttctttcttgatgtcctctcctttctgtgtaaagtgcttcgagttttggccactgcctcttttcacttttacgtgtctgttgtttggtcgagacgtcgagtctatggtgtcgccagcagctcctgcatgcactctcgcgaccta

SEQ ID NO: 8864 - DNA, 1510 bp, Zea mays
gcacgagaccattacctagaacatcctaatcgaaaaattactgcacttgctctccggctccgggcagccacgagtatcagccccggcgagcggcggcgatgcagaacctgctgtccggcgcgtcccacgagacgctcccggacagcttcatcttcccggccgagcagcgcccgccggcgtcggcagccgccgtcgcgctccccgtcatcgacctgtccgggccccgcgacgaggtccggcgagccgttcttgaagctggcaaggagctaggcttcttccaggtggtgaaccacggcgtgccggagcaggtggtgcgggacatggaggcgtgctgcgaggagttcttccgcctccccgcggaggacaaggcggccttctactcggaggacacaagcaagcccaaccgcctcttcaccagcaccacctacggcaccggcggcgagcgctactggcgggactgcctccgcctggcctgcggcttccccgtcgccgccgacgccagggacgcctggcccgacaagcccgacggcctcagggaggcggcggagaggttcgtcgcgtcgacgaggcgcctgaacctggagctgctgcggctgctgtgcgagggcgtgggcctccgcgcggactacttcgagggggacctcagcgccggcgacgtggtcgtgaatgtcaaccactacccgccgtgcccggacccggcgcgcacgctgggcctgccgccgcactgcgaccgcaacctcatcacgctgctgctccagggcagcgtcgccggcctccaggtgtcctaccgcggcgactggatccgcgtccagcccgtgcccggcgccttcgtcgtcaactttggccaccagctcgagatcgccacgaacgggctgctgaagagcatcgagcaccgcgcggtggccagcgcggcggtgccgcgcacctcggtggcgacgttcatcatgcccaccgacgactgccttgtcgcccccgccgcggagctcgccggcggcggagacaagccgccgccgcggtaccgcgccgtcacgttccgggatttcatgaaggtgtacaagaccgtcggcgcgcgcagggagagcgtcgagaaggccttcaagatctgatggacgcgtatacatgctcgacatgcgttctgctcggcagagatctggtagttgttatctgcactgaataaaaggatgggagaaaaaacagaaaacgtcgcaagcagttcgcggcacaaactctctgtctctttcgttccaatttgcaactgtgtgtgtgagccgatgatagtgagtagagagcttcgttcccaactccggtgagtgccagaagagccaacaagtcctgcacgaacaccagtcgtcaccggagagcttcctgccggtgtcggcaaggatgcaaaggtgccaagagaatcgctttgtgtgtgaccttgtgccccgaaataaagggattgttcttgtttagaaaaaaaaaaaaaaaatgattttaatatatatattataagaaaaatttacaggat

SEQ ID NO: 8865 - DNA, 1254 bp, Zea mays
cgcccagaactcccgaaacccgcccgtccccaaagctcattccacgaggcgacaaccttccttccataagaacagagcggccacgctgaggagtgaggaggaaggtaggaggagaaccgtgagcagagagacatggcgccccaccaccagcagcgggcgctgctcctgttcccactcgtcttcctcctcctcctccttgccccgcccctcgccggcgcgtggggaaaggagggccacatcatggtctgcaagatcgccgagaagtacctgtcggagaaggcggcggcggcggtgcaggcgctgctgccggagtcggcgggcggggagctgtcgacggtgtgcccgtgggcggaccaggtgcgctggcactaccactgggccagcccgctccactacgccaacaccccccaagtctgcaacttcaagtattctcgggactgccacaattctcgtggccagcaagggatgtgcgtcgtcggggctatcaacaactacacggaccagctctacagctacggccagaagacttcgtataacctgacggagagcctgatgttcctggcacacttcgtcggcgacgtccaccagccgctgcacgtaggcttcgaagatgacgagggcggtaacaccatcaccgtccactggtaccggaggaaagcaaacctccatcacgtgtgggatgtcagcattattgatacggcaatcaaggacttctacaacaagagcatggataccatggtagaggctctcaagatgaatcttacagatggatggtctgacgacatcgtccactgggaaaattgcaagaacaaacacgcgacctgcgcgaacgactatgcgattgagagcatccattattcctgcaactacgcctacaaagatgtggagcaagacatcactctaggagatgattattttttcagtaggtacccgattgtggagaagaggttagcgcaggctggaatcagattggcgttggtacttaatcggatatttggtggaggtgaagcggatgatataccactacaagtacagtaacagctgtaataaaaggaagcatagctattacaaggatttgtccattacgtcgtctatacatcaataaattggcatgaatttgtaactccattgctatacatcaataaattggcatgaatttgtaacaattgaaaggatcaagatgccacccttgaattgcacttctcaaaatttcttgaacaaaataaaatttataatcaagttcaactttctctc

SEQ ID NO: 8866 - DNA, 2294 bp, Zea mays
  misc_feature (7)..(7): n is a, c, g, or t
cgcccanaactcccgaaaccagcccaacaccaaagctcattccgcgcccccccggcccgcccgccctaagaacagagcggccacgctgaggagtgaggaggaaggtaggaggagaaccgtgagcagagagacatggcgccccaccaccagcagcgggcgctgctcctgttcccactcgtcttcctcctcctcctccttgccccgcccctcgccggcgcgtggggaaaggagggccacatcatggtctgcaagatcgccgagaagtacctgtcggagaaggcggcggcggcggtgcaggcgctgctgccggagtcggcgggcggggagctgtcgacggtgtgcccgtgggcggaccaggtgcgctggcactaccactgggccagcccgctccactacgccaacaccccccaagtctgcaacttcaagtattctcgggactgccacaattctcgtggccagcaagggatgtgcgtcgtcggggctatcaacaactacacggaccagctctacagctacggccagaagacttcgtataacctgacggagagcctgatgttcctggcacacttcgtcggcgacgtccaccagccgctgcacgtaggcttcgaagatgacgagggcggtaacaccatcaccgtccactggtaccggaggaaagcaaacctccatcacgtctgtgcctgctgcacctcttcgatgccagatttcagatgtgtatactcaccaggtatagcccgtctgagtctctgagagtcagaatcctgtgtttttgctaggtgtgggatgtcagcattattgatacggcgatcaaggacttctacaacaagagcatggataccatggtagaggctctcaagatgaatcttacagatggatggtctgacgacatcgtccactgggaaaattgcaagaacaaacacgcgacctgcgcgaacgactatgcgattgagagcatccattattcctgcaactacgcctacaaagatgtggagcaagacatcactctaggagatgattattttttcagtaggtacccgattgtggagaagaggttagcgcaggctggaatcagattggcgttggtacttaatcggatatttggtggaggtgaagcggatgatataccactacaagtacagtaacagctctaataaaaggaagcatagctattacaaggatttgtccattacgtcgtctatacatcaataaattggcatgaatttgtaactccattgctatacatcaataaattggcatgaatttgtaacaactgaaaggatcaagatgccacccttgaattgcacttctcaaaatttcttgaacaaaataaaatttataatcaagttcaacttttctcttctgactcccccccccccaccgccttttgcactcgaaatttcattcctatactaacatgacaattctagcaaagtaaatgtgtaaaatcaattgttcaaatataaatgtgtaaactaaagaaggtattaggaaatccttggtgttttgacgatgtatcatagagtcggcactctccactagttctcgttggagcactcatataagagcgttgctctccttcacaaggactaagtgctctctgtgagccggtttctttgccactggatgaacatgaaccactcacaaccatgcataagcttgagttggatcactcacatgctctctaggtgatcatcaaacttttgattgccaccaaaccgtctaggtgatgtcgatcaccaagagtaacaattactaactttcattgttctgaccaagtctaataaaggtggtacatgcatacaaactactattaatgcactagtgaggccactaatcatgtgattatcatcactaagtccctcactaggtaatggatattcttcactctcaaatggtttcttcaacatttgaaatgggcaagagacctcatttggctaagttggagagtataaatagccccaagcaaaagaactagtcattacaattcaacttagcaagtcgagggcacatgacatgtccaatgcataccaactccctactctagacatgtctaggggtggtaatggatcactatccaaatacttattcataatttatctaagcccttaattaattttagttcaaaaatggatagaaatagagcatgatcctacaccgagctgatctttaaattttatcatgtgaaattaagagctcattaccacccctaaacatgcctcgtgtttcctcaatggctagtttcagaaactagtcgttattgtactcttatccgataagtatagcctcgaatgcat

SEQ ID NO: 8867 - DNA, 1786 bp, Zea mays
gtcgctcagtggcatgtcgcagatgaacttaagccataaccagctcactggcggcataccggcggggttaggctcgatgccggagctcaccctgctggacctttcgtcaaaccagctttccggcgccataccgccggcgctgggaacgctgagggtcaaccagcttaatctgtcctccaaccagctcaccggcgaggttcccgatgcgctcgcccgtacctacgaccaaagcttcatccgcaatccaggcctctgcaccgccccgccggtgtcgggcatgcgctcgtgcgcggccccgtcaaccgaccatgtctcgccgcgtctccgtgcgggcctcctcgccgcgggcgccgcgctcgtcgtcctcatcgcggcgctcgccgtcttcgtcgtccgcgacatcaggaggcggaagcggcggctcgcgctggctgaggagccctggaagctcaccgctttccagcccgtggacttcggcgaggcctccgtgctgcgcgggctcgccgacgagaacctcatcggcaagggcggctcggggcgcgtgtaccgcgtcacgtacaccagccggagcagcggcgaagcggcgggcaccgtggccgtgaagcgcatctgggccggcgggagtctggacaagaagctggagcgcgagttcgcgtcggaggtggacatcctcggccacatccggcacagcaacatcgtgaagctcctctgctgcctctcccgcgcggagaccaagctactcgtctacgagttcatgggcaacggcagcctggaccagtggctgcacggccacagcaggctggccgggaccgggactgccatggccagggccccgtcggtccggcgtgagccgctggactggccgacgagggtcaaggtggccgtcggcgccgcgcgcgggctgtactacatgcatcatgagtgctcgccgcccatcgtgcaccgcgacgtcaagtccagcaacatcttgctcgactcggagctcaatgccaaggtcgccgacttcgggctcgcccggatgttggtccaggccggcacgaccgacacgatgaccgccgtcgccggatcgttcggctacatggctcccgagtccgtgtacacgaggaaggtgaacgagaaggtcgacgtgtacagcttcggggtcgttctcttggagctgaccaccggtaggttggccaacgacggcggcgagcacggctccctggccgactgggcgtggcggcacctgcagtccggtaaaagcatcgccgaggccgcagacaagtccatcgcggacgccggttacggtgaccaagtcgaggccgtcttcaagctcggcattatatgcaccggtcgccagccgtcctcgcggccgacgatgaagggtgtgcttcagatactgcagcggtgcgagcaggcgcaccagaggaccttcgacgagaaggtcgccgactacgacgccgctccgctgctgcaggtgcatggaggtagccgccggaaacaactctccgatgccgaagtgatcgacgacgatgggaagggcggtttcgactgcaatgtctgaagaaaagcagaatgagcaatggctatgggaaccctgaccacctgaggccagaacctagcatataggacgccatgtgcttgtgcacgctctttgccagagcaaaggatagtcatcacagctcattacaacaacactgatggacagtgccaccccgtaatataggtttttatgtactgtaacagcgaaactataaaactaaatccaatcatatatttgacgaagcagtgaagagaaaaagggtta

SEQ ID NO: 8868 - DNA, 1899 bp, Zea mays
tccgcgggtacctcgcggccggccgggaacttgttctctcttccccacaacggcgagtttgagctgagctcacgctcgtcatctaactctccccccattcgcaatccaaaaagcttgcgcgctactccactggtccattacttacgcagtcagttcagcgagtgagcactgagcagccatgtagcaatttcaattgcaagttgcaacgcgacgaatacggagccatggacgacggcgccgcaaccacaatcgtccaaggcggcgacgcgcacgtcctgctcctgccgttccctgggatgcagggccacgcgaacccgatgctccagcttggccggcggctggccttccacggcctgcgccccaccttggtggtctcccgccacgtcctctccaccacctccacctccaggtcgtgccccatccccgtggccgccatctcggacggcttcgacgacggcgggatctcctcatgcccggacaccgcggagtacgtgcgccggatggaggccgcggggtcggagacgctggcggggctcctggacgccgaggcccgcgcggggcggcccgtccgcgtgctggtgtacgactcgcacctgccatgggcgcgccgcgtggcgcgggccgccggcgtggccgccgccgcgttcatgacgcagatgtgcgcggtgggcctcgtctacggcgaggcgtgggccgggcgggtggccctgccactggcggacggggccgcgctgcgcgggaggctcgccgtggagctgggccccgacgacgtgccgccgttcgtggcggcgcccgagtggtacccggcgttcaccgagtccgcgctgagccagttcgacgggctggagcacgccgacgacgtgctcgtcaactcgttccgtgacctggagccaatggaagcggattacctggagtcgacgtggcgcgcgaagaccgtcggcccgacactgccgtcgttctacctcgacgacggccgcttgccatgcgacaagacatacggcgtggacctcttctcgagcaccgactccgaggcggcgccgtgcatgacgtggcttgacaagcaggagccctgctccgtcgtcctcgcgtcgtacgggaccgtcgccaacctcaacaaggagcagctggacgagctcggcaacggactgtgcgattccggcaagcctttcgtttgggtgctgaggtccaacgaggcagagaagctgtctcgacagctcggtggcaggtgcaaggagaggggcctcattgtccccttctgtcctcagctcgaggtgctggcacacaaggccacaggttgcttcctgacgcactgcgggtggaactcgacgattgaatccatcgctagtggtgttccaatggtggcgatgccgcagtgggcggaccagccgacgacggccaagtatgtggagagcgcgtgggggattggggtgcgcatgcggaagggttccttggtgaggaaggaggtggagaggtgcataagggaggtgatgggcggggagaggaagcatgtgtacgggaggaatgccgctcgttggatgcacaaggccaaggaggccatgcaggaaggaggaagctctgacaagaacattgcagaattcgcagccaagtatttaccaaagtagatttccgattatgttctcctcggataatgagttttttgggcaataaagtttcttgtctttagggctaatttcgaaacttatcgtgtgcttggtttgtagagtcaccctatttctcattatatactagttattagtttatgagaaataaggtggtgatgaatcaacccgttttattttacaaaccaaataaaaaagtaatgaatgagaataagatgtattggtagaatttccccggctacggaggttgtctccacggctaatcgttggagagttggaa

SEQ ID NO: 8869 - DNA, 4406 bp, Zea mays
ccggccgggccgggctgttccgtcgtttcgtcgcacgagaccattacctagaacatcctaatcgaaaaacaactcggcaactacggagctgcctccaactcatttgcttaccatccctaccgcctggctcagatctcgatgcggcgcaagcttcccggcgacgcgccgctgtcggcggcggggcctggtcatgcgttgtccgcatccgcgccgtccgaggtggacctcgctcagctctccgccgccatcgcggccggggaggaccttggccccttcgtgcgccgggccttcgcgtgcggccgccccgagccgctgctcgcctcgctccgcggcgcggcgcgggaccgcgaggcggagatcgaggagctctgccgcgcacacttccacgattttatccgcgccgtcgacgacctccggtccctccttgccgacgccgacgcgctcaagggctccctctcggcgtcccactccgcgcttctctcctcggcggccccgttgctcgcctcgcttgaatccttcctcgccgcgcgctcgctcgcggggaatctctcctccgcgctagcctcctcccgacgctgcgtacggctgctcgcgctcgcggcgcgggcgaacgcgcacttacaggccggcaatcatgggctctacctcgccctgcgcgccgtcgacgccatcgaccgtgatctcgcctcgggacccgagcctctgccgctacccacgctccgccgcatgctgctcagcgtcgtccctgcggtgcgtgcgcatgccgagcgcgagatctcccgggagttctcagactggatggttagcattcgcgctgcttcgaggcacctcggccaggtggccatcagccggtcggctgccgcgaggcagcgccaggaggagctccgctccaagcaccgcccgctggaggagtgcatcaccttggatgacgatggtgttggtgacctcgacgattttgcggcagccgcggcaacagctgaagcagcagatggtgccgctgcagcctcttttgaccttacgccgctctatcgagcgatgcatatacaccagacgctggcgctaggtgagcggttcaagaagtactacctggaaaacaggaagctgcagctgacatcggacttcgatgtcattgcggcgacgccattcctagagtcccaccaggtgtttttctcgcagattgctgggttttttattgttgaggaccgggtgtttagaacagggggtgggcttacatctcggccagatgtagatgcactttgggatgctgctgtggggaagatggtctctgtgatggaagacaacttctccaggatgcagacagcaaatcacttgcttctcatcactgattatgctgctttgctttctgccacaatgcggcggtatggttatccagtagggatgctactcgatgtgctggctaagcacagggacaagtaccatgatttgctgcttgcagattgccgtaggcaggtggctgaggcactgacagcagataagtttgatcagatgctcatgagaaaggagtatgagtactcaatgaatgtccttgcatttggaattcagagctcagacattaccccagctttcccatatgttgcaccgttttcatgcaccgtcccagacatttgccgtattgttcgttcgttcattgaagattctgtgagcttcatggcacatgggggaggtggggatacctatgcagcagtgaagaagtaccttggtcggatcctatctgaggtggtggatgcttcgattaaaaaacttttggattcaggcagtggtctaagtgtgtcccaggcaatgcaggttgctgctaacatgtctgtgatggagcgggcatgcgagttctttacacgccatgctgcacaactgtgtggtgtgccgctgcgtgctgtggagcgtggtcggcgggacttcccacttcgcaggtcacgtgatgctgcggaggcgctcctgctgcggcttctgcgtgccaaggttgatgagtttatgagacaatctgatggtatcaactggatggctgatgactctcctcctggcggcaatgagtatgcgaatgaggtcatcatctaccttgagacgctcacatcaacggcacagcagatccttccccttcctgtgctacaccgtgtacttgtggcagtgcttgcccacatctctgaaaggatcatcgagctcttcttgaacgattcagtaaagcggttcaatgccaatgcggtcactggtatagatactgatctcaaaatgtttgagacgtttgcagagggcatgtctagcctgtttgtggactcaggtcaagaatctgcaaaaaatgaaatgaaggctgcactagtggaagcaaggcagctagtgaatcttcttatgagcaatagtccagagaatttcctaaatccagtgatccgtgagaagagctataacaagctagattatagaaaggttgcaatcatctcagagaagtttagagatacctcagagagttatttctcaacatttgggacaaggggtgccaggcagaacccaaagaagaaatctctggataccctgatcaagaggctcagagaagccagttagatatcctcccagctgtaagataatacatgcaactggcttctcacatcctcatattttcgtgaaataatctgtatctggtttgtgttatgcctgtttcagtcgttaaccttatgctgtaattgctgttagattctatgtttcatatgtgtggaaatcatcttgttgattcttttgccatttactatatgatcgaggtatagtatattagtatggcataatggttaattttgcctgtgaggagaaattgctcgctaagaccaatattttatatttttcttcaggagatagggatgcttttatttcccccctccagttccttactcttggtaacaaacgatttaatgttatatatatttgaatgttataaaggtaaacttcggtaagagatcaacaaatccttgtaacttgatattgctaagaagtgatcaccccataagtagcaatgccttaggattaaatttgggaactgaacctacctgagttggtgaagggtgtggatgcacacctagaagatctaagttctagtccttgtgatagcatgcctagtttgtccaaagtccgtaatataaagcttcctttcttttgagttggtttatttattttaaaagtagttatgaattgtttattctattagaagatatagatttccatttgctgctttgagacaacactactcattgatttgaatttccaggttgaccggtaaattactggattgtgggaaccataaagatgacaatgtcttttcaaccctttagctcactgttggctatcttttacaatttctgaaagataattgaacatgttagaatgtattgtgtgagttcttgttagggttatgtatagaccccttttgtattgggccttggcccacctaactctattattaatttatcaccaaccctagttagtgttagggtttcagtttttccaacatgatatccagctaggttttctttctcctcttctcccccaccagtcgctagccctccaccctttcctcccttgccctcatcgctaggccccatcccttcttcaccatcacgctgccaggcccttcccatggttggcgacccctagatctgagccatcggacatctcgtgggttgtcggcgcgcccaacgagcttgcacccctcccttcaagcttcgacgccatcgacctttcctctgccgcggcgatgactgctcagctccaacccagaaccgctcttccccacggcgtggccgcgctcgcttctatctcgccctgcgacgctcctgttctccaacgctccattcgacgtggcaacgaccgcctgactccaatccggtcacgcccgacgcccttcctcacggcggcttgcccccaatcccttctcccggtgtctcccaccagcccgcgacgtggccctgcgccgccctccagcctgcgctagccccttgcatcgccaactgccctatctgacagaccacgacacccatctacccgctcgcgttggccccctgcttcccccatcaggccgcaacgccctccctttatagtgtggcctcctcggcgtggggctctgcttgtctcgctcttcctggtgccatcgctactggtccgagcttcgcgtctggcgtcacccctctacatggcgtggccgcaacaacccgtgccgccctcatcctcactgacacgactgcattggccgacactgtacaaccctgttcctatcccgtgtccggcttcgtcgtgcagccctctcgcgctgcacgccctccccatgggcctgtcgtcgttgacatgtctctcttccccaccttcgtgtcgccacactcttctccatggatgggcacttcgcctgccggacc

SEQ ID NO: 8870 - DNA, 1378 bp, Zea mays
gcacgtcgccacgttatatttcgtccgccgtcctccgcctccgccgcaccattttcgtcagctctcctggcgcccggtggctcgccggcgcaaattaagtaattaacccgaactccctggcattctccgcgggcctgtagtcttgtagcctctcgcttgcttcgccgtagcacttgcttaattagggcggtgttcgagaggtgggtgtggtggtgtactggtgtactagtactactcgcctcgcctcgcctcgcctcgagggtttgtttgactggcggaggcaggagctgcggcggtccgggagcgcatggggaacgcgaacgccaaggagggggagaacggccacatggcggcgtctcctgagccggcggctcccaacggcggcggaggaagcagcagctcggcgggaggcgctgccgcgcgacctccaccgttgtcgccgccagacgacgtgatgctggagcgtccaccgcccgtgccctatctcttcgtgccgcaggttccagagactccactgcacagacctactgagctctctcctcttctcaaccattcaccggtaaacgaatccaccgaccaccactcccaggagcagggtattccaactctgattacatggagccaaggaggagatgaggtgttcctggaaggatcgtgggataactggacatcgaggagggcacttgagagatctggaaaagatcacgccgtcttgttggttctgccatccggagtctaccattaccggatcatcgtggacggggagctgaggtacatccctgaactacctcacgcagctgacgaaagagggcgagtggccaacgtcctcgatgtccatgactacgtgccagaaagcctcgacagcgtagccgagttcgaagcgcccccgtctcccgtgcacagctacgacctgcattgcccgggcgacgaggagttcgccaaggagccgcccacgctcccgccccagcttctcgtgtccgtcctcgggggggacgtcgatagcgctggccatggcaatcaagctttgaagccacagcacgtcgtcctcgaccacctgttcatcgagaaagggtgggggtcgcagtcgctgctcgccctcggcgtcacccaccggtttgagtccaagtacgtgagctttgtgctctacaagccgttggagaggtgatggtggtactgtctactagctgtgtgtgagtggaagaacagagtggactgctggaggtgaataatgtgtgtgtgtgcccttgtatagaagggaaatgcatgcaggagcttgtagctgtagctgatcttttattttatttttttattttcctttcactttcgacgaaagtaataaattagttgaccatgcatgcatgcttcgtgcaaaccgcct

SEQ ID NO: 8871 - DNA, 1533 bp, Zea mays
ctcgtgccgttttttttttttttttttcaagaaataatatgacatgttctagatattggtccattaatcacaaccaagaggtccaagatatcacttgcagataacataaccctgctactccatgacatttgcttgaagattatcatcatattcctctatttgaaatgcatgttataatgttatcctaactttgcataaactcgtcagtccgcagcattattaagaacatatacctaataatacacaaaaggttttacagtacattaggatgcctgaattatcaccaggctacaaacctaagacctcttccatggttacaaaccggccctgctcgattgataattgcccagccacaccgacggcaacagatagtaggccgtcacttaagttcacagatggtccggatgcaccttgagcccttatagcagacaagaaattgaggtgctccaagtagctggatccatgatgaagaccttgatacttgatccgttcatcttccgccattattgttacaactccatctctgccttctgttctctttccaaacctgacaatgctctctggaacaaaagtttcgcccttcccaatgtcaccaaccacacaaatttcttgctcgtttctacttccttcagcaaacatgcagagatcaagcatgccacgggagccattatcaaattctactatcacatatgcattatcaataatatctggtacctgtccatcatacacttcattcttatggttaacatcaatggctcctgaagccatcacgcgaactggatttgcagccgcaaacaatatcatcagatcaaagaagtggcagcacttctctactagagttcccccactgttacaattgaatctattccagttgtttaccttaacaaggaaaggaaaacggtgttcgcgtattgccaccattctgacttgtcctagtgtaccgctcttaacgatgtctatcagcttagcaacgggtggcatatacctgtattctaatccaacttgcacaactatctctggtctctgtttagcagcttcaatgaccttcttgcagtcctgcacagtggtgcacaggggcttctcgacaaggatgtgctgcggttcacgatggtggatgatgtccatgagtatctcgtagtgggtcatgtttggggatgatacgatgatggcgtcacagagcccgctgtccagcagctcgcggtgacctggaaaggtctggggaggcgggaggccgagctcagcggcgagctggaggccaaggcggagtgactcctggtgggggtcggcgaggccggtgacccgcacccggacggactgctcccgctcgacctctgtggcgaggtgggcgaggttgtggaggtgctcccggcccatcatccccaccccgactatcccatacctcacctccgccgccgccgccgccgcctcctccatctcctacagcgatgattgtagtggactggagtgttgacacttgacaggtggttgctgcgacgccaatcaaaaacgaatgaagctcgctttctatttaat

SEQ ID NO: 8872 - DNA, 5924 bp, Zea mays
  misc_feature (431)..(431): n is a, c, g, or t
  misc_feature (445)..(445): n is a, c, g, or t
  misc_feature (464)..(464): n is a, c, g, or t
  misc_feature (528)..(528): n is a, c, g, or t
  misc_feature (3121)..(3121): n is a, c, g, or t
  misc_feature (3143)..(3143): n is a, c, g, or t
  misc_feature (3273)..(3273): n is a, c, g, or t
  misc_feature (3291)..(3291): n is a, c, g, or t
  misc_feature (3665)..(3665): n is a, c, g, or t
ggtggcgagggtgaagagtgacttcacgtttatgacaccgtccagcatagtgatgtggatgctagtgcccccatccccgctgcctcgactcgtgttgtcatcatcctctatgcagaacctgttaaaactattgaaccaactcaagccagcggttgcggtgcagaacctgatttaggctcccgtccgtagacaactttgaatggagaacatttcagtgccgattgatatgatgaattatagcaaaattctgcccatggtaaccatttcagccatgatttaggacggtccccagctagacagcgcagatacatggtgattattctgttaacaacttctgactgaccatcggtttgtgggtggaatgctgagctcatttgtaacttcactccagccatggtaaatagttcagtccagaactggctagtgaaaantgtgtcccgatcantgactatcgagcatggcanaccatgaagtttgacaatttcgtcaaagaaggcctttgccactgatgctgctgaatatggatgncctaaagtaataaaatgaccatacttagagaaccgatccaccactgttagaactactgacttgccaccaacctttgggaatccttcaataaagtccattgatatatcagcccacaccatagagggaattggcaagggttgaagtaggccggctgggtgaagatgctgagtcttatgttgttggcaaactgcacagctgcgcacaaactccctaacacgttggagagctttagaattgtaaaatgatgtgcgccacctatgggctgtcttctgcacgccttcatgaccagactcatgtgcttgggccagaagttgaggccacaaagtggatgcatccgggatgaataccttgcctttgaaccgtagtaagccatctgccattgtccagtcaggacttgcttttccctctgccagctgagcgcggactgcaaccccttgagggtctgagtcagacctccgtttgcaaagtagagaagagatcaaaggaaggggaagaaagggtatacacagttcctgtatcttcctctcggcgagacaatgcatctgctgcgccattcaacttgccgggcctgtattccactgttatatcatacccaaacagtttgctgacccaagtatgctgagggattgttgacagccgctgatcgagcaagaattttaagctatagtggtcagtgcggactgtaaagggtcggccccagacatatggccgccagtgtcgaactgcctttaccaatccaatcaactcccgctcatatgctggcaatttttggtgatgaagggacaccggcctgctgaagaaggctatggcaccatcgccttggtgcaggactgctccaaatccagagccggaggcagcacagtcaatgaaaaaccttttgtcgaaatccggtaactggagaagtggtgctgtcagcaaggcttgtttgagttgacagaaagcctcggctgtttcctctgtccagtggaatgcatctcttttcaggagggctgtaagaggagctgccactgacccatatcctgctataaacttgcggtaataccctgtgagtcctaggaagctgcggagtgctcggatggtcctcggtatgggccatgattcaaccgcgtccaccttggaagggtccatggcgaccccctgcgcagagacaatgtgtccaaggtaagtgactgcagatttaccaaatgagcacttggacttcttaagaacaaggttgttgtcccgcagtaattggaatacttgcttcacatgttgtaagtgttctgtccaggacgagctatatatcagaatgtcatcaaagaataccagggtgaactttcggatgaacggcttcagtatatcattcatcagagcttggaatgtggatggcgcattagtcaggccgaacggcatgactagaaattcaaagtgaccacaatgtgtacggaaggctgttttgtggatgtcatccgggtgcatcctgacttgatgataaccactccggagatccagctttgtgaagaaacttgcacctcggagttcatcaagtagctcgtccaccaccggaattggaaatttgtccttgattgtttttgcatttaattcacggtaatcaatgcaaaacctccatgttttatctgccttcttgaccaataatacaggtgacgagaatgctgatgtgcactctcgaatgatgccttgtgccaacatctgatcacactgacgctcaatctcgtctttaagcagttgagggtatcggtagggtcgtacaaccactggttctgtaccagccagcaaccgtatgtgatggtcttggcgacgtgatggtggcagtccctgagggtcctgaaacaaatcagagaaagaggacagcagttcttccatacaatccctgttcttgtccatggatgcaaatcccaacactgagtccccaacccctgtcaattgtaccaaccttcccttcctccagaatgccattgtgtgtgtgtcaaagttgcagaccaccggtcctagagatcgcagccactgcactcctaatacgagatcgaaaccatcaagaggcaaggaataacatgttgtggtgaatttctcctggccgatggtgagggttgctgtgatttgacccttgcttgaaatgcgttctccattggcaacttttaccgataggcctggctgggacagcacttgcaatccgagacgtgccactgcagcttcactgaggaatgtgtgagtggatcctgaatccactagtgcagttaaattgatgccgttgattgtgactgggagcctgagagtatctgtgacgcctatcccagtcatggcctgaagagaaattcccaagtcgactggtaatggaggttctgtggttgtatcctcttcttccaattcaagcaagaatataccacggcctgaacacttgtgttctggtgaatatttttccttacagtggtagcattctccactggcgcgtttggcggctaactcatctggagataggcgcctaaaacgtggtcggttggccgtagttgctgccggtcgtgccattgttggtgctgcaggtttggagggtacttccagagctgttgtggactgtccagtggagctgcccgtgtgnatcaaacgtcgttcatacaccntggccagatgcatagcacgctgcagcgtctctggagtttgtaattccacatcagttcggagaggttcgcctaagcctgctgtgtacatgttagactgttgccgatgagacatgtcgtcacaacggcacancagggttaagaattggcncgaatactcttccacggtgcctgtgcgcttcagttcttttaaatcagccatgccattgaacctgagtggtggcccgaagcgcatctggatgaactcaatgaagcgtgtccaagtcagcacgccgcctagatcgcgctccaaggcatagaaccattccgcagccacaccttccaagtgaagcgatgcttgccagaccctctcgtcttgatgaactcccatgccgcgaaaatatgtatcacatttgttcagccatggcaagggatcagaatcaccatcataatggggaaaagaaaaattgggcctgcgtagtcctccttcgtcgtggcgatcacggtgtccaccaagaatgccccggcgaccacttccatatccancgtcgctgcccccagatgcagtttgcccctgcaccaacatggctctcgagtgcaggacctgtaggcagggtcatcgagggcagaggctgtccccgcggcgagcccgtctgggtggggggttcctgctccaggagagtgatacgctgcgcatgagtgtccagccggtgattcatggtggcgagttgccccagaatgcgatcaagcttctcggagttcgtcatcttcccagtctcgtcgtcgccgccggacattgatgtcgatgcagcggctgaatctgataccaaattgttacgaatcctgctgcgatgcgcaggacggggaggcgtacaccacgaagggtgagttagtagggtggattgagtggaggagcgcagggaatagggcacgcagcgtggcggctgaggaacacgatcaccagggcgcgtgggggtcgccactgtgatcaagcagccgcccacgcaggtgcgacttcttttgataaaaaaaccctattacaatctgagacacccttatagctccggggcctaacaacttaggagattattaaggagataagctccagggaacaacttaggagattattaaggagataagctccagggaggataagcctcctaaaacttctctaacacccagccgccatctaacaaatggctgggcctaattattctggcgcctggcatattgccggcccacaaaagagtctataacagtataacaaatatattaattaattaacactactttcacagaaagaaacatttcattgaagggaacatgtacttctacaattggtgacattttttccctcaagtttcaggcctttcttgtaaggataacatacttgtacgctgtaactacacagcagtataactaagttacctagaatcacatctgcaagaggttacagattaatatgtcaccacttggaaaataaaaggtgcaagaaaaatatatagctgtatttgtaccttcccaatgtcaccaaccacacaaatttcttgctcgtttctacttccttcagcaaacatgcagagatcaagcatgccacgggagccattatcaaattctactatcacatatgcattatcaataatatctggtacctgcattaggagataatcaacttttagccactacaggaatgtttaaaggctgccttcagcttgtggtttatttactggtattgattaggatttccaactctgcaacattatacaaatgctagagcagtgagtctaaatataagcactcaggctttcactggttacaccagatcgcaagtctttcagtagaaagagagacgaaacagaacatctttattgaaaatagcatgctgcatgagcatgagcacagagctatgcatgcgcagaatatgcatccaatgaaatgttttaatcaagcagtgagacaaccagacctgtccatcatacacttcattcttatggttaacatcaatggctcctgaagccatcacgcgaactggatttgcagccgcaaacaatatcatcagatcaaagaagtggcagcacttctctactagagttcccccactgttacaattgaatctattccagttgtttaccttaacaaggaaaggaaaacggtgttcgcgtattgccaccattctgacttgtcctagtgtaccgctcttaacgatgtctatcagcttagcaacgggtggcatatacctgtattctaatccaacttgcacaactatctctggtctctgtttagcagcttcaatgaccttcttgcagtcctgcacagtggtgcacaggggcttctcgacaaggatgtgctgcggttcacgatggtggatgatgtccatgagtatctcgtagtgggtcatgtttggggatgatacgatgatggcgtcacagagcccgctgtccagcagctcgcggtgacctggaaaggtcttgaaacctttggatgtcactggggaggcgggaggccgagctcagcggcgagctggaggccaaggcggagtgacccctggtgggggtcgccgaggccggtgacccgcacccggacggactgctcccgctcgacctctgtggcgaggtgggcgaggttgtggaggtgctcccggcccatcatccccaccccgactatcccatacctcacctccgccgccgccgccgccgcctcctccatctcctacagcgatgattgtagtggactggagtgttgacacttgacaggtggttgctgcgacgccaatcaaaaacgaatgaagctcgctttctatttaat

SEQ ID NO: 8873 - DNA, 1645 bp, Zea mays
ttggccaatcctgacacattatcttctgctccccgcggggccggccgggagctcacccagatcagaatccagacctcgtcagagagcattcccttgtgcatctcggcctctccttcctcccttcctcgcccgcccagtcctctaaccatcttctccaaacgcccggagatggtctcgctgcgatgcaccaccgcgcaccactccctcctcggctcgccgacctgcctcgcgcgcccgcggcggcggccgtgccccgtcgtgcgcgctgccgtcgccgtggaggccggcgctcaggccaaggtctcactcatccggattgggacgcgtgggagtcctctggctcttgcacaagcccatgaaactcgggaaaaactgaaagccgcacactctgagttagctgaggagggggctattgagatcgtcatcataaagaccacaggagacatgatcttggacaaaccccttgcagatattggaggcaagggtttattcaccaaggagatagatgatgcactcttgcagggaaggattgatatagctgtgcactctatgaaagatgttccaacatatctacctgaaggcacaatattgccctgtaacctcccacgagaagatgtaagagatgcattcatatgcttgactgcaaattcgctcgcggagcttcctgctggcagtgttgttggaagtgcttccttgcggagacaatctcagattctctacagatatccatcactgaaagtagttaacttcagaggaaatgttcagacacggttaaggaaactcaaggaaggagatgtgtctgctacattgttggcgctggctggattaaggcggctaaatatggcagaaaatgcaacagctgtactatcagtggaagaaatgcttccggcagttgcccaaggtgctattggaatcgcttgccgaagcaacgatgacaaaatgatggagtatctgtcctcgttgaaccacgaggataccagactagctgtcacatgcgaaagagaattcttggcagttcttgatggcaactgccgaactccaattgcggcctatgcttaccgtgacaaggacgggaactgctcattccggggcctactgtcttcaccagacggatctaaagtatttgagacggcaagaagtggaccgtactctttcgacgacatggtcgagatgggcaaagacgctggccacgagctgaaggcgaaggctgggcctggcttcttcgatagccttcaatgaacagaatgtgcggccatgcgcgatttcagttggcaccctttcggttgaaaacgagggccaaagtaggttgttgaggggtttgtttttgtttcttctttttttctcctactactagttcctgctagagccttgtactaccactcatgttgagcagccccattcagcttttgttgtatctcatgttcttttagcactctgggttagagagagccggtatctgcacagctatgttgtgtcgaagttgatgtgactctgcagatagttgttgtttcaagaatatttgagcgagctcatgataaccatgggagtaagattcgatgttcctattcttcggaaaaaaaaaaaaaaaaaaagcccctccggccaaaaaaaaaaaaaaaaaaaacgcgagactagttcctcgtgc

SEQ ID NO: 8874 - DNA, 1616 bp, Zea mays
  misc_feature (1604)..(1604): n is a, c, g, or t
  misc_feature (1608)..(1608): n is a, c, g, or t
  misc_feature (1611)..(1611): n is a, c, g, or t
  misc_feature (1613)..(1613): n is a, c, g, or t
ctcgaggccggccggtggttggccaatcctgacacattatcctctccacctcttcagaatccggacctcggcagagtccagtccctcgtgcatctcggcctctccactctcctttccacgcccgtccagtcctctaatctgacccctcttctccagccggccggagatggtctcgctgcgatgcacaaccgcgcaccactccctcctcggctcgccgacctgcctcgcgcgcccgcggcggcgggcgtgccccgtcgtgcgcgctgccgtcgccgtggaggccggcgcgcaggccaaggtctcactcatccgaattgggacgcgtgggagtcctcttgctcttgcacaagcccacgaaactcgagaaaaactgaaagccacacactctgagttagctgaggagagggccattgagatcgtcatcataaagaccacaggagacatgatcttggacaaaccccttgcagacattggaggcaagggtttattcaccaaggagatagatgatgcgctcttgcagggaaggattgatatcgctgttcactctatgaaagatgttccaacatatctacctgaaggcacaatattgccctgtaacctaccacgagaagatgtcagagacgcattcatatgtttgactgcaaattcgcttgcagagcttcctgctggcagtgttattggaagtgcttctctgcggagacaatctcagattctctacagatatccatcactgaaagtagttaacttcagaggaaacgttcagacacggttaaggaaactcaaggagggagatgtctctgctacattgttggcactggctggattaaggcggctaaatatggcagaaaatgcaactgctgtactatcagtggaagaaatgcttccagcagttgcccaaggtgctattggaatagcttgccgaagcaatgatgacaaaatgatggagtatctatcagcgttgaaccatgaagataccagattagctgttgcatgtgaaagagaatttttggcagttcttgatggtaactgccgaactccaattgcagcctatgcttaccgtgacaatgatgggaattgctcattccgcggtctattggcttccccagatggatctaaagtatttgagacaacaagaagtggaccgtactcttttgacgacatggttgagatgggcaaagatgctggtcatgagctgaaggcaaaggctgggcctggcttctttgatagcttgcaatgaaaagaatgagcggccatgagcaatttcaattgtcactcttttggttagaaacagagggcccaagtagagtgttgagaggtttgtttttgtttcttctttctcctactagttctgctagagaagggtgtacctggtgtagtggtgagctgagtcatcaggtcgcgggttcgaagcatccagtctccgtatttgcgggagaaggtttgtctcggtttatctcttttccgctactcatatgggagaaatgtgggagcctcagtctgctctttttttttttccatactagttctgctagtgccttgtactatcactcgtattgagcagccccattcagctttgtagtgaaaaaaaaaaaaaaaaatccaanaaanaananaaa

SEQ ID NO: 8875 - DNA, 1721 bp, Zea mays
ctccaccacctcttcctcctcggtcctcacctggagttgtagcaagcagcaccacatcatatcacagcagagcagagagtggggtgaagcagggagctgggcaggagagccccaacggcctgtcctgccgcggccatgcgtttctctgcgctgctcctcatcgtggcgctgctctgcctcggcggcgggcgcgtggccgccggcttcgagtccatcttcccgccctacggctccagcttcttcggcgggcccgccggccgcttctgcgacggccgcctcgtcatcgacttcctcatggaggcaatggatatgccactcctcaacgcgtacctggattctctaggcacgccaagctttcggaccggcgttaattttgctcaagctggatgttcgatcacaccagcaaagccgacatcagtcagcccattctcatttggtctccagatcaagcagttcttcgccttcaagaacaaagtcactaagctcctgtctgaaggagatatgcacagccgatacattcctcagcaagattacttctcagagggactctacacgttcgatattgggcagaatgaccttgctggtgagttctattcaagaacagaggaccaggtcatcgcatccattccaactattttgctggaatttgagaatggtctcaagaaactgtatgaccaaggtgctaggaagttctggattcacaacacgggccccctcggttgcttgcctcaaaacattgccctcttcggcaaagacccatcccaactggacgagctccactgtgtggcgaagcacaaccgtgccgcaaagcttttcaacttacagctgcacgcactttgcacgaagctgagggcagaattcgatggagccagcatcacttacgtggacatccacacgatcaaatacagcctgatcgccaactactctcgatacgggttcgagcacgccactcaggcgtgctgtggatacggaggcccacccctgaactacgatggtaacgtaccatgtggacacacggtgtctctggatggtaagatggtcaccgcaaaagggtgcagcgacactactgaattcgtcaactgggatgggatacattacacggaagctgcgaatttccatatcgcctcgcagatcctgaccgggaagtattctgatcctccgttcgtggataagatgccgttcgtcataaaacctagattctgattggcatacaattttccctctttactcacccactttacagcaccggttgcagatacgatgtatacttattacttgccaataaccatatatagcttgagtaaaaaaatcatatatacggcttggtttcagttgtccaaaaggttcagcttttttttttctaacggtcttttctaagaatctgattatgtagagaatttggttgtaagtgagtatataggatttagaatctgaaagtaaagtgtggatttctcttattgcggcaactcaattggttgtgggttcacattgattttaaacattttcccccaatcgatttttatataagatggctgaaaagttggacgtttgacggcctgtggtagcttatggtggctaaaatcagtaaaaagatgaaacaaacatagcctatagcttattgtgctcgatttgatgattatatcgcattatccttgtttggctcacttttttctgatgtgcttttataaaaatctagattccagcggaatctggctgtgagt

SEQ ID NO: 8876 - DNA, 1794 bp, Zea mays
cattgggtacctcgaggccggccggcacgagaccattacctagaacatcctaatcgaaaagtgtccccttggcgcggcgcccacctctgacctcgccactggagatgctgctgcgccagagctgaaccaaaaccccgggaaatcaggcagcaggccgccggaggaaatggagcagctggtgggagttcaccatcaccaccactcgctctcccctcgggctcctcgcaccccgacccgcccgcagccgcagccgcagccgcacccgctcctccaccatctcccgtccaacaggttccgggatctccactcccagattcacaatcacattcaccccgcggtccccgcggccagcagggtgctccgcgccaccccgcccttcttcctcatcctcctcgccgccgtctacctgctcgcctccgtcaccatcttctccgcccccacgccgctgctccgcctccgattggcctctcccaggccgctgatcctcccgaagcccgcgccaccgccgccgccgcctgcgccggagctctttgatctagacggcgggagtgtccgggtccgcctcaccaatgtcggcgccgccgtcacctcgttcctcgtcccggacaagaacggggttctcgctgatgtggtgctcggattcgactcgctggatccgtacctgaatggaacctcaccttactttggctgcattgttggtcgagttgcaaatagaatcaaggatggaaagttcactctaaatggggtgcagtacaatctgagtatcaacaacccacctaacactcttcatggtgggtttaaagggtttgacaaaactatatgggaagtcgccgagtataacaaaggggacaagccctcaatcaccttcaagtattacagtaaagatggagaggaaggttacccaggtgatgtttctgtcaccgcgagatactcgcttctcccaagcgcgacactgaagcttgagatggaagctataccactgaacaaggccacacccatcagcctagcacagcacacctactggaacctggcaggccacagctcaggagacgtgctctcgcactcggtccagatctggggctctcagataaccccggtagaccagacctcaatacctacaggcgagctcatgccagtgaccggcacccccttcgattttctgaccgggaccaggatcggaagcaggatcgaccaggtccccggcggttacgatcacaactacatggtcgactccggcgaagtgaggtcaggcctgcggcatgtggcgcacgtcgcggacccgtccagctcgagggccctggacatctgggccgacgcgcctggcgtgcagttctacaccggaaattctcttggtggcgtcgtgggcaaaggaggcgcggtctatgggaagcacgctggcctctgcctcgagacgcagggtttccccaacgctgttaaccagccgagttttccctcggtcgtgtttggccccggtgagaggtacagccatacgatgctgttcgagctctctaccgagtgagtcatgtagcccgtctgcctgcccgtgtagatagatagatatacaccgcttttattttccttgttgttttgtgcttgcgagtagttaagaaactgtggcgcgcgcggcggttgttcaattgattcttggtttagggctgaatgttgtagcaggaatgcaacaagactagtaggaaaggaacggatttgaggggagttagtaggttaccaaaaaaaaaaaaaaaactgatgtgaacctgtcacttgtgtgtgttgagtatagttcattcaggattt

SEQ ID NO: 8877 - DNA, 2015 bp, Zea mays
aaaaccaaaccgaaagctgtcgccaccgctcgccggagaaggagcatacgttccccaacccaccggggctccccccaaaacccaccacaaggcttgcccaaggcttcccctcgcccatgccacgctcgcgccttcccccgactccacacccgcgggcatgatccgcggcgatggaggactcggcgccatcgtccgccgcacctgaccctcccctttcccctccaccttccacgcccccgcacccgcccgaggaggaggggggctgctgggtgctcgttccggccagcgaggtcgagggggcccacgcgcccaaggtcatccactgggacgacctgcagcaggagctcgcgcgcctctggagcctctccgccgcgctccagcccgccgaggaccgcaaggcgcacctcaccgcgcgcctcgagtccgctctacaggctaggcaggcgtttctcgagcaggacaatgagttggctgaaatgaggcagagactgcaagagcgtactgaccgtctgggggatctgaagacgcgcgccaagaaactgtcagaggatgttgtggttcggagggaacagctttgtgtcaagatcagaacgttgtcaggggcaagcaaggctctcgaggctgcacgcagcaatctgaaggaagctaatgaattgctgtcaggggaaaatggttgtgggcgccttaaagatctggaacagcagttacggatgagacagcaatatatggtagcacaagttgctcagatatatcctgtgaggcctttggatgaacaatcttcagatcacaaacctggatttacttccaacataacgaaaacaagtaatgttgaatcagtgttgccaaatagcccccaacacagacctttggtcatattgggtctacagttatcaaagctttctgtgaaaaagactggctacttcagtgacaagacagaggttcagaaatcttcgactgttcttggatatgctgctcatgcagtctccctcattgcatcctatctcaatgttcctcttcggtatcccttgcgctttggaggttcacggtcatatgttctcgaccctgcgccttcagttgagccatcatctataacctcagtaggaacgtctgtccctcccagcacaagcatgaggacaacagagttccctctgtttcttgacagccaggagacaacaagatcatcatatgcgatattcttgttgaacaaggatatcgagcaacttctgaattacattggcgctgaaagcctcgggccaagacatgtcctagcaaacctgaagcagctgacaacgatcatccagtcacaaggatacatttctgatggttagtttaacccagatacagttttggtgctgtgagtttagtccagaagacacaggcacccttctttttttaacccccctttgagtcttgacacacaagaggtggtcgctgtctctgtgctgatacgctcattgtaaatgagcaaaatggagtcactaccaggttgtacaggaaagatgtggatcatactactgtactgtgctatatacgcagcaaccggaggcgcttgttcgaaaaaaaaaaaaaaaaatgctgtagcgtgtttcttgatgtggatagcgctggtgagaaacacggccctggttcaactgcgcatggctgcggatggtcgtgctgtgcatgtcatttgtctggtccattggccgacgtgtgatcgacagcactggtactgaaacctgctgacccaagttctagcttaggttgctagtggggactagggacacatgggcggatgcgcgatgcgtgccaagatgaactaggtccagtctcgacacgcgattgcgtgcatctctcccctgtcgcggcacgcttttgtggcggtgaagcttgcgacctgatcagttcgttggttgctcgtgcgtcgtgcccagccgcaatcacttatacggcgactacctggtatccattcaaaaggatggaagacttgttcatccaatccctcaaatatattattgcatgcaggggtaccgagc

SEQ ID NO: 8878 - DNA, 3402 bp, Zea mays
acagcccaccaacgacgttgattccctcgaggccaagccaggcacaaaaaaaccaaaccaaaccaaaccgaaagctgtcgccaccgctcgccggagaaggagcaaacgttccccaacccaccggagctccctccaaaacccaccacaaggcttgcccaaggcttcccctcgcccatgccacgctcgcgcctccccccgactccacacccgcgggcatgatccgcggcgatggaggactcggcgccatcgtccgccgcacctgaccctcccctttcccctccaccttccacgcccccgcacccgcacccgcacccgcccgaggaggaggggggctgctgggtgctcgttccggccagcgaggtcgagggggcccacgcgcccaaggtcatccactgggacgacctgcagcaggagctcgcgcgcctctggagcctctccgccgcgctccagcccgccgaggaccgcaaggcgcacctcaccgcgcgcctcgagtccgctctacaggctagacaggcgtttctcgagcaggacaatgagttggctgaaatgaggcagagactgcaagagcgtactgaccgtctgggggatctgaagacgcgcgccaagaagctgtcagaggatgctgtggttcggagggaacagctttgtgtcaagatcagaacgttgtcaggggcaagcaaggctctcgaggctgcacgcagcaatctgaaggaagctaatgaattgctgtcaggggaaaatggttgtgggcgccttaaagatctggaacagcagttacggatgagacagcaatatatggtagcgcaagttgctcagatatatcctgtgaggcctttggatgaacaatcctcagatcacaaaacctggatttacttcccacataacgaaaacaagtaatgttgaatcagtgttgccaaatagcccccaaaacagacctttggtcatattgggtctacagttatcaaagctttctgtgaaaaagactggctacttcagtgacaagacagaggttcagaaatcttcgactgttcttggatatgctgctcatgcagtctccctcattgcatcctatctcaatgttcctcttcggtatcctttgcgctttggaggttcacggtcatatgttctcgaccctgcgccttcagttgagccatcatctataacctcagtaggaacgtctgtccctcccagcacaagcatgaggacaacggagttccctctgtttcttgacagccaggagacaacaaggtcatcatatgcgatattcttgttgaacaaggatatcgagcaacttctgaattacattggcgctgaaagcctcgggccaagacatgtcctagcaaacctgaagcagctgacaacgatcatccagtcacaaggatacatttctgatggttagtttaacccagatacagttttggtgctgtgagtttagtccagaagacacaggcacccttttttttaacccccctttgagtcttgagtcttgacacacaagagttggtcgctgtctctgtgctgacacgctcattgtaaatgagcaaaatggagtcactaccaggttgtacaggaaagatgtggatcatactactgtactgtgctatatacgcagcaaccggaggcgcttgttcatgggaaaattatccatgttgtagcgtgtttcttgatgtggatagcgctggtgagaaacacggccctggttcaactgcgcatggctgcggatggtcgtgctgtgatccattggccgacgtgtggtcgacagcactggtactgaaacctgctgacccaagttctagcttaggttgctagtggggattagggacacatgggcggatgcgcgatgcgtgccaagatgaactaggtcctgtctcgacacgcgattgcgtgcatctctaccctggcgcggcacgcttttgtggcggtgaagcttgcgacctgaccagttcgttggttgctcgtgcgtgcatccgttcaaaaggatggagacttgttcatccaatccctcagatatattactgcgtgcagctggaattcgtctggagtgaagagcatgacatgaccgtttccttcctcgaccatgtccctctccagctagcttgctcccctccatgtcgtttcttcttcgtcgtcgccggccgtcgtcaccactttttgacgcgctagcgcctagctgctgcctgctcgttcttccacctcgccagtctccatcaacgcggctccgtcgccctcacgcacgcgcgcatagatataaacataaacgccggctggcactggtagacattcttcactcccacgctagctacgcccactccccccgcgctatgcctatggccgaccgcgtccaccccatgccatctccctcctccccgccgcttccacctccgccagggcgacggcgacctgacgccgaccccgccacggagacgacgccgctgcacccgtccttcttccacgacatcccgctgtcgccgcccccagcaggcacgtacatcgtgcaggtgcccaaggaccaggtcctccgcgagccacccccggaccgcgcgcgccgctacaagaagctcgctggccagcccgcgcggcgccgccgcctccgccgcgcgtgctgcctctcctgcgccgcgctcctcgccatactcctcgccgccgccgccttcgcgggcgccgtctgcctcgccttccgcccgcgcgcgccgtccttctccgtgccctccgcgctcgccatccgcggcctcgccaacgccaccgccaccgccaccggcgccgcagccccgctctcccccgcgctcgacgccgccgtgcgcgccgacaacgggcgcaacgggaaggtgggcgtggagtaccgcgcgggcggcgccgtcgcggtgtcctacgcggggcagcggctggccgcgggcccgtggcccgcgttccgccaggcgccgcggaacgtcacggtggtcgcggccgccatgcggggccagggcgtgcgcctctcggatgcgcgcaggcggcagctcgccgcggaccgggccgcgggcgccgtgccgctcacgctggaggccagggtccccgtgcgcctgcgcttcggcaaggtgctgcggacgtggaccgtccacgtcagggcccgctgcgaggtggccgtcgacaggctggacggggatgccaccgcggtcaacaggggctgcagggtcagggtcaagccgctatggtggtggtggtgaggtgatagccggcgccggcgatcgtgtgtctatacaacgttgacgttgtcaatgccgcctcaacgtaaacgcctagtaatttataagatctcttattttcccctcattttatatatggtatccaaacaaaaaaaaaaaaaaaactcttcatttgtgagtcagtttatatatatgtatacataccatgtgtattgttctcagc

SEQ ID NO: 8879 - DNA, 1097 bp, Zea mays
cttcagtttgccttttttagctgacggatcgctgcaacacaaggggggcagctggatccttcaatcagcatcaaccgttgagggaagcagttccagatagcgagtttgaggttacagatgcaggaaataactttctatttggggcaaatattgatggccatatggagcctcttaacgaagacgatttgcttggaactgccttcgaagtctttttttacatggaacagatgccaggaaacggcatctctaactacatttcatcaaaggattctcagcaagagttatcatcttcaatgatctcacatccatttggcgttgctgatatcgcgttcaattccatagattcatcgatcaatgatatccaattcttaaacagaaattcccgggctccaggtcctgctcaacaacgtatgcgaacatacaccaaggtgcacaagcgcggcgctgttggaagatctatcgacatcaacagatattctgggtacgatgaactgaagcatgacgttgcccgtatgtttggaattgaggggcagctcagcgaccagaacagagttggctggaaactggtttatgaagatcacgagaaggatgtcctattagttggtgatgacccatgggaggacttcgtgaactgcgtgcggtgcatcaggattctttcgccgcaggaagagaggcaaatgaggctggccagcgactacggagacagcttcgttggcaaccaagcgtgcagcagctcggacggaggtcgcccgtggagggtcaccggcgactagaaatagcaggcgatgtctgagcacaaatgtttggtataatccgtccaacgatagcaagaaaatgatacgcgatttctgagcacaaacttttgcactcagatgatcgtgcaaacagttagcaattagcatttaaaaaaaatgttgcagttcaatgtaactgcaggaatgtctctgatgtagcctcttcgatgtggcgcttctgtcttgctatgttttggcagccttaacaatcgatgtgctacagttgctctgcctatgtatttactatactacctcggccttgtataaaaaaaaaaaactcgagcagctggacgctgaccgtgg

SEQ ID NO: 8880 - DNA, 3878 bp, Zea mays
attgggtacctcgaggccgcccggggcttgctagttgctcctttctctgccgcccgccgctgccgagtgccgggtcttcgctttctttctcctcttcgggcgcttcgctgcttgcctgctctgctcgcgacctgcttctcagacccgccctcctcgccggccgcccggcgatgcctcctggccagaggcggcggtggcggcggcggcgacggagatagttagctcttcagattgagtgactggtggtcgccggcggcggggacgcggagtatggcggcggcgccggggacgagctcgggcggcgccggaggcgaggtggccgggggcaccaaggtcaacgaggagctgtggtacgcgtgcgcgggaccgctcgtggcgctgccgccggcggggagcctcgttgtctacttcccgcagggacacagcgagcaggtagcagcatctatgcgaaaggatgcagatgccaaaattccgagctatccaaatctctcatctaagcttatatgcatactccgtagtgtcactatgcttgctgatcctgacacagatgaggtttacgctcgaatgactctccagcccgttagcaatgtgacgcattgtgacaaggagacgttgctggcaacagagcttgcactgaaacaaaccagaccacagacagagttcttttgtaaaacactgactgcaagtgatacaagcactcatggaggtttctctgtgccacggcgtgctgcagagcgaattttcccccatcttgacttctcagtgcagcctcctgctcaggaactgcaggccagggatttgcacgatgcaatttggacattccgtcatatatatcgaggtcagcctaaaaggcatttgctgactactggctggagcctatttgtcagtggaaagagactccttgctggtgattcagtcctgtttattagggacggaagacagcaactcctcttggggataaggcgggcaaataggcagcccgttaacctctcatcatctgttttgtctagcgacagtatgcatattggaattcttgctgctgcagcccatgcagcagccaataacagccaattcacagtattctataacccaagggctagtccttcagaatttgttattccttttgccaagtaccagaaggccgtctatagcaaccaactatcacttggcatgcggtttagaatgatgtttgaaactgaagaatctgcaacaagaaggtacatgggaacaataactggtataagtgatatggatcctttaaggtggaaaaactcccaatggcgcaatattcaggttgcatgggatgaagcagcaccaagtgagagacgcaccagggtttccctttgggaggttgaacctgttatcgctccattcttcatttatccctcgccattgttcactgcaaaacgtccgaggcaacctggggtaacagatgatgatagctcagaaatggacaatctttttaagcggaccatgccatggtttggtgaggaggttggcaagagagatctgagtactcaaaacggtttagttcctggattaagtttggttcagtggatgaatatgcaacacaacccctctcttgccaacacggttatgcaaccggaattgctaaattcgttagctggaaaacctgtacaaactctggctgcggctgatctatctaggcaaattagcttccagccccagttcctgcaacaaaataacatccagttcaacacttcgctgctacctccccaaaaccagcagaccgaacagttagcaaatgtaatagctacaccaaaccaattgggaagtgttatagtaccacaaaaggcagttcaaaattgcagttctgaacagaaacagaatctggttacacaaccactgcaagtcagccaaccaatggttagtgtggcacagcctcaacttgtccatactcaactccagcaacctcaagtagttctccaggctcagcctcagcaacctcaagtcattgtccaagctcaactacaacaacagcaacctctggttcaaaatcacaccaccatacaaggtggccttcaacaaatccagcttctgcagcaacagcaagttcagcagtcagtgcaggaacaacagcaaataaagatacagccttttcaggtacctaatgatgccaacatggtaacacagttatctgatcagatgaaaatacaactattgaaggctctacagccacagcagcctctggtcatggaacagcagaaaatgatatttgatttgcagcaacaagcagtaaattctcagtcaactgctcagcagtgctcacaggtagctacccaagtggttggtttgcatagcagtagcactaatcagtacccgacgcagcaaaagactcaacctctcaaaacatttcaagattttcctgggaatgctgtttctattgtaaaaccagaaattgtcacctccgtgggtgctcgctctttgcatgtgcctggtggggtgcagtcaatgaagatggatgaagttccctcttcttcaacatcgccatccacaaacaacaatcctgttattttgcgatcaactccaagtagctccaagaaccaatgtttacctactgcagcaaaggctcctcagtcatctgttgtattgggttctacacttgaacagggtatgaagccttgtgacagtacacaacacccaatggtgattcccaagctggctgaagaaaggccagctactggacaagactacatgaacaacaatcagctggattatttggatacatcatcttcagcgacttcagtttgcctttcacaggctgatggatcgctgcaacaaagttttccaccttcatccttcaatcaacatcaaccgttgagagaagcagttccagatagcgagtttgaggttacagatgcaggaaataactttctatttggggcaaatatcgatggccatatggagcctcttaacgaagacgatttgcttggaactgccttcgaagctgacaagtacatggaacagatgccaggaaacggcatctctaactacatttcatcaaaggattctcagcaagagttatcatcttcaatgatctcacatccatttggcgttgctgatatcgcgttcaattccatagattcgtcgatcaatgatatccaattcttaaacagaaattcccgggctccaggtcctgttcaacaacgtatgcgaacatacaccaaggtgcacaagcgtggcgctgttggaagatctatcgacatcaacagatattctggttacgatgaactgaagcatgacgttgcccgtatgtttggaattgaggggcagctcagcgaccaaaacagagttggctggaaactggtttacgaagatcacgagaaggatgtcctattagttggtgatgacccatgggaggacttcgtgaactgcgtgcggtgcatcaggattctttcgccgcaggaagagaggcaaatgaggctggccagcgactacggagacagctttcttggcaaccaagcgtgcagcagctcggacgggggtcgtccgtggagggtcaccggcgactagaaatagcaggcgatgtctgagcacaaatgtttggtataatccgtcccacgatagcaagaaaatgatacgcgatttctgagcacaaacttttgcactcagatgatcgtgcagacaattagcattttaagaaaaatgttgcagttcaatgtaactgcaggaatgtctctgatgtagcctcttcgatgtggcagccttaacaatcgatgtgctacagttactctgcctatgtatttactatactacctcggccttgtatatccttttgacgtaggagcacccgtgtaggcgcagctggatgctgaaccccccggaggctgttagggacaattacaaccgttcataat

SEQ ID NO: 8881 - DNA, 3060 bp, Zea mays
  misc_feature (3052)..(3052): n is a, c, g, or t
  misc_feature (3056)..(3059): n is a, c, g, or t
gtccgctcgtggcgctgccgccggcggggagcctcgttgtctacttcccgcagggacacagcgagcaggtagcagcatctatgcgaaaggatgcagatgccaaaattccgagctatccaaatctctcatcatctgttttgtctagcgacagtatgcatattggaattcttgctgctgcagcccatgcagcagccaataacagccaattcacagtattctataacccaagggctagtccttcagaatttgttattccttttgccaagtaccagaaggccgtctatagcaaccaactatcacttggcatgcggtttagaatgatgtttgaaactgaagaatctgcaacaagaaggtacatgggaacaataactggtataagtgatatggatcctttaaggtggaaaaactcccaatggcgcaatattcaggttgcatgggatgaagcagcaccaagtgagagacgcaccagggtttccctttgggaggttgaacctgttatcgctccattcttcatttatccctcgccattgttcactgcaaaacgtccgaggcaacctggggtaacagatgatgatagctcagaaatggacaatctttttaagcggaccatgccatggtttggtgaggaggttggcaagagagatctgagtactcaaaacggtttagttcctggattaagtttggttcagtggatgaatatgcaacacaacccctctcttgccaacacggttatgcaaccggaattgctaaattcgttagctggaaaacctgtacaaactctggctgcggctgatctatctaggcaaattagcttccagccccagttcctgcaacaaaataacatccagttcaacacttcgctgctacctccccaaaaccaacagaccgaacagttagcaaatgtaatagctacaccaaaccaattgggaagtgttatagtaccacaaaaggcagttcaaaattgcagttctgaacagaaacagaatctggttacacaaccactgcaagtcagccaaccaatggttagtgtggcacagcctcaacttgtccatactcaactccagcaacctcaagtagttctccaggctcagcctcagcaacctcaagtcattgtccaagctcaactacaacaacagcaacctctggttcaaaatcacaccaccatacaaggtggccttcaacaaatccagcttctgcagcaacagcaagttcagcagtcagtgcaggaacaacagcaaataaagatacagccttttcaggtacctaatgatgccaacatggtaacacagttatctgatcagatgaaaatacaactattgaaggctctacagccacagcagcctctggtcatggaacagcagaaaatgatatttgatttgcagcaacaagcagtaaattctcagtcaactgctcagcagtgctcacaggtagctacccaagtggttggtttgcatagcagtagcactaatcagtacccgacgcagcaaaagactcaacctctcaaaacatttcaagattttcctgggaatgctgtttctattgtaaaaccagaaattgtcacctccgtgggtgctcgctctttgcatgtgcctggtggggtgcagtcaatgaagatggatgaagttccctcttcttcaacatcgccatccacaaacaacaatcctgttattttgcgatcaactccaagtagctccaagaaccaatgtttacctactgcagcaaaggctcctcagtcatctgttgtattgggttctacacttgaacagggtatgaagccttgtgacagtacacaacacccaatggtgattcccaagctggctgaagaaaggccagctactggacaagactacatgaacaacaatcagctggattatttggatacatcatcttcagcgacttcagtttgcctttcacaggctgatggatcgctgcaacaaagttttccaccttcatccttcaatcaacatcaaccgttgagagaagcagttccagatagtgagtttgaggttacagatgcaggaaataactttctatttggggcaaatatcgatggccatatggagcctcttaacgaagacgatttgcttggaactgccttcgaagctgacaagtacatggaacagatgccaggaaacggcatctctaactacatttcatcaaaggattctcagcaagagttatcatcttcaatgatctcacatccatttggcgttgctgatatcgcgttcaattccatagattcatcgatcaatgatatccaattcttaaacagaaattcccgggctccaggtcctgctcaacaacgtatgcgaacatacaccaaggtgcacaagcgcggcgctgttggaagatctatcgacatcaacagatattctgggtacgatgaactgaagcatgacgttgctcgtatgtttggaattgaggggcagctcagcgaccaaaacagagttggctggaaactggtttacgaagatcacgagaaggatgtcctattagttggtgatgacccatgggaggacttcgtgaactgcgtgcggtgcatcaggattctttcgccgcaggaagagaggcaaatgaggctggccagcgactacggagacagctttgttggcaaccaagcgtgcagcagctcggacggaggtcgcccgtggagggtcaccggcgactagaaatagcaggcgatgtctgagcacaaatgtttggtataatccgtccaacgatagcaagaaaatgatacgcgatttctgagcacaaacttttgcactcagatgatcgtgcaaacaattagcattttaagaaaaatgttgcagttcaatgtaactgcaggaatgtctctgatgtagcctcttcgatgtggcagccttaacaatcgatgtgctacagttactctgcctatgtatttactatactacctcggccttgtatatccttttgacgtaggagcagctggacgctgaaccccccggaggctgttagggacaataacaaccgttcataatttgccacagatacagatctgagtggacaaatggattcagtttacgtaaaaaanaaannnng

SEQ ID NO: 8882 - DNA, 2899 bp, Zea mays
gtaccaaacttgcttggcagcagaactctagaaacaatctttagccaaataattgcaaaattcactttgatcttaaaatgatttcctattactcattaatcatgtctttcctattattattgctgttataatactaacaatatcgcccagagacattctccgtcttcatccactgcaaagccccaaaaccctcactaaagcaccgcagaagggcccctacctgctttgctattgctacccagccgccattaatatcactaccaccagaccgcctcactttgaatctcactcccctccactcacacgctccatccaatggagcttactctccccttcgtcatcctcctcgcactcctcgcaagcccctcgcttccccatgccaatggcgacggcggcaacacgacgacgtacatcgtgttcatggatccggcgcgaatgccgtctgtgcaccggacaccggcgcactggcatgcggcgcacctcgagtccctgtccatcgacccggcccgccacttgctgtactcctactccgccgccgcgcacggattcgcggcggcgctgctaccgggccatttgcccctgctccgcagcagccccgaggtgctccaggttgtgccggacgagatgttccagctccacacgacgcgctccccagagttcttgggccttctcacgccggcctaccagcctgccacgggcaatctggaggcggccacgcacgacgtggtcataggggttcttgacaccggcgtatggccagagtcgccgagcttcgcgggcggcaacctgccgccaccgcccgctcactggaagggggtgtgcgaggctggcgtggatttcccgccgagcttgtgcgggaggaagctggtgggcgcgcgcagcttctcgcgcggcctccgtgcggcaaacggcggcgcaataggcgtggggaagaggacgttcaggtcggcccgggacagggacgggcacggcacgcacacggcgaccacggcggccggcgcggtggtggcgaacgcaagcctgctcgggtacgccacggggacggcgcgcgggatggcgcccggggcgcgggtggccgcgtacaaggtgtgctggccggaggggtgcctcgggtccgacatcctggccggcattgacgccgctgttgctgatggcgtgggcgtgctgtcgctgtccctcggcggcggctcagcgccgtacttccgggacaccgtagcggtgggcgcctttggtgcggcggcggccggagtgttcgtctcttgctccgccgggaactccggcccatccggatccaccgtctcaaactccgctccgtgggtcgccaccgtcggcgccgggacactggaccgcgacttcccggcatacgtgatgctccccacgggcgcgcgcctggccggcgtgtccctctacgcggggccttctccctccccacgccccgccatgctcccgctcctctacggcagcgggcgtgacaacgccagcaagctgtgcctctccgggacgctggacccggccgccgtgcgcggcaaaatagttgtgtgcgaccgcggcgtcaacgcgcgcgtggagaagggcgccgtcgtgaaggcggccggcggcgccggcatgatactggcgaacacggcagccagcggagaggagctcgtggcggacagccacctgctccccgcggtggcggtggggcgcgcggtgggcgacaagatacgggagtacgcggcgcgcggtggcggtaggcccatggcgatgctgagcttcggcggcacggttctgggcgtccggccgtctccggtcgtggcggcgttcagctcccgcggccccaacaccgtggtgccggagatcttgaagccggacatgattgggccgggggtaaacatcctggccgcctggacgggcgtcgctggaccgaccggactcgccaaagacggccgtcggactcgcttcaacatcatctcagggacttcgatgtcatgccctcacatcagcggggtggcggcgctgatgaaggcggcacacccagactggagcccagccgccatcaagtcggcgctgatgaccaccgcctacaccgtggacaacacgaactcgtcgctccgggacgcggcggacggctccgtcgccaacgcgttctcgtacggcgccggccacgtggacccgcagagggcgctttcgccgggcctcgtgtacgacatctccacgcacgactacgccgccttcctctgctccctcaactacagcgccccgcacgtccaagtgatcaccaaggcgtccaacgtctcgtgcggcgccccgaacaagtcccgccccggggacctcaactacccgtccttctcggtggtgttcggccagaagcggaagacgaagccggcggcggccctgcgtttcaggagggagctgaccaacgtcggccccgcggcgtcggtctacgacgtgaaggtggtcggccccgagtccgtcgccgtcacggtgacgccggcgaggctcacgttcaggcaggccggccagaagctcaggtactatgtcacctttgcgtccagggctcggcaaggccacgcgaagccggacttcgggtggatttcctgggtcaacgatgagcacgtcgtccgcagccccgtcgcgtatacgtggaagatgtgatgtgaggttccctgcctgcctaaagtctagctcgatgacgaaggaataggataggttggtgtagtttgctcaccgcttcgcaaagagaatcggcgtgaagctctctatctctctctctcggctgcagtgcagacctgtacttgtttcctatctttcttttcggacatcaagtaaccctgaatctgaatgacgaatccgccgtttggtgtttgccaaaaaaaaaaaaaaaaaaacatcgaaaaaaaaaaaaaaaaaaatctagaac

SEQ ID NO: 8883 - DNA, 3556 bp, Zea mays
ccacgcgtccgattctccctcttcccgacccgcacccgctcctcagtcctccccctcttgatgcagatattttgaaatctaagccaccgcagcccgcccgtccagcgctgctctccgccgtcgcttgcgccatgtcgtcgcgacatgacaaggagaagtcggtgaacgtacaggttctcctccgctgcaggcccttcagcgatgatgagctccggaacaacgcgccgcaggtcatcacctgcaacgattaccagcgggaggtcgccgtcacgcagaacatcgccgggaagcagttcgatcgggtctacgccttcgacaaggtttttggaccgacagcaaagcagaaggaattgtatgaccaggccattattcctattgtaaatgaggttttagagggatttaattgcaccatatttgcgtatggccagacaggcactggaaaaacatacaccatggaaggcgagtgcaggagagccaagagtggaccgaagggtcaattacctgcagacgctggagttatacctcgggcagtgaagcaaatctttgataccctggagaggcagaacaccgagtacagtgttaagatcacgttccttgagctgtacaatgaggaaattacagatcttcttgctcctgaagagatatctaaggctgcatttgaggataaacagaagaaagccttacctcttaatcttatggaggatgggaagggtggagttcttgttcgaggtctcgaggaagaaattgttacgaacgcgagtgaaatattctctctgttagaaagggggtctgcaaaacgccgactgcagagacattacttgaacaagcaatctaggtcaatctcagccagtcttcttttgaactatacgctacaacaaacttatgtgctcattactacttttaacattttagccggtcccactctctatttcaatcactattacataaaagaggcaacccctgaaggagaagagctgataaaatgcgggaagttaaatctagttgacttggctgggtccgagaacatctctcgttctggagctaaggagggccgtgcaagggaggctggcgaaattaataaaagcttgcttactctgggtcgtgtgattacggcattggtcgaacaccttggacatgttccttacagggacagcaaactcacaagattgctgcgtgattcattaggaggaagaacaaagacttgtattatcgctactgtttcaccctctgtgcattgtctcgaagaaaccctgagtacattggattatgctcaccgggcaaagagcattaagaacaggcctgaggtaaatcagaaaatgatgaaatctacattaattaaagatctttatggtgaaattgaccgacttaaggcagaggtatacgctgctcgagaaaaagttggggtgtacattcccaaagacaggtatcagcaagaggaaaatgagcgaaaggcgatggctgatcagatagaacaaatgaatgcttctttggaagtaaaccataagctaattagtgatctgcaacaaaattatgattctgagcttcaacattctgctgatttgagcaaaaagcttgaagtcacagagaaatgtctggaccacacaagcaacctactctctacgacaaaagaagatcttaaacaggcacagtataatctaaatgagaaagattatataatttcagagcagaagaaagcagaaaatgctttaacacaccaaacgtatgtgctgagatcagatctggaacaatatactcgtgataatacttcactatattcaaagattgctaggggagacaagctaagtgcaacaaataggtcagtcgtgaatacattccaaactgaccttgcttcgaagttggatattctttccaatacactcaatgcatcaatagaccaacaaaatatgcatctaaaatctgtggaggacttatgccaatcttatgttgattcccatgacaaggctacttctgagctgaaaaagaagattttggcttcaaaatcattatacatgtcacatatggaagctttcctaaatgttgtcctcgtacataaagcaagtgcaaatggcacactagaagatatatcatcactgtctgctgcaagctgctgtagtcttgaccagctactagtttgtgttgagggagaggcacagaatatatttaatgacatccataatttgttaaccatccaccgaagcgaaatgacgcacttcactcaagaattaagggagagtttccaaataagcttggataggacaaaagaaatgtccacctatattattgggctctttgacaagtacgttgaggaaacctccaaattgcacagtcactcaaataatactcatgaagcacaaatgaaaagcattgaagactttcagatggtttatgaggagcaatcaaaatcagtggagcagaagcttttagcggagataagcagtttagtatctaaacatattactcgacaaagagagttggtgggcgttagattgagctctctgggcgatgctgcccgtggaaataaggcatttttggatgaacacacatcggccatggagtttgtcacaaaagatgctaagaggaagtgggaaacgtttgcagagcaggctgaaaatgactgcaaagctggctccagcttttctgcagctaagcatagccgcatggaaaccatgcttcaggagtgcgcatgcactgttgactccgccgttcagcaatggaagaagtcacatgctgctgttaacgatctcagcagaaagcaagttgctgaagttgaagcactcgtcaggactgcaattgagaacaacgagcaacatgaactggaagttgcatcttctcgagctgtggctgaagaagacgcctccaataacagcaaggacatagctcagggcgttgaaaatctgttggaagaggcacggaattcaagttcaagagtggtctcaacggtggaggctcacttcggtgagctacagatgctgcaagagagccactcgagccaggctgccggtatcaacatgcacgccgacaaggctctccaaaccagttacaaggactacgaaccctcaggtgaaactccggtgaggtctgagccgaacgtgccaagcaaaggctcgattgaatcgctgcgagccatgcccgtggagaccatgatgaatgagttccgtgagaaccatccgtatgaacatgaatcgagcaaagaatctaagttatctcagatacctcgcttgccgctcgcgacaatcaactgagacattcacttccctatgtgcagtgtacttttattagtagggcgtcaatttgccggttttggtgtcccttgtgcacttgtgctaggttaaccatggggtgtgagctgccttggctctctccagtgcatttcccttttttcccgcattcaattatctgtaatgttctgttgtgccttgtacgatactgatattgtacagcatcagatatgtgccaaagctagcttgaattgcatgactcattacattggaatctgaaaaaaaaaaaaaaaaaaaaaaaaaaaaaaaaaaaaaaaaaaaaaaaactcgaaaagggc

SEQ ID NO: 8884 - DNA, 3409 bp, Zea mays
attctccctcttcccgacccgcacccgctcctcagtcctccccctcttgatgcagatattttgaaatctaagccaccgcagcccgcccgtccagcgctgctctccgccgtcgcttgcgccatgtcgtcgcgacatgacaaggagaagtcggtgaacgtacaggttctcctccgctgcaggcccttcagcgatgatgagctccggaacaacgcgccgcaggtcatcacctgcaacgattaccagcgggaggtcgccgtcacgcagaacatcgccgggaagcagttcgatcgggtctacgccttcgacaaggtttttggaccgacagcaaagcagaaggaattgtatgaccaggccattattcctattgtaaatgaggttttagagggatttaattgcaccatatttgcgtatggccagacaggcactggaaaaacatacaccatggaaggcgagtgcaggagagccaagagtggaccgaagggtcaattacctgcagacgctggagttatacctcgggcagtgaagcaaatctttgataccctggagaggcagaacaccgagtacagtgttaagatcacgttccttgagctgtacaatgaggaaattacagatcttcttgctcctgaagagatatctaaggctgcatttgaggataaacagaagaaagccttacctcttaatcttatggaggatgggaagggtggagttcttgttcgaggtctagaggaagaaattgtcacgaatgcaagtgaaatattctctctattagaaagggggtctgcaaagcgccgcactgcagagacattactgaacaagcaatccagtcgatcgcactccctgttctcaatcactattcacataaaagaggcaacccctgaaggagaagaactgataaaatgtggaaaactgaatctagttgacttggctgggtctgagaacatctcccgttctggagctaaggagggccgcgcaagggaggctggcgaaatcaataaaagcttgcttactctgggccgtgtgattacggcactggtagaacaccttggtcatgttccttacagggacagcaaactcacaagattgctgcgtgattcattaggaggaagaacaaagacttgcattattgctactgtttcaccctccgtgcattgcctcgaagaaaccttgagtactttggattatgcacaccgggcaaagagcattaagaacagacctgaggtaaatcagaaaatgatgaaatcaacattaattaaagatctttatggggaaattgatcgacttaaggcagaggtatacgctgctcgagaaaaagttggagtgtacattcctaaagacagatatcagcaggaggaaaatgagcgaaaggcaatggctgatcaaatagaacaaatgaatgcttctttggaagcaaaccagaagctaattagtgacctgcaagaaaagtatgattctgagcttcgacattctgctgatttgagcaaaaagcttgaagtcacggagaaatgtatggaccacacaagcaacctactctctgcgacaaaagaagatctgaaacaggcacagtataatctaaaggagaaagattatataatttccgagcagaaaaaagcagaaaatgctttaacacaccaagcttgtgtgctgagatcagacttggaaaaatatactcgcgataatacttcactgtattcaaaaattgctagaggagacaagctaagtgcaacaaacaggtcggtcgtgaatacattccaaactgaccttgcttcgaagttggatactctttccaatacactcaatgcatcaatagaccagcaaaatatgcacctaaaagctgtggaggatttatgccaatcctgtgttgattcccatgacagggctacttctgagctgaaaaagaagattttggcttcaaaatcattatacatgtcacatatggaagctttccaaaatgttgtcctcctacataaagcaagtgcaaatgccacactagaagatatatcatcactgtctgctacaagctgctgtagtcttgatcagctactagtttgtgttgagggagaggctcaaaatatatttaatgacatccataaattgttaaccacacaccgaagcgaaatgacacacttcactcaacaattaagggagagtttccaaataagcttggacaggacaaaagaaatgtctacctatattattgggctctttgacaagtatgttgaggagacctccaaattgcagagtcactcaaataatactcatgaagcacaaatgaaaagcattgaagattttcagatggtttacgaggagcaatcaaaatcagaggagcagaagcttctagcggacattagcagtttagtgtctaaacatattactcgacagagagagttggtgggagttagattgagctctctgggtgatgctgcccgtggaaacaaggcatttttggatgaacacacatcggccatggagtttgtcacaaaagatgctaagaggaagtgggaaacatttgcagagcaggctgagaatgactgcaaagctggctccagctcttctgcagtcaagcattgccgcatggaaaccatgcttcaggagtgcgcatgcactgttgactccgcagttcagcaatggaagaagtcacatgctgctgtcaacgatctcagcagaaagcaagttgctgaagttgaagcactcgtcaggactgcaattgagaacaatgagcaacatgaagtggaagttgcatcttctcgagctgtggctgaagaagacaccaccaatagcagcaaggacatagcccagggcgttgaaaatctgttggaaaaggcacagaaatctagttcaagagtggtctcaatggtggaggctcacttcgcagagctacagaagctgcaagagagccactccacccaggctaccggtatcaacatgcacgcagacaagtctttccaaaccagttacaaggactacgagccgacgggtgaaactccagtgaggtctgagccgaacgtgccaagcaaaggctcgatcgagtcgcttcgagccatgcccatggagaccttgatgaacgagttccgtgagaaccatccgtatgaatctgaatcgagcaaagaatccaagttatctcagatccctcgcttgccgctcgcgacaatcaactgagacatctcacatcccccgtgtgcagtgtaattttattagtagagcatcaatttggtgtccttgttgtgcacttgtgctaagttaactgcggcgggtgagctgccttggctctccccccagtgcatttccccttcccccagtcaatcatctgtatcattgccttgtgcgacactgatttttgtagagcatcagaaatttgcccaagaaaaaaaaaaaaaaaaaaaaaaaaaaaactcgaggaggggggcggtac

SEQ ID NO: 8885 - DNA, 972 bp, Zea mays
acattataaacattacaatattgaggacctatccataaaactcacggccctactggttcgaggctgactagcactcgtcaccgttccgagaccagcgccagacgcagacggccccgaacgccggcggcggagcatcaggtcgtcgacctccgagcatcgacccgccgcgatggagaagggaaagggcctcgctcgccgctgggcggtggagctccccgacgcctcctcctcctcccccgccgtccccgacccgcccggcttcaccagatccgcgcccgacgcggacgacgccgctggagcgcgccagcgcaaggactccgaggctgcatggaaggcgcagaaagcttgggaagttgcgcaggctccgttcaagaacctgatgatgatgggatttatgatgtggatggcagggagcactgtccacctcttcagcatcggaattaccttctctgctctgtggcaacccctcaacgctctccgatctgttgggaaagtttttgaaccatttaaggacccaagggtggatactattgctcctaagttgctctttattgccctcaatttggctgccatgggattgggtatatggaagcttaatacattgggccttcttccaacaaatccatcagattgggtgtcttctctggctcctgctcgggaggttgaatatgccggaggagggctccccttaatttaatgtccatttccatttgaacttattttactagttgtaatattaataccgagtgacatttttaccatacacccctgaatacacgaagttccggggttttttcccctgtctggatttgtactactattttctagatgcgtttgtttgtatcgaatttgcgaccctgaagtatagtcgtgtctggatggaaaaggattaaattatcttctattcaattttgactaggaatgaatttaattaccttcgaaaaaaaaaaaaaaaagaatttaattaccttc

SEQ ID NO: 8886 - DNA, 939 bp, Zea mays
attcggctcgagagcatttgtcccaccacttttattcttcaatatcgatgaggcgagggagatgcatattcgtgtggaacggaggcgagataaagaatctggggagtactttgagtgggttgataatttgcgggcggccgccccgggctggtacaaatcagtctcaactaaatcaatccacaaaagtaatattcaaccgactttcgatgagcttgagaagtttaagaagcctggtgatgacatgaatggcgacatggctagtttgtctactctatttgcaaacaggaaaaaagggcattttatgaagggtgatgctgtcattgttattaaaggcgacttgaaaaatctggagggatgggttgaaaaagtagaggatgaaaccgttcacatcagaccaaaaatatctgatcttccgaaaacattagccttcaatgaaaaggagctttgcaaatatttcaagcctggtgaccatgtcaaggtgatctcaggtgtccaagaaggtgctactggcatggtcgttaaagtggaagggcatgtcttgatcattttgtctgacacaactaaagaacatatccgtgtgtttgctgatcatgtcgtcgaaagctctgaaatcaccacaggaataaccagaattggtgattatgaactgcatgatcttgtccttttagacaacttgtcatttggagtaattataagggtggaagctgaagcatttcaggttctgaaaggagtgccagatagacctgaagttgtgctcgtgaaactaagagaaataaaaagcaaaattgaaaggcgctcatcagctaaagatcgttctaataatattatctctgcaaaggatgttgtaagggttgttgaaggagcatgcaaggggaagcaaggacccgtggaacacatacacaaggggatgctgtttatctatgacaggcatcaccttga

SEQ ID NO: 8887 - DNA, 1671 bp, Zea mays
aaattaccacaggaatcaccagaatcggtgattatgaactgcacggtccggtcctcccgggcaacttgtcatttggagtaattataagggtggaagctgaagcatttcaggttctgaaaggagtgccagatagacctgaagttgtgctcgtgaaattaagagagataaaaagcaaaattgataggcgctcatcagctaaagatcgttctaataatattatctctgcaaaagatgtcataagggttgttgaaggagcatgcaaggggaagcaaggacccgtggaacacatacacaaggggatgctgtttatttatgacaggcatcaccttgaacatgcaggctttatttgtgcaaaagcgcaatcttgccttcttgttggtggatcaaccggtggccatcgaggaaatggtatggacacagttgatgcacggcttggtgctttgagatcttcagcaagcattctgcaatctccaggaaggctgcccccaagaggacctaatatgaattatggcggaaggtttggaggcggccgtggtggtaggtgtgatgccttggtgggtaaatgtatcaaaattaaatctggcccttataagggataccgtggccgtgttaaagaggtgactggtgcactcgtacgtgtagagcttgattcattgatgaagattgtcacagttaaaagagatgatatcgctgacacacctacagtcgcgacgccattccgtgaacctcgttattcattgggtggtgaaacaccaatgcacccgtctcgaacaccgcatcatgcttatcagactccaatgcgggaccctggagcaacaccaatacatgatggaatgcggactcccatgcgaagtcgagcctgggctcctatgagtcctccaagggacaattgggaagatggaaatcctgctacttggggtagcagtccagcttaccagccaggaaccccacaagctcggccatatgaagcccccacacctggatcggggtgggcaaatactccaggagttagtttcaatgacgctcctactcccagggataactatgcaaatgccccaagtccatacgtgccttccacacctgttggtcaaccaatgacgccaaactcagcctcgtaccttccaggcacacctggtggtcaaccaatgaccccaggcaatgctgggatggatatgctgtccccaataataggtggtgatggtgaagttgcatggctgttgccggatgttttggtcaatgtgttgaggggaggtgatgacggccctggcgtggttagggaagtactcggggatggatcttgccgggttgcacttgggtcgtcgggcaacggtgacgtggtgacggtccttgcgaacgaggtcgaggtcatcaggccgaagaagagcgacaggatcaagatattgaacggcaatttccgtgggtacacaggaaagctcataggtatagatggttctgacggaatagtgaggcttgacgaaacatacgaagttaagatcttagatatggtgattttggccaaactggccacttaagatcttagatgtatatgttgtaacgtgtccgtcatagaacgtattctgtaacaatgccctcgtttgcaataaagctttgcttatttgcaccaaaaaaaaaaaaaaaaaaaaaaaaaaaaaaaaaatccaaaaattatta

SEQ ID NO: 8888 - DNA, 2317 bp, Zea mays
tgcagtgttttgctacggttcaaaagatcgttgtcccaatcatggcgccacggcacagatgacctgtcatggaatcttgtactatcccacgtggaaggctcttccagagttccagtgcagaaagcttcggcaacctccaatcacagggccgcctttttttttgttgttctcaaaaatcatgatgcttcaatgcaaaatatttacagctatacatcgcgttactccgattttttttcagatgaattttactcaccagtcgtcagcatgtacaaagcagtaagtaggatagtgtattataccatcaccaatgctaatgggtgacgtttcatacagaagtggacgatgtacatgtgcgcctgcggccggcggccggcctactcctccctgggtatccaccggctccaccagatgcttttgcgctggctgttgagctcgtccatgctctccttgatcgttctcatgatcttcctctgcaggcgcagcacggaggcaagcgcgttccgctgggtgctgcttttctttggttttatttccctgagctcttgaagctgtgcttctgtaaagcctcccacatcttcagttcctgaccttgccatgaggccgataacccaccgcgctgcttcactgtagtccttctgggttgcgcggaacagttgcagccgtacgttttgcatgacggagaggccaaggagcccttcacggttgaagtacgggtgtgccaatgcggccttagcactggtcctctgccgtgctttgtaccggaccatcgaggtgaggagttcccatccgataccaccgtctaaatccatgatgtcaaagcccctccggagctcagcactcgctcgtggctccaccagattcctccaagcttgtaagtcataatcacatcttttcagttggcgattaaattgtatgaggttgctatcagttcgtagtgacgggaatgccatctgtaagaatatgagacccaagctatatatgtcgaatctgtcaggaagattcagctgccacaggactggagacaaagttgttgcaactggaacagaaggagcagacggggtttgtgtgctcataatatattgttctggagcagcataccttggatccaaaaggaactctttaggaatatagttaattcctacccgtaagtcagccgctgctccaagatcaataattttgaaggttcgtgatccctctgaaaatatcacattttgaggttttatatctctgtgaacaattcctgtcgaatgaagtccgtcaagtgcaaataagagttgtctcatcaccgtttgaatgatcttattctctctcgctattccctttggcaagtcttggataccgccaagaatttttgtctccacattgtaagggaattccttgctttgcatgagatcataaagtgtatcctcaccttcaaaacgccaaataagccaatattcttcagctcccttaccttttgctttggtctcgcaaaagccataaataaaatccgcacagctactagcgcatgccctcctgacacggtattcatccaaatctccactgcaccatactctgttgccttcttcacgaccaaatccccttgcttcttcgccgcttcggggttcgccagtgaagccttacacacgaccccgaatgcgccctccccaagcttcttcccaaataccaagtcatccttgcggaaggaagggcggaagaggcgttcggcgaaggcgaggacgaacatgtcgaagaaccccggcgcgacgccgggcgtggaccagaggtacgacacggtagctagcgcgagcgcgacgccgggggccgtgatggtgagcccgtcgttccgggggagcgtgctgcggtagatgacgtcgccgcactgcatgacggtgcaggggagccccacccccaccgcctccaccagctggcggcccagctccgtcgcgacgccgccgagctccgccgtcaccggccggaacgacgcggcggcgtggcccgccggccgccggcgccggcgccggaggagggtgttgtggccggggaggaaggaggtggagagaccgaggccactagcggccatttcggatttttcggaacacatacacaaggggatgctgtttatctatgacaggcatcaccttgaacatgcaggttttatttgtgcaaaagcgcaatcttgccttcttgttggtggatcaactggtggccgtcgaggaaatggtatggacacagctgatgcacggcttgatgctttgcgatcttcagcaagcattctgcaatctccaggaaggctgcccccaagaggacctaatatgaattatggtggaaggtttgg

SEQ ID NO: 8889 - DNA, 843 bp, Zea mays
ttttttttttttttttccacaaatcgaactgtatttctatggcgttctttactaaggtcctgtaacttttatatcctgatctttacacaagaacaaaaaactccctatcccttttcagtcacataaagaagaatgggcaaaatggcaagagttatattctcgagcaagcaagcgacgaaaagccgtgatatcgcggcgcggcctgaccctgctctgtcgcgctcgtaggcttcagtagttcttggtgggagtctccccgacgacgtcctgcctgcactgctggaacacctgcaggatgttgcggtaggggctgctcctggacgacggcgaggcggtgccggagcgatggcgcttgctgctcgacggccgtgattccgggctgagcgcttcgtccgcctctcgcgcaggccgctccatctccggcgcagcgtccttccacagagtctccaggaatgactccttcagcgcgccatcgaccgtgagagggcagaactccggcatgggccacgcaacgggcccgccttcgtcgggaggctccggcaggggttccacgggcgccatctcctcatcttccttccttgcgtccccgacgccgacgctcgccccgtcgacgacggcgtcgcctgccgccgcctcgaccttatccatgaagctcgcgctagcctccaccatccgatccccaccccgcttcgcctcggattccgataacgtatcggcgccttgccttccccctctggtcgatgctcgaggcggggagagggggttcgagtttgaaatgggggagagcgaggggagagcgcaacggccgcgtatattatgggatgggaaatggccaaaatcccg

SEQ ID NO: 8890 - DNA, 1241 bp, Zea mays
  misc_feature (1194)..(1194): n is a, c, g, or t
ttgggtacctcgaggccggccgggtcggctctaaccctcgcgctcgccgctcgcggtctcgcctcttcttcgctcacaccctcacacgattcgccgcgaggagtttccccttccgctgcgtgcatcccgcgagagctcgaaaacctagccgccaaatcgatggctcggcgcggccacaacgacgacgacgacgaggtcgatgaggaggaagaggaggatgcctatgacctggacgacgacgaggatgaggatgaggaggacgactacgaggaggagacgaggcgcgggaaggcctcccgcggcggcggcggcgccaagagcggcggcgggcggaagcggtcgcgggaagacaactttatcgacgactcggccatcgaggacgaggacgatgaggatgacgacggcggtggccgaccgaggaagaagggtggcggcggggtgcgaggattcttcgacgaggaggcccaggtcgacgaggatgaggaagaagaggacgaaggagagggcgaggacgattttattaatgatgctggggcggacctccctgatgaggatgttgttaggggttcaagacgtcattctattcctatgagggatgaagaagaggacattgatgagatggagagacaagtgcgggagagatacgcaagatctactcatattgagtacggtgaggaagctgcagaagtggaacagcaagctctgctgccctcggtgaaggatcctaaactatggatggtcaaatgtgcgattgggcatgagagagagactgcgatttgtctgatgcaaaagttcattgataggtcagaccttcaaataaagtcagtcgtggcattggatcatctaaaaaattatatttatgttgaagctgagaaggaggcccatgtcaaagaggcttgcaaaggtctacgaaacatttatgcttcggcaaaaataacattagtgccgataaaagaaatggcagatgtcctctccgttgagagcaaatctgtcgatctgtcaagggattcttgggtccgaatgaaattgggcatatataaaggcgaccttgctaaggttgttgatgttgacaatgtacgtcaaagagtagatgtgaagctgatccctagaatagatctacaagctttggctagtaaactggaagggggcgacagcgtcgagaagaaagcatttgtcccaccaccacgattcttncatatcgatgaggcgagggagatgcatattcgtgtggaacggaggcg

SEQ ID NO: 8891 - DNA, 2286 bp, Zea mays
cccaggttattcaagcagagagctgatctcaaaaatcatgatgcttcaatgcaaaatatttacagctatacatcgcgttactccgatttttttttcagatgaattttactcaccagtcgtcagcatgtacaaagcagtaagtaggatagtgtattatactatcaccaattcaccagtgctaataggtgacgtttcatacagaagtggacgatgtacatgtgcgcctgcggccggcctactcctccctgggtatccaccggctccaccagatgcttttgcgctggctgttgagctcgtccatgctctccttgatcgttctcatgatcttcctctgcaggcgcagcacggaggcaagcgcgttccgctgggtgctgcttttctttggttttatttccctaagctcttgaagctgtgcttctgtaaagcctcccacatcttcagttcctgaccttgccatgaggccgataacccaccgcgctgcttcactgtagtccttctgggttgcgcggaacagttgcagccgtacgttttgcatgacggagaggccaaggagcccttcacggttgaagtacgggtgtgccaatgcggccttagcactagcgtggtcgcggccgtggtaccggaccatcgaggtgaggagttcccatccgataccaccgtctaaatccatgatgtcaaagcccctccggagctcagcactcgctcgtggctccaccagattcctccaagcttgtaagtcataatcacatcttttcagttggcgattaaattgtatgaggttgctatcagttcgtagtgaagggaatgccatctgtaagaatatgagacccaagctatatatgtcgaatctgtcaggaaggttcagctgccacaggactggagacaaagttgttgcaactggaacagaaggagcagacggggtttgtgtgctcataatatattgttctggagcagcataccttggatccaaaaggaactctttaggaatatagttaattcctacacgtaagtcagctgctgctccaagatcaataattttgaaggttcgtgatccctctgaaaatatcacattttgaggttttatatctctgtgaacaattcctgtcgaatgaagtccgtcaagagcaaataagagttgtctcatcaccgtttgaatgatcttattctctctcgctattccctttggcaagtcttggataccgccaagaatttttgtctccacattgtaagggaattccttgctttgcatgagatcataaagtgtatcctcaccttcaaaacgccaaataagccaatattcttcagctcccttaccttttgcttttgtctcgcaaaagccataaataaaatccgcacagctactagcgcatgccctcctgacacgttcattcatccaaatctccactgcaccatactctgttgccttcttcacgaccaaatccccttgcttcttcgccgcttcggggttcgccagtgaagccttacacacgaccccgaatgcgccctccccaagcttcttcccaaataccaagtcatccttgcggaaggtagggcggaagaggcgttcggcgaaggcgaggacgaacatgtcgaagaaccccggcgcgacgccgggcgtggaccagaggtacgacacggtagcgagcgcgagcgtgacgccgggggccgtgatggtgagcccgtcgttccgggggagcgtgctgcggtagatgacgtcgccgcactgcatgacggtgcaggggagccccacgcccaccgcctccaccagctggcggcccagctccgtcgcgacgccgccgagctccgccgtcaccggccggaacgacgcggcggcgtggcccgccggccgccggcgccggcgccggaggagggtgtcgtggccggggaggaaggaggtggagagaccgaggccactagcggccatttcggatttttcccccgaccttttcctggttccggaatgcggctcccgctatatattccgagtttgaattatcgttcgagagataattttgttcaaacgtgtggaatatatgagtttgacacgtagctgagggtccacatgtcagtgactcaaaatgcatgtgacaaaggaggagttttggttgtttctgaaataaaaataaaaaagacgaggaggccataatttgtggttacgggaagattaacgtggtggggaagcatcgattgcttccgtggctaggatctgctccgagtgtctcactctcagactcccggacaagacacggtcaattcataatcatcttcttccgtccagaaatcaag

SEQ ID NO: 8892 - DNA, 2513 bp, Zea mays
ggtaccccctcgaggtctccgcccgggaacaccaatactcgtagttcgcccccttcacgaaggaacctgctcggcctcgccgtccccggcgcgtggagcgcgtcgcgtccgccacacgcaccgaccatcccctgccctcatcagcaatccccggcccgcagcgtacaaatacacgctccccgccgctccgacctcactttccccgcctccatcaccaattcacgatctcctttcccgcaccgcgccccggatcgccggctcgcaattccggagttaaattcccctccaccgcaaccgtcatgggcggctcccacagccgcgaggacgtcgatctcacctcctccgacgaagaggaggaattcgaggacgactatgacgcccgatcacccatcgcggaggccgcagcgagcgcggggcagcgcgacgacgacctcctccgcaccgccacaccttcctcgcttgaggccatcgacgccaagctcaggtcgctggatctcaagtaccagagacctaccgccgccaagctctacctccacgtcggcggggcctcgccttccgcgcgctgggtgcccgccgagcgccgcgcgacctacgcattcgtcgaccagtcgagcgacgacgcctcctcccccaggtggttcctagaggttgggccggggccgcgggtctccgcgcccgtggactcggcgctccagctgaagacgatccccgcgcagcgccgggcggacttcgccgcgagcgggtccgtatgggctctgcgactacccaccgacgccgaattgcgccggttcagggtggagtacgagcgctgtcttttcgagaacacgtacggagtggaggccacggacgaagggcggaaggaggtgttcggcgccgacttcgccgcgtgggcgcggcctgccgaggccgacgacactgtttgggccgacgcggaggaaagcctcacccctcccgccgcagcaccagggaaggacctgcttaaggagttcgaggaggaggccggcgacggcgacagcatccagagcctcgcgcttggggcgcttgacaacagcttcttagtcggcggcgccgggatacaggtggtcaagaacttccgccacggcttgcacgggaagggcgcgtcggtgaagatctcgggaggccgtggcggcagtgggagcgcttattcgacgccgaagaaggcactgctgatgcgcggcgagactaacatgctactgatgagcccaggagaggctctgcattccaatggtgttcaccatgttgacgttgagactgggaaggttgtcgcagaatggcggtttgagaaggatggagctgatatcacaatgcgagacattgccaatgacagcaagggagcgcagttggaaccctccgggtcgacattcttgggcctggatgacaacaggttgtgtagatgggatatgcgcgacgccagaggccgggtgcagacaatcggtagctcatcagactcaccagtgctgaactggtcacagggtcatcagttctcgcggggcaccaatttccagtgctttgcaagtactggggatggttcaatcgttgttggttctgtggatggcaagatcagactctattctaagagctcgatgcgtatggcgaagacagcattcccaggccttgggtccccgattacacatgtagatgttacttatgatgggaaatggattctgggaacaactgacacatacttgatcttgatatgcactatcttcaaggacaaagatgggaaagaaaagactgggtttagtggccgaatggggaataggattgctgcaccaaggcttctgaagctcactccacttgattcagttttagccgggaccgacaacaaattccacggcgggcaattctcatgggtaacggagaacggaaagcaggaaaagcaccttgtcgctacagtcggcaaattcagcgtcatttggaattttcagcaagtcaaggacagcaaccatgagtgctaccgtgatcagcagggcctcaagagctgctactgctacaaagttgtcctcaaggatgaatcaatcgtcgacagccgcttcatgcacgagaagtttgcgacgagtgactctcctgaagctccgctcgttgtcgctacgccaatgaaagtcagctccttcagtatagcaaatcgacgctgactccgaagctcttttccccagttgtgcagaaataatctgagaagttgcaggtttttgttcagtttgttcctttttcctcttttagacggtttggttagttctgttggtacagaactgatcgaggttcctcccgagaagaactggtttttgtgtcgtgtgcatgtctggtcatttgtagcgggctagcggctcggtataatggtgtgtatgtctgttggataaaatgtaccatgtgacaaaaaaaagtaattttgatttgaaaaaaaaaaaaaaaaaaataaaaaaagaaaaaaaaaaaaaaaaaagcttagcgaggacgtcgacctcgtgtttaaacactatgaagtgggaacgtga

SEQ ID NO: 8893 - DNA, 2236 bp, Zea mays
gcacgagaccattacctagaacatcctaatctaaaacccgccgccccgacgttcggagcctcctgccgcaatttttttttgaggctggtctgtttcgtgacgtcccgcgagaagagaacccccgtggcccctggccgcgacggagcggtcagaagcagcggcggccggcgcggtttcggtttcctggttggcccgagaattccgattcctctcctgatttgtgttgcctggaggccccgtcgctgtccccgcgctctctgtctcctcacgcttggctgttcgccgcggcgccaccgtcggaggcagctgctaatcgcgcgtccggtggccgcgttgcagcggcggagcgtctcttgttgtgcagtgctgcagcggattgtcgcggcctgcccgcggtgaggccggcatccctcttcggaaggcgtgctcgggcggggccagcccaaccgccgttcgtgcgctagagttcctcgctcagaaagtggagaaataagatacatagtggaagatgagatcagttgttcggtcacttcgccagctccgccgatttatccagcactatgcagaggggaactcacaagcaaccagattgttcgggctgcagaatgctttaatcatgtgcggatcgacaccccgttcactgagcatgttacgtcgtaatggtgaaattagcagatttgcaagccctggcatggagttgatgaggtccatgttctctaatgtagcggctggttctatcaaagatattggaagaggtggcccgatggtggaatatgagaggagaatagcatcaggagacctagtagatggcgatagctttcaggttgatacaattcaacaattacaagggctctatgaggagttgattgagaatggagaagactgccagctggatagatataagtcatctgagaaatcaggacggagtcgatggctatggtcccgcctcattactcagccttctagctttgctccagttaagggcctttacctctatggtggtgttggtacagggaagacgatgcttatggacttgttctatgaacagctgccatctaattggagaaaaaaacgtattcactttcatgatttcatgttgaacgtacatagtcgtcttcagatgcataaaggtgtttcagatccccttgatgttgtagcagctgagatttcagatgaggccatcatattatgtcttgatgagtttatggtaactgatgttgctgatgctatgattctgaaccggctgttcagacaattgttcagcaaaggcattattcttgtttcaacttctaaccgtgctccagataagctttatgaaggtggcttacaacgggaccttttcttgccatttattgacaccttgaaagaaaggtgcatcgtgcaccccattggatctgcggtggactatcgtcaactgggttctgctgaacaaggtttctattttgtcggaaagcattacagtacgcttctgaaacagaagctccagtctttaattggagatgaggaacccagcccacaaactgttgaagtaattatgggaaggaaattacaggtttctctgggagcaaatggctgtgcatattttccttttgaagatctctgtgatagacctttaggtgcagcagattactttggactcttcaaaaaatttcacaccctggcacttgatggtgttccaaagtttgggtctagtaacagaacagcagcttatcggttcgtcacactgattgatgttatgtacgagaacaaagcaaggctgttatgtacagccgaggctggaccagtagaactgtttgagaatatcatgactcttgctgaagcacagaaggtttcaccaagatcttcgcgctcacagaaaagtgacgaccctgacctatgtgtggacaatgagcttggatttgccaaggatcgtacgattagcaggttgacagagatcaacagcagagaatatttggaggacttcgaaatgagattagggcaacagcagctgctgcccttgcaagctctagataatggtggtgatgttgtactagcataataagtagaaggcttctgggcctcatttgaaattcttgtattcgcgcccacctggcttacataggcaactgagaagctatgcttttccaaccgtggtgcatgtaaatgtgcaataaagctatgaaagagtattttttgctaataggtgggtgatctataaaatggctcaatctatagggagacgtgtccaaaagcggcc

SEQ ID NO: 8894 - DNA, 841 bp, Zea mays
tcggccgggtgatgttgtagcagctgagaattcagatgaggccatcatattatgtcttgatgagtttatggtaactgatgttgctgatgctatgattctgaaccgtctattcagacaattgttcagcaaaggcgttattcttgtttcgacttctaaccgtgctctagataagctttatgaaggtggcttacaacgggaccttttcttgccatttattgacaccttgaaaagctgaaattcgaattcagtttcgccgtgaacgctttggccatgacatagtccgcgccacaaacgagctggttctacgcgatcaacctgaagaagcaatcctgttgaaagtcaacaacaaggtcccagggcttgggctccaactagatgcttcagaattgaacctgctttaccgggatagatacagcaccgaggtaccagattcgtatgaacatcttctactggatgtgctagatggagatagtcatttattcatgcgcaacgacgagctggctgccgcatggaacgtgctgactccgataatccatgagatcgatcagaacagagtagttccatagctctacgaggctggggacagagggcctatcaatgcttaccatctcgctgctaaacatggggtgcgatgggatgatgactggtgagtcgatacatggcaaagattctcgatgcgcaacgagattcattaccaatttttgtcgttgtatcgcagtcagctgtacaatatgccttctgcaatcggcctgatcaatgactttcgaggagacatgcaaacatggtttctttcctgtcctggtgacgcactgttgattcaagtcggaaaaaaaaacccaaa

SEQ ID NO: 8895 - DNA, 4609 bp, Zea mays
  misc_feature (829)..(829): n is a, c, g, or t
  misc_feature (831)..(831): n is a, c, g, or t
gggtcgggcagctctaccttggacttctccggtggtcttcgcttccaggagtggatcttcaacaagtccaattgcctaatcaactatctcctgggtaaatctgatcgccctgagttctttttagtcatctccttcggaaggtgctccttgtgcctgagcgcggagttagtggggtttcttcttcaatccttcattggtggagaagcggacttattcagggttactcttctgtcggatcaggtcttttgcttctcgctttcttgcaagaatgtgggtttcatagtttatcggcttcgttcttatgtctgtccatcgttcaaagcttacatgcacttatggaattctggtggcccaaattggatcaatgaatggcacctttaattgatgaagaatcaaagtcattgaaactggtttcccgtcatcgtaataagtctgtttcgtttgctgacattgtccgtaagcctgctttatcaggttcaaactctatgcctttgggacgtccggctagttctagaccatcttcttcaagcttgcggcagaggccttcgattttcaatcagatttcttatccaatgtatccctccaaagatcggttggaatttcggccaaattactcttcaagttcttcgatgaactcggcggtgaatctgtgctggggtggcagagggttttctgggcgttcgcaatttcaaaattattcaaattctagtaacgggcgctttgagggccttaacattcgggcatcattaagtgactcccgcgctcgtccttgggctccacggaagttaatttggcggcccaagaagaatttgggtcagtgccctttgcntncgggggatgttggacaagcttttggtaccaacaatgctgctcccttcggcccagcggtgcgggatattcgtcatatcttgggacattctatttcgggcaataacctgcaaattttcgtgattttctggtcagaattgcaggcggtcttttgattccttccctagtaagtttgagaatgcaatttggacgtcttctccgcgattgtggttcaggcccccttgctctcacttactggtgggccgtctcccctgccttgttataattgttttggtgagttcgtgcaggcggttctctcgagaagtggctcttcgccttccacggaacttacactgttcacgaaaccctcttccacaaatataattcactcagttagccaaaagaacacaaatgtctttaaattttatactctatactcataaatagaaaccgtagcaatgtgtacctgtataatttgctaataatttagtaaaacaggggtacatatattaagctccaccgtcattatttggcagcgctgcgataaggaaaaccgtgtccttgcatggcatggcatgacatggcaggcaggcagttcggttctaggcttctagctatgtcgctgccgaatgttaaggcctatgcaatgtcagatcaggcgtatgtcgcttctgtctgactaattaaggatccaattcttgtagtgagaagttaaaggatttaaagttacttatcatgagtttgcttgtagcacttgttgcaggtgattcagtacaacgtggatgaagtgacccctaatgttacgtacgtacgcttgtcgtacttgtaataataattgttgtataggagtactgtcagtgtgggggtgggctacctaggccatgcaccctagctacgtacaaaacctcgctcgttgtttcgccggcggtggctcgtggcatggcatgacggcggctgacggcgacagcgagggacgacggccgcggcagccgccggggacctgaacagaacatctctgcgcggcagatcctcttgtcggcgccagggccgcgcaagttcagagccccaccaccactcccagtcccagcagcagttccagtcggtaggctagtatttgttcccgcgtgctggcctgcgctgcaaagtgttcacattttcccggcgtcttgtatgacatgcagtgcaggagttggttgtcttgttcacagacagagcacctcaatcagggctcatatttatcgtttactttgtttcagctatgtttgctagcctagccctctgtttttatatatctagccccaacaaaaagtcactgataaatggaacccacatatcatgccatgagctctctcgcccgtcctctccctctcccttctcgtgctcttgcttctatcactagcgagtagcgacccgccggagctcactaccgcacgggagtggagagagagagagagggagccgcgccgccgcccgccgaagctcggcgttggcgtggtggtcaggtcagactagagagtccggcggcggggaatggagtaaagaaaggaaagcagctgtactacccacatgcggcgggagaggctggtccctttgccccaacccgatggcatggcacagccgccgcaaaagtcaaattacacagtggcgcgcgttgaaaatgatggtacgggggccaggtccttcacctcacctcttcttgtccatctcaacacatgctactcgatcagtcgatctgccactaccacagcgttggtaggatttggaggagacggagcccggcagaaatcacaggtgcacaatgctctccagcagaaaccacaggtcccctgtctacattatttgtacagtactaggtgaaagatgtgacgatcagcggcatttttaaaaataaaaaaactttggctgcaaagaaaggccatccaaacaggcatgctgctgcatttaattaggtcttcacgcggctcatacacaaaacaacccaagacatgggaaagtcacatcgttgttgttgtcgtgtgcgcatgtttgattaagcaggtggagaaatgtcatccaaagctccaataaaaaaagatccaagtttgtaagtattgctaaaacaaaagtaaacattttctcttttttaaagagaacactgaatacacttcgaactcaattttgttcgtcaacactgtgctccctttgtatcgactcatatacacattgcatccccacccccacccacaacaggaagaaaagaaaaaactacactttttctccaactcgaacacaagatggcaaaacaaacatccccagaaatagagttccctaaaatccctacgaaagatggtcagaaagccaaagcctagaaccggagtggtacatctaaatcaaaacctgtagagctttcctccctttcatgttccaacgcaaagtggtagtacatccacgggacggaaggaggacagaatctacatgaaattcaaaaacacatccatccagctcaccctcacctgcagcgtcgtccgtgcacaattccttgccccctcctgttctctctctcttttcaaatgagcatcgtgcacaacttgacctactggtacaggtcttcgagccagtggccacaccgcacaatatttaattcctattccggagtatccacacagcctgtgtgaagctagctgaaacaaagcaaagcaacacgagcacagcaagcagccaagcactcaactcatcacccgaagcagagtttaaattccagatcccaagctccaaaatttccacaccccgaaaagcccacaataaaaccccccctgtccccctcagactcacacacacacatcctgccttcctcagtcctcactcggtcactccccccaagaagagaagccaagccaaacctgccaaagacgacatttttcatggacgccggcgcagcaaccgccgcccgggagcgcccggcgccgccctcgccggtgccggtgccgcaggcgtcgccggacccgtccaaccccttccccaccacgttcgtgcaggccgacaccacctccttcaagcaggtggtccagatcctgaccggcactccggagaccgcggcggccgcggcgtcgggcgggacgcaggcgtcgccgccggccccgcagaaggcggcgccggcgcccccgggccccaagaagccggctttcaagctctacgagcggcggagcagcatgaggagcctcaagatgctctgccccctgctcccggccgccgccgccttcgccgccgcgggcggctccgccggcgccggattctccccgcgtgggttctcgcctcgcgggctcgaggtgctgtcgcccagcatgctggatctcccgtcgctcgcgctcgggagccccgtcacgccgctgccgccgctgccgggctcccaggaggccgccgccgccgaggaccgcgccatcgccgagaaggggttctacctccacccgtccccgcgcggcaatgccggcgccggcgccgacctgcagccgcctcccaggctgctcccgctcttccccgtgcagtcgccgtcgccgaccggccggtcgtgagtccgtgtgacggcatcttggcttcccccctccccttgctctaggctggcctgctcggtacgctctgctgcttgtcgcggcgctcctcaagctggaggccgacccgatctgcggatgatttgctcctacctctcgtcagctctgggacgatgtttcctgtatcttcagtccccatgttgtaatcttggtgtttgtaacagtgattcggcgcataagagagggattaattgatcacccgaaaaaaaaaaaaaaaa

SEQ ID NO: 8896 - DNA, 888 bp, Zea mays
  misc_feature (836)..(837): n is a, c, g, or t
  misc_feature (852)..(852): n is a, c, g, or t
  misc_feature (855)..(855): n is a, c, g, or t
  misc_feature (859)..(859): n is a, c, g, or t
  misc_feature (869)..(869): n is a, c, g, or t
  misc_feature (871)..(871): n is a, c, g, or t
  misc_feature (880)..(880): n is a, c, g, or t
  misc_feature (882)..(883): n is a, c, g, or t
  misc_feature (888)..(888): n is a, c, g, or t
ctcgaggccggcggccggggttcggagcctcctgccgcaatttttttttaaggctggtctgtttcgtgacgtcccgcgagaagagaacccccgtggcccctggccgcgacggagcggtcagaagcagcggcggccggcgcggtttccgtttcctggttggcccgagaattccgattcctctcctgatttgtgtacatatagttgcctggaggccccgtcgctgtccccgcgctctctgtctcctcacgcttggctgttcgccgcggcgccaccgtcggaggcagctgctaatcgcgcgtccggtggccgcgttgcagcggcggagcgtctcttgttgtgcagtgctgcagcggattgtcgcggcctgcccgcggtgaggccggcatccctcttcggaaggcgtgctcgggcggggccagcccaaccgccgttcgtgcgctagagttcctcgctcagaaagtggagaaataagatacatagtggaagatgagatcagttgttcggtcacttcgccagctccgccgatttatccagcactatgcagaggggaactcacaagcaaccagattgttcgggctgcagaatgctttaatcatgtgcggatcgacaccccgttcactgagcatgttacgtcgtaatggtgaaattagcagatttgcaagccctggcatggagttgatgaggtccatgttctctaatgtagcggctggttctatcaaagatattggaagaggtggcccgatggtggaatatgagaggagaatagcatcaggagacctagtagatggcgatagctttcaggttgatacaattcaacaattacaagggctctatgnnggagcttgatctganaantggnaaaaaactgncnggtggatanannctaan

SEQ ID NO: 8897 - DNA, 2520 bp, Zea mays
cacaccattttctaccaccatatgatggtggggatgaacttctctctatcgaagttcttcctctgcgtcctcgacttctacgacatctaggtcggacacttcacccttaactccatccttgccctcttgacctttgccaatctgtgtgagaccatcgttggggtgaggccccacgtcgacctattccgtcatttctttctcctccaggcattgagcagccggaacttcttcggcaagttctacttccaacttcgctattatttttacatgataacatattggcatataggagtggtaattttactaattcgttgcattgacattgtggtatgatttcagcgcaaatttagactttcagcttgatgacaactaaatacaaatgtcactgccatacagcctccttttgaaagctatgttatggaaggtagctatcatttttacttcatgcattgcagaactttcctgattatgatttacgatacgtgaaacatttacatagaaggttaataatttggactatgcgttggattctccatatgacattacaagatgagatgaaaccatgatttttcttaacggtttgctaaccaaataatgagatatactgcagtgtagtccatgctctctaaccagtgcactttatatttcagatctctggaaaaaacattgtgtggacctggacagactaataatcacatcatgaccattcatagacatttctcagagtttagaaagaatatattcatcgattctgaaaaaggatctctttgacatgatcccataagaagacaaagctaagatagaaagtgtcggtcttagtgtcaccagaaaacctgaactggaaattcccatagttgtcaccttttcttgacatgggtttagattgatattataactttgtaaacttaaaatgtgtggattctgaattggcctgttacttggcgcatatgaacagtagctatgctttcgttcattctaacgccttgtgaatttgatgtttcctgcattcctatagttgtcaccttttcttgacatgggctcagattgatattctaactttgtaagctgaaaatatgtggattcctggtttggtgcaaattgtggtgtgtttctaggagggtttaattttccgagggaattgctaaagattttgtcgaggcttgaactgttgtgtaggacaaaaacaatgacacgcccggtttccaaatcctaaaggcacaggacatttgtgtagacccaaactggtactggattggcgttagagcattacatggatacatcattatcttcaatttactctttcaattgttccttgactggcttggccgtgagtactctccagctcaaagatagtttgattcacacacttcaaaatcttatgtttgtcttttagaacaaaacccaacattgtatcattggtggttggcatttgacaaaattaagtgctaattcgaaaatgcttctctgctcagttcgcttcgcaaacttgaactgtgctggcggcgtcattttgcttcccaacatcaatccaatttttattgattctttagaaataatttctacaatattataatgtttgttcgacattgcttcgttttagcccgttgtttcggctagcgagcgggtgcggaagaaggaagggagaggcgcttggttgacccggacggcaggacaccgccgggggttcgctgcaatgcagtgacgatttccacagcttctgaggctaaggtaagctttcaagcgaatttgtcgctgcaactgttctttagccaagcctcgcgagttctggcttcggggtaggcggaacattttcctgtgcgccttctgatgcttatccgctcagaagattagtataatatttatttgcttctctctaactggatttaagttgtactgtcctatagaagtttgaatgtatacgcaaaacccatttttaatttagcttattattttgcctaatgtatcatgtatgtaagctgagttaaaagaaaaactgacggatatttaactaaactagatctatgagtaattgttgaactggtgaaagagttagaaggcaactgtatgcatctgtgtgctggcgtaggtgatataccacaccaaaaagtgtaatagttggctcatactaaggcttgcaactctttctatcttttacggttttctaaattgatagatggtttgattagtctttaacattattttgtctctatggatggattgcagaacaactattctctttcagtgattcatgagtctacccacggacctgcaggtaattttatcaatgaccctaaacatcatatgtcctggtaattcatataattgtagaacgacttacaatttggaacaaagataggtttttattttttattgagttgtctaaatatttcacttgcattttttatatgaagggtcgaagtctatgaatatttagctaagcaacctgggaaagcaatatatatgctgatctcagttacaaggaaataactagcttcaatgatatacgcaccttccgaagcc

SEQ ID NO: 8898 - DNA, 4098 bp, Zea mays
  misc_feature (3391)..(3391): n is a, c, g, or t
  misc_feature (3518)..(3518): n is a, c, g, or t
  misc_feature (3999)..(3999): n is a, c, g, or t
ctctggatgcaagatctgatgttgtattgcaacctaactctgaggataagcatatcttttcaattgcttctaatgggcagtattctgcatgctcggcttataagggtttcttcactggctctgttggttttgagcattacaaaatggtctggaaatcttgggcacctcctaagtgtcggttcttcctttggttgctggctcataataggtgctggactgcagacagactggaaaaaagaggactaaatcatcctcctagatgccctctttgtgaccaagagcctgaaaccatcaaccatcttctggtttcttgtagcttttccagattatattggtacatcactcttcggaaattcgggctccacattcttgcctctatccaagatgacacaaacttcctgcagtggtggaaacgtattgctgatattgtgtcaggcatgaccaagaagggggtaaattcacttttgattctgggagcctggatgatctggaagttcagaaacagagtggtgtttgacgggtcccccccccaatatcactacactattagaggccactgctgaggaaagggagaaatggatggttgcaggagctaagggtctttcctttttagctgctcctagtaccattgcctgagataagttgtatcttttagttgtgtatggattgtttcctttatgcttgtttctggcctccataaggaggtcctgtattcgggtccttttccgaccctatttcttcttacttaataaaatgaggcgcagctctcctgcgtttttcgagaaaaaaaaggaggttagggacaccattgcttgtctcccttctgataaggctcatgggcctgatggttttacaggaaaattttacaagacatgctgggacatcattaaagtcgacataatggctgctcttaattccctttaccatggaaatgcctataagcttgatttgttgaactcagcgtatctcattcttcttccgaagagggaagatgcttcttcagctggtgattttcgaccaattagcttgattcatagttttgctaagttggtcactaagatcctcgctaatcgtttggggccatatcttcaagacctagtggtagctaaccagagtgcttttattagaggaaggtcaatacatgacaatttcatgctagtgcaacaatcgattaagttccttcataagaggaagatctctagtttactgctgaaactagatatttccaaggctttcgactcagtctcgtgggcgtttttgttggaaattttgacacatttgggctttggtcctgtttggcgtaatctaatctccaacttgttattcacttctactcaggagctcctgaatggctcgcctggtaatcatatttttcatcggagaggtcttcgccagggagatcctctttctcccatgttatttgtgttggttatggatgtgcttagcagcttgttccgggttgctgaaaatagaggcttgttgcagggccttgggggagctgatgtccgcagtcgagtctccatctatgcggatgatgtggtccttttcataaagccaattgaagcagacctgaattgtgctaagataatactaaactgttttggttcggcttctggtctggtaaccaatatgctcaagagcagtgctattccaattagatgtgatgatcagcaggtgcttgctggttgcagtgtgctgcattgcagtcccgctgcgtttccttgcaggtatctggggctgcccatttctgataaaaagctgaggaattgtgaccttaagttatggattgagaagatcgcagatcggctgcctaactggaaggctcggttgctcaacctggctgggcggactgcgttggtgaagtttgttctatcggccattccgacttatcttcttattgcaatcaacgtccctcggtgggttattaaatcaattgataaaattcggcgaggatttctttggagaggaagaaaggaggttaatggtggtagctgtcttgttccatgggaagttgtcacgaggcctctgaggcttggtgggcttgggatccctaaccttaagctcaaaagctgggcattgcaggcaaaatggttatggttggaaaagacggatcagagcagaccttggcgtgggttgtccctcccagtgcaacgtcaggttagacagttctttgatttgtcggtttttaccattttagggaatggggctactactctcttctggtcggatagatggattcatgggaatactatccaggacattgcccctgaggtggtgggtatggttggccgcaaggcgtattcttccagaacggtggcacaggctctggataattggcattgggtcagtgatattcgtggtgctctttccttgagtgggttgcagcaatatctgttgttatgggatactttgggggacgttaggctctctcatgatgctgacagacatgtttggatgcactcttcttctgggatgttctcctcaaagtcttgctataaggcttttttcatgggttcaatttcgtttgagccatggaaacgtttgtggaaatcctgggctcccccaaaatgcaagttcttcctctggctggcgataaggaataagtgttggactgctgatagactaaggaggagagggctgcaacacccggttgtttgtgttctttgtgaccaagagcaggaaacagtgcaacatcttctgtgtacttgcagttttgccaggcaattttggcatgctattcttgttcccttgtgtcttggggatctcattcctgctgttgatgaaatctcatttgctgattggtggaggaaggcgcttaagaaggtgcccaaattcagaaagaaaggcttcaacagtctcattattttggggtcttggtgcctatggctgactagaaacaaagctgtttttgatggtgtaaacccttccatgtgttttgttaaaagcttatttctgaatgagttaagttgttgggagagggctggggctaagcagctagcaagttttggtcttcctgctattatgagtagggtctagagtgtggtcaagtgttctgtttgccctacgggcattgtactttggtcctcttggaccttttcctctcttaatataatgacgtgcagtcctcctgcgcgttcgagaaaaaaaaactttgtccgattagtcgtaattaatcgactgatcgctattgcgcacacgataagcagcagtgacgcgatcagaccgatcggaaacctaatcgtccgatcagatcgcggacgatcagtttggcccacttcgtttttgtttcggtccactagccactgcagcccacgcacggacacacaacccactaaaccgtcacgagagcagcagaccacaagaggcaacggcaacgccgccacgcactcanaacacacagtcgcccactcaccctcgaaccctagaccatactcaccagagcacacgggcgacaacaggcgactagcgccccctcgatccctagcatggcgactcctagctgctgcaggtgaccattntcctcttctccagttctccccaagtccctagtcctcgatggcccgatttcctgttcaccggcgagtggcttgctgttgtgttgtgtaggcagtcgatggcctcaagatagaacaaacgctggcactggtggccacgcacgtacagttgtcatagttgtaacacaacccttagtgaggatgctcattcggtgtgaggcggcgaaactagcgcaagggagtaggtagggatgaaaatgaatacttattcggatatcaattttttgttttttcatttattgtgaacaaataggatatagaatcagctatgcaaattcatatttttgtttttagcattgagcttgtaaagattcataaaaggtaaacctcaaatttatcatatatctttgaaatgatagatataaaattcggatacaatccgatactgatacggatactttttcacctttttgttgttggtagcaaataatgtataaaaaattangcaaaattttattcgtatttataataatgtgcttgataacataagaaaagatttacatcaaatttcatacatactatcttaaaatattaaatttgtcct

SEQ ID NO: 8899 - DNA, 893 bp, Zea mays
  misc_feature (104)..(104): n is a, c, g, or t
  misc_feature (164)..(164): n is a, c, g, or t
  misc_feature (182)..(182): n is a, c, g, or t
cagctaaatgctggagtaactgcagttcctctgaaatagtgatgattcttctgggctataatctgtgccgaagatacaatcgacctttaacaaaatcacacccnccatcagcatattgtcgataaagagatcttaagaaggcccttccagctcccaatatttgntattaacactcatgaatncccatgagtcatccacgcaccaagttctgtgactgagacctatgtctcgtgctgtccactgacggccatcctctagatatggttttcccgtctttatgtccaagataggcgtgtcagcattaacagcctgcacacttatccctttcatcaaatggatgccaaatttcaagcccattccatgaaccttactggcaatttgactgaaccctcctatcaactctagacgatggaaatctttgaacgtccggaaaaggtcgaccccattcatcaatgttgtcaaatccatatgaatctgtgtatgcaccgtcaacatatttccggtaccagaggaaatcaataactgcatactgatatccatgtgggagtaacttctctgtcatgatctgtgcattttgcaggtatgcattttcgtctacaatccatgaaaaagaatcatacgagttccaccctcttggaggcaacatggcctgttcttcatttgcctcggaagtaccccagagcaagagaacgaggaagtggagggcgcggcagaggcagtgacgcctccacggcggaggggaggtagccctagcccccatggccttcccgccggacaccgaacaggactcgctgcctctggggtgttctgtactggtgctgcgggagcagaacagagctgagctgaaattggtaggggaggtagagagcgggaggcaagcacttccttggagt

SEQ ID NO: 8900 - DNA, 2954 bp, Zea mays
ccaccgagttcagctgggacaacaagtatcccggagctcagctgcttgcaacacaggtcacccggccggccatcgatcttgcatgcacatgaaccatacatatatcactcagaaactacgtgtactaacttgacgcatatgcatgcatgaaccatcatcatctatccttggtcatcaggagtacttggctggaaggacagagctggaaggctacaagaggggcctggactcgttcgtctgcgccgtgatgcccaacagcggcaacacgcagatccgcaccacccctggtccgtcgtcgtccggccgtaaataacgatctgctgctgcaacctgatgatctgattgacacgacacgacaccgcatgcaggagggcttctcttcacccgcgactccgttaacctgcagtacacaaccaccgcgaccctgctgctgtcgatctacgcgaaggccctcctcgcttctgcagcaggagcagtccagtgcagcgccgcgagcttctctccggaccagatcagttcatttgcgacgtcacaggtacgcaagcaaagcaaagcaaagcatatatatacacagtttccatgcagcgccagctaattaacgaacctcgctcatcgatcggattctcgtctctttctctcggtctttcgtttcctgcaggtggactacatcctgggagacaaccccaggagcgcgtcctacatggtcggcttcagctccaagttcccgaggcgcatccaccaccgcggctcctccattccgtccatcaaggtcctcccccggaaggtcacctgcagcgagggcttctcgtcgtggttcccgacggccaaccccaaccccaacttccacgtcggcgccatcgtcggcggacccgacgggaacgaccagttcggcgacaacagggaggactccacgcactccgagccggcaacgtacatcaacgctgcatttgtcggcgcctgcgctgctgcactggggcgcagccagcaggtgcctgtggacgaaacagcctcagcccacagtgatgttatgtaactagctacaacggaggagtatgcaagggcgggcaaccaaaccatgatatcgctttgtgtaacatcccaaggcccctaccccccactaccactcttgatcatcctgataagaagagataaataaataaataaataaataaatacaatggcaaatctgcagtagtaaacattatctgccgagtcaaacatgcgtcattcagcaaaacccaatcacatgacttagagaagcagtcaatctcgtttcaactttgatcggaatgaagtgtcttatctacaatggtttgctgcagtactccagcaacagctggacaaatcaaaactaaactggggggttctattttttttttctttatactgccatttgtatatataggcatatagctatggttgccgctaagctagctggccaatccaggaaccagccagagatgcacaattaaccgcggtgccaaagaagagttcccagaaccaaagatccaccgcgagaaccgaagagaagatgagcagggcgagcgtctcgtatctattcaaaggccagcctgaagcctcagccagcgtcttcaacaaggggagggattcgctgtctatctcccggcttcttattgaccacgcggtgacccactgcacatcggccgggaccatgtccagctcttctcgaaggcgtcttcccaggtctggcatgtgtccgccgccgtagaggaccgctattctcttgtacccaccgtttattgcttcccggatcttctcggcagcaactctgttcctctccccaatgataactgatttctcctcaacgggtgtaggcacagctgtgaattcagatgtcagttgctttgccaagaaaatcttcagtgcagctccaaaatctagcctggacaatgcctccagctctggaaacccatcttgcttttccactggcagacacagcccagtgatgacgagtagcccaacaagtggcattggtagcacacgtgaggcccatagtaacttcgacctccaaaagttaaggccatctggcatgttacttggctgcaccaaggctttggttgatttcagtgtcatgtctatggcaaacgtgagaatactttcacctctttcactctgaagctgtttgaatgtttcatagtcaaggtcagcatgttgccatttctcattgccataatcaagacagtctaactgataatccaacgaaaggacccgagccatttgtttctgtatgaaaccaataatactaaatcctctgcgtgaagatttcatcttcttagcagccattggacctttcggattgctcaaattctcccgagttgtaaccatttcatacaggacacaatcgtaatcttcaagctctcgctgcagtctatcaaagtattctttgtctgcaatgtggactgtagaaaccaaatcaacgtggaggaaggggtggagaagcgaccacgggaaccgcttcttgaagcgcaccaccgccgtctgcagctccccgcctggcagcccgcctccgcctgcccctccggcacagccaagctcggggcggcggtagcggaggtagtcggtgatggagctgctggtagcgaaccgctccacctctccgtcccccaccccggacgcggcggctgcggcgacggaccgcagccagggggcgcggcgccggcggcgagcgcgggaggagaggaaagcggcggcgaacgaggtggagggcaccgaagccgtcgagagcatcgccgtcggcggttagggttttggagaaggcagggagcgagagagttgaagcggcagtgggtggagggggcgaccgggcgagcgacgagcgtggcggattgctggatgctcgcctcgcctcggcctcccccggcccccctcgcgctcccccctggaagataaccgagacgtagacccacccccggccggcctcgaggtacccaatg

SEQ ID NO: 8901 - DNA, 1893 bp, Zea mays
cattgggtacctcgaggccggccgggatccaagcaatcggtcgagctgggtcgaagaaacttcaacacacaacatacgtatacagtcagctgctgcagtacagtaggagctagatcgagctagcatggcggtgaaggtgtgggtgttcgccgtggcactgatgatgtgcgctggtgtaggccttggagctgacgacgacgacggcagcagtagtgccggtagtatggatgctgctggcagccgccttattagccgctgtcgtctgagctcgcccaactaccgcggcgccctggcaaaggccatcctcttcttcgaggggcagcggtcggggcggctgccggcaaaccagagagtcaggtggcgcggggactcggcgctcaccgacggccaacccgaaaacgtgaacttgacgggtggctactacgacgccggagacaacgtcaagttcggtttcccgatggcgttcagcgtcaccctcctgagctggagcgccgtcgagtaccgcgacgaggtggcggcggcgggtcagctccgccacctccggtccgccatccagtggggcgccgacttccttctccgtgcccacaccacgccgaccaccctctacactcaggttggcgacggcaacgccgaccaccaatgctgggagcggccagaggacatggacacgccgcggacgctgtacaagatcacccggagctcgcccgggtccgaggccgccggcgaggcggcggcggcgctcgccgccgcgtacctggtgttcagggacgaccgggacaagaccttggccacgcagctcctggccgcgtccagatccctcttcgacttcgccaacgactacaggggatcctaccagttgtcctgcccattctactgctcctactcaggctaccaggacgagctccagtgggcgtcggcatggctctaccgggcaaccaaggacagcaagtacctcgacttcctgcagaacaaccagggcggcagcgccaccgagttcagctgggacaacaagtatcccggagctcagctgcttgcaacacaggagtacttggctggaaggacagagctggaaggctacaagaggggcctggactcgttcgtctgcgccgtgatgcccaacagcggcaacacgcagatccgcaccacccctggagggcttctcttcacccgcgactccgttaacctgcagtacacaaccaccgccaccctgctgctgtcgatctacgcgaaggccctcctcgcttctgcagcaggagcagtccagtgcagcgccgcgaccttctctccggaccagatcagttcatttgcgacgtcacaggtggactacatcctgggagacaaccccaggagcgcgtcctacatggtcggcttcagctccaagttcccgaggcgcatccaccaccgcggctcctccattccgtccatcaaggtcctcccccggaaggtcacctgcagcgagggcttctcgtcgtggttcccgacggccaaccccaaccccaacgtccacgtcggcgccatcgtcggcgggcccgacgggaacgaccagttcggcgacaacagggaggactccacgcactccgagccggcaacgtacatcaacgcggcatttgtgggcgcctgcgctgctgcactggggcgcagccagcaggtgcctgtggacgaaacagcctcagcccacagtgatgttatgtaactagctacaacggaggagtatgcaagggcgggcaaccaaaccatgatatcgctttgtgtaacatcccaaggcccctacccccactaccactcttgatcatcctgataagaagagataaataaataattaaatacaatgacaaaactgcaaaagcaaaaaaaaaaaaaaaaagcggccaaaaaaaaaaaaaaaggccccta

SEQ ID NO: 8902 - DNA, 1702 bp, Zea mays
atatcacaagcaatcgatcaagctagcatggcggtgaaggtgtgggtgttcgccgtggcactgatgatgtgcgctggtgtagggcttggagctgacgacgacggcggcagccgccttattagccgctgtcgtctgagctcgcccaactaccgcggcgccctggcaaaggccatcctcttcttcgaggggcagcggtcggggcggctgccggcaaaccagagagtcaggtggcgcggggactcggcgctcaccgacggccaacccgaaaacgtgaacttgacgggtggctactacgacgccggagacaacgtcaagttcggtttcccgatggcgttcagcgtcaccctcctgagctggagcgccgtcgagtaccgcgacgaggtggcggcggcgggtcagctccgccacctccggtccgccatccagtggggcgccgacttccttctccgtgcccacaccacgccgaccaccctctacactcaggttggcgacggcaacgccgaccaccaatgctgggagcggccagaggacatggacacgccgcggacgctgtacaagatcacccggagctcgcccgggtccgaggccgccggcgaggcggcggcagcgctcgccgccgcgtacctggtgttcagggacgaccgggacaagaccttagccacgcagctcctggccgcgtccagatccctcttcgacttcgcaaacgactacaggggatcctaccagttgtcctgcccattctactgctcctactcaggctaccaggacgagctccagtgggcgtcggcatggctctaccgggcaaccaaggacagcaagtacctcgacttcctgcagaacaaccagggcggcagcgccaccgagttcagctgggacaacaagtatcccggagctcagctgcttgcaacacaggagtacttggctggaaggacagcagctggaaggctacaagaggggcctggactcgttcgtctgcgccgtgatgcccaacagcggcaacacgcagatccgcaccacccctggagggcttctcttcacccgcgactccgttaacctgcagtacacaaccaccgccaccctgctgctgtcgatctacgcgaaggccctcctcgcttctgcagcaggagcagtccagtgcagcgccgcgaccttctctccggaccagatcagttcatttcgacgtcacaggtggactacatcctgggagacaaccccaggagcgcgtcctacatggtcggcttcagctccaagttcccgaggcgcatccaccaccgcggctcctccattccgtccatcaaggtcctcccccggaaggtcacctgcagcgagggcttctcgtcgtggttcccgacggccaaccccaaccccaacgtccacgtcggcgccatcgtcggcgggcccgacgggaacgaccagttcggcgacaacagggaggactccacgcactccgagccggcaacgtacatcaacgcggcatttgtgggcgcctgcgctgctgcactggggcgcagccagcaggtgcctgtggacgaaacagcctcagccccacagtgatgttatgtaactagctacaacggaggagtatgcaagggcgggcaaccaaaccatgatatcgctttgtgtaacatcccaaggcccctacccccactaccactcttgatcatcctgataagaagagataaataaataattaaatacaatg

SEQ ID NO: 8903 - DNA, 1417 bp, Zea mays
ccctcgaggccggccggggcagccctatcgtcgtcttcggttcgtctcttctgttgctgggctcgtcgcgagggtagcagaggccagatgagggacagagcaagtgagagaagctgaagaaacaatttgtttttttctttcttatcgaaacagcacagaccagtgaaagagggagcgaattagtgaaaagaagacaataaataaatacaacgaatgcagcgagcgaggtggaggtggggggaaaagggcgaggtgacaccgtgacagagagaaggcgagggagggatcacgaggtgtgcttcctcctccgcccaatcctgcccaaccaaatccgccagcgccgcctcctttacactcccacctctgtcccggagcaaaaaagggagggagaggctcgcttcttggatcgcggggtcacgggacgcgcgccgcgggccggtacgctgctgctggcggactgctcgacccttgcctaccagctgctgcctgctgctgcttccttggctggcgccggcgagagacggaggcgaggcgacgacgatggaccgggcggcgctcaccgtgggcccggggatggacatgcccataatgcacgacggcgaccgctacgagctcgtccgcgacatcggctccggcaacttcggcgtcgcgcgcctcatgcgcaaccgcgccgacggccagctcgtcgccgtcaagtacatcgagcgaggcgagaagattgacgagaacgtgcagcgggagatcatcaaccaccgctccctgcggcaccccaacatcatccgcttcaaggaggtcatcctcaccccgacgcacctcgccatcgtcatggagtacgcctccggcggggagctcttcgagcgcatctgcaacgctggcaggttcagcgaggacgaggcgcgtttctttttccagcaactcatatcaggggtcagctactgccattccatgcaagtatgccatcgcgacttgaagctagagaacaccctgttggacgggagcaccgcgcctcgcctcaagatatgtgattttggctactcaaagtcatcagttctacactcgcagccgaaatctacagtgggaactcctgcatacattgctcctgaggttcttctgaagaaggaatacgatggaaaggtcgctgatgtgtggtcatgtggagtaacgctgtacgtgatgctggtcggtgcatatccgtttgaggacccagatgagcctaagaatttcaggaagacaattcagagaatattgggtgtgcagtactcaattccagactatgtccacatatctccagagtgccaaaatcttgtctctaggattttcgtcgccgacccagccaccaggatcaccatccctgagataaggaaccatccatggttcttgaagaacctgccagctgacctaatggatgacagcacga

SEQ ID NO: 8904 - DNA, 4381 bp, Zea mays
cactcgcgctagtggagtctgcaattgcctagagccctagatctcctagaactagactcaactagaggtatattcttatttcacttgttcaacaatatttacatcaatttgcctttcgtaactcattttttcttttttccccagattttatttgctatatgtcatttgattgtaaatggattataatcaaaatgactattaaataaggtattttttaatatctattacttattttatagctacaagttactttaaactgtatcgtaatatttttattcatcgttgcgttagcaacacctagattcatcatgtacgtaccaaggctacttaaaaccgagtctatcgaaatctaatcgtccacggttaagttaaaagctttccttttccaagtacgtacgtagtttcttttttaatgcgctcttcgtcaacttcgcaatccttgtcactgggttctctatggtgttcctcggtgcttgaaaggattcatcgtctttaccgtctgtgcaagcatcccaccagggtcagggtcactgtccaaacgagacacaaaagcagcaaaccccagccggcctaaattttaatcatcacgtcagacatcaagagaggaggctgacttctagcccttctcgtcggcacgcaaacagatcgtcacgacaacgcgccttgcacgcggccacccgacaatccgctctcagctgtccagcccctgagatgggcctctccgaccctccgatcacaatataccgactcagcggctcagggctattccggtaacttccgcacgtgcgcttttggaccatcaccgcctcccagatatttctgcccatggacccacagctcaactacctaccttggtcactaaccggtgccctcgattcgcaatggatgacagatgggaccaacgggagcacctgggcccaggtggcggtgtgagttagtattgagtaaatgacgcgggagacgagcaggacggcagcccacacatcgtcttcttcggttcgtctctgctctgctgctgggatcaccgtcaccggcaaccgcgagggagggagagggacagagcgaagagagagaaaactgaagaaacaacattttccgtttttcttgcttagtgaaaccagtggaagagggagagaaaagaagacgaagacgacaatataagtaaataaaaaaaaggcagcgagcgaggtggggaaaaaggggcgagttgatagagagaaagatagagagagaaggcgagggaggcagggatcacgaggtgtgcttcctcctccgcccaatcgggcccaaccaaatcccgccagcgccgcctcctttatactcccacctctttcccggagcttcttggatcacgggacgcgcgccgcgggccggtacgctgctggtgctggaccgctcgactctcgccgtccccctgctgctttggctggcgcgccggcgagagagagagagagagagggacgcgacggcgatggaccgggcggcgctcaccgtgggcccggggatggacatgcccataatgcacgacggcgaccgctacgagcttgtccgcgacatcggctccggcaacttcggcgtcgcgcgcctcatgcgcaaccgcgccgacggccagctcgtcgccgtcaagtacatcgaccgaggcgagaaggtcggtcactcaggtctccgctactgcttgctgtgcggctgtgccttctgggcagactatcaccaacgtcgtcgaccaaccaatcgctgctgcagattgacgagaacgtgcagcgggagatcatcaaccaccgctcgctgcgccaccccaacatcatccgcttcaaggaggtcatcctcaccccgacgcacctggccatcgtcatggagtacgcctccggcggcgagctcttcgagcgcatctgcaacgccggcagattcagcgaggacgaggtccgtctttctctcgctatcatcgaccctgcttgcttgctgctcgtgctgtcttgtgcactaattgctatctgcgccactcctgcttcactggactaatcaaactgtcaaagcccctttttcatttcaggcgcgtttctttttccaacaactcatatcaggggtcagctactgccattccatggtacgtatattgtttttctttgcttccaatgttactactgtcaatctgtactgctctggactggtctgtttaaaatcgcttctgtttttctgcctacctgttcgtcaagcaagtatgccatcgtgacttgaagctagagaacaccctgttggacggcagcaccgcgcctcgcgtcaagatatgtgatttcggctactcaaaggtagtagcaagatgctcgctctgttgtttatttacaaacttagtggggaaaatgaagtgcagttgcaatgaacagggcgcactttacctgctagtatacgacatgagtagtaaaattatcaataactgtaattagcagcccataacgtagtcaagaataaaatgaactgaaatcagctgcttaggctgcggcaacaacaataacaaagcattttagtccccgacaagctggggtaggctaaaatcatctgcttacagttcaacagatattgttatctggtgcctttcaaaagaagattggccatcttgtgagattcttgtctccttattaaactgttgctctgcttctaactcctttttgcattgcagtcatcagttctacactctcagcccaaatctaccgtgggaactccagcatacattgctcctgaggttcttctgaagaaggaatatgatgggaaggtattatgctactgtcactgacgattctacacatcctgaggaggtgtttggtctctaaggactaatttatagatcctccattttattctattttagtcccgaaattgttaaatacgaaaacttaaatatagtttctgtatttgacattttagagtctaaaatggaataaaattgagggtttaaaaattagtccctataaaacagacacctcctcgtactgtttgtattcaacaacctccccccccccacacacacaaatgtgttattgttcttcacttgggccgcatttatacatggcgtagccaattagccatgcatagcaagaactatgtgttggaaggctggaattctaaatcagtccctaactcttcgttactgaaccaaggttgccgacgtgtggtcgtgtggggtaaccctctacgtgatgctggtcggcgcgtatccattcgaggacccagacgagcctaagaatttcaggaagacgatccaggttctccctccgcagacgcgcgcgtttacataattacatccagtgtttcagaaccggctgccccgttcggatcgaaccaaaaacgccgacgagattattcttgtctttgcagagaatactgggcgtgcagtactcggttccagactacgtccacatatctccggaatgccaggacctaatctccaggatcttcgtcgccaacccgtccaccgtgagtacttccggcttcgtgatgtcgttcacgagcctgcctttgagcggatcgctgacatgcacagcatgacacgccgtgtgcagaggatcaccatgcccgagatacggagccacccttggttcctgaagaacctcccggccgacctggtggacgacagcgcgacgacgacgagcaagcagtacgaggagcccgagcagccgatgcagggcatggacgagatcatgcagatcctgggcgaggccaccattccggcggcggggtcccgcgggctcaaccagttcctgaacgacggcctggacctcgacgacgacatggaggacctggactcggacgccgacctcgacctggagagcagcggggagatcgtgtacgctatgtgacggcgccgagtgctcagcgacgaggcaatgtctcgttgcgctcgcaggttgccgagataactagagagacggagagggtgggtgtgtgctgctgctgcctgcagcctgcgtgtagttgtgtgctttcaggtctctgctgctcatgcctgatgccgtcgttcgtgatggcccctttttaccgtcctgttgtgtttggccgttgttatttggtgcgccttcagtgcagtgttttgcaacggtttagccatttggaatcgctactgctacaacctcgttcatccgagaggaccctttgtttctgcatccccagcgatgtacttgtattactacactgtatcatatgttatatttggtgtaggaaaataaaggaactccattgcccgttctctgtcaaaaaaaaaaatggccccttccgcctctcagttttgtgagaacccgctggagatctttctcgattttggtgtcttcttggctcatatatctcaagtcgtgcacaccctctatcagagcaaatataataaaaggctata

SEQ ID NO: 8905 - DNA, 1851 bp, Zea mays
aaataaaaaaaaaggcagcgagcgaggtggggaaaaaggggcgagttgatagagagaaagatagagagagaaggcgagggaggcagggatcacgaggtgtgcttcctcctccgcgcaatcgggcccaaccaaatcccgccagcgccgcctcctttatactcccacctctttcccggagcttcttggatcacgggacgcgcgccgcgggccggtacgctgctggtgctggctggaccgctcgctcgactctcgcctaccagctgctgctttggctggcgcgccggcgagagagagagagagagagagagagagagagagagagagagagagggacgcgacggcgatggaccgggcggcggtcaccgtggggccggggatggacatgcccataatgcacgacggcgaccgctacgagctcgtccgcgacatcggctccggcaacttcggcgtcgcgcgcctcatgcgcaaccgcgccgacggccagctcgtcgccgtcaagtacatcgaccgaggcgagaagattgacgagaacgtgcagcgggagatcatcaaccaccgctcgctgcgccaccccaacatcatccgcttcaaggaggtcatcctcaccccgacgcacctggccatcgtcatggagtacgcctccggcggggagctcttcgagcgcatctgcaacgccggcagattcagcgaggacgaggcgcgtttctttttccagcaactcatatcaggggtcagctactgccattccatgcaagtatgccatcgtgacttgaagctagagaacaccctgttggacggcagcaccgcgcctcgcgtcaagatatgtgatttcggctactcaaagtcatcagttctacactctcagcccaaatctaccgtgggaactccagcatacattgctcctgaggttcttctgaagaaggaatacgatggaaaggttgccgacgtgtggtcgtgtggggtaaccctctacgtgatgctggtcggcgcgtatccattcgaggacccagacgagcctaagaatttcaggaagacgatccagagaatactgggcgtgcagtactcggttccagactacgtccacatatctccggaatgccaggacctcatctccaggatcttcgtcgccaacccgtccaccaggatcaccatgcccgagatacggagccacccttggttcctgaagaacctcccggccgacctggtggacgacagcgcgacgacgacgagcaagcagtacgaggagcccgagcagccgatgcagggcatggacgagatcatgcagatcctgggcgaggccaccattccggcggcggggtcccgcgggctcaaccagttcctgaacgacggcctggacctcgacgacgacatggaggacctggactcggacgccgacctcgacctggagagcagcggggagatcgtgtacgctatgtgacggcacggcgccgagtgctcagcgacgaggcaatgtctcgttgcgctttcgcaggttgccgagataactagagagacggagagggtggggcgtgggtgtgtgctgctgctgcctgcttctagttgtgtgctcgcaggtctctgctgctcatgcctgatgccgtcgtgatggcccctttttaccgtcccgttgtgtttggccgttgttatttggtgcgccttcagttcagtgttttgcaacggtttagccatttggaattgctactgctagaacctcgttcaaccgagaggaaccctttgtttctgcatccccagcgatgtacttgtattactacactgtatcatatgttatatttggtgtaggaaaataaaggaactacatttcccgttcaaaaaaaaaaaaaaaaaaaaaac

SEQ ID NO: 8906 - DNA, 2150 bp, Zea mays
tcggtaccctgtccagcccctgagatgggcctctccgaccctccgatcacaatataccgactcagcggctcagggctattccggtaacttccgcacgtgcgcttttggaccatcaccgcctcccagatatttctgcccatggacccacagctcaactacctaccttggtcactaaccggtgccctcgattcgcaatggatgacagatgggaccaacgggagcacctgggcccaggtggcggtgtgagttagtattgagtaaatgacgcgggagacgagcaggacggcagcccacacatcgtcttcttcggttcgtctctgctctgctgctgggatcaccgtcaccggcaaccgcgagggagggagagggacagagcgaagcgagagagaaaaccgaagaaacaacattttccgtttttcttgcttagtgaaaccagtggaagagggagagaaaagaagacgaagacgacaatataagtaaataaaaaaaaaggcagcgagcgaggtggggaaaaaggggcgagttgatagagagaaagatagagagagaaggcgagggaggcagggatcacgaggtgtgcttcctcctccgcccaatcgggcccaaccaaatcccgccagcgccgcctcctttatactcccacctctttcccggagcttcttggatcacgggacgcgcgccgcgggccggtacgctgctggtgctggaccgctcgactctcgcctaccagctgctgctttggctggcgcgccggcgagagagagagagagagagggacgcgacggcgatggaccgggcggcgctcaccgtgggcccggggatggacatgcccataatgcacgacggcgaccgctacgagcttgtccgcgacatcggctccggcaacttcggcgtcgcgcgcctcatgcgcaaccgcgccgacggccagctcgtcgccgtcaagtacatcgaccgaggcgagaagattgacgagaacgtgcagcgggagatcatcaaccaccgctcgctgcgccaccccaacatcatccgcttcaaggaggtcatcctcaccccgacgcacctggccatcgtcatggagtacgcctccggcggcgagctcttcgagcgcatctgcaacgccggcagattcagcgaggacgaggcgcgtttctttttccaacaactcatatcaggggtcagctactgccattccatgcaagtatgccatcgtgacttgaagctagagaacaccctgttggacggcagcaccgcgcctcgcgtcaagatatgtgatttcggctactcaaagtcatcagttctacactctcagcccaaatctaccgtgggaactccagcatacattgctcctgaggttcttctgaagaaggaatacgatgggaaggttgccgacgtgtggtcgtgtggggtaaccctctacgtgatgctggtcggcgcgtatccattcgaggacccagacgagcctaagaatttcaggaagacgatccagagaatactgggcgtgcagtactcggttccagactacgtccacatatctccggaatgccaggacctaatctccaggatcttcgtcgccaacccgtccaccaggatcaccatgcccgagatacggagccacccttggttcctgaagaacctcccggccgacctggtggacgacagcgcgacgacgacgagcaagcagtacgaggagcccgagcagccgatgcagggcatggacgagatcatgcagatcctgggcgaggccaccattccggcggcggggtcccgcgggctcaaccagttcctgaacgacggcctggacctcgacgacgacatggaggacctggactcgggcgccgacctcgacctggagaggcagcggggagatcgtgtacgctatgtgacggcgccgagtgctcagcgacgaggcaatgtctcgttgcgctcgcaggttgccgagataactagagagacggagagggggggtgtgtgctgctgctgcctgcagcctgcgtgtagttgtgtgctttcaggtctctgctgctcatgcctgatgccgtcgttcgtgatggcccctttttaccgtcctgttgtgtttggccgttgttatttggtgcgccttcagtgcagtgttttgcaacggtttagccatttggaatcgctactgctac

SEQ ID NO: 8907 - DNA, 2614 bp, Zea mays
ctgggggcccccagccggccctccctgggccctggcccctgtgctctccttgccaccgaacgagagccaaaagcctcccgccccacgacgcgcccgccccggcggcgacgccccggaggacgtttcccgcagcgaccggcgaccaagccttgatcgcctccgccccatggctacccgggcgcgggcgtagccgccgcctcggccgcagcaggctcggtccgcccctttcggcgatttctgttccagtcgcatcgcgcgacagctcgtcgtccgattcggatccccgccaccgcggcggaacgaggcgtctccggtccccgagggtattcggggaatttgagactgatacgtcgggatcctgtcgataatgcggggctacgagtacgagaccaatggttaccaccaggaagtggaagatgagtacggagatgagtactatgatcaagatgagtatgaggaggaaggttcgggtgctggggatgggtatgctgaggaggaagagcctacagagggacaaaaggagatccttgaattgagagaacgattaaaagagcagattaggcgaaaggcaaaggctgctgctgcctgcacagctggtcgatcatcttcttcacaaatacctcaagccagggacaaatttggctctttctttgggccatccaagccggtgatttctcgtcgagtgatagaagaaagaaaatcattgaaagaactgcatagcacggttgcaagggagccaaggccttctggagtacataaggatattccatcgtcctctaaagtgcaaagtagagtaaatggacatcagcataaacaaaagattgttaatcaggtaaagaagaaggctgaggcacttaaggataaccgggattattcatttctactctcggatgatgctgacctgtcatcctctccaaaggagaaacctgctgctagatcttccttgactcgaagggctgatcgtgagttgacgcaatcaacagtaaagaggaaggcatcaacaagtcaacctgcacgcttgtcaaatggatatggacctaagaacacaatgtcaactcaaaggcatgctgaaggtaaggtaaattccatgagaagggaggatttctcgaatacagaaagggttgtttcacgtgacaatgagaggatgtatgaaagggttgtttcacgtgacaatgagaggatgcatagtattgcaagaaatggatccaaccaggcaagtactagcaaaaccacaatccaaaagcatccaagcaggggtcccattgctaataagcaaccttccaaggattcgaatgatgcaactctgaggaagagcagtgtagcctcaaagcaccatcccttagagattgacagaccaaaatcctcgcaaagtcagaggatgcagtcagctggtcagagaccacagcattcttcccatggtcagacgccacatcaatccatgcagcataggacgcagcagtcattgcagagtcggaggccacagcaaatgacacagggtcagaagccacaacagtctttgcagagtcaaaggactcaacagtccttgcagaatcgaaggccacagcagtcctcacatattcagaaatcgcaatcctcacaagcacacagaccacagtcattaagtaacaggtctcaggctttacaaggacaaaggcctctttcttcacagggtcaatatccggagcaaagaagagtacatgcaagtgacagagtcaaacaagctgaaaggcagattcggcctccttccaagtccatgccatcacggccagtctcttccaatggaattcgtgatgatcatgcaaaaaggaagcaagtggcaaaaagaagatttgatgaagatgaagatgatgaagaccccttagcaatgatcagaaatatgtttgggtatgatcctagtagatatgcaggcagagatgaagatgtcagtgacatggaagccgattttgctactatagaaatggaagagaaaaggagcgcgaggattgctaggcaggaggatgaagaacaacttcgcttgattgaggaagaagagagacgcgagcaggagagaaagaggcgaaagatggcacgaggccgatagtcgaatacactcctatttggatgttataatatactaccttcgttctcgaatatttgtcgtccgctggttcatttttgaactaaaccgtgacaaataaaaaagaacgcaggagtatctggcaggcctgattgcctgaatacgaagccccatggcggatcagacaggcacttctcttgcagtcctgtttacccttaccacgatgattatctggaggcaaatcaagggaaaacgacaggtgaccaacactgggcacgtgtaacagcagactgtagttgtagtggtttagttctcgaagctgacatggactatatttaagttctcgtcagattgtttggatagcagaaggtttccgattgttgcagcgcctcaccagattgtttcttcatatgatatactgattctttcagtcaagcctatataaggatgcgtaatacaagtgcccctcttgtatatctttctcgggtgtaatagtgttgtaataaacgatgttcgaattttcggatatgattttgagctttgtcaggcgatccctgc

SEQ ID NO: 8908 - DNA, 2558 bp, Zea mays
aaaacccttatctttccctctacgcactcgcgatgctccctccagtcaccgcaccgacccatccgcctccgccctgggaatcgacgaccaccactagaccgccgccgccacctcctcctccttccggcgccgagtccgaggtgccgccaaagaagcggaagctggagggggtggggtttcagcgctcgccctattacacgatcagagaaaccgttgcaaatctccgcgtccgcttccttcaggtttgccaaggaactgattcagaaaagaaagatactgctgtaggaatcttgaatgagatgaaatctgtgatggaattatccaagaaaacacggcttgatctgtccgcttctgctgaacctgtgaaaccgttgaacaaacatgcagctagagctcctgaggataagcgtgttgggaaagttctgtctgcagagaagagtttagttcctccgacaagcctgggcctggctggacattttgtgcacaatacaggtgggggtgtaccactcaagcctgataactcagacaccgcagcacatgggttaccggtgaagattaggaagtggcccggactaagtaagataacaggttttacaaagcgacagggtggacttcctcaaggttcttatgtcatcggtggatctcccattggctggaattttcttgtgtggcctggaagcaaagcagtctactatggtttgaccaaagcagagtggttggctcgtcaatctgcaaatagaaattcgaacatgctgtcccagtgatctaacagctacatggatcgatctttagaagataacatagtattccctaatccctagttattgtgatataagtagaaccaaatagtacatgacgcaccaggaaggtaacctctgacaccagagcatggtagcttggtaaggtactgaggtatattggttttgttgctcattaggggtaatcaacagtaaatactagataatagatatacggagaattttggtactgtaaactggatgggccggccaagtgtccatgttatgtcttctgttcagaagtggatacgatgaagaatttaaacacatgacagcgcattagcgccgatgcacacttcaaatcaactggtggagcttctgactccctgctctatgtgactttgttcccgtaatttctgtatcttgcctgcctctctttatctgtggagagaccagagagaatgcttgtgaaaatttgtgtttagttgcttgtttttgcagctattgttcaagcgcagaaatgctagtggtattagtttggctttctaccttgcctgtcctttttattagtttggctttctgccttgtttgtctttttcttttggtctgatgagatctagattttctaacttccataaccttgaaacatttgagcccctttagaatgcaggaattttagaggaatcatatataaatttcacagaaatcagttcatttttacgaaaagcacagaaaacagcaaaaaattcggcaatccaactgaaaacctcaggataaacaggaggatctgttcggaatctggacggcctgaacatcacttcacttttctagtcagaacaagggcgtaggggaccaagccaccaaggccccgcttctgtgtcttccattcttgtcggagcgtgctccgttgttgacggaagcaacgcttttggggcatggaaacgggcctgcagcgtcccaactcgcgattgggccctcgcagcacctgccaaaacaagaaaagcctagcccatgcgccgtgcggaggttccacagacatctcacgcctctgaggcaggtccacgtcaggcattttaaccggcgcaggcgaaacgcgcctatttaactgtgcgcccgcctcaacccctgcctcctccctgggccctggcccctgtgctccccttgccaccgaacgagagccaaaagcctcccgccccacgacgcgcccgccccggcggcgacgccccggaggacgtttcccgcagcgaccggcgaccaagccttgattgcctccgccccatggctacccgggcgcgggcgtagccgccgcctcggccgcagcaggctcggtccgcccccctcggcgatttctgttccagtcgcatcgcgcgacagctcgtcgtccgattcggatccccgccaccgcggcggaacgaggcgtctccggtccccgaggtgagtccaccgaccggtggtgcgaatccgccttgtttctatggttgctttcccgtggcggcgtcccagagtcgccccgtattcttcgtccaaaccctagatttgccatccttgtgtcgcgtctggggcggattttgagcaattatgtgcctgccccatgaattgagcgtcttcgccaaggaattttagggtcaaccgatcctggttcgatgtgtatttggtcccgattgtaggcttggttggttcgacgtgggcattgtctgaaaaattaatggcggcctgtgtaaacttatggaagttttcttgctctgattcagggtattcggggaatttgagactgataagtcgggatcctgtcgataatgcggggctacgttacgagaccaa

SEQ ID NO: 8909 - DNA, 4986 bp, Zea mays
  misc_feature (3295)..(3295): n is a, c, g, or t
  misc_feature (3324)..(3324): n is a, c, g, or t
  misc_feature (3443)..(3443): n is a, c, g, or t
cccctgccgtatgcctgggaatcgtaaaagtggaatgaaatttttggttgaaatcatgcgagatgctgaccttgcattttataactttcactcatttagttgtcattttttttatcattcttgtcttaggcgcttgaatttttcaccgcattttgacatgtatgactgaatcttgtcatatttttacagatcgttgacgaatagggtcaaatcttaccataactatgactacaaactaaatcttgttataactatagctacaaaccaaacgtccaaagtctaaaccggctaaagccctataattgtttcactaattatatgaagtttgatcagctagaatatttctttccgagtgtaattcgatataaacgaacaaaatctaaatctgtctaatcttatacgtgacgaaatgtgcaacttaaacatcgaatcgaacagacccttaaaaactttgttttttttttcgactttcgtcgtgtccgctggacgacacctcctttccgcaaaggcccagccgaggcccaccgccaccgccaccgccgtcccgctccacgcgtccgcaccctctgcgcggcgccggtcgagaactcgtgatgccccgcgaccgcgacgagccagccgccgtgcgcgtctacaccgtctgcgacgagtccaggtaccagaatttgagggatacggtggtgtcggtgttcctctcctgacctggcttgccctagctcatggttggtgcttgcttgtgctcctgcttgcaggtacctgatcgtgcgcaacgtgccgtcactcggatgcggtgacgacctcgccagtctcttcgggacgtacggccccgtggaggagtcagtctcacctcttctccacctgtattctgtatccgtatttgcttagttgatcgattacccaccctggggggtgtcaggtgcacgcccatggatgcagaggactctgagccctacactgacgtcttcttcgtcaagttctcacaggtcaacaacgccaggtgaggcgattcgtttcataccaccgcctccatccaatggcattttccactcacgtgttgtggacggtgtgctgaactgctgatatagcagtctagtctagttcagattttcttggactgtaataacatcacagggcaatgaaatcgccccgtgttttctgtggcctaccaaccctaactgctgcagttcacaagaatggctggatgatataacctgttgtagcctgcttctccataatacttaggcttcatctttcttcaactttggacaatgtttagtttatgcttattgctatcaggcttcaatcaagagaacataatacttgggcttttattgaaccacaaaaatcaattgggccataaaatccatggattcagtcggccatcatacaatttgatccactaaatgttgattcattttacatcttgcggtccaactgctaccattgaagctcgagcttacccgctgcacaagtattgccatcttttctcgcggtaaaagtccagaatcagcggcctccatttgaaatgcaaaattggtgctcatgctgcaggtttgcaaagaggaagcttgacgagtctgtgtttcttggcaaccgcctgcaggtgacctatgcccctcaatttgagagccctcaagataccaaggagaaactggaagttaggagaaaagaagtccttggccgaataaaatgtgtgcctacactttactttttggtctctacagctttgtaggggtatttagtattttgatttgacagcaacacataatgacataactactgtgagcattgctaatttatttacactggtaccttcgtttgagaaattttcttccatttccagcatctgctggcagacctgaagggtcatctccagctcagggatcatctagtgggaatcaccaccaaatgaactctaataagaggtttgtattcctgacattggctttgctgatttcagtataacgtgaccagttacattgtggatttctgaaactatgacagctaggctcaagctcttcaatttaactgttctcttgagcaaaatgtagaagtgtcagcctgatttttctcctaaggttcattttacacacattcagggaatatatgaagacaattcatgcttctcctattgaagatcctcgtttcagtcatgtgccctcagacaaggtatgtggcaaaagtgtgttaaatctaattaccttgaaataatttcctggtaaatttaaggttactaaagaatgccaacgagccaactttggtcaactgagatatttgatactagaaacacaagcatctttgcattacatcgcttaagcacagtagctggtaagggtcaaaatgtctaacttctgtcgagatcctgctgtgctagtctgttacgcaaacctgtttaatgtagcttacaactctagtgactttgcaccttttcttttcttgttggtcctggtttcctctccttgagttgaatgctactttaactacatatgaataaaagttcgtgttgtttgtaggattattttccatccgagtcgatgaatgctactgtaaagctagtcagagggaagcttgataaggtaaacactatcgtctgctgtctatctttttttgccttgcaactatgccggtaagctaaaagcttgctccttaaaaaatggcagatacaatctggtggtgataattccagtacctcagcagcatccaggaaaccaggggttgataagcgcaggcgaatttgattgcagataatgccgagcacgcgttcaatgttttggtgtaatgttgatattagcataacataccaggattttaatggacttttttctatcaattttctcactcacattctaggccattaagttgtttatgtttcagggtggcggtgctatactatatggttagctagaattgctggaatatcgataaccgagttaagttaaaaatgcctcgcgtttagttttcccagctgtaatgttatgttactcttgcaatcaattgcatcggaattctcatattttatattgacgcgcctccgatgcatgtgtacggtgagacatgatccataagaaagacatgcctggcgttgggcatcgttttgaaaccactttattccatttttaacttcccgcattgctaatttggtctgcgaaacgaagttttggaaggatttgtcttgtgcggattaaacgtgctacgtgtcacattggttaaaatctaaatgacggtgaggcaagacttgcaattgacatgcctattatttgcttgtaatgctgtgaaataggtcgatttgttcatnacggattttggcatgttcatgtactctcnagtttgggtagaaaacatccggatcataagattaaactaatggtttgcaaaacggtcatcgctacacgcatttggccgttaacccattactctatacattatagaatgctaactagaangtgttcatgaaattatgtataataataagaaacaacactacctccctgtgctcttgaatatttgttgcctgttaatttatttgataattaaaaaagaacggacggagattatgacagagaagagtgtgtgagagacaagtaaagaaagaggtggagggaccagagaccacgggtggcgcgatgcgacgtcggctgtcgtgctcgtgaccgcagccgcgccttcccgcctccacctcctcctgcgattccgatccgccgccctgtccggccggccggtaagccccgcctccgccctgttccctcggcacccatttttcatttcaactgagaggcggaggaaccaacccaggcacccaaccaaccctagatccaccgcttctgccacacgagagggagagatagacctctccgatctaattccgcatggcctcctcctcctccttcgcccccgacgaccagaccgacgccgacttcttcgacaagctcgtcgacgacgacgaccccgccaccagcctccccgacgacccacccatcccagagccgcaggcgcctcccgagggttcaggcaagggcggcgccggcgtccacactgcggtcaagcaggtgcagtgggcttccttcggaggtggcgcggacgacggtcctgacccatttgctcatctctcgggaggcgccggcgacgacgacggcttcctcgtgaccacggccgggacccagacggcctcggatcacgccttctttggcgggacccagagcttggccgccgaggtgacggaccaggacttcttcgccgggagcaactcctccaatcagcataatgtcagtggtcagcacgaccagggcggcggcagcactgcagtggattcagcagatcccatgtctttggaggccatgtaccctgggtggaagtatgatgaggcctcccagcaatggtaccagcttgacgacagtgtaaattcaactgggaatgcagctcaggtgctggacaacagcactcggtatgcacagcagcagcagcagctccacgcctcttatctgcacaattcagtgcattcagggcttgagacaattgctgaggagggcactaccgcaaccggtgctgtctcaagttggggccaagggggctgcctcagagtacccacccaacatgctcttctatgcagagtaccctggttggtactttgacaccaacactcagcagtggcactcccttgagtcgtaccagcaggccgccgtgcaggctggaacatctagcacgggtcagactgttgttgcaagcgatgatgttgttgcgacttcctctctgacaggccataatgccgggcaacctgaggaccttgctgcccacaatcaggtgacccaacgcaactcatcctcgaatagtttcacccatcagaaccaatggcagaccaccgatgcacttggtaacaatgtacaatctgaaagcctggctagtagcttctatggttttgaacaacacatgaatgctgagactaccagttcctctacgagccaacagactggttttcacacagggtaccga

SEQ ID NO: 8910 - DNA, 2313 bp, Zea mays
ctttccgcaaaggcccagccgaggcccaccgccaccgccaccgccgtcccgctccacgcgtccgcaccctctgcgcggcgccggtcgagaactcgtgatgccccgcgaccgcgacgagccagccgccgtgcgcgtctacaccgtctgcgacgagtccaggtacctgatcgtgcgcaacgtgccgtcactcggatgcggtgacgacctcgccagtctcttcgggacgtacggccccgtggaggagtgcacgcccatggatgcagaggactctgagccctacactgacgtcttcttcgtcaagttctcacaggtcaacaacgccaggtttgcaaagaggaagcttgacgagtctgtgtttcttggcaaccgcctgcaggtgacctatgcccctcaatttgagagccctcaagataccaaggagaaactggaagttaggagaaaagaagtccttggccgaataaaatcatctgctggcagacctgaagggtcatctccagctcagggatcatctagtgggaatcaccaccaaatgaactctaataagagggaatatatgaagacaattcatgcttctcctattgaagatcctcgtttcagtcatgtgtcctcagacaaggattattttccatccgagtcgatgaatgctactgtaaagctagtcagagggaagcttgataagatacaatctggtggtgataattccagtacctcagcagcatccaggaaaccaggggtcgataagcgcaggcgaatttgattgcagacaatgccgagcacgcgttcaatgttttggtgtaatgttgatattagcataacataccaggattttaatggccttttttctatcaattttctcactcacattctaggccattaagttgtttatgtttcagggtggcggtgctgtactatatggttagctagaattgccggaatatcgataaccgagttaagttaaaaatgcctcgcgtttagttttcccagctgtaatgttatgttactcttgcaatcaattgtatcggaattctcatattttatattgacgcgcctccgatgcatgtgtacggtgagacatgatccataagaaagacatgcctggcgttgggcatcgttttgaaaccactttattccatttttaacttcccgcattgctaatttggtctgcgaaacgaagttttggaaggatttgtcttgtgcggattaaacgtgctacgtgtcacattggttaaaatctaaatgacggtgaggcaagacttgcaattgacatgcctattatttgcttgtaatgctgtgaaataggtcgatttgttcatgacggattttggcatgttcatgtactctcgagtttgggtagaaaacatccggatcataagattaaactaatggtttgcaaaacggtcatcgctacacgcatttggccgttaacccattactctatacattatagaatgctaactagaatgtgttcatgaaattatgtataataataagaaacaacactacctccctgtgctcttgaatatttgttgcctgttaatttatttgataattaaaaaagaacggacggagattatgacagagaagagtgtgtgagagacaagtaaagaaagaggtggagggaccagagaccacgggtggcgcgatgcgacgtcggctgtcgtgctcgtgaccgcagccgcgccttcccgcctccacctcctcctgcgattccgatccgccgccctgtccggccggccggtaagccccgcctccgccctgttccctcggcacccatttttcatttcaactgagaggcggaggaaccaacccaggcacccaaccaaccctagatccaccgcttctgccacacgagagggagagagagatagacctctccgatctatttccgcatggcctcctcctcctccttcgcccccgacgaccagaccgacgccgacttcttcgacaagctcgtcgacgacgacgaccccgccaccagcttccccgacgacccacccatcccagagccgcaggcgcctcccgagggttcaggcaagggcggcgccggcgtccacactgcggtcaagcaggtgcagtgggcttccttcggaggtggcgcggacgacggtcctgacccatttgctcatctctcgggaggcgccggcgacgacgacggcttcctcgggaccacggccgggacccagacggcctcggatcacgccttctttggcttggccgccgaggtgacggaccaggacttcttcgccgggagcaactcctccgatcagcataatgtcagtggtcagcacgaccagggcggcggcagcactgcag

SEQ ID NO: 8911 - DNA, 1306 bp, Zea mays
ctcgcggtggctcgaggccgatgccaaccatctctctccggtccggtccggagcggttgaagcgaagcgagagtcaactaccgccgccctctctctagtccagatttccagcggtccagaccgagagctcggctccctacacgacatcatcatggacgccgccccgctcctcgctctcctcctcgcggccgtgtccctctccgcggcggcggcgggcgacggcgcgcacccgggctactccgacgagggcacctgcacggtggacgccgccggagcgggcgtgggctcgggcccggagctgcggcgcctggaggagcgccggcccgggcgcatcatcgacatcacgcacgcgtacgtgccggaccttctggcgttcgcgccgggggctgtcacggggcccttggtccacctcaaggagtccatggcgaacgggtccgagtacaacctgtcggagctgcggttggagtgccacatgggcacccacgtcgacgcgccaggccacatgaaccaaggccacttcgccgccggcctcgacgtggacacgctcgacctcgacgtcctcaacggacctgcgttgctggttgatgttccgagggacacaaatataacagctgaagcgatggaattcctgaatatccctagaggagttcgccgagttctattcaggacgctgaacactgacaggaagttgatgtggaggaagggaggtgacatgagctatgttgggtttacagaggatggcgcacagtggctagttgacaacactgacataaagctagtcggaatcgacagtctatcggttgcagcatttgagcacttgatctctgcccatgtggtcttcttcaagaccccggatataatccctgtcgaaggcctgaagctagacaacattgagacgggaatatacatgctgcattgtttacctctcagactggttggagccgagggtgcaccgaccagatgcatcctcatcaagtgatcacccccctgctcttgctggaggtgacattgtatcatgccagctgagctgatgcttcatcgtggccaacgcattgattcgcagtcttcgtcttcgtctatatgaaacatagtgttgtatgcccatgtagatatgcttgtacggacaatagagacacagcaatacttccatcaaggaaatacttttgggtaagccggtaatgtaaaagacagacatacagttgactgaataaactagaggcctgagaggctgaggcctcgtgcttcacaaaaaaaaaaaaaaaaaatcagtgtaagttccgaaaagaagaagaaacattaacggtgt

SEQ ID NO: 8912 - DNA, 856 bp, Zea mays
gggacctcgagccggccgggaaaaaaatatccgcggcgtctctctccgcgcctccgcgccacagaaccagctggggctagcccaccgcgccccgcagccacaaattaagcggagcccggccggggccgggattattcgttgcagtagtcacagctgacggacgactgaaccaccgacagacaacatggccgcctccgcctccaccgtctccggcctcgccggcgcctccctggccagccgcccggctttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacgtggcacctgggcctgttcatcgtgctcaccttcggccagatcggattcaagggcaggaccgaggactacttcgagaagtgaagtggttatgatccgatccatcatctctggtgctgcgttgcgtgcgtgcgtgccgaaatcgaacctttgctgtgtatagggttctgcgatttcgtcgaatgtgtgatgctacttttgaccttccatgtaaaatctatgccgcccggccccaacgcgctctggtttaatttgatgcatctagctactaaaaaaaaaaaaaaaaaagcggccctctgccctaaaagggatttttttttc

SEQ ID NO: 8913 - DNA, 974 bp, Zea mays
gccggccggtccgggacgggcagcacggcccaactgcttatccagacatgtccaagtgtagcgctcccataggcgcctcggcgagcggcgaatctgtttcatccgctgcaagtgatccacaccaggcgcgcccccacaacaatccgcggcgtctctctccgcccccccgccccgcagaaccagctggggctagcccaccgggcagcgcagccacaaattaaacggagcccggcaggggcatccattattcgttgcagtagtcacagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacgtggcacctgggcctgttcatcgtgctcaccttcggccagattggattcaagggcaggaccgaggactacttcgagaagtgaagcggttaagatcctatgcatcattcctggtgctgcgttgcgtgcgtgcgtgccgcaatcgaacctttgctgtatagggttccgatttcgtcgaatgtaatgtatgatgctacttttgagcttcaatgtaaaatctatgccgcccggccccaacgcgctcttgtttaatttgatgcatctagctaaaaataatacccctctaagccccacccgctcctcagataaaaaagtatttttttttc

SEQ ID NO: 8914 - DNA, 621 bp, Zea mays
cgcctccgcctcccccgtttcgggcctcgccgggccctccgtggccagccgccgggcgttttcccaccagtttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagggtcccggccatcaacggcaacagcctcacggggttttttttttccagcatcggccaggagttggcccatttccccaggcccccgccggtcacctcccagttttggctgtggctagtgacgtggcacctgggcctgttcatcgtgctccccttcggccagatcggattcaagggcaggaccgaggactacttcgaaaagtgaagcggttaagatcctatccatcatccctggtgttgcgctgcgttgcgttgcgtgggtgctcccccctatcgaacctttgctgtatagggttccgatttcgtcgaatgtaatgtatgatgctacttttgagcttcaatgtaaaatttatcccgcccggccccaacgcgctcaggtttaatttgatgcatct

SEQ ID NO: 8915 - DNA, 825 bp, Zea mays
actactaagggcgattgggtttctcgaggccggccgggaaacggagcccggcctgggcatccattattcgttgcagtagtcgcagccgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacgtggcatctgggcctgttcatcgtgctcaccttcggccagatcggattccccacgcgtccgatcggattcaagggcaggaccgaggactacttcgagaagtgaagcggttaagatcctatccatcatccctggtgctgcgctgcgttgcgttgcgtgcgtgctcgccgctatcgaacctttgctgtatagggttccgatttcgtcgaatgtaatgtatgatgctacttttgagcttcaatgtaaaatctatgccgtccggccccaacgcgctctggtttaatttgatgcatctatgctactagtataaccctctcagctaggccccttactctgataaaaaaacatttttttttct

SEQ ID NO: 8916 - DNA, 991 bp, Zea mays
ccacgcgtccggtttcatccgctgcaagtgatccacaccaggcgcgcccccacaacaatccgcggcgtctcatcccgtcctctcgctctcgtccgcagcaccaccgccgcgcgtcccactcccaccgtccctgtccgcgcctcgtccgcaccacagaaccagctggggctagcccgccgcgcagcgcagccacaaattaaacggagcccggcctgggcatccattattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacgtggcacctgggcctgttcatcgtgctcaccttcggccagatcggattcaagggcaggaccgaggactacttcgagaagtgaagcggttaagatcctatccatcatccctggtgctgcgctgcgttgcgttgcgtgcgtgctcgccgctatcgaacctttgctgtatagggttccgatttcgtcgaatgtaatgtatgatgctacttttgagcttcaatgtaaaatctatgccgtccggccccaacgcgctcaggtttaatttgatgcaacaaaaaaaaaaaaaaaagcgccccaaggcccccctctgataaaaaaagcatttttttttctaaaaaaaaaaaaaaaaaagggccctagggcc

SEQ ID NO: 8917 - DNA, 1232 bp, Zea mays
  misc_feature (2)..(2): n is a, c, g, or t
cncggccggggaaaaaaataggtaccctacctcctcccggtccctcgccgatcgagatctacccccaatcccttctccccctccaggcgacgggcgccggaggccgacggcgacggggcagcacattgcctctgattgattcatcgacagaagcctcgcgacccggcccccgcttcgccgtgatccggcgacccgacgagtcgagccgagcagctcgtcgccgagcaccgaaatggggtcgttcaacggccacatcctgccggggacgctgttcctggcggtgggcctgtggcgggtgtggtccgccgtcgcgcgcttcgccgccgacccaccggcgttccgcgtccgcacgtggaaccccctccccaagggcccccgcctgctggagctctacttggtggccggcggcgcgttcctggacatgtgcctggagctcggcggcggcatcctcgccggcggcgcccgggtcggcccggacagcctcatctacctcgagcacgccggcatgctgctcatgttcttcctcttcggcgcgctcgccctcctctcccagaagacaagcaggtacctgccgctgaccgacggcgagctgagcctagtggcagcgacggcattcacgtcagagctgcttctcttctcctaccactccgccacccacacgggggctagagggctactaccaccacctcctggtcctcctcatcggcctctgcatcctctccaccgtcctgggcgcgctctcgccggcgagcttccccgccgacctcgctgccggcgtgctcctcacgctgcaagggctgtggttctaccagacggcgctcacgctgtacgggcccatgctcccggccgagtgcggcgtggacgccgacggccacgtcgactgccgcagccgcgccgcggaggagcgcgccgagcagctggccaacctgcagctgttcggggtcgtgttcgtcgctttcgtctacgtgcttgggtgctacgccgtcgcggcagcgaggtacgggcacccggacctcgcggcgatgcatgacgagcacgccgcggcatacgagtgccgtggcggggttggctccaggaccgaggtcgagtgtgtggctgtgtagtgttcggataggagattttgaggccagatgatttaacatctctgcataattctttatttttagaatcactccgtttacgtataatcaatccaaacaataaaaaaaatttaaaaaaaaagcttgatatgc

SEQ ID NO: 8918 - DNA, 1181 bp, Zea mays
gcaagggctgtccgtccccggccattctcagcacggttcacggctgattgagtcggccactgcccacgccacccaaaaactcatggccagcgctgcctgcggcgtcaccgcgcgtgcccacctgccttccgccgtccctgcagccgcaagaaagctcttcttccgctgcagggccgcgtccaccatgaacgaggcatcggcgagctcgccggacgccgaggagaagaagacgacgactgtcttcgtggccggctcgacggggcgcaccggcaagctcgttgtggagaagctgctggccaagggattcggcgtcgtcgccggtacgacggacgtgagcagggcccgcggcagcctgccccaggaccccaaccttcagctcgtcagggctaacgttacggagggcgtcgacaagctggtggaggccgtgcgcggcgtcgacgctgtcgtctgcgcgacgggattccggcggtcctttgacccttttgctccgtggaaggtagacaactttggcacagtgaacctggttgaagcatgcagaaaggctggcgtagcaagattcgtactcgtcagctccattttagtaaatggggccgccatgggtcaacttctgaatccagcctacattgtgctcaatctacttggcttaacactggtcgcaaagctacaggcagagaatcacatcaggaaatcaggaatagattacactatcgtaaggcctggagggctgacagatcaacccccaacagggaatatagtcatggaacctgaggacactctttattcgggatccatatctcggagccaggttgctgaagtagcggttgaagcactggtgtgtccagagtcttcctacaaagttgttgagattatcgcccgtactgatgctccaaatcgctctctgaaggatatgtacgctgcaattaagcaaaattgactgctatatttttttgacaggatggttagtttgttatacaaccatgaatcaatgaagaacacttatagtctatgtatttggcattcgacagtatattttttgacgcgcgaaaatctcctgaagctggtcagataagccttcagtctaggccggctaggtcacctctaaaaccggtcactgtaaatatttgctattttagtctttttaacgtggactaaatattattatgtcaaaaaaaaaaaaaaaa

SEQ ID NO: 8919 - DNA, 905 bp, Zea mays
  misc_feature (862)..(862): n is a, c, g, or t
catggggtacttcgagcccggccgggggccaatgcccagtgcccacgccacgccacccaaaaactcatggccagcgctgtctgcggcgtcaccgcccgcgcccacctgccttccgccgtccctgcagccgcaagaaaactcttcttccgctgcagggccgcgtccaccatgaacgaggcatcggcgagctcgccggacgccgaggagaagaagacgacgactgtcttcgtggccggctcgacggggcgcaccggcaagctcgttgtggagaagctgctagccaagggattcggcgtcgtcgccggtacgacggacgtgagcagggcccgcggcagcctgccccaggaccccaaccttcagctcgtcagggctgacgttacggagggcgtcgacaagctggtggaggccgtgcgcggcgtcgacgctgtcgtctgcgccacgggattccggcggtcctttgacccttttgctccgtggaaggtagacaactttggcacagtgaacctggttgaagcatgcagaaaggctggcgtagcaagattcgtactcgtcagctccattttagtaaatggggccgccatgggtcaacttctgaatccagcctacattgtgctcaatctacttggcctaacactggtcgcaaagctacaggcagagaatcacatcagaaaatcaggaatagattacactatcgtaaggcctggagggctgacagatcaacccccaacagggaatatagtcatggaacctgaggacactcttttattcgggatccatatctcggagccaggttgcttgcagtagcggttgaaagcacttggtgtgtccagagcttttcctacaaaagttgtgagattatcgnccgtactgatgctccaatcgctctctgaaagatatgtacgctg

SEQ ID NO: 8920 - DNA, 2567 bp, Zea mays
tcttttttgtttgaatttgaaatcccttccttttctttttgcctacacatgaccaccttatacccaaaatatgtcttgtaacctttcaaagtgtttgtgaggtattcataaataagatatctttgacaaggacaaatagtgtaaacatccaaaataatcattgcaattatttatcaagcaaaaaacatgctccaagatgaatgcatcaaataatatattcaactcttttgtttgaaaatctaccccctactctactattctcaagagatggattggggtgtcacaggatactcggctgtctacgagatctatatgagctcaagtatattaaaacgactgtcgatgcggatgttttcgtaattgtgctcttataagttggacgatactgtcacgaccgaggggacaaggcgcaacaggacgaaacatgattgtggttcatggtgcaaaggatggtttgtcgtgcgtgatcatgcgctttgttctgttgttgcacagggacatgtgaagacgtgtgcgttcttagattagatggctcctgttcatggaatcacatggttaagagctatgtcccaacatatcctaacgacatatgtcgacacactagcaagagatttgtaaatttgtccttttcaacactagccttcgaaattttatccttaggtccagaattcatggatacagatcgatccatataataaaggaggcaacaaagtcatagtccggcccgaatcatctccacgcttagttgtaccgtaaaatgaaatgctgcattgtttaggatttttttactcatcgttttatcattctagataacgtgacaattttgaaaacgctccagtgaaacaagccgactgaccgaaccgttgaattgcaatttccgctagaaagccgacgagacaatttcttccgttcgtttcagatcgggcggtggtcctgaccaaggcgctgccggccactggcctctcgcaaccggcgaccgcatctcgaagtagagggtgctggccgccgctctcggaagcgctctggaaggacacggccatggcgatgcgggccgctgcgcgtcaagccatactctctccaccgcttgggccccgcagtcctcgccccttcctctgtggttgttccttgtctatcgctcctcggttggagccgtgccgagcggcgagctccaccaccgcgccggccgccggaaagcatctccctccattgttcagcgtcgcgccgatgatggactggacggacaaccactatcggacgctcgcgcggcttatctcgcggcatgcctggctttatactgagatggtcgtcgccgagaccatcgtgcatcagaaggataacctggataggtttctagcatttccggaggaacaacatcctattgtgctgcagattggtggaagtaaccttgaaaatttagcaaaagcaacagaactggcaaatgattattcatatgatgagatcaacctaaactgtggctgtccaagcggcaaagttgctggtcatggttgctttggtgctcgcttaatgtttgatccagagtttgtaggagatgccatgtcaactatcgcagctaattgtgatgtcccagttagtgttaaatgcagaattggtgttgacgatcgtgattcttatgaagaactatgtgaatttgtagataaagttatctcaaaatctccaaccaggcatttcattattcatgctcggaaggcattgcttagtggtctcagtcccgcagagaatcggaagattcctccattgaaatatgagtactattttgctttgttgcgggacttcccagaaataaaatttactctaaatggtggcataaccaatgttagtcaagttagtgcatccatgagacaaggtgcacacggagttatggttggccgggctgcttataacaatccatggaacatgctaggacatgtggatggggaaatctatggcaagcaaacaagatacatttctcgacgccagatacttgagaactaccaagcttatggtgattcaataattgaccagtatggccccagcaggccaaatgtgagacaacttgtcaagccactgttaaacttattccactcagaacctggcaacagcctatggaaacgcaaagctgactctgcattgcgtcattgcaagacagtgaaaactttcttggaggagactcttgacgcaatatcggacagcgttcttgacaagccagtaaacagggaaccatccagtgacgaagaatattttgctagtgtcgattctctgttgccaccaaaatacacgacaccgatgcatgaaagacttgtagccgtatccacttgaacagcgtgtcgggaagcggattgcctgcggtactgcagggtgtagttgggcacggggcagtgcccacgcaggggggctgtgaaaatgatctatgtaattgttgtaacacatatacgtcgccacgtcggggtatatcattagctgtagacataaccattttggctttgcggtaaaatccttgctcatgcttgcatggaacatgtacccatttttttcatcaggattcttagccgtgaaaaaaaaaaaaaaaa

SEQ ID NO: 8921 - DNA, 5998 bp, Zea mays
  misc_feature (5970)..(5970): n is a, c, g, or t
caaccgaattagattaattgatatatacctaaattactattattagaatgaaatttaatttcaatgatccaaacatttcttttattgaaattcgtatgcatttgtcactatggttaaaaactgttagaggtttgcattgtgaaattgtcagcataggctgtagctttatgacaccacaatgtacttgttagttctgtgaaattaatcgccataagttcttcgcggcagtgacagagagtgatcagaagaaggcgggcgcggcggcgtcggacaagaactcgacgtcgtcgcaacacgacggcggcttcaagggcggccgcgcgacgttcgtggcggatcaggcggagggcacggccacggccagcatcgggaagcaggtggtcgaggccctggagaggggcaaccgggcgctggcgcagcagctggaggcgcacaggagctggtgggacgccgacagggagcagcgggcggcgctcctccgcgccatggacagggtcgccgacgccgtgtgcaggatcgccgataagctctgagggggagggggcctcgccgacgggaactggcacgcttcggttggcttcgatcgctgtggactgagtgaagagtgagaagtacaagacatgcgtgcacgcattcagaacttcaggtagcggtgcattcagtacgacattggcatacatacatcagattattgcagtacaagacatacttctgctgctctggtctgaaacgttgagccgtggcgtggctccaggtccagggtttggggcttgctctggctggatcactctgtatcgcttatgctattgctagtgcgtgcgttgagcttttctgtcttcctgaaaaggcacctcgcctcagccctctcagcgatcggttcttggtccctctcccggtctcactctccctgctatgattaacaaccggttcttggtccgtgcttttaccgactgaatctgaacctactcccagctctgttcatccaaaacccactccctccttttgttttcctcctcgagtttgaggggtcctgctgcaactcaaatgatgtatttcgttcgtcccacaataaacacacatcatacttctcagtaagtcaaatcctttaatgtttgactaaatttatacaaacatatactaacatttatagtgtatactaagtgtaattagattaaccatgtttttttacaacagatttgtttgaaatatatatatatatatatatatatatatatatatatatatatatatatatatatatatatataggttttattttctatatttctagttaaactttaaaagtttagtttttcgagaaacaagatgtatatttggtttcgaattgaggaaggagtacaacagactcttccggtggcctatgtggccatgctactgggagcctgggagggtgtttcatccaccggactaagaactaaaacatgaactatttataaaacaattgcataagcagcgtataatccatatgacgaatatattaagtccaactaatgtacaattagactatattttggcatgacagtgttcatggaactgagtgccgcgttcacaataatgcgcagctctcactcagccgaggctttccagttcagacgctgcctgcctgtctctgctcgcgtctcatcagacaaagtggctacagcttcacaagcagcgccacgtgaggggagaatattcaggaggcgaccaggcagcagtcagctaactctgatgctctgctcttctcgccttgtctgtcagtcactgcaactgcgacacaggtccatggcatgggaactctccgaggcgtcgtcaccccggagcccggcgcgtccccagcacggatccggttattccggcgtgctagctagggcctaccgctgccgctagcagaatgaatcgatctgaacgaacacgcctgatgctgcctcatcgatcaatggttatctatggtgggtaccccagttgtcgtcctataagactctgaagactgtcagcactgttcactgatatatatgtatgtatgggcatggctggttgctgcatacataacatgcatgaacgatacattattcggaatgaaaaagaaagaaagcaatggaaatcaatagattattactatcattacaaactatatatgcagctgctactagttatatatgaacataacaagcacatacatacatacagcagtatatatgatgatactatatctatgcggagacttatatatactagctatggactatggtgtggtggtcatgagccgtagcatcccaaaaaccatgacagcgtcgtcctggcatggccgccgggcgaagacgacgacgcggccgccgccgatctggcgtcgtcccaacctgctggagcacccagcagtgccttcctgtgcttcctcttgttcttggtgtgcgccaccttcccgcgcaccgtcacctccttcttcccgaagtccaccatgtagtccagcagccctgctgatggaatggacggacacgagcagccgagcacagacatgagctgactagctgatgagcagagcagagcaggcaggcaggcaggcaggcatggatagatgcgcaagaaggatgaagaaggaaggacagcgatgcattggttagcacactgctagtagctgttggtaaatgtacacgcatcattacggacatgcatgcatacatggaatgatttgtcctggtgatggaaaaactctgcatgtaggcgctcaccgttcatcttggagacgacgtcggcgacccgctgccggcagtgcgagcaacccatgttggcgctcatcaccaccacctgcacctgcgcatgcatggttccagcgacgcatcattcattcattcgcatccgcattgcctctacgcgcgtaatgaataaaagaaaatgttgcttctctcgaaataaaacacacgttccgttttctaaaaaaacaaaacaaaacaaaactagcctatacgtaattaataaaaagctagttaattaagagcatctccaagagactggataaatggcttgtcaagttaaattttagctatttaatagcaaaatagctcttcaacagactatccgtttaacttgccaagctatccggctctttaaattgaccctctcactagctaaatttggctagcaactctcgccagttaaactaacttacatgtttaagagtctgttcgaatgaaatgttatatatagagtttaatctttatagacagataaatagagtaaaaagtaaagagtatattaatcccaccttccactgatcgatcaggacgtacgtacggctagagttcattgtatatagttgaggggaatatattcgtacgtagcacagggaagctaggagggaagagatgcatatgttcctctccaaaagtcacatggctagctgctgccactcttgaaccctaatgcagattgttctaataatctaatcctacacagccacaggcagccaccagctaggcagctagcggtattatatatactccattcgttcttttttatttgtcacgttttagtttaaaaataaactaacgaacaaggaacaagaacgataacggaggtagtagtatatagcagcatatgccgtgcgtgctaatctatcagctacgcaagccacttgcattatattatatatagtagatgaatactagtcgcatcgcatggcatcttaccgttgcgatcttctctgatcaggcaacaggccaatgcaaagactcctccggagatctagtcccattcccatacagattaaactcgtgcaggaggaattctagagattaagaaatataatgttcggtcatagcagctagctaactgatgatggtgaaatactgtaaatgactgagtcaaatataatggtcaaaaacacacactgcacatgcaggcaggaacgcccgccagtatatcatatgatgttgggatgagaaggagaagcgtgtgcgcttaattaatttattattatcaggtcaaaggaagcgtgtgcaagcgtagttggtgagggggttataaacgaggagcattcatcaggcatggcggctgcctgtacagtgaacctgctcgtgccttagcctattcgtctactgcctggcatgctcaccggtcaaagacagacggtttcactttcaccttcgttatgggctcctggccgccagacaagcagctcgagctctctcccggcaacagccaacagctaataacagctcatcagctgtggccgagaacggcgcaacaaacaagtggctgcaatagcatagcattgcattgcattgcatagagcggcgcaagaaacaggctacaggcgctgcatgcgtgcccggtgtctgctaccagcagattcagtctcttggtcttgccaacaagttactgccattgatttgcatgtggacaagaacaataatgtgtagctcacagattctcatctccaggatcatcagagcaagttaaaagatactacagtagaaagaaagagagacagacagacagacagggaagcaaacttgctccctgcactggagttgtttggcggattggcactaagccactaacagtaacaggggctggacttctcacctttacgctaaaagccggactgggagggcaaaaagcgaccgggtcccttttgagaatccaaggagatcaaaccagcagccaggctccagcatctctctcttcctcttctccctcgatgtgtgcagtggaacaacggacactgaacgtgtggagatggagactgtctgtcgaaatgcggtgaaggatggagtgactttactgtgctacgacactaccactgaagcctgaacagcaaaggctagcatcatatcctcaacgaggcaggaaggagagagcacagagtcctgctccggcagaaagacagagtcgctagcagagtgattgatagtcgcagctgggtttcaagaacccaacgacatgcaagccattgcggagttctcatttcttggcgctgatcagcttgctggcaatgatgaggaagaaagggagagcgcgtaccgatgggagggagagatcttccgcaaacctcagagcctgtagcttgcttggcgtgctgctgacggttgcgtccgacgaggcgccgaagctccgcttggaggaggaggaggaggactcactccccctgtcgtcttcattccctccgtgctccagctccatgtccctggcggcgtgcgcgtgggctcttcttgatgcttgagctccccctccctttccggtcccgcgacagcacccaaggcttctcctttttatactagctattctagacatggagagagagagagagagaggatcccatgtcacaacagttacttgttgagaccacgctttgagaggtctgatatattttaggcacttgtgaatgaggttaggtgtaggaaggtgaactccagcaatcaggcttatttgctgagggatctcctttccaaagacccacccagcccaggcacagtgtggcatggtcattcacttccatagtttcattggatgactaggatttacatgtatgtatgatgtcacttgtcttggaggctagtgccattttacaaatgaaggaggggcccaccatgtattggattcctcccccttctttgttttcactgttacagtaacagattaagaaatcaccacatcaggggaggttacttgcagtgcgaaaagtaaaagagagagagagagagaaaggtttccgaagtctaaaatggtcgtcatggacggtggaatgtgacattggaacaacaaaacacacagtcaggacctctccagaatccacattttcggaacttttgaagtttctgcaaggaaatcctcctgcagctatgcatatttcacacacggggggaaaaaaaagagaaggttccagttcttggcaccttatagcgtgatgattttaaaatgtactaggtagagttgatactgagaataacgaattgctctttaggcacaccnatatagtatgtagttttgctacagacgg

SEQ ID NO: 8922 - DNA, 2030 bp, Zea mays
ccttttgcggttttaccccccggggaaccaggcgcccggccgcctaaggaaatgcggagcgatgaggcggcgttcaggcactgacgtcgccggtcagcgcgagctgcgcggggaccgaacctgccatcgcaagcacgtcgaggacgggtagactcgtccatccttccttcctcctgttagtcgtcgtagggtagtttgcactttgcagatagctagctagtagttaggggatcaggcatgggtgagggcgaggcggaggtgaagggcggggtgctgcagggccgctacgagctcggccgcgtgctgggtcacggcaacttcgggcgcgtccacgcggcgcgggacctgcgcaccgggcgggccgtggcggtgaaggtgctcgacaaggacaagatgctgcgcacgggcatgatggagcagatcaagcgcgagatcgccgtcatgaagcgcgtggcccaccccgacgccggccagctccacgaggttatggccacgcgctccaagatctacctcgcgctggagctcgtccgcggaggggagctcttcgcgcggatcgtgcgcgccgggcgcgtcaaggaggacgtggcgcggcgctacttccggcagctcatccacgccgtggacttctgccacgcgcggggcgtgtaccaccgcgacctgaagctcgagaacctcctcctggacgacgcggggaacctcaaggtcgtcgactttggcctcagcgcgctggccgaccacgcgcgcagcgacgggctgctgcacacgctctgcggcacgcccgggtacgtcgcgccggaggtgttccggaacaagggctacgacggcgccaaggctgacatctggtcgtgcggcgtcatcctctacgtcctcctcgcagggtcgctgccgttcccggacgacaacgttgccgccatgttccggaagatgagccgcggcgactaccggtgcccgccgtggctgtccacggaggcgcgcaggctcatccccaagctgctcgaccccgaccccgacacccgcatcaccatcgcccagctcgtcgagacgccgtggttcaacaagccgtccgtctcgaggtccgtcagagccgccgccgccgccagcggcgcaaccgagccgccggccgagcctgcctcctccgcaaaggacggcggcgacaaggacgagccaccggagacgatgaacgcgttccacctgatctccctctccgcggggttcgacctctcaccgctgttcgacgtggaaggcggtccggcgagggggccccgggagggcggcatgcggttcgcgacgcgggagcccgcgagcggcgtcgtctcccgtctcgaggaggtggccgcccgcggcggcgggcggatgcgggtgaccaagagcggcgcccgcggcgttcggctcgagggcgcggagcgcgggggccgcaagggccggctagccgtggcggccgacatcttctgcgtggcgccgtcggtgctcgtcgtcgacgtgaagaaggacggcggcgactccctcgagtaccgctccttctgcagcgaggagctccggccggcgctcaaagacatcgtctgggcggccgacccccagcccgccgtcgtgtgacgcccgtgctgccgcctgcccgctcattgtttctggatcgtagtggtgccatagtttagtcagtgtcagttccatttccaaagtgattgcgtcactgttctcgattcgataaaaaaaaaaaaaatactgtttgtggggggcgtcaagaatatgtatctccctcggcataattgcgttattattattattattgtgaatggtttattgtggatgggcgcccgctctttcctcctgatctgaatattcagtctagtccattatgcagtatgcgtcggctaaagacgtgccaaatttcttgtggaaagctgaactatgcagttttgttgggggactagggttcatttccaagctccatgctttcttaagcctgtaacgccatacggtaagcttgttttcgctgcggattgtctctcagattcaaaatcagggaggaccag

SEQ ID NO: 8923 - DNA, 2292 bp, Zea mays
cgtatccgttatccgaaaaaagtccaaatatccaaaaattctatccaaaccagtgttcatcatcttcgaatctagatccggacggatattttccgaaccatattacatccctatccggaaggagttgacctgcgaagcaaaaccagcagataataataaaacaccaaaacgttatatgtaaagcgaggaattaaaagaagaagaagaaaaaagtaaatcatggacagcctagccgtgtctaacggagccgatgcatgccaagaatgaggagagaggtgaaaagaagatgagcttggtaggtacccttatccaaatttacaccagcggccccaatatatctcggcagaatcctctcacgtccgtccgctcctcagtcagtcctcacctcctttttctctataaaatcccctccccagtccaccgttcccgagagcagcacagagggatcgtcatccgccccacccacaactgctccagatccaggcacggcacggcacggcagccgggccaacccaagcccgtcttctcttctctctcgtccgtccctcactcgccgcgacgtgacaagacaacgcgacgcgcgcgcagcgcatacgtcgtccaaggcacgcaggggccagccaaccaatcgcgtccgtccgggtctggtggtggccggaatgggcctcctcgatcagctctgggacgagacggtggccggcccgcgaccggactccggcctcggcaagctccgcaagtactcctccttctccccctcctcctcctcgtcgtcgtccatcctggctcccgcgccggcgccggcgccggcggtgacgcgcagcatcaccatcgcccgcccgccgtcgctctccgtcgagtcctacagctcctcctccgtcccgtcctccccggccagcacgcccgactcgccgctcgccgcaggtgggctccctctgtttttggtcgcctcgccgccccgttcttgggctacaaatcgtttctgtttctagttatgtctgcgcactgctgcgcagcagcgcaggactggatctccgacgaaatgggggcagtaaaagggatggaaaaaaagtatataaattttgacgttctattcacgttgtttttttttcttctacgccctcttaagcccgacgcagtcacagatctgccgctgcacagcacgcaatgccttcgtgatagcagatgatggttcgtgggaacttgggtggggagggtgcccttgccgcgtgattgtcaggaccacccagactagctagacattcatttgctggtgcgtttggtgctgtgataacaaagggttcgttcatcagaaagctgtgcatgcaagcacgatgcacaggcacagctggtcgatatgcctcatgcctgagctgagcctcaccctctgtgtgttggcgtgtttggcgcagctaccccgcccaaggcggacgtctggaggaggttccgccggaaaaccaaggtctccgacgggccggagccggccgtcgggcccaggagccccaccgtctacgactggttcgttctcgcctcaaagcttctcttcttgtactctcgtgccacgccacctcgaatcctcgatgcacaccatgtccatagctaagctagcaggtcacgatttatgttcctgatacagcttctgtccctggttggttcgctttgcagggtggtgatcagctcgttggaccgctgagttagaacagatcaatcgccaataagcaacaaccgagctagcagagggcatgtttgcgttcttctgaatgttgtgcgcgtgtgtctgtggcagcataagtagagagtatgtcgatgatgatgatgacgacgacgaggatcagttcgcggcggggaggttagaagtagccgggcgccgatttccatcctagtttgggcgtttggcctatagccggcaggcgcgttctccagttcttggatcaggggaagaactcctgccgggcagctgcctgcttcgttttctacgcaccctcctcccctctgtaattatcccaagcaccacctcgtactggtagtagtagcagtgttttgtgtgtgtgtgatgctacgatgtagctgtgcattttcttctgctcgcctggaaaccttttgcgttccaactgcagcggttgtggatgtgtttgccgccatggcccagcagtctggctgcgctctcgggctgcagctcccgtgtttgtgtcgcctggcctgcttgggagtctagctgtgcgtgtacaaatttagcctctcagcctggctccacaggaacgagatcagggtctgtttacaaaaaaaaaaaaaaaa

SEQ ID NO: 8924 - DNA, 1232 bp, Zea mays
gccggccggtccgggatccaatttacccagcggccccaatatatctcggcagaatcctctcacgtccgtccgctcctcacagtcagtcctcacctcctttcctctataaaatccctccccagtccaccgttcccgagagaagaacagagggatcgtcatccagatccaggcacgtcggccaacccaagcccgtcttctcttctctctctcgtccgtccctcactcgccgcgacgtgtgacaagacaacgcgacgcgcgcatacgtcgtccaaggcacgcaggggccagccaatcaatcgcgtccgtccgcgtccgggtctggtggtggccggaatgggcctcctcgatcagctctgggacgagacggtggccggcccgcgaccggactccggcctcggcaagctccgcaagtactcctccttctccccctcctcctcctcctcgtcgtcgtccatcctggcccccgcgccggcgccggcgccggcggtgacgcgcagcatcaccatcgcccgcccgccgtcgctctccgtcgagtcctacagctcctcctccgtcccgtcctcccctgccagcacgcccgactcgccgctcgccgcagctaccccgcccaaggcggacggctggaggaggttccgccggaaaaccaaggtctccgacgggccggagccggccgtcgggcccaggagccccaccgtctacgactgggtggtgatcagctcgttggaccgctgagttagaacagatcaatcgccaataagcaacacccgagcagagggcatgtttgcgttcttctgaatgttgtgcgcgtgtgtctgtggcagcataagtagagagtatgtcgatcgatgatgatgatgatgacgacgatcagttcgcggcggggaggttagaagtggccgggcgccgatttccatcctagtttaggcgtttggcctatagccggcaggcgggatcagcggaagaactcctgccgggctgcctgcttcgttttctacgcaccctcctcccctctgtaattatcccaagcaccacctcgtactggtagtagtagtagcagtgttttgtgtgtgtgtgtgatgctacgatgtagctgtgctttttcttctgctcgcctggaaaccttttgcgttccaaactgcagctgttgtgttccctccctgaattgttgttcaacctcgagttcgacttttaatatacttactgaataacggattacgaaaaaaaaaaaaaaa

SEQ ID NO: 8925 - DNA, 1100 bp, Zea mays
gccggccgccgcgggggcggaacagagggatcgtcatccgccccacccacaactgctccagatccaggcacggcacggcacggcagccgggccaacccaagcccgtcttctcttctctctcgtccgtcccgcactcgccgcgacgtgacaagacaacgcgacgcgcgcgcatacgtcgtccaaggcacgcaggggccagccaagccaaccaatcgcgtccgtccgggtctggtggtggccggaatgggcctcctcgatcagctctgggacgagacggtggccggcccgcgaccggactccggcctcggcaagctccgcaagtactcctccttctccccctcctcctcctcgtcctcgtcgtccatcctggctcccgcgccggcgccggcgccggcggtgacgcgcagcatcaccatcgcccgcccgccgtcgctctccgtcgagtcctacagctcctcctccgtcccgtcctccccggccagcacgcccgactcgccgctcgccgcagctaccccgcccaaggcggacgtctggaggaggttccgccggaaaaccaaggtctccgacgggccggagccggccgtcgggcccaggagccccaccgtctacgactgggtggtgatcagctcgttggaccgctgagttagaacagatcaatcgccaataagcaacaaccgagctagcagagggcatgtttgcgttcttctgaatgttgtgcgcgtgtgtctgtggcagcataagtagagagtatgtcgatgatgatgacgacgacgacgatcagttcgcggcagggaggttagaagtggcctggcgccgatctccatcctagtttgggcgtttggcctatagccggcaggcgcgttctccagttgttggatcaggggaagaactcctgccgtgggaggctcctagggctgcctgcttcgttttctacgcaccctcctcccctctgtaattatcccaagcaccacctcgtactggtctggtagtagtagcagtgttttgtgtgtgtgtgtgtgtgtgatgctacgatgtagctgtgccttttcttctgctcgcctggaaaccttttgcgttccaaactgcagctgttgtgttcc

SEQ ID NO: 8926 - DNA, 2766 bp, Zea mays
gctatatcaagtaccgtccggcaccttgcacggatcgttcgactataaatcttagatcgtctgcctattcaaaactaatcaacctgaaggtgacatgttcaataaaatgaattttagcgccaagcgcggaccgaccacgatcaaaggaaggctgtctgcgatgttctttatctgacatctagcgacacatataatgctcttatagcttgttgatatagctattgcaaataaccatagatcattgatcttgcaggggtggaccatccggataggacacatgccgtccgcgagtgtgcagacaacgataacaactatgtgggtggttgaagacaaatcttgtagatatctaaatattaatactaagagcaattccaagagactgtgtaaatcgttttgtaaaggtaaatttggctattattagaagaaaaacgtatctaagagcaactcgaaaagactttttatattctttctatcaatagagattgttttataaaaaataccttgcaacaacttattttaatgattatttaaatatagtcatcttctatcctgaatttctcgctagccaaagatagaaaacatgaatgaatctctagagtgcaaacaaacacgatatagaaaagttgttggatattgaaaagatatagaaagtgctttttatataaaagactctccatatgataatttaaagtgaaatttgaaaaacacttagagatgctctaatagactctataaatgtctctttaaacttagtagttttccatctggctctgtattttttgataagctacttcactcgctatatagatttttgagttagtctgttagactactctactttgtttttaaatgtatttgtagagtagctaaattagtataactgattaatttttggctaatctcttgaagttgctttaaattaatttagaatatgactgacaaatctagtggtagcatattctgcgcacggggtacatgaatacggatcatatccccagatctccgtgctgttcttgtttgttgtgtagccgccactagtacgaagccctcagtcctccctcacacaccgaaccgagcgcaccatgtcgtcggcggctggaggagtggaggagacggtgcgggcgtcgcacatcctcatcaagcacgagggttcccgccgcaaggcctcctggaaggaccctgacggccgcatcatctccgccaccacgcgcggcgacgccgcagcgcgcctcctggacctccgcaaccagattctctccggccaggccaacttcgccgacctcgccgctcggcactccgactgctcgtccgcgcgacgcggtggggacttaggtacctttgggaggaggcagatgcagaaacccttcgaggacgccacatatgccctcaaggttggtgagctcagcgacatcgtggacactgacagtggggttcacatcatcctgcggactgcctgaggaggggatcacactgtcctctcaggctttcagttagtgcttatggcgttctgttagaacctgtatttgtattcctgctgggagcctgagttccattccgtgcaaagataaatcatgtgtgacgacacgtttgcaacagcatttatgcttaaactgcattaatgatgatgcgttgagctcctgaatgcctagtttttctggcgacagtataaaaaaaaaaaaagcgcgcagactctgcctcgtgctaacgagtagcctcacagctgcctgattagcttttcaatctgctgaattctgcgcatgctctagaatagcttactgtgcagtgtgcacctgtgtaatttgactgcgaggcggattgtactctgattcaattcatagctgatataaactgtctgggtgagggcatccatgtaaaacgtgtttacaatggatactagctgctgcaagtatagctctgttggttttatccaatgctaaaatttaataggtacatgtttgttgctgtcgttgcatcagtaaatttcagatgtgtcaactgattgtgagaaaaaaacgtgcctcagttcaaagccttttgaaattcggtaggtacaaaatattagtatggattgtggaaattatttgggaaattcgacctggcctcctggtccatttcaacataggtacaaattgagattgtggaaattatttgtatatttctagtctaaacagtttataggttggtggtgatgctgaaactggaaacatattatccacaactgagaatataggagatacaactgcacattttagtgtttaaactacacatggtggtgatgctgaaactggaaacaatattatcttttattactttgttctcagtaatgaaaaaacaggggtggtcccttttatctttaagaaaatttgaaaacactgtttatgatatttgaagtcatgtaattagtgcatttctaatgttatgattacattttcaattcactgaacttatcatccactgattcaagaaatttaaacataaacattgagatggactatacactgtttaagctcatttgctgataagctgacaatgcatggaggtaaaacttgtggttgtgcaatgtgtctcctgcatggatcaatatctttctgctaatgtatgtagtagttactgataatctgacaatgtatgtagtagttaccgcctatcataggtgacaatgtatgtagtagttactgcctatcataggttcccgttcaataaatattatggaagaagtataaataatcaaatggagtgttacttctgtagcatattttgagtttt

SEQ ID NO: 8927 - DNA, 3459 bp, Zea mays
cggacctggctacgaagcgcaggcagtacagacagcaccgcctggtttgagcggctgccgccgctgcatatactccctccctgccttccagtgccaggggtgaccggcgtgcgtgccattccacgctctcgcggctcgtgtgccagcggtgaccagcgctcgtgctcgtccagtccaccaggcgctgctgttccggcaagccagccagcagcagccgccgccgccgccgtctcggagctcgagctcctagtcccccggggccgaggcgccggcgccatggaccagctccggcccgagccggccgcgggcgcgcacgagatcgagaagacggcggcgccggacgtggagtcggagcccgcggcggcggtgccggagccggagcgcgtgccgccgtggcgcgagcaggtcaccgcgcgcgggatggtggcggcgctgctcatcggcttcgtctacacggtgatcgtcatgaagctgagcctcaccacggggctcacccccaccatgaacgtctccgccgcgctgctcgccttcctggcgctccgcggctggacgcgcgccctcggccgcctaggcattgcctgccgccccttcacccgccaggagaacaccgtcgtgcagacctgcgtcgtcgcctgctacaccatagggttcggcggtgggttcgggtcgttcctgctgggcctggacaagaagacgtacgagctctccggggtgagcacgccgggcaacgtgccggggagctacagggagcctgccatcggctggatgaccggattcctcctcgccgtcagcttcgtggggctcctcaccttgcttccactcagaaaggtgctcgtcatcgactacaaactcacttatccaagtgggacagccaccgcggttctcataaacgggttccacacacctcaaggagataagaatgcaaaaattcaggtccgtggattcctcaagtacttcgggatcagcttcctgtggagcttcttccagtggttctacaccgccggcgaccactgcggattcgcccagttccctactttcgggctccaggcttttaaccagacgttttccttcgacttcagcctgacgtacgttggtgctgggatgatctgctcgcacctcgtcaacctctcgttgctgttcggtgccgtcgtttcctggggcgtcatgtggccactcatcggcaagcagaagggcaactggtatccggcagatgcatctcagaatagcatgacaggcatctacgggtacaaggccttcctttgcattgcccttctcgtgggagacggtctctacaacttcgtcaaagtcatagctatcactgtcaagaacatacgcgagagatcacgtcgcaagaacctgaacagagtggcggacgcggacacgatggcgctggacgacatgcagcgcgacgaggtgttcaacagggacaacatcccgacgtggctgtcctacgcggggtacgcggcgctgagcctgatcgcggtgatcgccatcccgatcatgttccgggaggtgaggtggtactacgtggtggtggcgtacgcgctggcgccggcgctggggttctgcaacgcgtacgggaccgggctgacggacatgaacatggggtacaactacgggaaggtcgcgctgttcgtgctggcggcgtgggcggggaaggacagcggcgtggtggccgggctggtggggtgcgggctggtgaagcagctggtgctcgtgtcggccgacctgatgcacgacttcaagacggggcacctgacgctgacgtcgccgcggtcgatgctggtggggcaggccgtgggcacgctgatggggtgcgtcctggcgccgctcaccttcatgctcttctacagggcgttcgacgtgggcgagccggacgggtactggaaggccccctacgcgctcatctaccgcaacatggccatcctcggcgtggagggcttctcggcgctgcccaggcactgcctgcagctgtgcgcggggttcttcgcgttcgcggtgctggcgaacctggcgcgggacctgctgccgcgccggctcgcgcggctcgtgccgctgcccatggccatggccgtgccgttcctcgtgggcgccagcttcgccgtcgacatgtgcgtggggagcctcgtggtgttcgcgtggcacaggctcgacggcaagaaggccgcgctgctggtgccggccgtcgcctcggggctcatctgcggcgacgggatctggacgttcccgtcgtcgctgctcgcgctggccaaggtcaagccgcccatctgcatgaagttcacgccagggagctagagggcgcgctgacgatgcgtacagaacagagggcatcgttcgtcgtttgtggggtggaatccgtgtagtagaattacataccaatcaggcctgttctaatgtccatatgagcttaatgtacggtgtatatatgtaaaacggaaatctgaaggatgacaggatgaattgcctgttgtctagtagcacgcatattattattattatagcagagcactaataaaactctttatcttacacaaagtgttactgcaactgcaatgccccaacgctgttcagcagatcctggtgcgctcagccctcttccgctgcagtggagcagcttcactcagcggcaccgtttggaagttgaaagagaaaactgagcacggcatctccgtccgtgcgcagtgcatggcacagtcgtcggtacgcgcccgcctaacccgtcggcatcaacgatgatgcttccttccacagccacggttcgctcaacttgcccaacggttcctcagttggcaccacacacagattgtggttgtggccggtggggtgcggtacctctccgcctttttggcgtttggtgcctcacgccgccactacctacaggcggctagaggttccaaactcgctgacaattcgacacattgaatgaatcgatgctcgatgaaggatgcatgcatcaaaaagggtggccggcgtgcctcgtctctgccgtcacttctgttctcggtgacagacgtccccaagctttgcccctctcgttgcttcggtggtgctgtggagctctgaacaagagggcacggacattctccggttaccatcaacctcccgtcggtagtgaaggttgctgtcgtgctacactcggtggtcgtagcgggataggcttcactgagcaatcggatagatcgggactctgtatacgcgcatcgttttgcactatcatgataacggaacagaataatctagatgctgctgtatccaatccaactgcaccggcgactgaggaggagagctggctaagcaggaccgacgaatttttcccccgtctgtcaactccacgtccacatgcgtgagtcaccgtgacaccgtcctgtgcgtgagggtgatatccaaacggaccacccgaaacggatatattgaagcacgacccatttagcacgacacacggctagatccgaataatta

SEQ ID NO: 8928 - DNA, 1188 bp, Zea mays
aattataattgtttcattcaggacgcccgtctccacgtagcctggaaggttcacgaggttcattgagccgttgagcgtgtaactgccgtgaaggttcccgaagcatctggaacacgtgggcacgccactgggcgtgtgcgctgaccctgacggcaccaaaaggagaaagaggaagcgagcccccaggaaagcggtcagaattggagtgcaagcgacgcgtcgagccccatcccgttcccgcgcctcgccgagagatctgcaccgtcgtcggcaccaacccgtcagtccgtacgtcgtccgcgccggcgaacgagtagagatggaggagacggcggcagcggctacggctgagaaggcgtcgtcgtacaggtactgggtgcgggaagccaccggcgacgccgcgccgctccccgtcccgcgcaagctcgaccccgccgccaatgggaacgggaacccgccgcccctcggctccgtctggaatcaggctggaacttgggaggaaaagaacctcaactcatgggctaatagtaggataaaggatttgctgggctctctaggttcattgaagttccctacagggaatgcatccgttgatgaagtgtccaagtgctcaggcgatgcctttcaggtcactgtccgcaacaagaagagagtaggatataactacgaactaagcttgagatttaaaggtgaatggttagttaaagaagaaaacaagaagatcaaaggacacttagacattcccgagttctcgttcggtgagatcgatgacctggaggtgcaagtaaggttcagtgacgacaagggcctcgcatccgacgacaaggcacggatctgcaaggatctcaagtcctttatggccccgattcaggagaaaatgcgcgtgttcgaagaagagctcaagggtagatagcgagcattagcgagaatcggcagtgctaggtgggcgctgccgtgcccgtgctggaatgatgagtaaaacatgttgacgtcttgtggtgtctccacgttctaaagtcgtcttcggatgactgggactgtctgtgtactgatgctatgcacttccggagatgagtatgtacggttacgaactgcctaaaccgtctcttcgtcctaatcattttcgggatatgatggtagtagagagatttaggtcttgtttggtttctgaaaaaaaaaaaaaaaacc

SEQ ID NO: 8929 - DNA, 1003 bp, Zea mays
ggaacacgtgggcacgccgcacgccactgggcgttgcgctgaccctgacggcaccaaaaggagaaagaggaagcgagcccccaggaaagcggtcagaattggagtgcaagcgacgcgtcgagccccatcccgttcccgcgcctcgccgagagatctgcgccgtcgtcggcaccaatccgtacacccgtcagtccgtccgtcgtcggcgccggcgaacgagtagagatggaggagacggcggcagcggcaccggctgagaaggcgtcgtcgtacaggtactgggtgcgggaagccaccggcgacgccgcgccgctccccgtcccgcgcaagctcgaccccgccgccaatgggaacgggaacccgccgcccctcgggtccgtctggaatcaggctggaacttgggaggaaaagaacctcaactcatgggctaatagtaggataaaggatttgctgggctctctaggttcattgaagttccctacagggaatgcatccgttgatgaagtgtccaagtgctcaggcgatgcctttcaggtcactgtccgcaacaagaagagagtaggatataactacgaactaagcttgagatttaaaggtgaatggttagttaaagaagaaaacaagaagatcaaaggacacttagacattcccgagttctcgttcggtgagatcgatgacctggaggtgcaagtaaggttcagtgacgacaagggcctcgcatccgacgacaaggcacggatctgcaaggatctcaagtcctttatggccccgattcaggagaaaatgcgcgtgttcgaagaagagctcaagggtagatagcgagcattagcgagaatcggcagtgctaggtgggcgctgccgtgcccgtgctggaatgatgagtaaaacatgttgacgtcttgtggtgtctccacgttctaaagtcgtcttcggatgactgggactgtctgtgtactgatgctatgcacttccggagatgagtatgtacggttacgaactgccc

SEQ ID NO: 8930 - DNA, 1022 bp, Zea mays
gccggccgtcccggcaaaaagcgagagagacaggagcgagccccgagaaagcggtgagaattggagtgcactcgacgcgtcgagcggtcgattcccatcccgttcccgccccgcgcctcgccttgagatctgtggcgtcgtcggcaccagtccgtccgtccgtccgtcgtcggcgccggagaacgagtagagatggaggaggcggcggcggctgagaaggcgtcgtcgtacaggtactgggtgcgggaggccaccggcgacgccgcgccgctccccgtcccgcgcaagctcgacaccgctgccaacgggaacgggaacctgccgcccgtcggctccgtatggaatcaggctggaacatgggaggaaaagaacctcaactcatgggccaatagtagattaaaggatttgatgggctctttaggttcattggccttccctacagggaaggcatctattgacgaagtgtccaattgctcaggcgatgcatttcaggtcattgtccgcaacaagaagagagtaggatataactatgaactaagcttgagatttagcggtgaatggttaatcaaagaagaaaacaagaagatcaaagggcatctagacattcccgagttttcattcggcgagatcgatgacttggaggtacaagtaaggttcggcgatgacaagggcctcgcgtctgatgatagaacacggatctgcaaggatctcaagtcctttttggcgccgatccaggagaaaatgcgcatgtttgaagaagagctcaaaggtagatagcgagtattagcaagagttcgcagtgctaggcaagtgacttggcagttggcaccgccgtgctagctgtgatgtgtgtgtcgcaacgctctcaaagctgagactgtatgtgtactggtgtaatacacttgtcaagatgagcacgtacgaactgttctcttggcaaaaaaaaaaaaaaaaatgtgatagtaaaaggaattcaagatgtttttggaaaaaaaaaaaaaaaaaaggcccctagggccctc

SEQ ID NO: 8931 - DNA, 934 bp, Zea mays
ccggccggcgccgccacaattggagtgcactcgacgcgtcgagcggtcgagccccatcccgttcccgccccgcgcctcgcctcgccttgagatctgtggcgtcgtcggcaccagtccgtccgtccgtccttccgtcgtcggcgccggagaacgagtagagatggaggagacggcggcggtagcggcggcggctgagaaggcgtcgtcgtacaggtactgggtgcgggaggccaccggcgacgccgcgccgctccccgtcccgcgcaagctcgacaccgctgccaacgggaacgggaacccgccgcccgtcggctccgtctggaatcaggctggaacatgggaggaaaagaacctcaactcatgggccaatagtagaataaaggatttgatgggctctttaggttcattggccttccctacagggaaggcatctattgacgaagtgtccaagtgctcaggcgacgcatttcaggtcattgtccgcaacaagaagagagtaggatataactatgaactaagcttgagatttagcggtgaatggttaatcaaagaagaaaacaagaagatcaaagggcatctagacattcccgagttttcattcggcaagatcgatgacttggaggtacaagtaaggttcggcgatgacaagggcctcgcgtctgatgatagaacacggatctgcaaggatctcaagtcctttttggcgccgatccaggagaaaatgcgcatgtttgaagaagaactcaaaggtagatagcgagtattagcaagagttcgcagtgctaggcaagtgacttggcagttagcaccgctgtgatgtgtgtcgcaacgctctcaaagctgagactgtatgtgtactggtgtaatgcacttgtcaagatgagcacgtacgaactgttctcttggtatccctcattttcagcataaagggcgg

SEQ ID NO: 8932 - DNA, 1682 bp, Zea mays
cattgggaccctcgaggccggcccggcccccgcgccggccggccctctagactgtagcccttaatcgaaaccgtccccaacccttcttcctccacgctctcgtctccgccgcgctaggaacttccaactcccaagcccagccgcctgcctagggttaaggtcgcccctccgccccctcgctccgctcgtgaccggcagggttcgtcgccgccgttggatatgtcgcggacgctggtgcagccggtggggcagaagcgcctcaccaacgtggctgtggtgcggctgcgcaagcacggccagcgcttcgagatcgcctgcttcccaaacaaggtgctctcgtggcgctcccgcgtcgagaaggacatcgacgaggtgctccagtcccacaccgtctactccaacgtctccaagggcatcctcgccaactccaaggaactcgccaaggccttcggcaccgacgaccttacccaaatctgcatcgagattctggagaaaggggaactccaggtctccggcaaggagagggaggcgcagctctccagccagttccgcgacatcgcaactattgtcatggagaagaccatcaacccagagacccgccgcccctacaccatcaccatgatcgagcgcctcatgcacgagatacacttcgccgtcgacccaaacctcacctccaaggaacaggctctaaaagttatcaagaagctcacagagcatttccccataaagcgtgcaccgctaagggtgcggttcactgcaccaaaacccaattttccaggccttacggagaagattggcggatggaatgctaccataatttcaaaggatgaattgagcactcagccttctattgtatgcgagatcgagccatctcttctgcgctcatgtgaggagcggttgaaggatgtccaagggagggtcgaagtgctgtctgtctccacgcacgtagaaagtggcccatctgtggaacaacacaacagtgtggaagtgccacacgcggctcctgtaaaggaacctgatgctgttgctcagataagtgagaccatgcagaaacagagcatttctactgaaagccagggcaatgcacaaggcaagcaacagagaaggtgcaaggagtgtgatgtactcgtggaggacaagctttacagagagcactgcaagagtgggtggcacaaacacaactacacacgccacaagaatgggctcccgcctctcagccaagaggagtgtatggtggagatggaattggccgactccaagaaagaccttaaagactacgatttctgatgaggttacctggaagttcctttgacatgctatcttgtatttgggcactaatgttgtctgtctaatgcttttctaccacccaatcttatccaggatggttaacaaggggtgcacagggcatgaagttgtttccaatccgtttttattttaacgaggaagtgaggagtgaggcacatggtcgttttctgatgctgtataggaattattagaatgagatggtttagccacatctttgaactgagggtagaacctgtctgtctgtggattgctttggctttgtatcgtggacgagtgaacttggtagtggcattccaaattcgacattctatgcgggctagaaacttcgcttgttttaatacttatcggcatcctttcttttaaaaaaaaaaaaaaaa

SEQ ID NO: 8933 - DNA, 1610 bp, Zea mays
cattgggtacctcgaggccggccgcgcgccccccgcccgcacgctctcgtctccgccgcgctaggaacttccaactcccaagcccagccgcctgcctagggttaaggtcgcccctccgccccctcgctccgctcgtgaccggcagggtttgtcgccgccgttggatatgtcgcggacgctggtgcagccggtggggcagaagcgcctcaccaacgtggcggtggtgcggctgcgcaagcacggccagcgcttcgagatcgcctgcttcccaaacaaggtgctctcgtggcgctcccgcgtcgagaaggacatcgacgaggtgctccagtcccacaccgtctactccaacgtctccaagggcatcctcgccaactccaaggaactcgccaaggccttcggcaccgacgacctgacccaaatctgcatcgagattctggagaaaggggaactccaggtctccggcaaggagagggaggcgcagctctccagccagttccgcgacatcgcaactattgtcatggagaagaccatcaacccagagacccgccgcccctacaccatcaccatgatcgagcgcctcatgcacgagatacacttcgccgtcgacccaaaccttacctccaaggaacaggctctaaaagttatcaagaagctcacagagcatttccccataaagcgtgcaccactaagggtgcggttcactgcaccaaaacccaattttccaggccttatggagaagattggcggatggaatgctaccatcatttcaaaggatgaattgagcactcagccttctattgtatgcgagatcgagccatctcttctgcgctcatgtgaggagcggttgaaggatgtccaagggagggtcgaagtgctgtctgtctccacgcacgtagaaagtggcccatctgtggaacaacacaacagtgtggaagtgccacacgcggctcctgtaaaggaacctgatgctgttgctcagataagtgagaccatgcagaaacagagcatttctactgaaagccagggcaatgcacaaggcaagcaacagagaaggtgcaaggagtgtgatgtactcgtggaggacaagctttacagagagcactgcaagagtgggtggcacaaacacaactacacacgccacaagaatgggctcccgcctctcagccaagaggagtgtatggtggagatggaattggccgactccaagaaagaccttaaagactacgatttctgatgaggatggttaacaaggggtgcacagggcatgaagttgtttccaatccgtttttattttaacgaggaagtgaggagtgaggcacatggtcgttttctgatgctgtataggaattattagaatgagatggtttagccacatctttgaactgagggtagaacctgtctgtctgtggattgctttggctttgtatcgtggacgagtgaacttggtagtggcattccaaattcgacattctatgcgggctagaaacttcgcttgttttaatacttatcggcatcctttctttttggttttggtttgtgatagcgttgccttttgttgttgctacacctgatggcaatttcatttagatggcgaaaaaaaaaaaaaaaaa

SEQ ID NO: 8934 - DNA, 2548 bp, Zea mays
gcacgagaccattacctagaacatcctaatcgaaaaaccagtcagtccacacagcctacggcctgctctggctctgcctgtagagggctagagctacaagctacaactctgaaagtctgaacagtgcgccgcccaaccagagatggcgccgcataccaccgcagccgccggcggcggcggcggcgaggaggcgctggaggaggccagcactctccggcaccgccacagcgctgccaaggacggcggcgaggagggccaggccaacaacggggtcgccgccgccgccgacgacgacggggaggggaacgcgctgtcggtggagcgcgcgttcgcggaccaggcggttccgtcgtggcgggagcagctgacggtgcgcgccttcgtggtcagcttcttcctggccatcatgttcagcgtcatcgtgatgaagctcaacctcaccacggggatcatcccctcgctcaacgtctccgcggggctcctcggcttcttcttcgtacgcctctggaccgccgccatcgagagggttggcctcctcaggcagcccttcacgcgccaggagaacaccgtcatccagacctgcgtcgtcgcagcctacgacatcgccttcagcggtgggtttggtacatacttgtttggcatgagcgaaaccatcgccaagcaagcaacagaggctgacaatcctcagaatgtcaaaaaccctcacatcggatggatgatagggtttctcttccttgtcagtttcattggcctatttgctcttgtgcctctgagaaaggttatgatcgtcgactacaaacttacgtatcctagtggcacggcgactgcttatctcatcaacggtttccacacgccagagggtgccaagcttgcaaagaaacaagtgaagactctggggaaattcttcttgatgagcttcctctggggcttcttccagtggttctacactggtggagataattgtggattccagaacttccctacattaggccttcaagcttataagaacaagttttacttcgatttctctcctacctatgttggagttgggatgatctgcccccacattgtgaacgtttctgttctactgggaggcatactttcctggggaataatgtggcctctaattggcaaccagaaggggaattggtacgacgccagtctcccagaaagcagtctccatggactgcagggttacagggtttttatatccatcgcaataattcttggagacggcctgtacaacttcgtgaaggtgctcattcgcaccaccgcggggttcatatcgatgatgaagaaaaacagcacgcttccggtttcaaacaatggcagccccatcactgaaggtgtttccttcgatgacgaacgccgcagggacctgttcctgaaagaccagatccccagatcagttgcctacggagggtacgtggctgtcgctgccatctcaatcggcacccttcctcaggtcttcccgcagctcaagtggtactacatcctggtggcgtacatcttcgcgcctgtgctggccttctgcaacgcgtacgggactggccttaccgactggtccctcgcgtccacctacggcaagctcgccatcttcatcttcggcgcgtgggccggcgcgtcgaacggcggcgtcctcgtcgggctagctgcctgcggcgtgatgatgagcatcgtgtcgacggccgccgacctgatgcaggacttgaagaccgggtacctgacgctggcatcgcccaggtccatgttcatcagccaggtgatcggcacggcgatgggctgcgtcatcgcgccctgtgtcttctggctcttctacaaggccttcgccgacatcggcctcagcggcagcgagtacccggcgccctacgccatcgtgtaccggaacatggccatcctcggcgtggacggcttctcgtcgctccccaagaactgcctcaccctctgctacatcttcttcgcggcggccatcgtcgtcaacctggtcagggacctggtgccgaagaaggtcgccaggttcatcccgctcccgatggccatggcgatcccgttctacctcgggtccttcttcgccatcgacatgttcatcggcaccgtgatcctcttcgcgtgggagacgatcaacaaggccaaagccaacgccttcgcgccagcggttgcgtcggggctgatctgcggcgacggcatctggaccctgccgcagtccattcttgcgcttgccaaggtgaagccgcccatctgcatgaagttcttgtccaggtcggtgaatgcccaggtggacggcttcctcggaagttgaactgttgaaatcgtgacgtgcatgtatattgtgttgatgcaccatgcgtgctgtaaaacgtaccgggtaatgttgtgtcgacacgttctggttttgatgtacatgagtaagtacactagtcgtagggattgctaaattaatgtttggcgtatacgcgtcagcattagtaatgtacatgagtaagtaccaacatctgtatgttacctgggttcaaatttcataactactttcccgtaaaaaaaaaaaaaa

SEQ ID NO: 8935 - DNA, 2232 bp, Zea mays
ccccccacccccgccccacaccaaacacacccacttactcctatacaaacacacaaaagcaaagctccttcctcactcctaaatccagctactagtgctccagtcaaatacatccgagacgcgtgtattttaaaacacgtgtattaataagaaacacactggactccaccacacctgtcagtcatacatacagacgctaaccaccccgacattaattctactgacattatagtagtatatacgtatgccacaagcctactaatgaccgaaccttatcgcttgggtatggtgagagaacatatacatagaatgatataagatggagcatgcagctagctagcaagcaagccttgggttgggtcacgtcgacgtcgtcgtcttcggcggctataaaactaggttagacgtcgagcgaccggccccttgcttctctcccccggcccgcccgcccgcccgctcgctcgccgctggatcagtttcgtggcgctttggagcagcgaagtggttgctgtgcttggtatttctagtgcgtagtatcgccatcagcgctcaataatactactcctcttcctctatgctgcacgccccggcccctttgttttgtagctcttgtcagcgaaccttccccctgaaaaccccacccacccttcctctccgatcctcctagtagcgcctcacttgcttcattccgatccattccaccacccatctccctcctcagctcccctctccgctctccctccctcgctcgcgctctccacgcggatcaccggaggctagctagcaagctcgaccggcgcggccgatctagctcgcgcttgttggccgcttcagcttagcagcggcggcacgtcgtcaacctgtgctgtgagaaagactagtagagagagatacgtgtaaggatggctggcgcggggggtgcgacggctgtgaagcagccggcggcgggggcgcccgacgctggggccagcaggagcggggtcggggctggcgccgccggggcgccggtcgccgacccgcgcgccgaggcgctgcggtgcccgcgctgcgactcggccaacaccaagttctgctactacaacaactactcgctgtcgcagccgcggcacttctgcaaggcgtgcaagcgctactggacgcgcgggggcacgctccgcaacgtccccgtcggcgggggctgccgcaagaacaagcgctccaggagcagcggcgggcccggcgccggcgggaggaacgggtcctccgctgctgctgctgctgctgccgccgccgccgccgtcacgtcctcctcggcgccgtcgacgctgtccctcccgctgcatacggggtccctgccgtcgttgtcctcggcgctggggctgcccgggggcgcctcgctcgcgtcgctcctcctcgggaccgctggctctggcggtgaccacctcggcctcttccaggccgccatgcagtcggtggtctcctcggaggcgaccgcctacgagatgcagcagcagcagcagcagcagacgcaggtggaccacctgctaggcctcggctacggaggcgccggcgccggcgccggcgcgcagatccacctcaagccgtggatgcacgaggcacccggtgctggcgcgggcgggatcatggacagcttctacgcgccgctgctgtccagctccctcgtgccgggcctggaggagctgcacgtcaaggcggaggtcgccggtgccggggatcaccagcagaagcccgcgcccggggaccagcagagcgccagctgggagctgccgacgccgtcgtcgtccaacgtcgacgccaacgtcatcgcatctgacgcgctcatggccgccgccgccgcgtccatgaaccccggggttagctccgccacagcacccacggcgccaaccgtcccctcctccttcatgtactggggcaacggcggtattggcggcgctgccgcggcgtggccagacctcaccaactgcggatcttccattgccacgttcttctagccgtctggctgtcccgcactcccgctggcctcgttaacttcgttttttttaccttaattttctggttaattttttcttgactaaaataacatgtaatttgtggggaaagctgagatgagagagagagcgcactgtggaagaagagagctagatcatctcaccacctcatagggcagaaaattcgagaaatcaaacaatgatccaatatttcaagaggatttcttcaaaaaaaaaaaaaaaa

SEQ ID NO: 8936 - DNA, 2242 bp, Zea mays
tacactaaccaccccgacattccattccgttgacagatgtgtacgtacatgcgtatatacgtatctaagacggagcacgcggaagcgcgtgcagccttccttggtcacgtcttcgtcttcgtagtcgtcggtacggtcggctataaaactaggttattagacagcgtgcggccccttcactcgatcagttttcgtggtgcttggacacttggagcagcagccaagtggttgcggtatttctagtgcgtagcgtaggcgtagtatcgccatcagcagcgctcaaaataatactgcgcgctcgcttaatttgttttctagcttttgtcagcgaaccttcgccctgaaaaccccacccactcttcctctccgatcctcctagcgcctcacttgcttcattccattccattccattccactacccaatacccatctccccgccggcctttcccctcccgcgtgccgatctgcctccggaggctagctcgaccggccgatctagctcgcgcgccgccgctttcagctcgatcagctgccgcacgtcgtccaccgacccgccgtcctgtgagcgcgatcgacagattactaagatggctggcgcggggtgtgcgacagccgtgcagcggccggcggcggcgggggcgccggctgctgtggcaaggaccgcggtcggggcaggcggcgcggtcgccgacccgcgcgcggaggcgctgcggtgcccgcgctgcgactcggccaacaccaagttctgctactacaacaactactcgctgtcgcagccgcgccacttctgcaaggcgtgcaagcgctactggacgcgcgggggcacgctccgcaacgtccccgtcggcgggggctgccgcaagaacaagcgctcctccaggagcggcggcggcgggaggaatgggtcctcctcctccttctcctcctcctcggcggactcgacggcgctgcccctcccgccgcctccgacgacgatggggtccctgccgtcgtcgctggggctgcccgggggcgcgtcgctcctcctcgggtccgcgctccctggcggtgccggtgaccaccaccacctcggccttttccaggcggccatgcagtcggtggtctcctccgacgcgaccgcctacgacgagatgcagcagcaacagcagacgcagctggaccacctgctgggcctcggatacagaggaggcgccggcgcgcagatccagctcaagccgtggatgcaggaggccgccggggcaggcggcgcgcccgggatcatggacagcttctacgcgccgctgctgttcagctccctcgtgccggggctggaggagctgcacgtcaaggcggaggccgccggagccggggatcaccagcagaagccgtcatcaagggaccagcagagcgccagctgggactgggagctgccgacgccgtcgtcgtccaacgtcgacgccaacgtcgtcaccgcgtctgacgcgctcatggccgccgccgccgccgcgtccatgaaccccgctgttagtgttagctccacgccctccacggcaccaaccgccccctcctcgttcttatactggggcaacagcggcattggcggcgctgccgcggcctggccagacctcgccaactgcggatcctccattgccacgctcttctagccaagccgcgcctggctgtcctgctggcctcgttaacttggtttttttgtacctcaaaaaaaaaaaaaaaattttcttgactgaaataacatgtaaatttgcggggaaaagaaaactgagatgagagagagagaacgctgtgaaagaagagagctagaccatctcaccacctcatagggcagaaacttagacaaatcaaacaaatgatccaatccaatatttcaagagaattccttcgccgcgactatgatcttcatggcacctgcggtcttggccgtcaagcgatgatcaaggccggccgtccacaactggcatgcatggatttaggaggaggaggaggagatcctgagaccatggcgagctagagatcgatcgagactcgagagcaaagaaggcaagaagttgtaagtgccgtgctgccctgacactactccttgatttgctactttcttggctactagcttctccgatccttgggtgttttgtacatagggcatatggtgtggggggtaatacaatatagctaagatggcccgcgtgagatcatggtgcaagtcatgagcccctctctctcgatctctctttagatgtacaagtta

SEQ ID NO: 8937 - DNA, 750 bp, Zea mays
agaaaaccaatttgtttgtgtggctacaacgcaagcaaagcctccccagccgctttctttctttctttctcccttccttccttcgttgcactggtgcttcttctccatcatcatcatcagaggaggagctacctacctaccttttgatgcaggttgccatggccaccaccaccagcagcagcttggtcaccggcttgaggtgcaggacaggtgcagcagtggcattgatcagacccactagtgccgctggggatcgccggggctggaggacgacggcgtccggccgtggagcccgcaggggcaaggtcacggtcgctgcggcctgcaagacatgcaaaggaaagggggcagtagaatgcccagggtgcaagggcaccggcaagaacaagaagaacggcaacatcttcgagagatggaagtgctttgactgccaggggttcgggctcaagagctgccctacctgtggcaaaggaggtctcacacccgagcagcgaggggagagatgaatcaaccatatacaacgaaaactgcattcactgtataccaggcactgctgatatacctgcacctccagaaacaccaccactatattttttctttctcatgcatgtctgtgcattcgcgtggccttgcccagaaatcaaacactgagtaccatcagacaggcagattggactggtgaaatgctatagttggacatctactacaaaaaaaaaaaaaaccccccagccaaaaaaaaaaaaagcggcc

SEQ ID NO: 8938 - DNA, 1586 bp, Zea mays
  misc_feature (1399)..(1399): n is a, c, g, or t
agagtccctgggactgctcttagagatttcggcctaagagagagcgggcgattgggtttcgggaagagggcaccggcaatgtcaacgacgacggaggcggcaaagagcggctcagccgcaccggtgcggtgccagcggatcggctgcgacgccgtattcaccgacgatgacaaccgcgagggctcctgccaataccacccctccgcacctatgtttcatgacggcatgaaagaatggagctgctgcaagcaaagaagccatgatttcagcttatttttgcagatacctggatgcacaacaggaaagcatacaaccgaaaaaccaatcacaaaagctgtttcatctaaccgtacaaaggcaacaccgatccagtcctctaagcagggtgtgggagttgatgtgtgtgcaaggtgtcgtcaaggtttcttttgctccgatcatggatcacagcccaagccacaaaagccagctgctaccgacgatacaaacaaggaacctgttgagaaatcagctgttccaccgcccaagaaaaggatcgatgtaaatgagctgaggacatgtaaaaataaaggatgtggtaaatcctacaaggagaaggataaccatgattctgcatgtgactaccatccaggtcctgccgttttccatgacaggatgagagggtggaaatgctgtgatgttcatgtcaaggagtttgacgagtttatggagatacctccgtgcacaaagggttggcataatgctgatgcggtgtgaattcacgccatgcttaaggctgttttcatgttgtatcgtcacctgccatgtaaacaccatttctgcagtttattgaggatttcatttggaagtgtgacaagagctttgaggatgggctgcctaagctttgcgcatggtggttgtctggaaatcttacgtgattctccttgcacatttggtgtctggattcaaattggggttttgtctgtttgaagccgaaggatgtcaatattttaaccctgtcaaagtcagaggagttagcgcatgctgtggagcagtagaggtgccgtgtttcttgtgtgtgttccatggctgctggagaagtcctgtccgtgtactggtttgctcggtttgagcaggcaaaagcctggaccatgcatcactagtttgttctacaatataatgaaaacgtagctgcactcttggaaagagaaaagcacattctcttgatttattggatgctgttttggcgtgcatacactagcattatcattatgtcatggatacatggacatgggattcaaatataagtagtactggtagtgctttggacacggcagcgtttaggttcaagggatgccgatgatcgggatgaacgggaagaacaagaagaacggaggcagtcctccaaaactgaagggcnggcctgttgcctccacgggacggtggagtccacgccggcgtccgtgccgccggtggcatcggccttaacgctggctgctgctggcacggccacgtccaagttgccgcgaccgtcggtctgcgccgcgtggaggcccgcgccgccgacgtcgtcgccggggtatttcaccgccacgaccacaccggaa

SEQ ID NO: 8939 - DNA, 910 bp, Zea mays
ggaaaagacaatctcttgatttattggatgctgttttggcgtgcatacactagcattatcattatgtcatggatacatggacatgggattcaaatataagtagtactggtagtgctttggacacggcagcgttcaggttcaagggatgccgatgatcgggatgaacgggaagaagaagaagggaggcagtcctccaaaactgaagggcggcctgttgcctccacgggacggtggagtccacgccggcgtccgtgccgccggtggcgtcggccttagcgctggctccatcggggcgttaccaccctggtgttcacggtcggccatggtcgcagcgacagcggagccgccgctagccgcagcgcacctcgtgaagaaggcgaggcgggagcccagaacataggaggcggggtaggaggcggagccaggcgcccgggccgggacgacgcgcgcgaccgtgagtccccacggcgcgcagagctgctccgtggcgccgaggaccctggccgcgcacggcgcgcccgaggctgacgctgctgctggcacggccacgtcgaagttgccgcgaccgtcggtctgcgccgcgtggaggcccgcgccgccgtcgtcgtcgccggcgcatttcaccgccacgaccacaccggagagatcgtgttcctcgtcgcagtcgaggcaggcgacggagccgcggaggcggagcgcggcgctctcgcacggcaccgcgccgagcgcgacggcgaggagcagcaggagcgccccgacgagggggagccgaggaggagccagcatagggaacgtacgacgagtgatctgcatggacaaggaaagttggcgcgtcgaccgttgagaccgcctgctgctcggtgctcgcttaccagatgtgttatgtgtacgcggctagtatttcgaaaca

SEQ ID NO: 8940 - DNA, 838 bp, Zea mays
ggaagagaaaagcacaatctctgatttattggatgctgttttgcgtgcatacactagcattatcattattatgtcatggatacatggacatgggattcaaatgtaagtagtactgatagtgctttggacacggcagcgtcaggtttcaagggatgccgatgatcgggatgaacgggaagaagaagaagggaggcagtcctccaaaaccgaagggcggcctgttgcctccacggaacggtggagtccacgccgccggtggcgtcggccttcgcgctggctccatcggggcgttaccaccctggtggtcacggtcggccatggtcgcagcgacagcggagccgccgctagccgcagcgcacctcgtgaagaaggcgagggcggagcccagaacataggaggcggggtaggaggcggagccaggcgcccgggccgggacgacgcgcgcccgaggctgacgctgctgctggcacggccacgtcgaagttgccgcgaccgtcggtctgcgccgcgtggaggcccgcgccgccgtcgtcgtcgccggcgcatttcaccgccacgaccacaccggagagatcgtgttcctcgtcgcagtcgaggcaggcgacggagccgcggaggcggagcgcggcgctctcgcacggcaccgcgccgagcgcgacggcgaggagcagcaggagcgccccggcgagggggagccgaggaggagccagcatagggaacgtacgacgagtgatctgcatggacaaggaaagctggcgcgtcgaccgttgagaccgcctgctgctcggtgctcgcttaccagatgtgttatgtgtacgcggctagtattccggccggc

SEQ ID NO: 8941 - DNA, 2830 bp, Zea mays
gcttctgcagttatcaacatttttctatgttcaaccttgttaacatattaagacgagtttttctttcatttttcaaaaaaataaatcaatctttatttgctcctcttgagttgcttcacaagttatagaacgaaaaatggttctcttttgctctcccttgttattccgatcacttttgccacacaaacatccactcacttcattgtatctcacttcattgtattttaaatttatcgtatcattagtggggagttattataacagatcacctagaacacctcgtttaaacccccgggtaggatgtccacttccgcttcctcttcctctcagtccaaccgcccctcgtgcccaccgcttctacaatggcgccatccgccgctaccgcgagcatcctcctcgccctcatcgccatcctcctcccctccgtaacggcggccgcggcgctgcagatgcggcatcgcctcggcgcgtccttgcaggtcgcctccctcaacgcgtcggagccgccgaccaccttcttcgaggtcgatcgcccgatccgccctccgcgcggcagcgcggggccttgctccacgcttctcctctcggctaccttcggcgccacatacggccgcccccccgccaccgccgcctacgcgccgccggcttgcctcggcgacgcgggcggcgccggtgcctcgcgctcgccgtgctcgagtgggccgccgactgtcgcggccgccagttcgaccgcatcttcggcgtctggctctcgggcgccgagctcctccgcagctgcaccgccgagccgcgtcccaacggcatcctctggtccgtgtcccgcgacgtcaccaggtacgccgccctcctcgcggagcccggtgaggtcgcggtgtacctcggcaacctcatcgacaaaacatacaccggcgtctatcacgccaacctcacgctccacctctacttccgcaccgatccgcagccgcagccgccaccgcagcagcagcagcaggctgatctgattgtgcccatttcaaggagcttacccttgaacgacgggcagtggttcgccatccagaatgctactgatgtgcagtcaaagaagctcgccattccgtcgaacacctacagggcggtccttcaagtgttcgtttccttccattccgacgacgagttctggtataccaatccgcccaacgattacattcgggcgaacaacttgtccagtgtccccggcaatggcgcattcagggaagtcgtagctagggtggatggtgaagtcgtcggcgctgtttggccattcactgtgatttacaccggtggtgttaacccgcttctatggcggccaatcacaggaatcggctcattcaatctcccgacatatgacattgacatcacgccattcttgggcaagctcctggacggcgaggaacatgatttcgggtttggcgtgacaaatgctcttgatgtgtggtacgttgatgccaatttgcatctgtggctggatcacaagagcgagaagaccactggaggcttgctcagctatgaggcatccggattgaaccttaatgtgagctcagaattcactggattagacgggcagtttgtgacaagcgcaagtcggcacgtctctgccacgggatgggtgaaatcgtcgtacggggaggtcaccacaaccttcaatcagagattctgctatgagaacatcttggggtggggaaagaacggcactgtgcagatcgtgaaccaaacaatcgatgcgaagtctggcatttttgccaaggatgcttctgccgtgctgctctccgaggaattccatgaggttttcccgctgtacctttatactggaacctcagatcaagcggacgatgagtactcattggattcaattgttaaatttggtatcaatgggaagaagacctccggtgggaaaccgggcttcttgtacagctccctacggaattcacagtcggcacaaggcactatgagggtgaagaagaatttggtggtcagtggattggggaagacccatcaggtgtataagtatgtgggaactgatggatgctacttcagggatgtgagcagcaggaactacactatagtttccgaccgctccgatgattcttgttcaaaaagagcatatagctctgtcagcgagaagttgaatgatcagccagcaagaagaaagttgctggcaaacaaattgtaaagtacggaaagggaatagttcgtccacgtttcagttttttactttgcttcttgaataaaggctgcttggcagctcgtgcttcagaaagtaggtaagaaacttgaatgtccctttataaacacgccaattcggatctagtggcaaggtattgttatcagtgactatcaattgcatcaccatcatgtctatagctgcacaggatgatgcaccacagaacgagggatgaccattttatactggcagccaatactagttagtactaatcaagattctgacacgaccacactctttttttatgccagcattgcttactccgcatcgattggatttgttccggatctcgatctccttcaaggcatcagcagattcttgttgctcttctctgtcctctttgcagatgtgtgttttggaagttttttttccctttcgaaaagctctttgcagatgtgtggtggtacttattttttgatgtcaagacatacttggaccttgattgccatgtaccaccaactgtgatcttcactctagccttcatagctgaactaggtgagtgtacgtgcattgcaatagagacatataatatcacgataacttatgtacaaatgtgtattacactgttatgagatggagcacgacgtccgc

SEQ ID NO: 8942 - DNA, 1833 bp, Zea mays
gaaatatgttggtgataatggggatctgataattgcaaatcccacacgccatggaaaagaggggagcaagtcgttcaaattcaacaaagtttttggccccactacttctcaagatgacgtattcaaggacattgaaccacttattagatcagttcttgatggttataatgtttgcatttttgcgtatggtcaaactggatcagggaaaacatacacaatgactggacctgaaaatgcaacagagaatgaatggggtgtcaattacagagctctgaatgatctgttccatatttcacataatcgtggggataccatcatgtatgaaataaatgttcaaatgattgagatatacaatgaacaaatccgtgatcttctttgcagcaatggttcagagaaggagttagagattatgaatgccagccaacccaatgggcttgtcgttcctgatgcaacggtgcatcctgttaattcaacatccgatgttattgagtttaatgagaataggacatgccaaacagagcaagtgggttcgacaatgttgaatgaaagaagcagcagatctcacagtattgttacgcatacacattccgaggtgttagattttgaaaacagggagctactctgtgtgggtgcactacatcttgttgatcttgctgggagtgagagagtggaccgatcttctgttacaggcaatagacttaaagaagcacaacacataaacaaatctttgtccgctcttggagacgtcatattttctctaccgcagaagaatgctcatgtaccctaccggaacagcaaacttacacaagtcctacagagttctttgggcggccatgcaaaaaccttgatgtttgtgcagatcaacccagatgtctcatcttattcggagactttaagtactttgaagtttgctgaaagggtttctggagtggagctaggtgcctcaaaggcgaataaagaaggcaaagatattagagaatttatggaacagctctcactgctcaaacataaaatggcaaagaaagatgacgaaattaacagattacaacaactcaagacgcaaactccaagggtcaggactgcaaaacgtgcagattccccattgaaacattcgtcgtcgtccccaggcatatctaatttaggaagcaaaatccaacatagaaggacagtatcaagtggaaaggcaatgagcattgccagtagggctgggtctgataccttctctgacaccagtgacaggcactctgaatctggttctatgcagtctgttgatgatatcctaccacgtagggggattatgggtcttccgaagctctctattggtgaaatgggtcagaattctgctgaccctgagcttgtttgctttgactatgctgattcagaagagagattaagtgatatatcagatagtggtctttccatgggtacagagacggatgtttcagtaagcagtatagttgagttgacacgttttcaggagcaggaaaacatacctagcactctgaaagaacaagagagtgcacgaaaaattccaaatgatcagttgtccaaggtggccacccgagttcagaagacaacagtacccaaactagctcaaacttccttgtggcctaaactaagagatcctccagcccttagatccccagggagaatcacaacacaaacaatatctgtaccaaggacgtccatgacttcgaagagatggacataagtcaagtttgatcaacatgttctaacactagtttatggttttgtacagcacaatcgaaaagtaattcattccaattgatgaactttgtacagcacttgattctttcaggaaaaaatggcagt

SEQ ID NO: 8943 - DNA, 1498 bp, Zea mays
cgccagcctgactgcggcccacccaccgcaggccttgacgggcaccatttctcctctcgccagttttgccccactctttcctcacttccaagcgacacccgaaggccacagcggcacagcgccagcggcaacagtcaccagaccaccactaccagtctaccacccacctgacctgagcgaccccttcgcttccactccactgaagcgggccaaaagaaggaaagaaggcgggcaagcgacaggaaggaggaggaggaggaggaggagaagccatggcgagcgacggcgacgggaagggccgggtcgcgacggcgccgggggcaggagggtacggctacggctacggctacgccggcttcgagggggaggaggaccggaagtggtggccgtggctggtgcccaccgtgatcgtcgcatgcatcgccgtcttcgtcgtcgagatgtacgagaacaactgccccaagaaccggagccagctcggcggcgactgcgtcgccggcttcctccgccggttctccttccagccgctccgcgagaacccgctgctcgggccgtcctcctccactttggagaaaatgggagctcttgactggaataaaattgttcatcaaaaccaagggtggcgccttattagctgcatctggctccatgctggcctaattcatttggttgtgaacatgctaagtttgctgtttattggaatccgtcttgagcagcaatttggatttgttcgcattggtgccatatacctactgtctggttttggtggcagcgttctgtctgcactcttcctacggaataactacatctctgttggtgcttctggagctttatttggcctgcttggatccatgctttctgagctactcatgaactggactatatactccaacaaggcagcagctataataacactcctgtttataattgcactcaacttggctattgggatactacctcatgctgacaactttgctcacattggtggattcgcaacgggtttcctcttgggttttgttctgttggcaaggcctcaatttggctggatggaacaccacgagctgccgcagactaaccaacctcccaagtacaaagcgtaccagtatattttgtgggttgtggcactagtcttgctgttagttgggtttgtgatttcacttgtgatgcttttcaaagggaagaacgggaacgacggctgccactggtgccactatctaaactgcgtgccaacatcaaagtggaagtgcaacacctagacacctcaggtttctgttactctggcgaaacatgtagtattcagattcagaagaccattttttttatgcgtgtttgtctgtagatataaacaagttctttgttctttactgggttgaagttatgtaaactgctttgttgagctttgtatgtttataactcgaggttgatgcctattcaaaatcgttgtttagaatgctcgtaaaaaaaaaaaaaaaaaaaaagaaagcggccccggtgaatt

SEQ ID NO: 8944 - DNA, 848 bp, Zea mays
  misc_feature (549)..(549): n is a, c, g, or t
  misc_feature (563)..(563): n is a, c, g, or t
  misc_feature (566)..(566): n is a, c, g, or t
  misc_feature (588)..(588): n is a, c, g, or t
  misc_feature (613)..(613): n is a, c, g, or t
aaacagtcaccagaccaccagtccaccactaccacccacctgacctgagcggctgagcctgagcgaccccttcgcttccactccactgaagcgggccaaaaggaggaaagaaggcgggcaagcgacaggaaggaggaggagaagccatggcgagcgacggcgacgggaagggccgggtcgcgacggcgccgggggcaggagggtacggctacggctacggctacggcggcttcgagggggcggaggaccggaagtggtggccgtggctggtgcccaccgtgatcgtcgcatgcatcgccgtcttcgtcgtcgagatgtacgagaacaactgccccaagaaccggagccagctcggcggcgactgcgtcgccggcttcctccgccggttctccttccagccgctccgcgagaacccgctgctcgggccgtcctcctccactttggagaaaatgggagctcttgaccggaataaaatgttcatcaaaaccaagggtggcgccttattagctgcatctggctccatgctggccctaatttcattttggttgntgaacatgctaagnttntgctgttttattggaatccgtncttgagcagcaatttggatttgttncgcattggtgccatatacctactgtctggttttggtggcagcgttctgtctgcactcttcctacggaacaactacatctctgttggtgcttctggagctttatttggcctgcttggatccatgctttctgagctactcatgaactgaactatatactccaacaaggcagcagcttaaatggcccatggcttactgaccaccacggaggcggagcaccaggtggagagtgctctcc

SEQ ID NO: 8945 - DNA, 1510 bp, Zea mays
cccacgcgtccggtcgctgtcgtggagcacagccgcaccgcactcacaccatttcaccatctctccgcggaagcagatcctctccgctcgccagcctccccctcctgctgctgcctcctcgcttcaagcaacacccgaagcggcaacaaccaccaccaccaccaccaccggacctgcctgagcgaccccttggcttcccactccactgaagcagggcgagagagagtaaggaggaggaggagaagccatggcgagcgacggcgacggtaagggccgcgtcgctacggcgccgggggcagggtacgggtacgcggcgtacggcggctaccagggggcggaggagcggaagtggtggccgtggctcgtgcccaccgtcatcgtcgcctgcatcgccgtgttcgtcgtcgagatgtacgagaacaactgccccaagcacgggagccagctcggcgactgcgtcgccggcttcctccgccgcttctccttccagccgctccgcgagaacccgctgctcggcccgtcctcctccactttggagaaaatgggagctcttgactggaataaaattgtccatcaaaaccaagggtggcgccttattagctgcatctggctccatgctggcctaatccatttggttgtgaacatgctaagtttgctgtttattggaatccgccttgagcagcaatttggatttgttcgcattggtgccatatacctactgtctggttttggtggcagcgtgttgtctgcactcttcctacggaacagctacatctccgttggtgcttctggagctctatttggcctgctgggatccatgctttctgaactactcatgaactggactatatactccaacaaggcagcagctataataacactgttgtttattattgcactcaatttggctattgggatactacctcacgttgacaactttgctcacattggtggattcgcgacgggtttcctcttgggttttgttctgttggcaaggcctcaatttagctggatggaaagtcatgagttgccacacactaaccaacctcccaagtacaaagcataccagtatattttgtgggttgtggcactcgtcttgctgttagttgggtttgtgatttcactggtgatgcttttcaaagggaagaacgggaacgatggctgccattggtgccactacctgaactgcgtgccaacatccaagtggaagtgtaacacctagacacctcagttttctgtacactcgggggcaaaaatgtagtatccagatttacaagaccattctctatgtttgtttgtctgtagatatgaacaagttctttgttgtttactggttttgagtttccttgcctatgtaaactgcttcgttgagcgttctatgtttataattggagtttgatagctgttttaaattgctcaatggaaaagcagtagctttggtgcgcaaaaaaaaaaaaaaaaaaaaaaaaaaaaaaaaaaaaaggaaaaaaaaaaaaaaaactttattttt

SEQ ID NO: 8946 - DNA, 6425 bp, Zea mays
aattcggcacgaggacaaattcacaagacgagagacagaagaggaggtagtagagagagaagggccgagtaagtaggtgggtagtacgggagcgtaccgaatgatgatgagtccttggactctacaacagccaagcgctatctgaagcgagaagagaagcaaccagcccgtaggacaagacgtgtcgggaggaggaagaacaagtagccagggagcagcagccatcgccattcctgcctggttttgctcctgctgttatgaggagctggactagatgaggggaatgctctttgctggtagcgcacgagaagggcacgcggggacactgctgcaactgcaacaccaacgacaggggctcgccgccggcaaactctcaggcgccggcgacctctgggagcccacctcggtgcttgaccgccgacacagccccagcccgagcccgccgacctcggttcccacgctgtcgtcgcccctgggcgccgcgaccgccggtgtggcggccctcgccggtgctaacgccaagaacgtctccccgccgccggtggcggcggcggcggatgggccagggggaggaggggcggaggaggccgtggcggggggcaaggaggagtggcagctcacaccgcttgacatgggccttggcgccggcgaggggtgggacgcggccgaccccgcggcgccgccggggctcgcccccgaccaccccttcctcaggtggatcatcggcggcgaggacgcgtctgcggccatggggtctgtcatggacccgccggtccttgagctggaccacgcgccgtccatgatgtcgccggcgtttgggtccaccatgccgttcgcgccggccatggaggacgccaagccggtgcccttcggccacacgcccaacttcctgctccaccactgccaccagcaccacccccagccgcacgccgccttcttcggctcgcacccgtccctggacgcggcgccgcagccgaagcgaccacacccgatggccggggcgccggcgccgaagctgccgtctttccctgggcctgtcgcccaggcgggcggcgggttcgcgtcggccttgaagcccaaggcggaggcgggtaacgacgaggcggccgctgcggtggaccagcttgccgaggcggccagacttgccgaggccggcgacgccttcggcgcccgcgagatattggcgcggctcaattatcggctccccgccgtgcccacggccgggacgccgctgctccgctcggccttctacttcaaggaggccctgcgcgttgcgctctccccgaccggcgaggcccttgcgcccccggcggtgtcgacgccgtacgacgtggtcctgaagctcggcgcgtacaaggccttctccgaggtgtcccccgtgctccagttcgcgcacctgacctgcgtgcaggcggtgctggacgagctcggggccgccgggcgcatccacgtgctggacctggacatcggcatgggcgagcagtgggcgtcgctgatgcaggagctggcgcagcgcagccccgcggcgacgctcaaggtgaccgcattggtgtcgccggcgtcgcaccacccgctggagctgaacctcatccacgagaacctgtcgggcttcgcccgcgagctcggcgtgttcctccagttcgcggcgtacaacgtggacgccctggaccccgcggagctggtggccatcaccagcggcgacgccgtggccgtccacctccccgtggggtcggcccacgtggccgcaatgccggccgtgctccgcctcgtgaagcggctcggcgccaaggtggtggtgtccgtggaccgcggctgcgaccgcacggagctgtcgttcagcacgcacctgttacaggcgttccagtcctgcgtgtccctgctggactccatcgacgccgtggggggcgcggacgccgaggcggtcggcaggatcgagcgcttcatggtccagcccgacgtggagcggcgcgtagtgtcgcgccaccgcgcggcagtggccgtggacaagccgccgccgctgccgtggcggaccgtgctcgcgtcggcggggttcgtgccggtgcaggccagcacgttcgccgagtcgcaggccgaggccctactcaagcggatggcgctgatggggttccgcgtcgagaagcgcggcggcgcgctctgcctctactggcagcgcggcgagctggtctccgtgtcggcgtggcggtgctgaccgccgggagtacgccgccgccgccgcaaccaagagccagccgtgaatctaccacaagcccgggttagctaggactaatgatcctactactgcaagcaaaaaaaatattttccaccgtcgtcgtttgtaacgatctcatctggtctggtctcgtctgtctgcttattagtgtgtcctacccgattaatcgtggagtacgtcgtccgttgcctggctttgcagcctcggtgggctctgctcatgttgatttgcggagcgcgccgtggtttgcaggttgtaaaacgtaggcgtggtgcagtgcagtgaccagcgcatcctaccgcccgtcgtgttgctactcttttttttccattgctgtgaaatcaattaatggttatggcgtttgaaaatgtcccgttttctgcaaatcccgcaactaccaaggcatgaatctgaaactagcaaggcgtgttcatacgaaacccatgcaaaaaaaaggtcgtctgagttacagaggaaaaaaaagatcgttcgagaacgcgcgggagcagacacctggcgacgaagaagggcgggtccgggaccggaagagagagaggggtctccctgcaactagacaagtggacggcggagaagaagagtctcccgcagcaatggcgcgagcgaaacagaaaaaacaacaacgatcgggaataaagcggccaccacatgagcgcccccgccggaagagcaagcataaaggcggccggcaaaattttgttcttcacacacggtgagattccgatctgcacttggcggcgagatatatacaggctaggactaggacgctccggttgcttagcctccctcctaagcaagctgtggcatcgggtggcttcagcgaggctctgaatctacctgtccattatcttccccccctcccccgttgattgttccggtatcatcagtcagccagacagaagctgtgcttttcgctaatgctccaggctgacagaagtgtttacgaccattatcttgttccatcagatgctgctggtaccccccctcccccccaaaaaaaagaagctaggatcattcgcaccgctaggatgcaagttctaatcccttgaggttatgttgtatgatctgacagaaagaaagaaataagataaactcgtgcagttaacaccctctggcttggtgtgtgcactgcacccaccgctcctcgtcctccacgggctgcccaccgcgaagctcaaaagtgggcgcattacaggcgaagcagagatgctaaaccaagcaagttcccgcgtctactggactcctgccaagacaaacggaggaaccccgtgggagcgagtgtacgttcccggtgtccgtccatgacactgtcgcttggcgatccaaggacatatgccggggtgggggcggcctgctcctgcaatgcattgtcttgtcgtcatgatggaattcctcgcacagcggggggggggggggggggcagcatgaaccgaatcgcctgcttgttctgttctcgtccctctcttcttcttctgattgttctcctgcctgcctggctgctgcagatgcaaagacggtaatcatcgtggaaagcgccggcgctttgcagaagccgacggcggcacagcatctcatctctccctcgagcccgcgaaggacgacgatgaggaaggccctcctctgctaccgtgtagtctctgcgggaatatattgatgccgaatgaagagtgaacgatacgcccccccagcaaactgttgggtttcagcaagagggttcatgtacagcctttatgcttccaactcctctctggattgacgtaggattctacatgaacaaagctcgcagcaggagcccctcgactttagcacacacacagtacgttcgcacgagggagaacggcggccacagggagagaactccacgccggaacccggaagccaggcagaagatccaacaccgggccgctgaaccaagagagcatggagccggagcatgtgggccacggagaaattttagctgcgtccctgtgctgtgctgtctgtccttcgcagtccacagctcagctcagctcagctcccagtcccaagccgtgttgttgttccctgctctgcttccgcgtgcgggtgaacctgttgaccacaccacaccacgcacgcagcccccctcccccaccccgcgccacgctgccaccggcccacccaccgccgcccagcatcggggatccaatcccaactcgtgccggggcctgctgtactttacatatgcatgcatcctcctcagtgttgttggccaacgcatgtggctcgtgccgtgtcaccggctgctggatcccgtcggcttcgttttcccttcgttgtttcacgttgccacaaacaagtactggtaggagttttttttttcttccacagatcttgcaggacgaagagtcccagagaaacttcccgggaagcttcatcttccagttccagcgccgctgaacgctaaacgagcaccgctccccgcatgcctgcagcctgcggcctgccgactgccgattgccgtgaaagagcgaggcagagtagccagccaggccaggccaggctccctcgaaacgtcaaggcaggcaggcagagacaggcactgctgtcgaggtccagggtagggcacagcacacgccgcctactactcccatcccatgtgtggtcgccctcatgtgtcgggcgggccgcgccagcagcagcgcgcatgtggctcgcatcacgctcgcgcgcccacggcggtgcctggcccggttttgtctctgtgcgccgcgcccctcacatgcgcgtaaccgaaccgggcgtttgtatccggcagcggggggttcgttcatttacggttctgttctttccgcttacattttgggcttagcagatacgacgaccaaacctaaacccccggggctgccagtttcggccacgccgctcgtcgtcttcttcttcctcccgtgtctcaccaaccagcactctacagcaacaggggaacacagaacacgcctgcactgcactgcacgcgcgagcgagcctccctggtcacgggcacggtgcgctggagcctggagtggagtggaggagggcttgactggactggagcgagagggactggacttgtgatgttgttatcagaggacaggcacatcatgagcagagagctgcaggcacgcacaggcagcagcctatcctagctgcagtgggccgcgcgcgacgaggctcctctgtccgtgttgctttaccctaccctgcgtgcgagtggactggactggacgactggacatctggaacgcctgtgtggcgggcgggcggggccacaagtagtacccgtgacacacgcacgggacggcgagacgatgcatcattcatgcccatgggttcggtttgcctccgtctccacattacgaccaccacacagtccatccaaactgtacgggtattttcagtgaatcaaaaccattcctcagccatatattatacaataaaaaaatcgccagcgacgcagaactaggctacaccggcagattatttattattcgcgccctagacttgcgatcgtgttaaaagaggccacaagacaagcgcacgctttattcctaacctcccccgaacgaacgctttagtggcggctagcgttcacacggccgcctgcccccctccgattgaaagcgccacgaggtcgaatcgatcgcaaaagggatggaggaggggtgcattgttaatggttcagcatgattgaagtctcactcagagaggcccgggattcggaagccactggagctcaaggtcccgttcatacgggttagtattacagacgataccacccatcctcgaggattggaggacaaagccatcccaaccaacaacacagcaaggggaatgcggtgcacgatgcagtgttcagtgggagagcgagcggcggtggtggcaatgacaggggcaggggggctgctagatggattggaagtacccttgccctcccttggaaagagctaaagacacgcaacttttgagagccgaaccaaaaggaaaagggaagcagtgatgaagccgggcatacgtacgtaccaaatagagagacggacggatggatggtgtcacggtgaagccgcctcggagagcgggattcggtgccaactacaaggtttgttgggtgggtgggtcacgcacgccgcccgcaccatgcatgcaccagccagccagccagccagcctttgcgcccttctat

SEQ ID NO: 8947 - DNA, 1130 bp, Zea mays
cgagtgacaagtgctctcccaccaccacccgccagctcaagccgcaaaggccaggccaccactccttacctttacctctcttttttttccttcattcacgaatcccttcttccgccttcttcgtcgggccatcctcaccgacgagaagagatctcctcttcggcacgaggaggacagcaggggagaaagatgggggggcgggtggatcacgagtactcttacctgttcaagatggtgctcatcggggacagcggcgtcggcaagtccaatatcctctctcgcttcacgcgcaaccacttctccctcgactccaagtccaccatcggcgtcgagttcgccaccaagtccctacagattgacggcaaaacaataaaggctcagatctgggacacagctgggcaggaaaggtaccgtgcgattacaagcgcctactaccgtggcgccgtggccgccctgcttgtgtacgacatcacgaagaggcagagcttcgacaacgttcacaggtggcttcgtgagctccgcgaccacgctgactccagcatcgtgatcatgatggtgggcaacaaatccgacctgatccacttgagagctatctctgaggacgaaggcaaagcgttggctgagaaggaagggctgttcttcctcgagacgtcagctatggaggccatcaacgtggaggaagccttccagactattatcacggaggtgtatggcatcgtcaacaggaaagcgctggccgccaaggaagcagctgccacagctgccccattgccttcacagggcaaaaccatcagcattgacagcaatgcaggaaatacaaagaaggcatgctgctctacataaataaaaaagatgtaaccttttttaaaatatggtagaaaatggagcatatatagtcatcataaaatatggtgtggaggcgatatataactactgcttttcttttctttatttttttgtgtggacaaaatcgagtacatgcagtgtttctgaatcaaaagttagatattgtattaggattcataccttttatgttctccaagttgaatggtactactgcagaatcatagtccaatgttactgtagagttcaagtgtgcggccgtgatttttatcacgcgttctaattgt

SEQ ID NO: 8948 - DNA, 1094 bp, Zea mays
accactagaacatggtcatggaggtccctacgaggctacgaccctgtccctgcccttgaaagaagagagcaaggccgtaggatcggaattcccttccggacaagacacctaccaccacccaccacccagcgcaaggccaggcggcccaggccaccactccttaccttttcccccctcttttgttccttcattcacgaatcccgtcttcttcctttcttggccttctccacctcatcgccgagacgagatctctcccacacgaggagggcagcagggaagggagagatgggcgggcgggtggatcacgagtactcctacctgttcaagatggtcctcatcggagacagcggcgtcggcaagtccaatatcctctctcgcttcacgcgcaaccacttctccctcgactccaagtccaccatcggcgtcgagttcgccaccaagtccctgcagatggacggcaaaacaataaaggctcagatctgggacacagctgggcaggaaaggtaccgtgcaattacaagtgcttactaccgtggagccgtgggagcactgcttgtgtacgacatcacaaagaggcagagcttcgacaatgttcacaggtggcttcgtgaactccgcgaccatgctgactccagtattgtgatcatgatggtcggtaacaaatctgacctaatccacctgagagctatctctgaggatgaaggcaaagcgttggctgagaaggaggggttgttcttcctcgagacatcagctatggaggctataaacgtggagcaagccttccagactatcatgacggaggtctatggcattgtcaacaggaaagcgctggctgccaaagaagcagcagctgcaactgcttcgttgccctcccagggtaaaattatcagcattgacagcactgcaggaaacacaaagagggcatgctgctctacctaaaaatgttcaaacaccacattatacagaaccttggagacaattgttggtagaaaatggagcatagtgatcacaaatggtgtggtggcaatatatactcctattctattctattctctttctttcttttctttattgtgtggcacaaaatgggggta

SEQ ID NO: 8949 - DNA, 1263 bp, Zea mays
cgaccctgtccctgcccttgaaagaagagagcaaggccgtgggatcggaattcccttccggacaagacacctaccaccacccaccacccagcgcaaggccaggcggggcggcccaggccaccactccttaccttttccccctcttttgttccttcattcacgaatcccgtcttcttcctttcttggccttctccacctcatcgccgagacgagatctctcccacacgaggaagggagagatgggcgggcgggtggatcacgagtactcctacctgttcaagatggtcctcatcggagacagcggcgtcggcaagtccaatatcctctctcgcttcacgcgcaaccacttctccctcgactccaagtccaccatcggcgtcgagttcgccaccaagtccctgcagatggacggcaaaacaataaaggctcagatctgggacacagctgggcaggaaaggtaccgtgcaattacaagtgcctactaccgtggagccgtgggagccctccttgtgtacgacatcacaaagaggcagagcttcgacaatgttcacaggtggcttcgtgaactccgcgaccatgctgactccagtattgtgatcatgatggtcggtaacaaatctgacctaatccacctgagagctatctctgaggatgaaggcaaagcgttggctgagaaggaggggttgttcttcctcgagacatcagctatggaggctataaacgtggagcaagccttccagactatcatgacggaggtctatggcattgtcaacaggaaagcgctggctgccaaagaagcagcagctgcaactgcttcgttgccctcccagggtaaaattatcagcattgacagcactgcaggaaacacaaagagggcatgctgctctacctaaaaatgttcaaacaccacattatacagaaccttggagacaattgttggtagaaaatggagcatagtgatcacaaatgatgtcgtggcaatatctactcttattctattctattctattcttttcttttctttattgtgtggacaaaatgggggtacatgcagtttagtttgttcagtgtgtgttagtcaaaagttagatattttcgttaggatccataccatttatcttctcaagttaaatgatactgcagtataactcagaatcatatagtcccaagttgctacagaattcaactgcgaatttgtgatttcatcatgcttacattcttgtaacaaaaaaaagggcggacacagaactactctgctgttcc

SEQ ID NO: 8950 - DNA, 3063 bp, Zea mays
  misc_feature (2276)..(2276): n is a, c, g, or t
  misc_feature (2364)..(2364): n is a, c, g, or t
  misc_feature (2377)..(2377): n is a, c, g, or t
  misc_feature (2779)..(2779): n is a, c, g, or t
tgaagaaaacttaaactagtttcatttttttttgattgaaaataaaccaactatgaacttttgactaaattttattacttttagaatgtagaaaactacttcaaaattggtcattagaccgaaattttctgaactgttggaggttttgtttgttatctagtttcatagtttagggctaaaagctggactgacatccaacgtgaaaacccccttttaaaattattaacgtatcactcctgttataaattataaaatatttaacttttttagagtggatgcataatgctagttgttgctaccatgataccttctctatatcatagagaaattgttctcttttgccccaggatcatatcatagcgtttggtgtagattgattgataggtcgatacgccagctactgccgctagtctgtattatgcggcatcctgtctgtcagtagagtgttaggtgaaaccaaactgtcgtcgtaatacttttcctgccattgtgattccttccatgataatgacactgtcattgccgttctattaattgtactggacacagcttctattttcgctcaggactgctggactggtaatgtttgatgtgcatttaaaccggaacaaaatctgagagcatggtttattactctagttacttacaactatgtcgctaattaagattatccttatcttctttcacacagattgacggcaaaacaataaaggctcagatctgggacacagctgggcaggaaaggtaccgtgcgattacaagcgcctactaccgtggcgccgtggccgccctgcttgtgtacgacatcacgaagaggcagagcttcgacaacgttcacaggtggcttcgtgagctccgcgaccacgctgactccagcatcgtgatcatgatggtgggcaacaaatccgacctgatccacttgagagctatctctgaggacgaaggcaaagcgttggctgagaaggaagggctgttcttcctcgagacgtcagctatggaggccatcaacgtggaggaagccttccagactattatcacggaggtgtatggcatcgtcaacaggaaagcgctggccgccaaggaagcagcagccacagctgccccattgccttcacagggcaaaaccatcagcattgacagcaatgcaggaaatacaaagaaggcatgctgctctacatgaataaaaaagatgtaacctttttaaaatatggtagaaaatggagcatatatagtcatcataaaatatggtgtggaggcgatattataactactgctattctattcttttcttttctttaatttttttttgtgtgtggacaaaatcgagtacatgcagtgtttctgaatcaaaagttagatattgtattaggattcataccttttatgttctccaagttgaatggtactactgcagaatcatagtccaatgttactgtagagttcaagtgtgaatttgtgattttatcacgcgttctaattggtaagacaattggttttgcttttaattaattgccaaggccagcggccagcaatcatgtcgtctacgctcgctgatgatgaccgacaacgttcagatcgtggtccacgagccttgatgacgtaccgcttagggtgccgtccacgcatcctgattgttctgttggtggtccgtagtgatggaatcgggatcatatttgaatgaaatcagatccggatatcatcttttaccgtattttaatttgaatacgaaaacagtaaggtcttgcatttttgtatttgcattcaaattgtgagacaagttcaaattaggaaaatagaatttggaaatagaaatagaaaataaaagagattgggaaagaaaattttaattaagttatttattcctcccataaataaataacaaggaaaataataaatattattatcataaacagtaaggtttagattcacattagtattaattttgacacttggaatctgaaattcaaaatagggatttgaatttaggttaaatgcttcaaattgaaagtagaaatagaaaaataaaagaggaaagaattcggatgggccgctactgccattattggcccatcttcctgcaccagcccactactcggtcagcccgacaccccaccacgcgcgcttctgtggccactgaacggtgggacccgcgggttgggagcttggctttgcacgcgcgagacaacgacatgcggggcccccttgtcagcagaatcgcgtgtgcatctgtgtttctgaccgatgggtctcgcggaaaggataaccagtgggcgtcntgtgcctctggtgagtgggcccatgtggccagactcttcttccctctgctgaaatcgcgcaacaaatcaaactcgttggcccgccatngccgtcgccgganatctcgaggtggccccaaacgtatatatcttataacaaagtaatgtcatgcatatcatagagataaaggagtaaaatcatcaataattgatgtgacaaataaactcttaacaatggtggttaataaactcttaatagtagtgattacctcttataatttaactcttcggttacaatcatccatattctaaaagcgagctataacatcttcatttcgaattgctttgagtaattcttgttccatgaatgtaatgatacaatcattcaaatattcatcacccatacgatttcatagatctgtcttcatgattttcattgctaaaaaacatctttccactgatgcagtggcaataggaagaaccaatacaagttttagcagttcatacgccaaaggaaaagcaanatgtttttgtatccaccatcagccttccaagttcagaaatagtatccaattgggcaaatcttgcatcagctcacaaattgtcaataaaaataggaagatcacttctaagattttttagatccctttggttaaaatcctcagggtatgccttagccaattctaccaaactctcaactttgaaagcatcaaaagaattcttgggactaaaggcagtaatgctggtaagcaattcagaatttacctcattgaagcgatcattaaattctgcaatttggaagtcaata

SEQ ID NO: 8951 - DNA, 2426 bp, Zea mays
tgtctgtcagtagtgttaggtgagaccaaactgtcgtcgtaatatttttccagcagtttaatggatggcccgtttcctctctcgtgtttcttcacaatgtgattccttcgataacactgtcattgccatcctgtaaagtactgaacagtttctattttagccaggacagctactgttgatgtggatttataaccgatgacttctcctaaatttctcatcttaataccgagcatgcaaaatcctgagcatttgtgagcactgaacatggcttattgctccagttacttgtacatcgtctaaagtttacgccggcctggcctgcacagatggacggcaaaacaataaaggctcagatctgggacacagctgggcaggaaaggtaccgtgcaattacaagtgcttactaccgtggagccgtgggagcactgcttgtgtacgacatcacaaagaggcagagcttcgacaatgttcacaggtggcttcgtgaactccgcgaccatgctgactccagtattgtgatcatgatggtcggtaacaaatctgacctaatccacctgagagctatctctgaggatgaaggcaaagcgttggctgagaaggaggggttgttcttcctcgagacatcagctatggaggctataaacgtggagcaagccttccagactatcatgacggaggtctatggcattgtcaacaggaaagcgctggctgccaaagaagcagcagctgcaactgcttcgttgccctcccagggtaaaattatcagcattgacagcactgcaggaaacacaaagagggcatgctgctctacctaaaaatgttcaaacaccacattatacagaaccttggagacaattgttggtagaaaatggagcatagtgatcacaaatgatgtggtggcaatatctactcttattctattctattctattcttttcttttctttattgtgtggacaaaatgggggtacatgcagtttagtttgttcagtgtgtgttagtcaaaagttagatattttcgttaggatccataccatttatcttctcaagttaaatgatactgcagtataactcagaatcatatagtcccaagttgctacagaattcaactgcgaatttgtgatttcatcatgcttacattctaaaaaaaaaaaaaaaaatattaagatatctttgtgcagcctactctgacaggagtttgttgcatgctggtacctaagccactcttgttccataactacagtaggtgttggaaccattgaataattagtttgtgaacagtttccatgactatattgggcagactgggcatgcctttgccctagtaaaattggtcctagtgctcgtggtattggtgtttgtcgtagcaaatggcagtattgctccctgtctagccgtcgttgccacccatgggccatggtgatgatgttcctattgcctgtagcgacgtgagtacatgccaatgacgtgtctcgactctggatggtaccggtggtgccctgtaatgtcttctgcggatgcgtggcactctgacttaaattctaggggccgatcgattgctcggatcagccttctcctttcccttgcagcttgaggccacattgaccatgttgattgggaatggattcctggcgatttccatcgggttttcgccaaaaatgagttgtccttgcttaatggtatattgtatctgttaccggagtaccttgcaaattttggtgttgtgggtgggtaaagttgtaccacttgcagtacttcctttcaactcttcagttgatggaatttggtgatcggctggcagcttgctagtttgataacactatttttttcaagggatttttatttttttaaagagaaaatgaactaattttctttggaaaaataaaaatcccttggaaaaaaatggtattgccaaaccagtccttaaagagtagatcgaaaatctgctcgaccttgattaggtcaaagttgaaacctatgggtgtctcgggcgccttgatccatgggcacgagatgtggtttgccacttggccctagtcaacaattgcgacttcggctgtgtcagctgagtcatcactttcttgttggacgtggataagagcctttctcccgaaggttgaagatggcaagtttatggttctattattcgtcatggtgttgtgcctaagagccatagctaccacaagaccctagaataatatagttaatcatagccactggttgatacgggcaaatcatatgtttgaagtacacaagaacgaagcaatgtcaaacaaaccttaaggctagcgtaggccatgcactcgctaggtcacctttgccaagactagttagccaatgcccaagcatcgaagaatgctgaagtttaccattagctctgtcaccacctttatttctagtgtttggaacatattccaaaggctcatg

SEQ ID NO: 8952 - DNA, 1097 bp, Zea mays
gggtacctccacccccccccggaagccgcaaaggccaggccaccactccttaccttttcctctcttttttttccttcattcacgaatcccttcttcttccgcagttccgccttcttcgtcgggccctcctcaccgacgagaagagatctcctcttcggcacgaggaggacagcaggggagaaagatgggcgggcgggtggatcacgagtactcttacctgttcaagatggtgctcatcggggacagcggcgtcggcaagtccaatatcctctctcgcttcacgcgcaaccacttctccctcgactccaagtccaccatcggcgtcgagttcgccaccaagtccctgcagattgacggcaaaacaataaaggctcagatctgggacacagctgggcaggaaaggtaccgtgcgattacaagcgcctactaccgtggcgccgtggccgccctgcttgtgtacgacatcacgaagaggcagagcttcgacaacgttcacaggtggcttcgtgagctccgcgaccacgctgactccagcatcgtgatcatgatggtgggcaacaaatccgacctgatccacttgagagctatctctgaggacgaaggcaaagcgttggctgagaaggaagggctgttcttcctcgagacgtcagctatggaggccatcaacgtggaggaagccttccagactattatcacggaggtgtatggcatcgtcaacaggaaagcgctggccgccaaggaagcagctgccacagctgccccattgccttcacagggcaaaaccatcagcattgacagcaatgcaggaaatacaaagaaggcatgctgctctacataaataaaaaagatgtaaccttttttaaaatatggtagaaaatggagcatatatagtcatcataaaatatggtgtggaggcgatatataactactgcttttcttttcttttcttttaccttttcttgtgggtggacaaaatcgagtacatgcagtgtttctgaatcaaaagttagatattgtattaggattcataccttttatgttctccaagttgaatggtactactgcagaatcatagtccaatgttactgtagaaaaaa

SEQ ID NO: 8953 - DNA, 1138 bp, Zea mays
acagaccacggctatcgaacagccgggttccacgaccaatccaaccgcgggggaaaaggggaaaccccacggcccggagcaacccttgggaaaatcgtcgacgccgttgagctcgaggcgaccggcggctcgccgccccgccacggcgccgctgcggcttcttctgatccctgtggctcagcgcggagggttaaatggcaaatagagcaagatggatgatgaagtacgaaaagggtcttgttgatatacttcatgagaacaatacttcacattatcgtacccaaaacggttggagaacagaggggtggaggaagatcgttagggatttcaatgtaaggtaccccgaagcaaagtttagtaaaatgcaaatccaggaacatgagactcaattgaagaaagactataagttgataaaatctatcctccaacgtgatggtgtctcatgggaccagagtgcatccatggttagaacaacagatgaaatctgggatgagataatcgaggatatgcccaaggcacggaagtaccaaagtaagagctttccattgctcgactcactagaactgttatttgatggtcctattcctgaagggggacagaaatcgccttccagcgtacctcagaatggtggtgaaaatgttgacgatggaggcaacaataccagcacagtcccagcaaacagcattaggacctcaaggcatagatgatctcgacacgctgcaaaaacgcggcgaagaggtgctggaacggctacagcatggcgcggaccgaaggctaccgagagctgatgaccaggcgcagtcgagttcttgtgtagaactgcagagggacaggcgcaagaagcggaaggccccggacgtccagcagatgatggagacctatttgaatttcaggatgaagcaagctcacgtcaaagaacaaagagcgaaggacgctggccagttcacgatttcaggctgtatcaaggctctgcacaccatggccgatgtgtcagacgaggtcaaggtgttagcctctgatgttttcaaggacgctgagaacagggagatctttctctcctatgaacccaggctgcgcagcttgtggctgaagagggaagttggcaagctactctcctgatagtggtgttttgtttgtt

SEQ ID NO: 8954 - DNA, 888 bp, Zea mays
gaccaacccaaccgtgggggtgccgggtgccctacggcctacgggccggagcagcgcttgggagccgcggcacggaggcatcgacgccgttgagctcgaggcgaccggcggctggcggccccgccacagcgttgctgtggcagtgtggcttcttctggtttctgcgggctcagcgcggaggcctattgcaggattaaatggcaaatagggcaagatggatgatgaagtacgaaaagggtcttgttgatatacttcatgagaacaacacttcacattatcgtacccaaaacggttggagaacagaggggtggaggaaaattgttagggatttcaatgtacggtaccctgaagcaaagtttagtaaaatgcaaatccaggaacatgagactcaattgaagaaagactacaggtcgataaaatatatcctccaacgtgatggtgtctcgtgggaccagagtgcgtccatgtttagaacaacagatgaaatctgggatgagattatcgaggatatgcccaaggcacggaagtaccaaagcaagagctttccattgcttgactcactagaaccgttatttgatggtcctattcctgaaggggcacaaaaatcaccttccagcatacctcagaatgttggtggaaacgttggtgatggaggcaacaatatcagcacagtcccagacttgtctgaaagacctagtggaacaattaacacaagcgttaatgaggcatggaataatatcagcctacttaagcaaacagcattgggaccccaaggtatagacaatctcgattctcgacacgctgcaaaatcgtgataaagaggtgctggaacggctacagcatggctcggaccggaggccgaagagagcggatgaacaggcacagtca

SEQ ID NO: 8955 - DNA, 1932 bp, Zea mays
ttcgaggcgaccggcggctcgccgccccgccacagcgccgctgcgatttcttctgatccctgtggctcagcgcggagttttctttattggcttattacagggttaaatggcaaatagagcaagatggatgatgaagtacgaaaagggtcttgttgatatacttcatgagaacaatacttcacattatcgtacccaaaacggttggagaacggaggggtggaggaaaatcgttagggatttcaatgtaaggtaccccgaagcaaagtttagtaaaatgcaaatccaggaacatgagactcaattgaagaaagactataagttgataaaatctatcctccaacgtgatggtgtctcatgggaccagagtgcatccatggttagaacaacagatgaaatctgggatgagataatcgaggatatgcccaaggcacggaagtaccaaagtaagagctttccattgctcgactcactagaactgttatttgatggtcctattcctgaagggggacagaaatcgccttccagcgtacctcagaatgttggtgaaaatgttgacgatggaggcaacaataccagcacagtcccaggtttgtctgaaagacctagtggaacgtttaacacaagcgttactgaggcatggaataatatcagcctactccagcaaacagcattaggacctcaaggcatagatgatctcgacacgctgcaaaaacgcggcgaagaggtgctggaacggctacagcatggcgcggaccgaaggctaccgagagctgatgaccaggcgcagtcgagttccttgtgtagaactgcagagggacaggcgcaagaagcggaaggccccggacgtccagcagatgatggagacctatttgaatttcaggatgaagcaagctcacgtcaaagaacaaagagcgaaggacgctgaccagttcacgatttcaggctgtatcaaggctctgcacaccatggccgatgtgtcagacgaggtcaaggtgttagcctctgatgttttcaaggacgctgagaacagggagatctttctctcctatgaacccaggctgcgcagcttgtggctgaagagggaagttggcaagctactctcctgatagtggtgttttgtttgttacctgtgtcagtgagtcagtctgacattcgattctggagggagctattgaaggtctaggcttcattcacaaactctattaaaccatctccgtcagtttgagagaacactcccctttttcctaaaacctgccatatattggggaattaggtgaaaagagccgctccagcatatcctatctcaatcatctttttctatatttttcaatccatcacaacatctcctcgatccctaagaaatattcgttttaaccttaatccacgtgcattggacaagacgtcgtctttttccttaattctctttctgtcactgacgcaccgccgccgtcgccaaagtgagaagcggagagagaggaaggtggttttacacattctcaagtaggtcaagtaggtcctgtccaaatcttgtttatgtactctagtatttatctcaattcacatgtattaagctggattgaagtataaatttccacctcaatcaacttcatatatatagaatgaggtgaatactagagtaaccaaataaaccctaaaaggatttacacattttccgtctgggccaacacaccctattgaaaaatgccacagaatgatcgtttcctgacaaaaagaaaaggtagaattgttctaccattgtgctcaagaaaaaaacgatagcccagcgtcaccctaaaaccaccacaccatgatatctagacatgacagtgggtatgggtatatgcaaataactacgagtaattatatcaggtatggatatttgagaattttatatctacggctacggatatgaatataataagatatctgcag

SEQ ID NO: 8956 - DNA, 1356 bp, Zea mays
ggccgcttttttttttttttttttcttttttttttttttttttttttttaaaattcagtgggtactcttcatttttttcgtaacaggtcgaatctaaagtacaagcactgaaacgaagtatcagcacattctaaatctcactcaacaaccaagacacccgaaaccaacaggatactacaaactgccggcccgcggacctgactgcacacattcaaaaatcaaaaccatatcaaaatgtgaaaactaaccaggaaaaagagcctatcatcattatactatatacacgcaagcattgtccccttatcaggggcttcctcttgtctgctactgactgaagaggaacataacatctattctctgccctagaactccattcttttgtctaaactcaaaacgaattttccttgtgaaacgatccttatgtgcagaggagtaccatacatcacgattcacggctcagactcaggtcctgacttggaaaaatcctggggcttactgcttgcaaatgccaaccatacaacagtaccagttaagtaaaagaagatagaaggcgcaaagagtgatatactccaagaatgagttgaatcaagaagaaagcctgtgagtgcaacgcctacaattcctggcaccgcgcctacagtgtttgtgattcccaggagaatgcttgcatattcactagagatgtcttgatgtgtgcaataaagccctgacaatgcgaagctggagagtgctacaccacttgtaagaaaagcaacaatttcccagggaggcagtccaagatccacagaggaaagcatcatgaaagtcgcaggtgacacaaaggcaattgtttggcaaatttttcgcaccttcgtggtgtcaactccatttgatatcaagttgtctgcaaaaggtgctgcaatagatgtaatgatcattgaacccaaaggaggaaggactgacacccatgctgcttctgtcaagttcaggttcagctcctcgctaaagaatgtcggtagccaagacaaacaagtataatgcccccaacttccacaaaagtgtgcatatatcattgcccacaccgccttgcttttgaaaaatgccccccaaggcacatcctttagtgaattttgcagatcttccaatgacgagtgtgatgattccgaagacatagcatatgagataagaccatcagatccagtagaactttgtccaagatttaataggctttttttgtcaccgaaccgttgcactataagagattcaaatcctaagcaccaaacaatcccaagaaggccaaatatgtaaaagacagactcccagccaaagttctgaatgatgggaggggcaaacaggagtcctcccgcccggccaaag

SEQ ID NO: 8957 - DNA, 1635 bp, Zea mays
accccgacaacaacaagttttactaggtattttataaaaaataatttaaagttagtttgtatttcgggagttctttgtttgagtggcacaggcctaaaatacctccaaggacagaggacactgctttgcgtgatacacacttcacccatggctagtattgtgaaggtctttcatgtgcatagtattcataaactggccatgatcagacccccaccccccccaccccccgcgtccatggcagcagaaccaagccttattgggtgagggcagtctatgtcattatattccctctccgatccatggttaccatataattggatctgcatttctgctgatatgttggcaaaacaaaattgtcaactaaaaagcttggtgaaagactgacataaatagaattgcattactgaagtgataagctcctgttgaagatttaggtaggaaaaaagaaatataagattttggtggatgaagtaatatagttctgtgcagttagttggtcaactgttatttccacttcattccagaatccagaggctgcaagatctgctctacctagataaaattatgacccttttgacataaattatttgaactggggtaacaacaggtggaactggaagctgcaaaatcagaaatcgagaagtggcattcagcatttcagagcattccagctgtaccttctggtaccattccagatcctgtttcagtggtgtcttacctcagtaccctgaagtcatcagaggaatcattgaaggagcagctggagaaagcaaagaaaagggaggcagctctcgtggccgcccgggccgggcgagagcaggagattgcagaactgaagtctgcagttagagatttaaaaacacaattaaggccaccatcaatgcagacaaggagattattgcttgatccagcaattcatgaggaatttacacgtttaaagaatcatgtggaggagaaagagaaaaaaataaaggagctacaggacaatgttgctgctgtcaattttactccatccagcaaactggggaaaatgctaatggctaaatgtagaacattgcaagaggaaaatgaagagattggggcgatggcatcagaaggaaaaatccatgagcttggaatgaaaattgcagttcttaagtctcagaacaatgagctcaggaatcaatttgatgttttgtacaaacacatggatggtgtaacaaatgatgtggagagatcaaacgaactggtgtccatcctgcaagaggagttagaagctaaggatctagagctgactagattgaaggaggcgcttgcccagaaagaagctactcaggacgcaccggtggagaccagtgacgacgctggaaatggtcaggaggcagattcagatacactgcaagtgaaggcggaaagctaagggagtttaggctttgaagtgtgtttgttgggacttgtgggaaaagtaatatcatggtatgcggtctcatagcatgtctaggttattatatagtagggggatcactgcacaaaaacatcggcaaacttttatctatgatcgtacatatggctttacaaaagattattttgcattgtagacaacactattatagtgtggattttgaaattagatatataataataatatagatgagt

SEQ ID NO: 8958 - DNA, 1402 bp, Zea mays
aaaacattgggtacctcgaggccggccggataatgcttcattacgtgaaccaatactacgtagctgcctgtgcctctttctggctccctgctgtctgcctggccggtgctcacagacacgcgcaagatggccggacgcacggaggaggctcgcaggagcggggagagggagacggtgtgcgtgacgggcgccggcgggtacatcgcctcatggctcgtcaagctcctcctctcccgcggctacgccgtgcacgccaccgtccgtgacccgcgtgatcccaagaacgcccacctggggcagctggaatgggccgcggagaatctccggctgttcaaggccgacgtgctcgacagcgacgcgctggctgccgcagtctccgggtgccggggggtcttccatgttgcctgtccggtgcccacggatagggttcttgatccggagtcagaagtactggctcctgctgtgcaaggtaccttaaacattcttcaggcttgctcagctaataatattcagaaggttgttgtggtttcgtctaccgccgctgttcatttcgacccaaattggcctccacatagacctaaagacgaggattgctggtcggacataaacttttgcaaaaagaacgaggactggtatatggttgccaaggttattgctgaaaagacagccctagaatacggagagagaaatggattaaatgttgttacagtttgccctactatggctttaggaccgctcttgcggcctatgctcaatgtcagccatgaattcctcatgtacattattaaaggaggtcctactatgatgaagaacattccatggcacatagttgatgtccgagatgtggttgatgctttgcttatggtatacaagaaagaggaatcgacagggagatacatctgtgcaccaaattgcatcagtgcaaaagatctggtgaacatgctgaagagggattatcctaattacaattatgtaaactgcgacaatgatatggtgcttaactctatagttacaccacttatgtcggagaaactgaagaatttgggctggaaaccaatgaagacactagaggaaacattattggatagtgttgaatgctataagaagatggggcttctaaaagatgctgagggatgcccttgtcgtcttcctcacctttttcatatggctatagaaaaatgaagaatactcaccattgcttcttgtgttacctaattactctttgaacattgttgggtatgtgttctaatcacacaccaataatgttgacattcaatgggttgtggttgatttgaaataaatgtttggtttcttatgtaatctatatggaacaaagtgcacctttcactttttttgtatggaagttgtcatgcatcttttttctcgaaaaaaaaaaaaaaaa

SEQ ID NO: 8959 - DNA, 1955 bp, Zea mays
ggaaagccggggccccccccggccggccgggccggtactccccaagtccccatcgggcatcggcgctgccacgccacggccgacgcttgagacgctccccgccgcctgccaggccgccaccgcgcgtgacttcgcctcatcctctccggagatggacttccaggtcgtcgtcctcgccggaggcacctccgagaaactctcgcccctcgtttccaaggacgttcccaaggcgttgctcccggtcgccaatcgccccgtactctcttacgcgctggacctccttgaggccagcgacctcaaggacctcatcgtggtggttgaggggcaggaggcagcgcagcttgtcgacgcttgggtatccagtgcgtacctggatcggcttcgagtggaggtagttgtggtttctgaagaccttggaagtgctggtgcattacgagctatttcaaagcgactgatggcaaacgatattttggtagttagcggtgacctggtaacagatgtgttgcctggggctgttgctgctactcatagaagaaatggtgctgctgttactgctttactatgttctgttcctgtcagtggtccttcagacacttcttcttctagtgggaaagataaagctaaaaagccaaatcgtttgaacatagtaggactggacaggagtaaacaattcttgttacatattgtgtcaggaactgatgttgaaaaagatattcaagttcataaaagaaaaatacaggctgttggtcagatggaaattcgaagtgacctaatggatgcacatctttatgcttttaagaggacaatattacaggacgtactggaacaaaaggaagcataccgtagcattagacttgaagtcctcccgtatttagttaggagtcaattgagatcaactccatcaggtggcagtggaacatcagttgacgaaattgagagtagtgcctttcagtccagtggtaatttgcagtgtttgtcgcagcatcgggtcattgcaccatctgctttcaagcaggatgtattatcaagatcaagtggtggacataggtgctgtgcttatattgctagtaaaagcaaatactgtcaccgcttgaactcaatccagtcatattgtgatatcaatcgagatgttataggggaagttagccacctgtctggttattcgttttctgcacaaaacaatattatccacccatcctctgttcttggatcaaagactacaataggaccacactgtattcttgctgagggttcacagcttggtgacaagtgtagtgtgaagcgatctgtgattggtcgtcattgccgaattggttccaatgtaaagatcgtcaactctgttgtgatgaatcatgttgttattgaagatggttgccacatccaaggttctgttgtatgtaataatgttcaactgcaagaacgggcagttctgaaagattgccaggttggagctggttatattgtgactgctggcagcgagcacaaagcagaatccctagcaagaaagtacagtgagctttgactggtttgttagatcctgaatgttttttttttgtgttcacttgagatgcaccccctcagaaaaaagggtagcagttgtccaaattttataaaatgtcattatgtacaacagcacagttcagtgcgaaaggtttggttgcttatctttcctaccaggcggcttgttagagcgaaaggtttggtcgcctatctatcctaccagctgcttgagcaagttgcatgctgtctgaggacgatgggttgatagttggggcatgtagttgggacctactattgtcggaaattctggattcggtttctcttccgccttgtgtttttgtgaggccaggtgattgcctcttttaccccttaggtcctcttaggaccacaggtttcttgaaatgcatgaataggaaaaatgcaggaatagaatgcgtaacatcttgaatcctacg

SEQ ID NO: 8960 - DNA, 1252 bp, Zea mays
ctcccgcccggccggccgcgctcttttcccgcagccgcagcaaggccccagcggcggcacggcgcagtggcgcaccctctggagtcaccttcttcctgcccaatacggccagcggcggcaccccgaccaggttgaccccgccccggcaacgaccagcgggtcgtacagcacgccgatccaattcctccgtgaaggtcgataaactgtgagatactgagattgaagctgcacactgttttagtttcttcaaggacaaggaacattaatatcaccaagtactttcgtcaatgaagcttgaagctgatttcgctgatgaagatgtcagttcaaataatggattacaagatctgtggtcacttgacgagatagatccaaagagagcaagattcccgtgctgcattgtttggactcctcttcctgtagtttcatggcttgccccttacataggacatgttggaatctgtcaggaggatggggctatcttggattttgctggttcaaatttggtgagcatggataattttgcttatggttcagttgccagatacctccagcttgacagaaagaagtgctgccttcctgttaatcttgcagcacatgtatgcaagcagtcctacagccattcagaagttggagcagcgatatcatgggatgatgctctgcgatcgggcatgagacgcttccagcacaagtactacaatctgttcacctgcaattgccactcgtttgtggcaaactgcctgaaccggctcgcttacaatggctctgtggagtggaatgttttgaatgtggcttcccttgtttggtttcatggccaatgggtggacaaaatgtctttcgctcggtctttcttgcctttcctaactgtgacatgcatcggtattttaatggctggctggtctttcctggtagggatggcagcattctctgttcttttgattggatggtttgttttaacggtatactgcgttaagggtttgatatgttgaccggagaagaattactgaaagcactcattagcgcattgcagtctacaaattatggatgtaatcgctgtgctagattcaattaaataattgatgtcatcagcctcagtgattctaaaaaaaaaaaaaaaacaccaatttattttgacttatggagggcggtctcgtgaaaaatttagttaatgggcgtgctcattggcctcaaaacttgtttctgcaattgcatggcctaacacaaaggtgggtcaatttattttgatctgcaa

SEQ ID NO: 8961 - DNA, 1496 bp, Zea mays
aactttgaatcctccatgggagaggcaagaggaaagggcaacccaaaagacgatgcaaatgaaggtaacatttgtaggcgtcgtagcttggttttgcttcacgagcacaacaagccatccatctatcccgctccctccatccgcaagcaaaagctaatcgatcttcccatgatctccttcaattgctactaataaactataatagaatcagttacctcagttgctcgtatagggcatgttctccaagctactccgtccccgcccgtccaaattgcaaataaaactgcaatctcgcagcggctgatggattagcaagcaggacaagagactgagatccatcctccagacacgcgcacgccaaggatcgcattcgccaagcaacgtcgggtcggcggcgcgggggcgatggagacgcggcggccgcggcgcggctggaacaaacgcttcgtcctcccgctcgcgctcctctgcctcgccgtgctgctccccggcgcgctgctcccgccgtccgcctcggcgtcgtcttcgtcgccggccgcgggaggtggcagcaggaaacgccggtgggttgggtttgactactatgtactggcgctgcagtggccgggcaccatctgccgcgagaccagcaactgctgcgacaccaatggctgctgccgatcacagcctctcaagtggttcacgattcatggtctttggccacagtacaactatgggggctggccatcatgctgcagaccaaccagattcaacataaataagatcttaatgttgatgccgatactcgagaagtactggccgtccttgtactgtggttcttcttcaacctgctttggtggaagggggccattttgggtgcatgagtgggaaactcatgggacctgtgcttaccctgaaatacaggatgaatatgactacttctccacagcactgtatctctacagcaaatacaatgttacgaaagctctgagaaaagcacgtatccggcctacaagcggcagaaaatacgccgttggccatattgttgccgtcattgaatatgcgtttggggcaatgccgtcactcgtctgtaagaacggctcagttcaagaactcaggctctgcttccacaaggattatcagcctcgtgattgcacgcttgaggccggctctgcaccgaacggcagaagctactgccctcgctacgtcacgttcccgtcgtataaaccgtccgtggtggccaatactacggaggggatcaacaaccaatccaatggcgaggttccgagctacatgcgtacgtctgactctgagtagcgtccaggactccaggttctgtgggcctctgccgagccgagtttgtatcaaatatcaatagagcgagacgccacggcgtgcttgcaaaattaccggcccggtatggtcctgtataattctttcattcacagtatcgaatgactggcccccgcgccccgggatttggaaatgaaatgtgaatgttaatgtatattatattc

SEQ ID NO: 8962 - DNA, 1186 bp, Zea mays
gcacgcaaggatcgcattcgccaagcaacgtcgggtcggcggcgcgggggcgatggagacgcggcggccgcggcgcggctggaacaaacgcttcgtcctcccgctcgcgctcctctgcctcgccgtgctgctccccggcgcgctgctcccgccgtccgcctcggcgtcgtcttcgtcgccggccgcgggaggtggcagcaggaaacgccggtgggttgggtttgactactatgtactggcgctgcagtggccgggcaccatctgccgcgagaccagcaactgctgcgacaccaatggctgctgccgatcacagcctctcaagtggttcacgattcatggtctttggccacagtacaactatgggggctggccatcatgctgcagaccaaccagattcaacataaataagatcttaatgttgatgccgatactcgagaagtactggccgtccttgtactgtggttcttcttcaacctgctttggtggaagggggccattttgggtgcatgagtgggaaactcatgggacttgtgcttaccctgaaatacaggatgaatatgactacttctccacagcactgtatctctacagcaaatacaatgttacgaaagctctgagaaaagcacgtatccggcctacaagcggcagaaaatacgccgttggccatattgttgctgtcattgaatatgcatttggggcaatgccgtcactcgtctgtaagaacggctcagttcaagaactcaggctctgcttccacaaggattatcagcctcgtgattgcacgcttgaggccggctctgcaccgaacggcagaagctactgccctcgctacgtcacgttcccgtcgtataaaccgtccgtggtggccaatactacggaggggatcaacaaccaatccaatggcgaggttccgagctacatgcgtacgtctgactctgagtagcgtccaggactccaggttgtgggcctctgccgagccgagtttgtatcaatagagcgagacgccacggcgtgcttgcaaaattaccggcccggtatggtcctgtataattcttttattcacagtatcaaatgactggccaccgcgcaccgggatttggaaatgaaatgtgaatgttaatggatattaaaaaaaaaaaaaacgaacacgtgcgtacacaaaaaaaaaaaaaaaaaaaggccccta

SEQ ID NO: 8963 - DNA, 1565 bp, Zea mays
gcggatcagtccgtctcgggcgcagcgaactctgcgcttccacttctctctccaccgtccctttacccaaccaaccaccgcactggtacgctctcgactctcgacaccggcagcagcaggaggtggagctagggcatgtgatcggactccttgcctgcttcctgatctcaacctcttttcaccagcgcgagggcggcgcggtctcaagccgggatggggtatctgccggcgctgggcgggaaggcggcccacctggtgaacgacctcgccactgtcatcctgaaccccgtctccgagcgcgagcgccagccacaccaccccacccacctcccggaggccactgaaggagaagacacactattcgttgacgatgattctgaccaaaattctgatggtcctgacacatcttcattcagagcatttctgatgtcctttgtgccttcctcaactgccagcaagaattcaatggagaccatacctgagcataatctagatgtggaatacccaactttaacacctgttgggaaggcgtgcagtgggaggaaaggcctgtttagtagagggaagcattcccttggtaggattattagcaaagcaggacttggtaatttgagacagaaacagacccacagcattgatggtgaaatcataggccaaaccgaatcagttgcacctagatttgaagtgaagggttcaaaagaatcaactttgcacgataaattgccagctatgtctgaaccttctcttcttctgacagaaatgatgcgagctgttctttatacatctcttcctgtacttgttcaaggaaggaactggatgctggtatatagcacctggaggcatggaatatctttgtctactctgtatcgaagaagcaggctttgtgctggctactcacttttgatagttggggatcgaagaggggcagtttttggtggcttggtcgaggccccactgcaacctatcgtaaaaaggaagtatcagggaactaatgactgctttgtgttcaccaacgtagatggttgtcctgttatatgccatccaacaggtgctaataactattttacattttgctctaccgattatatggcaatgggaggtggtggtcacttcgcactttatctcgatggagaccttatgactggttctagctccacctccgagacttttaacaacccatgcttatcccatacccaggaattcaaaatcaaagatgtcgagctgtggggtttcgtcaatgcttccaagtttgaagagatgctcatgatctgccgcaccgaaaagcaaggaatttggaacctgtgaccgtttggagttcactgagctgttgcttgttggtgtcaaccgatcctctgatgtggcttgtactgttgtacagttttgtagtaaacgtttgtatagcatgtagagagtttccatatggaatcagaagttgagaacatgtagagttttgctttgtagaataccaaatgccatttacagagaaaataccagtcactaacactcaaatgtatatatttcatagaaactaagaatgccctgcctacgttgcagatggaagtttt

SEQ ID NO: 8964 - DNA, 1210 bp, Zea mays
ggccgtggcgctcctcgtcctctgctaccggtccagcagcgtggtcaccgtcaggccctgggcgacggggctcagcgggcagctgcagaaggcgttcgtcacgggcgtgccgtcgctcaagaggtcggagctcgaggccgcgtgcgaggacttcagcaacgtcatcggctccctgtcggattacatggtgtataaggggacgctgtccaccggcgtggagatcgccgtggtgtccaccaccaagaactctgccaaggagtggtccaagcactgcgagtcacatcgcggcgagcccgcgtccggcctgtccagagtgaaccacaagaacttcgtcaacctgctgggctactgccaggaagagcagccgtttacgaggatgatggtgttcgagtacgctccaaacggcacgctcttcgagcatctgcacgtcagagaagacggttacctggactggccgactcgcctgcgcgtggcggtcggcgtcgcctactgcctggagcacatgcaccagctgagcccgccggagatcctgcgggcgctggacacgtccaccatctgcctcaccgacgacttcgccgccaagatctccgacgtcttcttctgcgacgagccccgccggcaggaggggagcctgtccctgtcggcgctgtcggaccgggagagcgtggtgtacagctacgggatggtgctgctggagaccatgaccggccggttcacggcgtccgacggcggcctgctagaggcctgggccgcggcctacctgagaggggagcggcagctccgggacgtgatggaccccgccctgcggaggtccttccacgccgccaccgtggacaggctggacggcgtcatcaggggctgcacccaccgggagcccaggaggcggctgaccatagcggaggtcgccaagcgcctgagggagatcactgccatgtcacccgacgcggccacccccaaggtttcgccgctgtggtgggcggagctggagatcatctgcgcagaggtcaactgaggtcaacctgagacggacgtgccaatgtttgtcgtgaaaaggctgtttcgtggtagatacacaggttgcttctttttgatatttttattttttaggtttatgttgaagtttgtgtccatctgtacatatgaacaaaatgaagtgtgcaaccaagctgattgttttaaaatattattttaataattaattattaaaaag

SEQ ID NO: 8965 - DNA, 1325 bp, Zea mays
gcagaaagatggatgcatggcacaataatgtagaacgcgcaatctatcgtacatcagattgctcatacaaaggtaactagcatctacatataccttacagaagtgctaaaacccagtgagaaaaactgcgagagaaacatatccgtggccagtccttcaagagccaccagaaagactgtcttctagcaagcggtgagcttcgcgatctcatcaagcaagtacttggactcagctgcgaagtcgaccggtgcttcacccctcacggggattctctgcctcttctcgttcatgtattcatgctgtgtgacactgacgcggaacaggtgaggaacccaggtggcttccttgagcttgagaacgtagctgtcgtccccctcctctttcctgatccgatcaagctcgtcggcgctgcagccaatgatcttctctgcatgctcattgaacacagacacccaagcctcgccagtgggatcggagagcttgatcaccatgatgtatctcagcgagcactcagagtaattcttttggcacccctcgcaccagtatccagacccaaaagcttcagtcaccttcttgttacaggtcgtgcaagcacggtaccacatattctgatcaggcttgatgtggcttatgatggcatacagactgaagaaaacaggcttttcctggcccatagcaggatcactggtgatgtgagacagaaaaactctatcagaatacatggacttgaaaccaccagcgcgtgtggcacccacttctgcactgattggtgccagtgaagtatctttgccttcagagtcataccaggacttcagattcttagcctcaggcaggtcaggattaatctcgagagtacttctgccaatagttgaaagagacacgccttggaagtcagatacttttaggctctttatcgcaacaacaggcgaactgtcaaccatgtccaaaagctcttggccagtcgtagtagcaagatcattccagagagaaatagtaacagttttgccagagtcatctgctacaacaatgtcacgcttcggtattgtctcgttgtcaatctttctcctaacactgagtgtgggagatacgctctgaaccacaccaacaatatctacaagctccctgccaccgacgtatggtcctagctgatcaatcttgacaaggttgtattgcactggtggaaggaaagtctccccctctgcttcttcaacaatagcattctcgtttagtgacaactcatagtcatttttgactgtcttgaactgcttgttggcaattctaagagatccttttgagacacgcgtacctcggccgcgaccacgcta

SEQ ID NO: 8966 - DNA, 1340 bp, Zea mays
  misc_feature (1338)..(1338): n is a, c, g, or t
  misc_feature (1340)..(1340): n is a, c, g, or t
cgggatacatgtcggggaaaagactgaatacgtggcacaacgatgcagatcgagcaatttatcttgtcttaaagcagggaatggttaaaaacttccgactcctggtagagagctattaagcagggaatggttaaatacatctgactgctgatagatgactattagagcagggaatggttaatacatctgactgctgatacatagctaaagcttagggccgcaatgacctgacaccatcaattagtcctaataatcctcgctatttgcagtaaggttgcatcttctactatcaagcagtaagcttcgctatctgttcaagcaggtacttggattcagctgcgtgctcgaccggcgcttcactcctcacagtgattctctgccttttctcgttattgtattcatgctgtgtgacgctgacgcggaacaggtgaggaacccaggtggcttccttgagcttcagaacataactgtcgtccccctcctctttcctgatccgatcaagctcgtcggcgctgcagccaatgatcttctctgcatgctcgttgaacacagagaaccatgcctcgccagtaggatcggagaccttgatgaccatgatgtatctcagtgagcattccgagtcattcttttggcatccctcacaccagtatccagatccaaaagtttcagtcaccttcttgttgcaggtcttgcaagcacggtaccacatgttctggtcaggcttgatgtggcttatggtggcatacaaactgaagaaaacaggcttttcctggcccatggcaggatcactagtaatgtgagacagaaaaactctatcagaatacgtggacttgaagccaccggcccgtgcggcacccatttctgcaccaattggtgccagcgaagtatctttgccttcagagtcataccatgacttgagattctgagcctcgtgtagatcaggattaatcgcaagagtacttttgcctacagtagaaagagacacgccttgaaagtcagacacttttaggctctttatcgcaacaacaggcgaactgtcagccatgtccaaaagctcttgcccagtcgtagtagcaagatcattccaaagagagatactaacagttttgccagagtcatccgccacaacaatgtcacgcttcggtattgtctcgttgtcaatctttctcctgacactgagtgtgggagatacgctctgaaccacaccaacaatatctacaagctccctgccaccgacatatgatcctagctgatcaatcttgacaaggttgtattgcacttgcggaatgcaagtctccccctctgcttcttcaacaatagcattctcgtttagtgacngn

SEQ ID NO: 8967 - DNA, 4189 bp, Zea mays
  misc_feature (46)..(46): n is a, c, g, or t
gtcctatttgagtgtccatttggatgttcgatattggagagaatgnaatgaattgagttgaatactaaatcatgcataatattgaaatgagatgtaattacagttatattgtttggatgttactaaattagagttgaaattgtgtggtctaattctacgcaataccgaggggtgacgctttgtattgagaggaggatttctagttatagtccaattccaattaattgagcctctgattcaaaatctcaattccacgtacaaccaaacaacaaaatttaaaaaagcttattccaattctcaattctgtgcttcaataatagactcatcggacacgcacaacacgtctagtcgacgcaaccaaacacaaccttaaatactaaaatagaataaaatacagggactaaacagtagtccataaaaaccaaacacttgttagctgcagcgacctaacatcatcaatcagtactcataatcttttcctatttgctcaaagttgcagatacacggaattggaactgcaattttgcaaggcttatcatagcatctgttccttgacaccaaggtaatctagcatctacatataccttacagaagtgctaaaacccagtgagagcaacacacagaacagtaatcaagttactggagctcaaaagaaaaactgcgagggagacatcgggggccagtccttcaagaaccaccagaaagactgcgtcttctagcaagcggtgagcttcgcgatctcttcaagcaagtacttggactcagctgcgaagtcgaccggtgcttcacccctcacggtgattctctgcctcttctcgttcatgtattcatgctgcgtgacgctgacacggaacaggtgaggaacccaggtggcttccttgagcttgagaacgtagctgtcgtccccctcctgcaaacaaacggcgagcccactgtcaggggcaaggcaaacaaagaaacagaagaaatccaatgctgtcagtccggagtattgaatttacctctttcctgatccgatcaagctcgtcggcgctgcagcccgtgatcttctctgcatgctcattgaacacagacacccaagcctcgccagtgggatcggagagcttgatcaccatgatgtatctgaaggacgcagagaaacaatcagatttgacaccaaatagataacggtagcagccttgtgctaacggcttttacctcagcgagcactcagagtaattcttttggcacccctcgcaccagtatccagacccaaaagcttcagtcaccttcttgttacaggtcgtgcaagcacggtaccacatattctgatcaggcttgatgtggcttatgatggcgtacagactgaagaaaacaggctgcaagggaaaaacaagaagtcgaattggagcttctccagatttgcaattcttccattaaagatacgaacagtgtcatatttcagtgaatattcaggatcgtaccttttcctggcccatagcaggatcactggtgatgtgagacagaaaaactctatcagaatacatggacttgaaaccaccagcgcgtgtggcacccacttctgcactgattggtgccagtgaagtatctttgccttcagagtcatacctattcgacaaatcatacacgagtctaagcatacctatagtggttaaaataatacaacaagcacatgtcattcaggagagaaacactaccaggacttcagattcttagcctcaggcaggtcaggattaatctcgagagtacttctgccaatagttgaaagagatacgcctacaacacaaatttcagcaacacagttatcacgacacactttcagtaactcactttttccaggaagaagattgaacagagattagatgatgtaccttggaagtcagatacttttaggctctttatcgcaacaacaggcgaactgtcaaccatgtccaaaagctcttggccagtcgtagtagcaagatcattccagagagaaatagtaacagttttgccactacaagaaatgaaatgagtcaattaggagcaattatttgactattagagaatccataagaaacatcactgaatgattgtattctatgctatcgacaagttaaaagatcaagtgatacttacgagtcatctgctacaacaatatcacgcttcggtattgtctcgttgtcaatctttctcctaacactgagtgtgggagatacgctctgaaccacaccaacaatatctgaagtataatacataaaacagtgagacactacaccaaacctgaaataaaaccaactggattcaaataattctgacatacctacaagctccctgccaccgacgtatggtcctagctgatcaatcttgacaaggttgtattgcactggtggaaggaaagtctccccctctgcttcttcaacaatagcattctcgtttagtgacaactcatagtcatttttgactgtcttgaactgcttgttggcaattctaagagatccttttgagacataatagacctttcccagctcaaaaattggatagaacttctttgcagcctcgttaaacatggtggcctggatctgggtgccctgtgcatacacaaattcagagaacatcagctcatgaacccatgcactaaacatgagtgcaatgcgatcagagcacttacatcctcatcagtaagttctacgttgaagacgcagccttctccacgagcattcctgtaggttctgagattgcctttgctcgtgacccgcaccttaatgacccagttaccctggtaggggttcagagtgatcaagggatggaccctccttgtcatggaaaggcgcgtggcaggagcagcactgcacgaaaagaaggacaacaatgaactgtaaatccaatcgctcccctggaccaaccagaacatcacaatacaggacggctggactgaaattgcaggcacttactttccacgctgctcagtcacgatctgggacgcggtcttcacctcttgcttaggcttcatcacgagtgggggagaatttgtttcctcagccacgactgagccttcgtctttaggcttcagcacaattggaggatcctctttcttggcctcgccgttgatctcggcatcgagcgcttcgcacacagtctcgcatttgacgacaatcaggactctggtaaacaaacacagtgattcaggaaaacaagggaaacgctgaatacgagaacagttgccaacgttagcccgctcatggtgacgaaaaaaaaggatggagaacacttacttgtcagcgttgcctttgacggagttgcaagtgtagtcgaggatgcggatgagaccgaaattcttcagattgccggagtggacctccgacgcaaagtaagtggggagcatcgccttgattttgtcgttcccatcggttgccgtgaaactgcaaggcaacaacggatccaaacccaagtgggggctcgtcagattggctgacaaaaacatgtgaaccgcgctaagaacagaacagatccgccgccccacggaatgaaaaccagcaagatactacattcagtgaggccagggaagtgggtcggtggccgcgcacctgaaccggctgcccatgccgatggacttgagatcgaggacctgaacgacgagatccgacacggcgccatcggagcccgtagacgggtgcgccaggatgtaggacacggcgcccggcgtcaccgacttggcagcgtccatggcgcctctgctacctttgctctccctggcgaatcgtcccgcggaggcgagaaggtttctcgtggatcggtggggggccggcgggcgtgggcgagcgttgagcggaggcgaagatgcgtcgagctgccaaggctacgcgcgcttataatatgataaggtagatttgggaaggaaatggcgggaggcgagcggcgctcgaggttttgcgcgttttttagccttgccgccgcggggttcgctgctaatgtagtttcgttttggctccggtctggcgctcgcgcgggaaatattttagaagttttggcgccggggaaggaggcgggcgcgagctgtttgctttggtccctggcgcgggctgttttggactgttggtgccaggccgcgcgaaccaagctttagcctgggcagtgggccggctcaggtgcaggcctgtttctaaaaaaaattatcttgccttttaaaattttcaattatggtccaatt

SEQ ID NO: 8968 - DNA, 2462 bp, Zea mays
tttttttttttttttttttttttcgcttccttaaaatactaaaatagtataaaatacagggactaaacagtagtcactaaaaaccaaacacttgttagctgcagcgacctaacatcaattagtactcataatctttccctatttgctcaaagttgcagatacacggaattggaactgcaattttgcaaggcttatcatagcatctgttccttgacaccaaggtaatctagcatctacatataccttacagaagtgctaaaacccagtgagagcaacacacagaacagtaatcaagttactggagctcaaaagaaaaactgcgagggagacatcgggggccagtccttcaagaaccaccagaaagactgcgtcttctagcaagcggtgagcttcgcgatctcttcaagcaagtacttggactcagctgcgaagtcgaccggtgcttcacccctcacggtgattctctgcctcttctcgttcatgtattcatgctgcgtgacgctgacacggaacaggtgaggaacccaggtggcttccttgagcttgagaacgtagctgtcgtccccctcctctttcctgatccgatcaagctcgtcggcgctgcagccaatgatcttctctgcatgctcattgaacacagacacccaagcctcgccagtgggatcggagagcttgatcaccatgatgtatctcagcgagcactcagagtaattcttttggcacccctcgcaccagtatccagacccaaaagcttcagtcaccttcttgttacaggtcgtgcaagcacggtaccacatattctgatcaggcttgatgtggcttatgatggcgtacagactgaagaaaacaggcttttcctggcccatagcaggatcactggtgatgtgagacagaaaaactctatcagaatacatggacttgaaaccaccagcgcgtgtggcacccacttctgcactgattggtgccagtgaagtatctttgccttcagagtcataccaggacttcagattcttagcctcaggcaggtcaggattaatctcgagagtacttctgccaatagttgaaagagatacgccttggaagtcagatacttttaggctctttatcgcaacaacaggcgaactgtcaaccatgtccaaaagctcttggccagtcgtagtagcaagatcattccagagagaaatagtaacagttttgccagagtcatctgctacaacaatatcacgcttcggtattgtctcgttgtcaatctttctcctaacactgagtgtgggagatacgctctgaaccacaccaacaatatctacaagctccctgccaccgacgtatggtcctagctgatcaatcttgacaaggttgtattgcactggtggaaggaaagtctccccctctgcttcttcaacaatagcattctcgtttagtgacaactcatagtcatttttgactgtcttgaactgcttgttggcaattctaagagatccttttgagacataatagacctttcccagctcaaaaattggatagaacttctttgcagcctcgttaaacatggtggcctggatctgggtgccatcctcatcagtaagctctacgttgaagacgcagccttctccacgagcattcctgtaggttctcagattgcctttgctcgtgacccgcaccttaatgacccagttaccctggtaggggttcagagtgatcaagggatggaccctccttgtcatggaaaggcgcgtggcaggagcagcatttccacgctgctcagtcacgatctgggacgcggacttcacctcttgcttaggcttcatcacgagtgggggagaatttgtttcctcagccacgactgagccttcgtctttaggcttcagcacaattggaggatcctctttcttggcctcgccgttgatctcggcgtcgagcgcttcgcacacagtctcgcatttgacgacaatcaggactttgtcagcgttgcctttgacggagttgcaagtgtagtcgaggatgcggatgagaccgaaattcttcagattgccggagtggacctccgacgcaaagtaagtggggagcatcgccttgattttgtcgttcccatcggttgccgtgaaactgaaccggctgcccatgccgatggacttgagatcgaggacctgaacgacgagatccgacacggcgccatcggagcccgtagacgggtgcgccaggatgtaggacacggcgcccggcgtcaccgacttggcagcgtccatggcgcctctgctacctttgctctccctggcgaatcgtcccgcggaggcgagaaggtttctcttggatcggttgggggctggcgggcgtgggcgagcgttgagcggaggcgaagatgcgtcgacctcccgcggccccccatggtcctaatatgataaggtagatttgggaaggaaatggcgggaggcgagcggcgctcgaggttttgcgcgtttgaa

SEQ ID NO: 8969 - DNA, 4090 bp, Zea mays
tgtggtttcgttagattctaataatactgtagaaaatatatttttcaaatgaaccacattctgccggtagataatgagtatcggtatcaaaatgtatcaaaatctcgctatctgagacgtccctactaatggaagacaactgagggacatcattacaaaaaggcctgcgagcaatggccagggacactggagcttgaaaggggtagccgccgaccagccgtggagtcatcgatggtgctacaacctatgggacatggaaggatgcacgaggcacatcggaggaagccaacatgggcagaaagggcggtcaacaatgagggattaggcgttaggtgttgggttcattgagttagggtttgttctttgttgtgtaatatgggctaggctaaaaaataaagtatgagttaatttcggatatctaaaggataatagtgggaagtaatattctaatctgtgcccttttaatctaggatcctagtaagcatattgtatattcaaatcctcaaaattggaatacctagagctccatactcttttagcatatttacactttccaccaattagctaaatgataccccctctgtacttaaataaaatttgttttaggccaacggtggattcatcaaaggcttgatggatgtattttatatacgtgtctagatttgtcttctctcatttaggtatagacataaaaactaagagctaaaacaactactccctctatttttttatttgacgttccgtagttcaatttgtactatttggtgtcagatttaaaagtatggaggtagtactgtttttgaagcggagggagtatttgtgattaccttcagtatcaccccgaaggcaattagctaggtcagagtggatataactggatggccaaagatcaactctattcgccgctggaaccagaacgataagatcccattcctccaatcatacaatatacaatgatgtactggtgaacagtcaacacactatatcactccaattctgcctgtgtttcacggacagagccgtatgaccggtgaaggttagaaatggacgcgtcgatgtgtcatgtgtggaataagtgcctgtcactgtgatgtatgatgtgagcagactctgaccgacaagtcgtgaactagaagcagccgatactatatgacctggctgttgcagtgtatgcttgatgccgaaatgttttcggtttagtggtccgatgtacgtgagtaccatgtttcattttcacggtcattgtcaaagacaaaatccttttttgttggacttggcacagaccgtaccagtaccattcaaatttaccgttccttcaagtttgctgcaatcgtcttgttcgtgcgactgcagaatgtgtaggcagctgccatggatttcgtcatttttttttctaaacaacaacaacaacactgccatagaattgcagcgcccagtttgcagccaatcttcgtccatcccatcatgtggcacatgttctgacaataacagaaggttgaacaggaagagaggagaagagtgcgaactcgttcgtggcaacaataaacaagtagtaaaacgcaacctcaccggatgatgcatatgacacatcaaacgggggcagttggatcgtctacgtgagggatagatgagaatatcataagaaagatccagagctggttggattataaaaaataaaaaaaaaaagatgagaggacgcgttgtgctgcgcaaacatccggccaccatctcagactcagagacagacatgcgcgtcagactgggaaatataccatgacagatgggcactcctccttccttgtcgctccaggatcatggccgatctggctttgcgcaaactaccaggataatttcccgagtcccaattcctcatgccgatcgagtatcctgtctgttgccttggaatccaaatgatagcaccatcatgcgaagaaccacagacacacatatgcaagactgaatagcgtgttagctagaggtagatgctaatcatacaggcctaatcatgcactgacgaactaggcgctgaattgtccatttggtctatatatatcctcaccaaacaccccaacaaacctctctcagaaaatgcaaccccccaacaaacttgaactaacgcctaggcacacatgtaaactactaatgctctccccctccctctgcttgtaccaatgcatgacacggaaacgaagtcaaacaaatccctcagcttccatcccctcctcgacccaaacccaaccaccatgacagcaaaccatgagctccatatgcccaaaacacccctacccccctccccattaatcctcgctaatggcatcagccatccagagcacatctttgctgggcacctttgctttgattagtacacggtgtttgaaaacttcacgttaaagggcacgcttggcaagttccttcaatgtcgccagttaaaccttccctatccagttccaaacttgcaaccccccctcccttcccctcccctccctcctcctacaagcaacagcagcagcacaccggcctccaagaggaggagcggagaggaggaaggtgagcggttgcctccgaaagcaagccatcactggcggctaccaaatgcaggcatgcatatagcgaacaggacaagaagcagcagaggaggaggaagaaggacaagtaggggcagagagctcaaggacgtcaagaaacggtcgctcgctgccacccaccatgtcctatgatcaggtgctcttcggtgccgggcgatcggcgtggagagcggctcagcacggcggcggcgacgcggtgacgaggcagatactcaagtgcatgcggtggcagctggaggagaccaccgacttcgtcacctgcccctaccactactactgcgacagctcctacccgggcgactactccgcggccgtcggcgtcctcgtcgctgccttcgccgcgtactgcttcctctccaccctcgcgttcaccgtcctcgacctcgtccgggggagcaacagcgcgccggcgccggcgccgggcgtccgaggcgtcaggaggaagtacctggtcccgtcgggcccgttcctgctcccgctggtgctgcttgcgctcgccagggggcagcgggtgaacgccgtgttcccgctggcgcagctcgggccggcattgctgctgctgctgcaggcgtcggcgctggcgttccggaacgaggccgacggcgacgtccggtacgcggtgctggaggcgtccacggtgtccggcgtgctgcacgccagcctgtacctggacgccgtcgtgctgccctactacacggggctggaggcgctccggtggtcccgcttctccggggagtgcgcgtcgtgcctgtgccggatggagccgctgctcgtgggcggctcggcggtgcggtaccgcggcctctccaagacggcgctggcggtcatcttcgcgctctgctcgcggatggtgtgccgcatctacggcgaggagcgcctcagcgcgtggacgcggtccgcgctggaggccgcgggctgggtgctcgtggccgccgacgccgtgtacctcgtcggctgggtcgccgcggagggcggcggcgtcggcgtcgcggcctacagcctggtcgccgggctcgtgttcctcagcgtcttcggcaaggcgtaccggttcctggcgtgggtggaggccaggcaatcgcagtggaagtccagcctctgccatagcgccgtttgatcgacgacactcgtcgtcacagctaattctcgcagggaaaaaaatctgtaaaaagaaagaaaggaatcgtcgcttattagttcatcttcttcttggttcttgctgtacaatctacacgatggggggcaaaaaaggtgcgattttttttgttcatgttacttagcttaatttggctgaagccattcaggtttttgttgatgaaacttcagagcttgttcttttggcgttttaaatatggttttgatggctcgttcccaatcccgctgaccagagtgcacatatgatccattgtgattctgatctggttaggctttgaatcagacaactgtactgtagttaccgggagtttcttaattatcatgattatatgaagttaaaaaaaaaaaaaaaa

SEQ ID NO: 8970 - DNA, 1726 bp, Zea mays
cgtcctcgggctctcggctctcctccggcctggcgtaccgctgcatgacatgacaaagaaacaaagtcaaacaaaagacctcagcttccatccccatcctcagcacaaccaccgtgacagcaccccgtatgcccaaaacacccctacactaatctttgctaatgccatcagccacacctttgcttcgattagtatacaatgtttgaaaacttcacgttgaagggcacgcttggcaagttcctccaatgtcgccagccaaaccactctctatccagttccaaccctccctccctccctccctcctacaagcaacagcagcagcacaccaccctccaacctccaagaagaggaacgaagagggaggaaggtggggagttgcctccgaaagcaagccatcactggctaccaaatgcaggcatgcatgcatgcatatagcgaacaggacaagaagaagcagatgatgaggaggaagaataagtaggagcagagctgaaggacaccaataagaaacggttgctcgctgccaccaccatgtcctatgatcagatgctctcgccgcttttcggtgccggcgggcgatcggcgtggagagcgggcgcccagcacggcggcggcgacgcggtgacgaggcagatactcaagtgcacgaggtggcagctcgaggagaccaccgacttcgtcacctgcccctaccactactactgcgacagctcctacccgggcgactaccccgccgccgtcggcgccctcgtcgccgccttcgccgcctactgctttctctccactctcgcgttcaccgtcctcgacctcgtgcggggcaacggtagcagcgcctcgtcgtcggcggcggccggcgtcaggggcatcaagaggaagtacctgctcccctcgggcccgttcctgctccccctggtgctgctcgcgctcgccagggggcagcgggtcaacgccgtgttcccgctcgcgcagctcggcccggcattgctcctgctgctccaggcctcggcgctggcgttccggaacgaggccgacggcgacgtccggtacgcggtgctggaggcgtccacggtgtccggcgtgctgcacgccagcctgtacctggacgccgtcgtgctgccgtactacacggggatggaggcgctccggtggtcccgcttctccggggagtgcgcgtcgtgcctgtgccggatggagcccctggtcgtgggcggcacggcggtgcagtaccggggcctgtccaagacggctctggcgatcatcttcgcgctgtgctcgcggatggtgtgccgcatctacggcgaggagcggctcagcgcctggacgcgggccgcgctggaagccgtgggctgggtgttcgtggccgccgatgcggtgtacctcgtcggctgggtcgccgcggagggcggcggcgtcggcgtggcggcctacagcctggttgccggcctggtgttcctcagcgtcttcggcaaggtctaccggttcttggcgtgggtggaggcgaggcaatcgcagtggaaatccagcctctgccatagcgccgtttgattcatgatactcctcaaagctaattctctcagaaaatctgtataaagaaagaaaggaatcgttgctttagttcatctccttcttggtgtacaatctacacggtggtaaagaaaaggtgcgattttttttgttcatgatacttggcataatttggcggaagccattcagatttttgttgatg

SEQ ID NO: 8971 - DNA, 2168 bp, Zea mays
ttgggtacctcgaggccggccggggccgccttcgccggggccggccgggactggtcactgtgccattgccgccgtccgtcctaggctcctagctagctagctagcaagctccgccgacgacggtacgtcaatcgagctagccctgcccatccactacactaccgcagcggcaagcaatggcgtgcggctctgctaccgccgctcgaccagcagcccgcctctggctgctggcggcggtggtggtggcgacctccttcctcgccgtcgcggcgccgccgggcgcgctggtgacgagcgtcccggggttcggcaacaagcagcagctgccgtcgaagcactacgccgggtacgtgacggtggacgagcggcacggcaggcggctgttctactacctggtggagtcggagcgcgacccggcccgggaccccgtcgtgctctggctcaacggcgggcccggctgctccagcttcgacggcttcgtctacgagcacgggccattcagctttgagccatcaggagggtcagctgggagcctgccaaagcttcatctcaacccttatagctggtctaaggtgtcgagtgtgatatacttggactcccctgccggcgtcgggctttcctactcaaacaacgtttcggactacgagactggcgacttcaagaccgccgccgattcgcacactttcctgctcaagtggttccagctctaccctgagttcttggcaaatccgttctacatagccggagagtcgtacgctggcgtttatgtccctaccctttcaagcgaagtcgtcaaaggaatccacaaaggagtgaagccagttataaactttaagggctacatggtcggcaatggtgtgtgcgacaccgtctttgatggtaatgctcttgtgccgtttgcgcacgggatggctctcatttcagagagtatatacaaggaagccagcactgcatgtcaagggaattactggaactctagcagtgcaaaatgcgacgaggcgctgtcaaaagtcgagacggaaatcgacggattaaatatctacgacatccttgagccatgttaccacgccccagctgataccaaacaagcagcagtgaccccacaggcacagagtactagcgagctgcctcagagtttcaaagacctcggcgtgaccagcaacaagcctctccctgtaaggacaagaatgcacggacgggcgtggcctttgagagctccggtaagagacggccgcgttccgtcgtggcaggagctggcggctgatgtagcttcgacttccagtggagttccgtgtatgagcgatgaggttgcgacagcgtggctaaacaacaatagcgtcagatccgctatccatgccgaaccagtcagttcaatcggaccctgggaattatgcacggataaactggattttgatcatgatgccggcagcatgatcatctatcacaagaacctcacgagtcagggctaccgtgctttcatctacagcggcgaccatgacatgtgtgtaccttacaccgggactgaagcatggactgcgtctttaggctacgccgtcgttgatccgtggcgacagtggattgtcgacgaacaagttgccgggtacacccaaggatatgaaaagggccttacttttgccactattaagggtgctgggcacacagttcctgagtacaaaccacaggaagcactagctttctacagccgttggcttgccggtgctaaactgtgaggaggcctattttgtgtgcaaaggtcatgcagtactgaatcaaacagaagttggataaagcatgcagcaataaggcagtcgaaggatcaaagtatccaacgcgccaactacaatgttgcattcattttcacatgttataccaatgcagttgctaattacctgcattgttcatgagttcacagtccatctaattggttgaccacaccgtctcatcttgcaccactatatacgttaactttattttagccttttaataccatttgactgcacccacacatacgccagaaaacgtcgtatctggccagccaacatcttacgaacctgcacctgagcgcacaaccatccaatcatgttgagtgtgaccaaacatttgtgaaaattttcccgtgattttttttaataatagtatatacggtggttgggctgtgcggctgtgcc

SEQ ID NO: 8972 - DNA, 3194 bp, Zea mays
ctctagactcgacctgcagacagcctaaggacaagttgctaacctatgtgtcgggacgtcgaggtctatgtattgcttgtgacgcctttgtgggttcctcttataatttttagctctttctagaggtacaagcacatcagatgggtcctatctgggtgattccagaggtaaaagctgacatgatattgaggttgttgtggtatactgagcattgtagtaaaaaagctagtgctaacactaacagtcgacaatgtgatcggtactaaggtcgatagctaatgtgataaataatcgagatccataggtaatgtgatagtgacagtcggtaagggccgcctgctgcaccggagcggcgtttggataattggattgcaacaacagcagggcttgtcagcctttcaccaataaaaaaaaacagtggcgcctgtcggcagcatctgaccggcgtgcacactgtgctcatttccatctccaatcgattcgcgcaggggatggggattcgaattctcacctcactccaccaacccgagcccagcacggcatggaccacggaccacggacaggtgtggggtgtggcagcctggcaggcgccgcgtccttttcttcctggcgcgcgcggtcggccattcgcccattctcgggtcgagacggcaagcgtcagaccagtgacgaagcaaatctaccatgcgatgcgagcatgacaaataaataccctttacctcgtccttgccgccgcggccgccggggcgtcccggatcgtggtggtgcttgccgtcgctggtgagtccatgagacgtgtgtcacccggccgttcagcgcagagcccatccggccatcccgttcgtacctaaccggcaccttcttctgcggatcaatccggcaaagccagcgcgcgcgatgcgccggcggtgggacagctgcttctcgggcagcgacgtccgcgtgggcgggcgcgtcccccccgaggagccggagccggaggtcttctccttcgccgagcccctcccgtcgtggcccacaggtgagtggaggagactggcgatgcatctcctcctctccttcggttggatttgggatcgtgcatctgcgtccgtgttgtgattgttgtgactgcccatcaatccacccccaccaccaactcgcgaaatgtgtggccgctagattgtttaatcgatccggcgccgcattctgccaggcgggggattcgcgcgggggaggatacgcatcggcggaggggagctggagctcgccgcggccaccgcgttccagaagatctgcaccctgtcgtcgcggcggccgtggcggcggcggcagcgccaccttttaccggccggtcggcgtcccagaggggttctcgctcctgggttactactgccagcctaactgccgcccgctccacggccacgtcctcgttgccagagcgggggagcgcccgtccggcgcctcacctcagccgccgccgccgccgctctgcaagccgctggactatacgctcatctgggaattccaagccagtggcgataccggctacggctacggtcgaagcgacgcctacttctggatccccgtgccgccggagaggtatcgggcgctcgggtgtctcgtgaccacggaaccacggagaccaccgctcgaggaggtggtatgcgtccgcgaggacctgacggacgagtgcgagccgcacggctcgctgctctgcctagagcagccgcggccgtcttcgttcttcaccgtgcggggcgttcgtccggtgcgccgagggatacgggagaaaggagtgtgcgtgggcaccttctgctgcgccgctgacgggctccccccgcgcgagcacggcatggcgtgcctgggcaacgtcgagctcgacctgtcggcgatgccaacgctggagcaggcgcacgcggtgatccggcactacggccccacgctgttcttccaccccaaggaggtctacctgccgtcgtccgtctcttggttcttcaagaacggcgccgcgttgtacaggcgagggggagacaccgcgggcgaggagatcgacggcgaggggtccaacctccctggtggcggttgcaacgacggggagttctggatcgacgttcccagcggcgagcggggccgcgccgtgtgccgcggcagcatcgacagcgcggagctctacgcgcacgtgaagccggccatgggcggcacgtgcaccgacgtggccatgtgggtgttctgcccgttcaacggcccggcgaggctcaagctgggcccgatcagcctcccgctgggcaagaccgggcggcacgtcggggactgggagcacttcacgttccgcgtcagcaacctcaccggtgagctcatgggcgtgtactactcgcagcacagcggcgggcactgggtggacgcctccgcattggagtacatcgacggcaaccggcctgtggtgtactcgtccaggaacgggcacgcgagctacgcgtaccctggcgtgtacctgcagggctcggcggcgctcggggtcggcatccgcaacgacgccgctcggagcagcctattcgtggactccagcgccaggtaccgcatcgttgcggcggggtatctgggcgagggcgccgtcgtcgagccgcagtggctgcagttcatgcgggagtggggtccgacggtggtgtacaagtggaggaagcggatggagtgggtgatcggccgcctacctccctggctcaggtgcagagcggagagcatgctgaacaagatgcccaacgagctgtccagggaagaagggccgaccgggcccaaggagaagaacaactgggagggagacgagagatggtaagactggtacgtaggaacagtgctcaacgatgtgattttataacatgtgtggcttaaattaaggggcgtgctatatttaggtgtttgaaaaacagcttcttcgcggaccatacactagtacaatttggctctataccagcggtacgctttttacatcacagacggttcggttagaaaaccgcctgtaatgtcccaggcggttcagtacgcctgtgatgtaatagtatcacaagcggtttttgtttaggaccgtctgtggtgctctatccttttcacaaacggaccctaagaaaaaaccgcctctgattgtaaaaatatttttaatttttaacagaaatatgcaaatacaatttaaatgaattaaaagaaaaaaaaaaaaaaaa

SEQ ID NO: 8973 - DNA, 906 bp, Zea mays
  misc_feature (859)..(859): n is a, c, g, or t
attctcgggtcgagacggcaagcgtcagaccagtgacgaagcaaatctaccatgcgatgcgagcatgacaaataaataccctttacctcgtccttgccgccgcggccgccggggcgtcccggatcgtggtggtgcttgccgtcgctggtgagtccatgagacgtgtgtcacccggccgttcagcgcagagcccatccggccatcccgttcgtacctaaccggcaccttcttctgcggatcaatccggcaaagccagcgcgcgcgatgcgccggcggtgggacagctgcttctcgggcagcgacgtccgcgtgggcgggcgcgtcccccccgaggagccggagccggaggtcttctccttcgccgagcccctcccgtcgtggcccacaggcgggggattcgcgcgggggaggatacgcatcggcggaggggaactggagctcgccgcggtcaccgcgttccagaagatctgcaccctgtcgtcgcggcggcgtggccgccggcggcagcgccaccttttaccggccggtcggcgtcccagaggggttctcgctcctgggttactactgccagcctaactgccgcccgctccacggccacgtcctcgttgccagagcgggggagcgcccgtccggcgcctcacctcagccgccgccgccaccgctctgcaggccgctggactatacgctcatctgggaattccaagccagtggcgataccggctacggctacggtcgaagcgacgcctacttctggatccccgtgccgccggagaggtatcgggcgcttgggtgtctcgtgaccacggaaccacggagaccaccgctcgaggatgtggtatgcgttcgcgaggacctgacngacgagtgctagccgcacggctcgctgctctgcctagagcagccgcg

SEQ ID NO: 8974 - DNA, 817 bp, Zea mays
attgggtacctcgaggccggccgggatgttttcttccacccccggggtccgcccccacccgtctctacctccgtgcgtcgtgcgccaaggcgcgaaccctagccgagatcagatcggaggcgagcgccaccaccggccggaggaagaggacgacacgatgctgcgggttgcggggagaaggctctcgtcttccctctcctggcgccccgccgcggcggtagccaggggtcccctcgccggcgctggcgtccccgaccgggacgacgactcggctcgcggacggagccagccgcggttctccatcgactcccccttctttgtcgcttccaggggtttctcttctactgaaacagttgtcccaaggaaccaagatgcgggcctagctgacctcccagcaactgtggctgctgtgaagaatcctaaccctaaggtggtttatgatgagtacaaccatgaaagatatcctcctggagatcccagcaagcgtgcctttgcatactttgtcctgagtggtgggaggttcatatatgcatcactgctgcgtcttctcgtactgaagtttgtcctgagcatgtcagcaagcaaggatgtgcttgcccttgcttcacttgaggtggacctctccagtatcgagccagggaccacagtgaccgtgaagtggcgtggaaagccagtctttatcaggcgtcggacagaggatgacatcaagcttgccaacagtgtggatgtggcatccctgcgccacccagagcaggatgcagaagcgtgtgaagaaccctgagtgcctggtggtcattggtgtgtgcacgcacctcgg

SEQ ID NO: 8975 - DNA, 3744 bp, Zea mays
gcactaatcaaaccataaatagaattcttgagcagatttatccaatctaataaaacgtatctccaaatgtaccagcccaatcatcgatgagagctgtaatgtgaaagatcgagagaggtctctgtcataatcatcaacagggaagaccaatcattagcagttaacacgactttgttgacttgccgactttaattagatattagagttacatatttctatagatcctcaaagaaagccataaaactcgatatttaactaccaacacatgaatagtatgaaaataaaagttatgatacatttacgagtaaatatttatgtgccttataacaggataaaaaacctatcaaggttgtattttgattccttccttaataggacattgtcatttgaaaacaaaatcgacctgtgggggtaagatcgcccccacaatattatattaaaataaaaccttctcagggccagaccttagacctgtgttttggcatgggacagacgagggaattttttaaccacaacctaaaaattcgctccgatgggaagtcgaacccatgatctgaggagtgctactcagaccacgtaaccaactcagcttgaggcactttcgcaggaaattgtcatatgatataacttatattatggatgttgtggtcatcataatacaaattatagatttcaaattttgtagaaagggtaaaacataatagatgtataacattcacatctttgtttctcactaacgtttgatagctttttttcagttgcaacacacggggtatatttgctagttatacaaaaagctgtgccattatcactttttatgaaattgctttttaaatagccccagtccttcactttttatggtcaaatagttattgctatgaaaaagctagcctttttttttgttttagtgttgtacaattaaatagttagctaaaactctgactttatttgccccgttctgaaattttcttttacacctacatcataatggaactcctttctaatgttggtattggacaggataaaagcggcgagaaacttgaagcacatgagaagtttgctgaacccagagaagtggaggtgagctttacatttttactctgcaccaatgttttcctccaataaaatgtttcagtcattatcatcgctatgaagctgtgatgttttggtcagtttctttaaactatcagctttgctattaacaagtttcattttggcatagtcagaaattagttataacgccatcaaagaaggaacttggtcttgcattcaaagggaaccagaagttggttgttgagtcattggaagtaagtttcataaccacattggcttgttatattatgttgctgttaggctgatcatcatttactttattatctttgtacaggccatgaccgagaccgaggcactggacatgaaagccgcgttggaatccagaggggaagtcgagttcaaggtgtgtacccttgggaagaatgtcaccataaagaaaaacatggtttcaatcaacatcgagaagaaaaaggagcaccagaggaaatttactccttccgtcatagagccatcctttgggatcgggcgcatcatatactgcctttttgagcactgcttctaccaaaggcctggcaagaccgaggatgagcagctaaacgtgttcaggtttccccctctcgttgctccaataaagtgcaccgtctttccattggtcaagctcgagaaatttgaggctgttgccaagaagatctccaaggccctgacagcagctgggatttcacatatcatcgacatgacaggtacatggccaaatcagtagagttgcgcttgttttctgtggcactgtttatctaagttctgttgcaatggaggtctacagtttcagtcagttctgggatttcacatatcatcgacatgacaggtaatacaataggaaaacggtacgcaaggacggacgagattggtgtccccctggcgatcacggttgatcacaccacgagcgtgacggtgcgcgatcgtgacagcaaggaccagatccgcgtggatgtggacgaggtggcctcggtggtgaaggaagtgacggacgggcagagcacctgggctgacatcatgtggaggtacccggctcacacggcctcggccgccgacgaggatggggcacagccctgaagaggcacagccacaacaccacccaacgatcgttggtctctgatagttccttcctgcgttccttaacagaaacagactgcattgttgtgtaagcctacagtagccagattcctgcacatttaaatttccacaaacaaatagtagcctctgtgttataaattctgctacaacatttcatcctgtttcacccttgaatggacctgtgatgtttgcctcgtcgtgaaaaaaaaaataaaaaaccaccggccccacggtccgggttcacgggagagcaccagcagaattacagttattaagtggaggcccatttggaagcaggctagccaagctcaccacgtgcaaatcagtgtgtgtgtttcgcggcctgcagaaattggggcagcgtagcccaccgcccccaatatttttctccgtccctcgttttcaccagtctctcttctctgtctgtcttcctccgtgcttcccggcgcgaaccctagccgagattagattggaggcgagcgccatcaccggaggaagagggcgacacgatgctgcgggttgcgggaagaaggctctcgtcttccgtctcctggcgccccgccgtggcggcggccaggggcccccttgccggtgctggcgcccccgaccgggacgacggctcggctcgcggccggagccagacgcggttctccatcgactcccccttctttgtcactgccaggggtaagagcgcgcgtccttccgcatgatttccgtgtctgcttgtagatttggctaggactgggatcgggatccatctggcttgatctacgatacgaggattgctaatttcgcgaagttgtggatgattgcttggttctcgatgatggcgtagctctgcatcgagtcctttctgtttagtgatccatgcttggttctcatgtagcttgatgtgccgtagctgtaactcttacgtggatcggtcttgttagcacttcgttaagtaagcgccccaacgtgtttggacgatttgcgttccttcaggacccaggagaatttgttcgcttgttttttagcattttgttatgctgtttgacattcatttcttgatttgcagccattgagctgtgctttaacatagacgaatgcctcctgccctttctgattagcactgccacttgccctatgtgatctcgtgaaaaacacaggacaactgcgtatcattatattaagaagaaaaatgttttgacccatataccaaacacctaaacacaccagtgaaaaactacatgcttgactacaagttaaaactaaaaaaaatgatcacaaccaaccattatttggcgcaagggcgaggagatgagaggcccctcaagcccaccaaaggagtagctcatccttgatgagcaacataacctcattcaagcttggcaaaatcccattaaaacgcagcgatggtggtgattccaaattgcccgagctcctaaaatgatgatgggattttgccctttttgaactggaccactcattctataatttgatttttacccactaatcatcaaaggaaacatcatcctgctgaggggttaaggattctagccccacttgctgcaggcatgc

SEQ ID NO: 8976 - DNA, 2340 bp, Zea mays
aggaacagcggccaccgactagtgcgccccacacgtcagcccctcgatccgcttcccatctgatgctcgtgctccgccgcgtctccttcctcctctcgtcgccctcccctcgcgcaccgctcgcaaaacctctcctgctcctacgcccgccccaaaccctagccccgacagcgcggcagctcgtggctatggccgcgtcagtcccgtcggcgggtggggcggggacgatgagccgcgacgcgttccgcgcggccgtgaccaacacgctggagcgccggctcttcttcgtgccctctttcaagatctacggcggcgtcgcggggctctacgactacggacccccaggttgcgctgtcaaagctaacgtcctcgcattctggcgccagcattttgtattggaggaagggatgcttgaggttgactgtccatgtgtgacgccagaagttgtcttgaaagcctctggacatgttgataaatttacagacttaatggttaaagatgaaaagacaggcaactgctaccgtgcggatcatttgctgaaggacttctgtaaggataagcttgagaaagatcacacattgtcaccagagatggcagaagaatacaatagagttcttgctatcctggatgatctcactgcagaacaattgggtgctaagattagggagtataagattgttgctccagacaccaagaactcattatcagatccatacccttttaatctcatgtttcaaacttccattggaccatcaggtttgagcccagggtatatgaggccagagacagctcagggtatatttgtgaacttcaaagacttgtattactacaatggcaataagctgccattcgctgcagcccaaattggtcaggccttcaggaatgagatatctccccgtcaaggccttttgagagtccgtgagtttactttagcggaaattgagcactttgtggacccagaggacaaatcccatccaaagtttggtgatgtttctgatctagagttctggatgtttccgagagaggatcaaatggcaggaaggtcagccacaagacttaaactcggaaattctatatctgagggaactgtgaacaatgagacccttggctacttcattggaagggtctaccttttcttgacacaacttgggattgacaaggatcgtctccgtttccgtcaacacctgccaaatgaaatggctcattatgctgctgattgttgggatgcagagattgaatgctcctatggttggattgagtgtgttggaattgctgataggtctgcctatgacttacgtgcccactcggataaaagcggcgagaaacttgaagcacatgagaagtttgctgaacccagagaagtggagaaattagttataacgccatcgaagaaggaacttggtcttgcattcaaagggaaccagaagttggttgttgagtcattggaagccatgaccgagaccgaggcactggacatgaaagccgcgttggaatccagaggggaagtcgagttcaaggtgtgtacccttgggaaggatgtcaccataaagaaaaacatggtttcaatcaacatcgagaagaaaaaggagcaccagaggaaatttactccttccgtcatagagccatcctttgggatcgggcgcatcatatactgcctttttgagcactgcttctaccaaaggcctggcaagaccgaggatgagcagctaaacgtgttcaggtttccccctctcgttgctccaataaagtgcaccgtctttccattggtcaagctcgagaaatttgaggctgttgccaagaagatctccaaggccctgacagcagctgggatttcacatatcatcgacatgacaggtaatacaataggaaaacggtacgcaaggacggacgagattggtgtccccctggcgatcacggttgatcacaccacgagcgtgacggtgcgcgatcgtgacagcaaggaccagatccgcgtggatgtggacgaggtggcctcggtggtgaaggaagtgacggacgggcagagcacctgggctgacatcatgtggaggtacccggctcacacggcctcggccgccgacgaggatggggcacagccctgaagaggcacagccacaacaccacccaacgatcgttggtctctgatagttccttcctgcgttccttaacagaaacagactgcattgttgtgtaagcctacagtagccagattcctgcacatttaaatttccacaaacaaatagtagcctctgtgttataaattctgctacaacatttcatcagggcgaaaaaaaaaaaaaaaactcggcgcccgttctctctctctctctctcctcgtgc

SEQ ID NO: 8977 - DNA, 536 bp, Zea mays
ctgtctgtcttcctccgtgcgtcccggcgcgaaccctagccgagattagattgaggcgagcgccatcaccggaggaagaggaagacacgatgctgcgggttgcgggaagaaggctctcgtcttccctctcctggcgccccgctgtggcggcggccaggggccccctcgccggcgctggtgcccccgaccgggacgacggctcggctcgcggccggagccagacgcggttctccatcgactctcccttctttgtcgctgccaggggtttctcttcgactgaaacacttgtcccaggaaaccaagatgctggcctagctgacatcccagcaactgtggctgctgtgaagaatcctaaccctaaggtggtttatgatgagtacaatcatgaaagatatcctcctggagatcccagcaagcgtgcatttgcttactttgtcctgagtggtgggaggttcatatatgcatcactgctgcgtctcctcgtattgaagtttgtcctgagcatgtcagcaagtaaggacgtgcttgcccttgct

SEQ ID NO: 8978 - DNA, 2542 bp, Zea mays
attagcctcagtgtcacgtgatcaacttgcatctaggcagccaccagtaattctaggaatgcactttctctctctctcaagtgcgctctctctcactcctcttttagctagattgtctctcaagtgctctctatctcctacatatttctcttatttcaatcatctctctctctctctctctctctctctttgatattctctctaaaatcgaaggctcgcctattctctgtctaaatatttagccccacttactctctttttacttcctggtgtcactccttcctacattaatttaatttacaatgattccattctttgtatccatcttcagcatctctctaatttactatctatcttgatatcaccctaatctttagtttctttccatctccatactttgtttatctcgtatctaaccaatccctttgggctccatattctctgtagttctacaaagacgaaataaaccatccgttagctggttgacagttgtcaaaagaaaagaaaaaatctggcaaaccgttcatcctatactcattgctttatccactggattcacccgtaaccattgggcacgagtaagcttcttctgataatgggcatgtgtctttgctggggaatcgtaacccacctgatggcaggtctacatgggcataataacattggatttgtcatggaaaatactttcataatatagtattttattaccttttgttatcacataataccatattgtattacctttttcttatcatgtaaatctgtgtattggaggacgtgttgaagtcaaaacaacagtacacaaaaaaatgcgctaatgttttctcatttgttaagcaggacctggatactgaaatcatagtggcaacagcaaggacccctgatgctacagcagtatctgctaatgttgtccttgatgagaggcagatgaatgctctttttcttgatctggtgagttactttcttctgcaactctgtctagaacagtgaaaggtctactaccgcaaacaaaaggttacataggataataagctgtaaaaatgttattttctcctgttagcccttttttgctgcagaacctttttagctttaacttcctcggtggggtgggtatgtggagttgtggacctattcaaaatttctgatgttgatttcacattggactggggaccaccctattccaaaagagtataaagcctgaaccgccgtggttcggctgtcatgataaagtagatgatgatacgttgatctggtgtttatataccagtttcatgattgcaattagtggcctcgatgtgttacgcatgttgctgttttgagttgaaaggcactagattttgatttgtttgccattgctttcgtgaatttttcccgagctatataacatacgtactacttttgcgagactaagagagtagaaaacgaaagatttgacacttttgatatcggcatttcccaggtatgaatgctctatttcttgatctggtcagggtgagcgagtcttacgggctgaaatttcctcgggagtttgctcttctcatgaagcagctgctgtattttgatcgctacacaagactgctggctcccagcatgaacatgctgcgagacgagaggatcaacatctccaccaatcgacaaccaagaagaactgatagatttcagtgaagccacgtcgttagtcaccggccacgtactagaggagtcgtgatgggcgataatagcaagctcatgtgacccaatactgtatatagttttgccagaccagcatagaaatgaaccacacgctagaaattgtacactccgtcgtattctgggattgagcgttatatcgtactagtaggtaacatgtaaaggctgtatcccacgaccaaagtaaatttcagatgaactgcttttgtctcgaaaaaaaaaaaaaaaaatcttttttctggtactagtagcgtgaatctggttaagatgcaactgcactacacttcagctgccatcagaaaaaagtgatcttgcagcagcttaacgaggtgctgaacaaaactggctagagagatggttgcattctctcgtggtcaccacgaacttgtagagttacgggattccactatatggcggcatttcagctttcattactcgttggagcttacacaacagggttcatagtggatattaacttggaaaatatcccgcagctcaggttcgtgtgcgtgcttgtgtgttgggttggggttgggccgttgggtgatagtgcttgaactatcaggctgccagtttcatggacatgattttcttgtttatatatatgactacgccagataaataaagcaaaatggataatctaaggccaacttcagcaattcatctaccgtctgtttggacggttgcacgcggatgcccaggctcaggcgagcccagccagcccggtacggctatttcatacgtatccgaggatgcaggtaaatggtctcaaattgatttgctttacatccacttatacagtctgcgtttttcgtatacaaccaaccaaacgaaaacttagaaaaagtcaacg

SEQ ID NO: 8979 - DNA, 2082 bp, Zea mays
gttttcacacttggctcgctcgctcgcacgcacgcactgacaacctgggtggccgccaccgcacaccctcttcgcctctcgctccccgtcgtcggtgagccgcgcccgtccagccgcccaccctctcaccgatggcttcggcggccgcgaggggcgccgcggtgcgctcccctctcctcgtccaccaccgcgtccccctggtacatcccagcgggggaggctcgctccgggtcggctggcccgggattgcgcccggacgggaggggcggcggcgggtggccccggttggggctagggttttcgcgcgctactcccaggcccaggacttctccacacgcctccaagatagagctggtgagctgcctaagttagtcgaggaccttacccagacatcgattagcacagggcctcgaggtgctttcaggatggcccaagggatccaagctgtgcttggggtcggcggggagtggctgaatgacctttcaaagacagccaatacatcagcatcagcaggaattccatctcagatgcagcttggtttgctttctccactttaccttagaaggctttttgagcgcatgggtgccacttatatcaagttaggccagtttgtagcatctgcgccaactttttttcctgcagaatatgttgaggaattccagaaatgctttgaccaagcaccagctgtcccatatgacgtgattgaatcaatattacgtgaggagctgcagcggccattagatagtgtgtatgaatacattgatccggtgccaatagcctctgcctcaatagcacaggttcatggggctaggttgaagagctctcagaaagatgtggtgattaaagttctaaagcctggtattgaagatactttggttgctgatctgaattttatctatgttgttgcacgtgttttagagttcttgaaccctgaactacaaaggacatcactggtaggcattgtaaaggatataaaagaatcaatgcttgaggaagttgactttagaaaagaggctgcaaatattcaggcatttcagggatacattgatgcaatggggtttgacaggcaggcaaaagccccatttgtgtatcagcactgtagtacaaaacgtgtattgactatggaaagattgtatggagttccgcttactgatcttgattctataagatctcttgttcctgatcctgagttgactttagtcactgcccttaatgtctggtttggaagcttaatttcatgtgaatccttccatgctgatgtacatgctgggaatctatggttgctccgtgatgggcgaattggttttattgattttgggattgttggtcgaatatctccaagaacttgggcagctatggaggtctttttggcttcttttgcaactgaggattatgatgctatggcctctgccctctctgaaatgggtgctacagggaatgatataaatactaatgaatttgcaaaggacctgcgaaagatattctcatcgatacaggacctggatactgaaatcatagtggcaacagcaaggacccctgatgctacagcagtatctgctaatgttgtccttgatgagaggcagatgaatgctctatttcttgatctggtcagggtgagcgagtcttacgggctgaagtttcctcgggagtttgctcttctcatgaagcagctgctgtattttgatcgctacacaagactgctggctcccagcatgaacatgctgcgagacgagaggatcaacatctccaccaatcgacaaccaagaagaactgatagatttcagtgaagccacgtcgttagtcaccggccacgtactagaggagtcgtgatgggcgataatagcaagctcatgtgacccaatactgtatatagttttgccagaccagcatagaaatgaaccacacgctagaaattgtacactcagtcgtattctgggattgagcgttatatcgtactagtaacatgtaaaggctgtatcccacggctaaagtaaatttcagatgaactgcttttgtctcaaaaaaaaaaaaaaaaaaaaaaaaaaaaaaaaaaaagggcggctgctcgcgatctagaactag

SEQ ID NO: 8980 - DNA, 1671 bp, Zea mays
  misc_feature (1)..(2): n is a, c, g, or t
nnttatggtgtttgaacatcctaatcgaaaaaaaaaaaaaacgaattcgccttcttcaaaaacctcttcgacgtcgcacccgcaacgcacgctggcgggcggcggccatggcgtacctccctccccacaagcgccaacccagcaccacagcctccacgcccatccccgcacccaacccgccacctccgtccctctcctcctccctccgctccctctccctctcctccccgcgcggccgcggccgcggccgcggcgcagtcggacgccacccgctcgcttctacaaagattttccgcgctgccggctgcatctcacgttggttccctctacctcccttctcccctgccggcgacggcgaggagtacatcctacgcctcgagcccttcccttgtccccccatcgagcacaggaccggtgccaaaccccttgcccttgtcgtcgcctccaccccaggacaaggctcttccggctccactgcggcggcagtcacctccatcgccgagcagtttcttcccgatctccttgccgccgcggagagggtcaaggcagaaggcgcgcctaaggatgagttggtgaaactgagtctcgttgcaagactgggaacggtgctcttcgagtgccagcccggtggatcgcccgtttcactggacgaactccgtcaggccgctaaagcaggggaagatggttccaggagccagttgcgtaaaacgttctacaccagtttgtctagtgagtgtctggatgatatggagcgaaccatggtaaagaggattgggctggattttgattcgtccaagaagcactatcatgtgaaggtttctgacaagaatcgaagtgattctacaatatcttgcaaatgcaccgtggaggaagatgggagtcttgctatccataaggttgaattgaatcaggtacggcacttggtggaagacatatcctgtcttttcaaaggtcttgatctaaggttgatgttgagtaagaaaaggatcctgaaaaacctagattctgaagtggaaaatgcagtaaagagcttggtgtctactgctattattgatcctaatgtgaaagggggagttagatggccacttggaaaggaatcaattggcgagaggttcagcatagttggggtgtggcacacggactacaaagctttcagaaacgagaccatgaggctcaagctaaggcatgctgacagattcgatcaccgtacctcgactgggggagtttctgatgaagttacattcaaactaactgctatatcttgcaaactggaggaagatgatctggcggagagcgctgtgaaagagatgctggagtctgcggtccaaatgctatgggacaatgcgctcaactaccgggtcgtgccttgagctccggttatgcagacaatagttcttccttgaagatgcaaagcgacatgatttctttgagcccctcctgtcctgtactagtactgaacaagagaactcctaaacacaactgacgctggggctgcccacgcacgccatcaaaaaaataaaaataaagtagcgttgggaaaaaaaaaaaaaaaaaaaatctcgagcccggcccccccccggggggggggcccggtacccattcgcctatatagtgagtcgtattagcggctccccggggggcgcggtttttaaaagcgtcggggactggaaa

SEQ ID NO: 8981 - DNA, 573 bp, Zea mays
cattgggtacctcgaggccggccgggatcaatcgccacccagcagagaaactaaacttgcatcgatcgctcgctcgtcagttctttctgatcatcggtcgcctctctagctagctagctacctgatcggccatggctgaggagaagaagcaccaccacctgttccaccgccacaaggacggcggcgaggaggaggcgagcgccggcggcgaggtggactacgacaagaaggagaagcaccacaagcacctggggcagctcggcgggctcggcgccatcgccgccggtgcatacgcaattcacgagaagcacaaggcgaagaaggaccccgagaacgcgcacggccacaaggtgaaggaggaggtggcggcggtggcggctctgggcgcggccgggttcgcgttccacgagcaccaccagaagaaggacgccaagaagcagggccagagctgatcgagcctctctctgtgtgtgtgccgcttattattgtggcgtttatagatacttactacttaataaatcgcctcgtccatgttgcctgccaaaaaaaaaaaaaaaaaaggcccctagggcc

SEQ ID NO: 8982 - DNA, 837 bp, Zea mays
aagaagaccgacgaccccaacttccagccggtatagacccgtgaccgccttcctctccactcctctttcttgccgcgcaagaacgcgcgccgcttttatctaccgcggccgccgcctgcgggccagtccgttcacgttcctgcttttcccctgtcctgcggttttggcctttttgcccccggcttcctggcggcaacgaaacaaccagtcggttcggtcgatgcttcgcgagttggaattggacgccggccgacccgctgctcaatccgtcgagttcgacatggctactcccttggttgctgggttgtcagtggctgccgctgcattaagcggaagatacatgattagagcatggcaagccttccggacccaggcggcaatgccgcgggtgcgccgcttctaccctggtggattccagggggaaatgaatcgaagggaagctgcattgatcctcggcgtcagagaacgtgctacagtggacaagatcaaggaggctcacaggagggtcatggtagctaaccaccctgatgctggtggcagccattacgtcgcctccaagatcaatgaggcgaaggacatgctgatgggaaaagggaagtccgggtcttcgatcttttagctgacacaagctcattctgctgtggcgtgatcaggctgtagctttttcgagggactgacagttgcacgtttcacatttcttaacaatgctctgctgcttgtaccatatatcataaaggatacagatacagatacagaattgaatcaacttattatctgggtcttaagttattgtttggactgattggaaatagtaaccatgtatatctcagagccccc

SEQ ID NO: 8983 - DNA, 1409 bp, Zea mays
cggatacccaatcgaattcttcttctgaagtaggagcagctaatagcacaacagatagtaaggaaaatctgagttctggcagtaattccggctcgagcactcccattgatgagagttatgctcaaaaaattattacagagaaggtgctaaagaaaagaacttttagggttccattgaaggttgtggaaaaaacaactggtgctggaacaattctttcgaaggagttgtattctgaagcaaaaaataggttagaggcactcgataagaaggatgcggaacggaggaaaactgctgaacttaagaataacctagagtcatacatatattctatgaaggagaagctggaagaaagcgcagatattttgactgtctcaactgaacaggagagggaatcctttgctgagaaacttagtgaggtgcaggattggttatatatggacggtgaagatgctcaagctaatgaattcaaagagcgtcttgaccaacttaaagccattggtgacccaattcttttcagattgagtgaattaaaaacccgaccaacggcctgtgaaaatgctcgattgtatcttgatgagctgcaaaagattgttaagaactgggagacaaacaaaccatggctcccccaaaagagagtagatgaggttgtaagtgaagcagagaaagtgaaagcttggctgaaggagaaggaaaacctgcagaaaaatacccctgtctttaacccaccagttttcacatctgaagaagtttctgagaaagttctggacttacaagataaggtctcaagtgtcaataggattccaaaaccaaaaccgaaggtcgagaagaaaacagcaaaggaggaagaacctgctagcaaggagaaaaccacctatacggaatctgcacccaacgagggtgaatacaccgaaacgtctcaggaatctaaggctcaagaagaggatcagtctgcatcagccaacactagtgattcagaacctgaacctcatgacgagttgtgagaaccagacagaatccataggaacaggtcgggacgacgcattacgcatgtactacaagaaggcagtttgaggataaattttggttgctcaattttttccaaaattttatttgacgaccgaaagacgaggctatgtaggtgttgaggaacactagatgctgtagggccaaaaatattttatcggtagtttctgattgctgtatagcagcctcatcgttgtgtaagttactcgcctcgaaggcgtagttcaggatctagaatcgctttgttatactgaactcatttcattttttaatgaagaatgctatataggattttacgtcagtaaggtattgttgtactgagctgatttgattttttaaataaataatttcatagattgtacgtcaaaaaataaaaagatattttt

SEQ ID NO: 8984 - DNA, 1227 bp, Zea mays
atgcaacgccgaagctcggaattcggctcgaggaacattcgggcggccgttgaaggttgtggaaaaaacagctggtgctggagcaattcgttcaaaggagttgtattctgaagcaaaaaataggttagaggcactcgataagaaggatgctgagcggaggaaaactgctgaacttaagaataacctagagtcatacatatattctatgaaggagaagttggaagaaagcacaggtattttgactgtctcaactgaacaggagagggaatcctttgcgcagaaacttagtgaggtgcaggattggttgtacatggacggtgaagatgctcaagctaatgaattcaaagagcgccttggtcaacttaaggccattggtgatccgattcttttcagattgagtgaattaaaagcccgaccagctgcctgtgaaaatgctcgattgtatcttgatgagctgcaaaagattgtgaacaagtgggagacaaataaaccatggctccccaaaaagagagtagatgaggttgtgagtcaagcagagaaagtgaaagcttggctggaggagaaggaaaacctgcagaaaaatacccctgtctatagctcaccagttttcacatctgaacaagtttatgagaaagttctggacttacaagataaggtctcaagtgtcaacagaattccaaaaccaaaacccaaggccgagaagaaaatagcagaggaagagcctgctagcaaggggaaaaccacatcttcggaatctgcacccaacgagggtgagtacaccgaaacgtctcaggaacctaaggctcgagaaggggatcattcagcatcagccaacagtagtgatttagatcctgaatctcacgacgagttgtgagtagcagaatccatagaaacaggtaggaaagattacgcatatatagtacacaagaaggcagtttgaggataaattttggttgctcaaatttccccaatttttatttgacgaccaaaagatgaggctatgtagtagggtgccgaggaatactagatgctgtagggccgaaatgattttatcggtagtttctgattgctcattgctgtaaggcagctttatattggtgtaagttactcgcctcaaaggcgttattcaggatctagaaacgctttgttgtgctgaactcatttcatttctttgacgagtaacgctatatagattctacgccaagagaattgtagtaatgaaaacat

SEQ ID NO: 8985 - DNA, 1461 bp, Zea mays
gtgccgtaccgaatcgccgggtcgacccaggcgacccgtagaagtggaattgttgctcttgatagagcagaagcagtaattgagataactgaatgggttgaagttccaaagaagatattgactctagagagtaacatcaccaatctgaattcttcttctgaagtaggagcagctaatagcacaacagatagtaaggaaaatctgagttctggcagtaatactaattcgagcactcccattgatgagagtaatgctcaagaaattattacagagaaggtgctaaagaaaagaacttttagggttccattgaaggttgtggaaaaaacaactggtgctggaacaattctttcgaaggagttgtattctgaagcaaaaaataggttagaggcactcgataagaaggatgcagaacggaggaaaactgctgaacttaagaataacctagagtcatacatatattctatgaaggagaagctggaagaaagcgcagatattttgactgtctcaactgaacaggagagggaatcctttgctgagaaacttagtgaggtgcaggattggttatatatggacggtgaagatgctcaagctaatgaattcaaagagcgtcttgaccaacttaaagccattggtgacccaattcttttcagattgtcaagaactgggagacaaacaaaccatggctcccccaaaagagagtagatgaggttgtaagtgaagcagagaaagtgaaagcttggctgaaggagaaggaaaacctgcagaaaaatacccctgtctttagcccaccagttttcacatctgaagaagtttctgataaagttctggacttacaagataaggtctcaagtgtcaataggattccaaaaccaaaaccgaaggtcgagaagaaaacagcaaaggaggaagaacctgctagcaaggagaaaaccacctatacggaatctgcacccaacgagggtgaatacaccgaaacgtctcaggaatctaaggctcaagaagaggatcagtctgcatcagccaacactagtgattcagaacctgaacctcatgacgagttgtgagaaccagacagaatccataggaacaggtcgggacgacgcattacgcatgtactacaagaaggcagtttgaggataaattttggttgctcaattttttccaaaattttatttgacgaccgaaagacgaggctatgtaggtgttgaggaacactagatgctgtagggccaaaaatattttatcggtagtttctgattgctgtatagcagcctcatcgttgtgtaagttactcgcctcgaaggcgtagttcaggatctagaatcgctttgttatactgaactcatttcattttttaatgaagaatgctatataggattttacgtcagtaaaaaaaaaaaaaagcttgttgtactgagctgatttgattttttaaataaataatttcatagattgtacgtc

SEQ ID NO: 8986 - DNA, 1408 bp, Zea mays
gttcataatttcatggaagcaggaaaaaaactaaatcctagtatacagtaaattccacagcagggaacaaaaccatcactttacatccattttatccatgttgtggaattgctcagtataacattttgactgatttaactcatggttgatgtgttattctgttctcaattcagtgcatgtttggtttttcagattgtgaacaagtgggagacaaataaaccatggctccccaaaaagagagtagatgaggtaaacctgtgagcttaatgacgtcgacttgttttgtaattatgtgtaatgctcattttggtggtcatgtaatgctctggctctaggttgtgagtcaagcagagaaagtgaaagcttggctggaggagaaggaaaacctgcagaaaaagtataccttttgagtcagcttgctttttttgttgtcttgtaaaaggtggctaactccggttgagcattttgcagtacccctgtctatagctcaccagttttcacatctgaacaagtttatgagaaagttctggacttacaagataaggttagtaatttggtagtggacccaacaaaaagtctgcatattactcatggcagtaatcatatctatacccttttattgtgcaggtctctggggtcggcagaattccaaaaccaaaacccaaggccgagaagaaaatagcagaggaagagcctgctagcaaggggaaaaccacatcttcggaatctgcacccaacgagggtgagtacaccgaaacgtctcaggaacctaaggctcgagaaggggatcattcagcatcagccaacagtagtgatttagatcctgaatctcacgacgagttgtgagtagcagaatccatagaaacaggtaggaaagattacgcatatatagtacacaagaaggcagtttgaggataaattttggttgctcaaatttccccaatttttatttgacgaccaaaagatgaggctatgtagtagggtgccgaggaatactagatgctgtagggccgaaatgattttatcggtagtttctgattgctcattgctgtaaggcagctttatattggtgtaagttactcgcctcaaaggcgttattcaggatctagaaacgctttgttgtgctgaactcatttcatttttttgacgagtaacgctatatagattctacgccaagagtattgttgtaatgaattcatttgattttttaaacgagaaattctatatagattttacatcaaaaaaaaaaaaaaaaactcgctcgtgccgggagctttgcctttcaattaagagagaggggaaaaaagttagagtacataggggcggcaaccctcaggccatagaattgggcacctaagaaggaacacgacagacaatcctagtacaagccaaggcggctggacgcact

SEQ ID NO: 8987 - DNA, 1271 bp, Zea mays
ctcgaggccggccgggctactgagcaatgatgcatgccgtgccgcgcgacttcttggcttcctctccgtttcttcttccttgtccgaggccgacacagcagccgtcgtcctgctagctaatcaatctagcgactgttttgccccccttttttttcttctcagttccacttgcttgccactgtgctcggttgcttagacagccagcattgccgggaaagcaacggaggccacggcgacctgcatcagccaggcagcttgtgcgtgctataaatggcgtgaggcgaggaagagaaggaagagagaatagctaggccgcgccgacgccgaaccgcagcagacacgcgcgcggacagcgtacgagggagggagctgcctgaggtagaggaggaggagaacatgcagggcggcggcggcgtggaccagccgccgatgcagatggtgctgcgggtgaggcacccgtcgtcgctgggcggcagcggggcggacgaggacgacggcgaggggtcctctaggtcggcgctctcggtgttcaaggccaaggaggagcagatcgagcggcgcaagatggaggtccgggagaaggtgttcgcccacctcggacgcgtcgaggaggagtccaagcgactcgccttcatcaggcaggagcttgaagggatggccgaccctacaaggaaggaggtggagtcgataaggaagcggatcgacacggtgaaccgtcagctcaagcctctcagcaagagctgcgtcaagaaggagaaggagtacaaggaggtcctggaggcgtacaacgagaagagcaaagagaaggctctgctagtgaacaggctaatcgagcttgtgagcgaaagcgagaggatgcggatgaagaagctcgaggagctcaacaagacggtcgactcgctctactagacgccagtcggtgctccgtgctctgctcacccacctctccatccactcatccatccagagcttgcacgctcgccctctgtaatctgatccccgtgtgccgtggattcgtgacctgttcaaggtggtgcttgtagtaactgatgtttttcgttgggtgatccttttctcttctttttttcttcttctctctttggtctcttttatttcaccagttcgtacgagtctcgttgcactgtcattgtcgagtaaaactgacgtactgtatttataagcaacaaacaggtaccagctgctgtctaaccacgttttgatggttcattcaaaaaaaaaaaaaaaatagtcttttgttcagggttgttccc

SEQ ID NO: 8988 - DNA, 1627 bp, Zea mays
aggccggccgggccgggctgcgcgagcctgaccagccacctagacctagctgaacccgaactggcgcacgaaccctagctactacctactagacgtccctgcccccttccccttcggagctgctggattcacccctcctctccctcgcgggtcccggcgcggacgcaaggcaaaggcaaaaggcggcagaggtggcgctgcagtccaccaattagcggctatggtgcttggcaagatcgccatcgtcatcggctccggagttatcggatcagtactcacaggtggtgagtctggccttcccgacttcaaggatgcaatctctggtgctttcaagttcttgaccaagagttcaaagcaaggcaaggatgggccgtcgaccagcaggccacatacttctgagttgttgacccaggtcaattatctcagagaggagctacaaatgttgtctaaatcaaatcatgttgctattgtcactgttgatggtagacctgggcctggtgcatatggtattacagctgttattattggagctattggctatttattcataagatggaaggggtggaaactttctgatatgatgtttgtgacgaagcgtggattatctgatgcttgcaatgttgtggggaaacaagtggatcaggtttcagaaagtgttaatgttgcaaggagacatcttgcaggaaggattgatcgtgtagattgtagtttagatgaatgccatgaaattacagaagccacaagggaacaggtcacaatcatccatggagatctaagtgccttccagaaggaaatggaaacagttcatcttgtagttcgtagtctggaggcaaagcttggacgcctagcttatactcaagatcggacaacacgaggaatatatgatttgtgcgaattcactaaaagattggatcagagcccgaaagctgagactcatcaggttacatcatcaacttctcgccctgctattgaatcctcagagagaattgccaaagctgggggcaaagaaccagctttggaaccagagtctcatagaatagaggcgcctaaggttgtgcgctcatctacaatcatgtcagcatcgggacttagtttgctagctggaactacaacaccacctaaaagagaccagccgggtgctttcagcagagcaagttcaatgaaggaaggatcctctgagttaccgagtggtgtccgaagctcagcagaaccaagccccaggagatctggcggttcaaccctttttggagggcttggttttctaaggagctacaccagctgagacgtatgtgctcagatacgtgaatttttattcagactccatcagcttgagctgcatatgtaggtagtagaaaacatggcagttgccaaaaggatggctcccttttccaattgcgaatttttgtaggaacttaataccttgcagggcaatgcctcgagggttgtatattgcactggattatactagtagaatacatgtttggcaaggagcagttgcaactaaatttgtgcttttcttggactcaaacctgctggctgatgatgcttgcttggatagcatgtatgcaacatttgttgtggcagctgcaggcatatctggaactctggatccactcacggttggatt

SEQ ID NO: 8989 - DNA, 1554 bp, Zea mays
caaaggcagcggaggtggcgctgcagtccaccagttcttgggctcttggcaacgtcgccatcgtcatcggccatggttcttggcaacgtcgccatcgtcatcggctccggggtcgccgccgcggtacttacaggcggtgagtttggccttcccgacttcagggatgcaatctctggggctttcaagttcttgaccaagagtgcaaagccaggcaaggatgggccgtctaccagcagtccacatactgctgagttgttcagccaggtcaatcatctcagagaggagctgcaaatgttgtctaaatcaaatcatgtttccattgtcactgttgatggtagacctggccctggtgcatacggtataacagctgttgttattggaggagctattggctatttattcataagatggaaggggtggaaactttctgatatgatgtttgtgacgaagcgtgggttatcagatgcttgcaatgtagtggggaaacaagtggatcaggtttcagaaagtgttaatgttgcaaagaaacatcttgctggaaggattgatcgtgtagattgtagtttagatgaatgccaagaaattacagaagccacaaaggaagaggttacaatcatccatggagatctaagtgccttccagaaggaaatggaaacagttcatctcgtagttcgtagtctggagacaaagcttggacgcctagcttatactcaagatcggacaacacgaggaatatatgatttgtgtgaattcactaaaagattggatcagagcccgaaagctgatactcgtcaggttacatcatcaacttctcgtcctgctattgaatcctcagagagaattgttagggttgcttctttacccctggctttggaaccggagtctcctagaattgaggcacctaaggttgtgcgctcatctacagtcatgtcagcatcgggtcttagtttgctagctggaactacaataccacctaaaagagatcaaccgggtgtgtacagcagagcaagttcaatgaaggaaggatcctctgagttgccgagtggcgtgcgaaactcagcagaaccaagccccaggagatctggtgcttcaaccctgtttggagggcttgggtttctaaggaactacaccagctgagatgtatgtgctcagataggtgttttttttcccaaggagaccagcagtttgagctgtatatgtaggtagtaggtaatagggcagttgccaaaaggacggctcccttttcctattgggaattgcgaatttttgtaggaactaataccttgcagagcaatgcctcgatgccaagatacagactttaaatttaatgttgggttagatgctggaagagaaacatcctattgtatattgcagtggaatgtactgctggaatacatgtttgggaaggagcaattacaactaagtttgtgcttttggtgcactggactctacctgctggctgatgttaggatagcatgtactgtatgcagcattgttgttgcagctgaaggctgcagccatgcctggaatcaccggggtcggccggcatgcatt

SEQ ID NO: 8990 - DNA, 1466 bp, Zea mays
gagccggccggggcgcgagcctgaccagcccctagctgaacccgaactggcgcacgaaccctagctactacctactagacgtccctgcccccttcccctccggaggtgctggattcacccctcctctccctcgcgggtcccggcgcggacgcaaggcaaaggcaaaaggcggcagaggtggcgctgcagtccaccaattagcggctatggtgcttggcaagatcgccatcgtcatcggctccggagttatcggatcagtactcacaggtggtgagtctggtcttcccgacttcaaggatgcaatctctggtgctttcaagttcttgaccaagagttcaaagcaaggcaaagatgggccgtcgaccagcaggccacatacttctgagttgttgacccaggtcaattatctcagagaggagctacaaatgttgtctaaatcaaatcatgttgctattgtcactgttgatggtagacctgggcctggtgcatatggtattacagctgttattattggagctattggctatttattcataagatggaaggggtggaaactttctgatatgatgtttgtgacgaagcgtggattatctgatgcttgcaatgttgtggggaaacaagtggatcaggtttcagaaagtgttaatgttgcaaggagacatcttgcaggaaggattgatcgtgtagattgtaggcgcggacgcgtgggtgaaattacagaagccacaagggaacaggtcacaatcatccatggagatctaagtgccttccagaaggaaatggaaacagttcatcttgtagttcgtagtctggaggcaaagcttggacgcctagcttatactcaagatcggacaacacgaggaatatatgatttgtgcgaattcactaaaagattggatcagagcccgaaagctgagactcatcaggttacatcatcaacttctcgccctgctattgaatcctcagagagaattgctagggctggttctttgcccccagctttggaaccagagtctcctagaatagaggcgcctaaggttgtgcgctcatctacaatcatgtcagcatcgggacttagtttgctagctggaactacaacaccacctaaaagagaccagccgggtgctttcagcagagcaagttcaatgaaggaaggatcctctgagttaccgagtggtgtccgaagctcagcagaaccaagccccaggagatctggcggttcaaccctttttggagggcttggttttctaaggagctacaccagctgagacgtatgtgctcagatacgtgaatttttattcagactccatcagcttgagctgcatatgtaggtagtagaaaacatggcagttgccaaaaggatggctcccttttccaattgcgaatttttgtagggacttaataccttgcagggcaatgccttcgagggttgtatattgcactggattattctaggtagatacatg

SEQ ID NO: 8991 - DNA, 1544 bp, Zea mays
cgtcgcgtggggtcgccatctcggctgtgggccggatcgtctttttcgcccggagggagggcgcccagaaaccgtgggaggccaaggccgcccacggttccggaggaggagagtccttcgactgggtacccttccaagatgctcgctgatgcacgatacatatcgcagacgctgaagctgggcgccctggggatcccgtcatatagagcattttctctggtcgagcttgaagctgcaactaataacttcgagaactctcacctgctggggcaggactctcacggcgagatgtaccgaggaaggttaggcaatggcaccccagtgacgatcaggacgctgaagatgaagaggagccagaccgcccagagcttcaaccgccacatcgagacgatctccaggctcaggcaccagaacctggtcagcgctctgggacactgcttcgagtacaatctcgacgagtccactgtcacccagctgtacatcgtgttcgagtacgtgcagaatgggaacctgaggagcaggatctcgcaagggaccgaagggtgcaggctgacgtggtcgcagaggatctcggccgccatcggcgtcgccaagggcatccagttcctgcacggggggatcatacctggcctggtcggaaacgatctgcggatcacgaacgtccttgtggaccagaaccatgtcgccaagatcggcagctacaacatcccgatcctggcggaggccatgaggtccgagcagggaggagctgggaacaagttccaggctgacagtcgggtgaagagcgataagacggacatcttcgacttcggggtgatcctgcttgaggttgtgtccgggaagaccatcacgtccatgtatgaagtggagatactgaaagaactgcttgcatgggcgattgccgacgaggaccgggtgaggaggaggagcttcgcagaccccgcggtgagcaaagggtgctcggacgagtcgctgaggacggtcatggagatctgtcagaggtgcctggcgaaggaggcgtcgcagcggccctcggtggaggacgtgctgtggaacctgcagttcgccgcccaggtgcaggacgactgggagacggatgcctggagcagcggcggaggaagcccagtgtcgtcgtcgtccagagccaccaggccgtctcggctacacttgagcagatagatgatcaggtgcttcaccaatctccagtaaagcggtcacatgatctacccatagtctaccggggacaaggacaaggatctaaagatgggaaatgctggtcagcctacagtacagcatctgcctctgatgggatgctgaaaaccacagcagtatcagctcgctgaaaactgtcctccctgtggtgcagactaatgtgctttgcgccactgtagagttcttttttggtttctctttatcatcacgtccctatctacgagtacaataatggtgtgccttttgtccattttcccccattggtattggtagcacaataatgatgtaacaggcattgccttctacgtcctgagttttgtgatcatcgtatt

SEQ ID NO: 8992 - DNA, 1104 bp, Zea mays
gccggccgggtcgggaggcggccacgcaagctccacgaagggaacgaaaccgacgccgagcccgagacggcgagccgttgcggcacgacacctcgctcgcttctcttccaggctgcgacctcccttccacatggccgctcccatccacgcgcgtctcctcccgctccccttgcacccgaacccaagccccagtctccacgcgagcggcacacgacgggtgccctggcccccgcgccaccgccgccgctgcctcgcgacgccgccgtcgcggaacgggagctcctcctcgccggagattgactggtgcccggtgcctccggaccagctccccgtgaacgagtacgaggcgctcgcggcctccctgcccttctcctgggcggcggggggcctccgcgtctactgctcccgcctcgcgctcacgggcgccgccgtcgcgctcttcgtcgggctcccggtcgccgccttcgggggccgcggcggggccggcggcgacgctctgcacctcgcgctcggcgccacggggtccgggatcctcgccgtcacgctcgctgtcgtgcggatgtacctcgggtgggcctacgtcggcaaccgcctgctcagcgccacagtggagtatgaggaaacgggatggtatgatggtcagatatgggttaaaactccagaagttttagctcgtgatcggcttctaggctcattttctgtcaagcctgtgctaaacagggtgaagttcaccttggtgggtctggcaggctccctgatcctttgcattcttctgtacgtgaacacggaaaccccaaaggaaccttatggaaataccggtggaaggtctatcccgggagtgtacagcgacgctgctgcaaggtcgtttgagcccgatgcattctgtggagaacctgatttgtcgtagcatcgtaaagcgtggagcatggaaggtttgtagatggcggtatatggtctcacagggtatatacgggggtttctgtacggggtttctgatccatcaaactagggtaatgtaaatatttggccacacccacactagtatcgacattttagacgcaagcctcttatgaaaattcaaaaaaaaaaagaaaactgattgct

SEQ ID NO: 8993 - DNA, 4253 bp, Zea mays
ttggggttgcaactcgcaagcgcgtgtagaacggggtccggtggtccatccgagccgtctcaccaacccaccgcagtccgcccagcccagcacagcacagcacaccacccggtcgtcatatggcggtgtctggtttacgatgcaacttgtcgtgtcgcaaattaaattgaacgtgctcactgctataactgcgatatattgtacagtacgtatctttttagcactttgtctcgcgtgtcctaggtctcatttggtacagctcagactcactgttaaatctaccttcttttcttaaatagcttcataaacggcgttctttggtttagctggaaatttaaaaaaaaagctatttggcaaaacagttttatcaacagttttatgtgtgactaaggacatcttcagctgatctcctattctatctcttctctcttccactatttcaaactccaccctaaaaacagtgacatataccagcttcgcatcccctattttatagggttaaatatgtctatgtcattgtaataattttttatgttttgatatgtgcaactaaacttcttaagcttgtaaatgtaccattaaacttgtaattaaatatgaaacaagccattgtgtacggttttgctgaaattagaccaacaaaaggaaatacgaaaatagtggacaacgggacaagcccactggctggttgacagtacaaggaaggaaggaagcaagaaagcgtccccgccccgccgtccggttcgatgccgagcagccgagggagggacgagtggacaacggaagcgttgttgcccggaccgtcgccggtcgctggagggcggggccgaccggagaccaggtcccgcgtgtcagatacgtaccaggtggggggcgtgccgggcgtcgtacgctggaccgggacaaggggaaagcatctgctactccggcaggtctcactccgagaactcataaataaacgccgccccgtttcccctcccctctctgacctccctctctcctcctctctcttgcttttgccaaccagaagcatcgtgccgaggcagccaagtatctcagcttctgattctcctcctccaaacaccatccgcgggcgtggcgtacatacccagtggtgccgacgactgccgagcaaggcaaaaaggccaagcagcgccccgggccgggccccagcgcggcgcctattggttcgctctgatcgccggggctagtcaacggccggtgatcagccgaccctcgcgcgggagtggggccgcggaacggcggcgatggcggggctgccgccggtcgccaggcggcgcccgctcgcgacggcgtcgtcgctgctgctgcttttgctgctgctcgtggtgaccgcggcggcgcgcgaggagcggggcctggcgcgtgtgcagggcccgccgccgcgccaccgccacgcgtacgccgcgatgatgtacatgggcacgccgcgggactacgagttctacgtcgccgtgcgcgtcatgatgcgctccctcccccgcgtccgcgccgacgccgaccgcgtcctcatcgcctccgccgacgtgccgcgcgactgggtccgcgcaatgtgagtgccgccttcctcgtccgctccgacgcgtctccgtcgaccaatagcgaaaccagagttcgaagccattccttgcaaagactttccaaggttattttttgcggataattttattgcgcactgcaaacccgcgtcgcgtctcgttgcggtgcaaactacagtgtagaaactcaaggcgaagactaggggatgtgtgacgtgttttcgggtacctgggagaacgatgatttgctagttcgggaagtggaaccgggcccgcctgcagagaggaagcttctcctagtttttttttttcaaattcttgtggggggtatcttcggccactcacatcgagacatatgcactgcatcctgcaatgcttactttgttattaaagttgctcacagaatatgctgtcatggatgcacagctctgaagctttgactatttcctgtcgtgtactttttcaatcctctgctacccacttacactggtcaactttcctttttcttttatagtgattgcacagaggatcttcgtttgtacaaaaataaatgttttccgtagtttctctgaccaggttcatagccaacacttttgtgtcttttatcattggtggtatcaaagtcagtcccaaacgattaatagcgatcggtgaatgtcccccaagacatggcttcatcgtttcacaagggtcaacgggacattttttttcttacttgttttactttcgtacgaagacttgtttcaacgaactaggaattttgaatgcaaaatgcgaaatgaaacgagacacctattgacaatacaaggggacgtatgcaggacagaagaggatggcatgagggtgttgatagtggagaacctcaggaatccttacgagagcaacctaggagggaccaacaagaggttcaagctgacactgaacaagctttatgcctggaccctggtggactacgagcgtgtcgtcatgattgattccgataacatcttcctccagaacacagacgagctattccaatgtggacagttctgtgctgttttcatcaacccgtgctacttccacaccggtcttttcgtgctccaggtatgtactgaactttcgttgttccacttgtgacctgtcccgatacaaccaaaatctgtgtcattttgcttgaaatcgtgagagcttgttgacttagctatgtcatacaaaacttctttagtcaaaatgccagttacaaactaatagaatttgagcatgcgtacccccaaagctgaagtatacgtcttcttccagtatgaatgatccattgaaaagaaaattcccaccatccataacttgattcttgttaaactcacacactgagatatgttgtgctcagacatgtaatggccaaccagactaatattggactcttcttcaatctgcagccttctattgatgtattcagaagcatgcttcatgacctggagactggccgtgaaaactctgatggtgctgaccaaggctttttggttgggtgctacccagacttgctcgacaaaccaatgtttcaccctcctgagaatggcacaaagctcaatgggacctatcgccttcctcttggctatcaaatggatgcgtcatactactgtgagtgctgcagctacacagcttcaataccaatgcacctgcctgcagctattgcttctgaaaatttcaaccacccttttgatgcatccctgcagatctcaagctacattggcatgtcccctgtgggccaaacagtgtcatcacattccccagcgcaccttggtttaaaccttggtactggtggtcctggccggtcttgccattaggtctttcctggcacaagcagcgctgggacgatcttgggtgagtcaataaaacagcacagaagcaaatatgtgtacctgagccgacagaaaattcattttatgttctatccactaaacaattacctgcttacatttcacaggtatgctgctgaaatgccagtgattctgatggagcttttgatgtacatagttatcatagcagtcaccagattggcaaggccagggatcaccaaactgtgctataaccgacggcctgagaagcaaagtgccctggtgcagtggctgatcaagctggctgcaattgcggctatggtggctgcatattccattccattctttgtgatcccacgcacagtccacccgatcatgggctggtccgtctacctatttggcgcgcttgccttgtcagtgctcgttatcaatgtttttctgctcccgccacttgatgtgcttacaacgtggcttgcaattgtgggcatgctcatcgttatggcattcccatggtaccatgatggtgttgtgagggctctggcggtctttggatatgcattttgctctgcgccaatcttgtgggcatccatggtgaggatgatggactcactgcagacgatgctcgagagggattcattcttcccccggattggtgaaccagcacaggagactgaattcagcaagctgtactgattcttttacgcacagatttgggatgcttcatcaccatatgaacagatgatccggatcagttaattctcgattgatgctggtggttttcgctcaggcattccgttgcgtactcatagtaatgtataaacattgcccccggccgccatgatagatgcagattcaggaaagacaggtcagttgtactgaactg

SEQ ID NO: 8994 - DNA, 1114 bp, Zea mays
gaaaaaaaatcatgaaatgcaacaatgaatatgttacggagttttgtcacagatttgctaaacagagctatatgttacactagagttcagaaagaagtaatctaggtaggatacccaggggaaaaaaacatgaaatgcaacaacgaatatgttttttttttttgttttgggatgatactcaatttgcaaacaggaccaggtttaaaaacagcttgtgtttttgatgcagtacaattacaatatctcaaacaatcatctacatcacagcggatgacatggtatagaaaatgaggtgccctcaactggacatgttctctactatggagaaaatagaagacatgcctctctaaacttcagcatcttgtctagactgaaccattagcttgtcctgtaactctggttgcctggggagaacaatcttagcccctcgacctgaagacgtgaaatatctcttcaaaatcatcacagcagcatatgcatcagatttggtgtcacgagcagacttcttgacacccctggagatcatgtaatctagggcgtccgtggacgttccatattcatcctgcagataaaccctcaagcccctttgggcagcttggacggcgagcctcccgacgacgctccgcactttgttggactgcggtgtctccgacccatcagcggacacgggaagcccgatgatgagctcgtccgcctcctgctgccgagccacgtcgagcagcgcaagctctagcttctgcccgcggagcctcagaacagtgaggggtcgagggaaggtgatccccctcccgatggcgaggccggtgcgggcgtcgccgaggtcgacgccgaggctgaacccgccgccgtgccagagcgggtcgcgtccccgccgccgcgcgtttggctggagcggggcggggagctcggcggcggcttccgtccggcctggtacgggagatgccctgatagctccagcagctcttcgacggcgcgggggcgggaaggaagcggaggccgcgcacgcgcgggcccgcacgagcggcgccggctccactgccgctgcggttgtcatggcaaggcgattcggcggtcgtgcagctgattcgttgccttggataggggaaagtgagtt

SEQ ID NO: 8995 - DNA, 585 bp, Zea mays
gatccatttcgaggactcgtactaggttcggcgttcgtagctcgtgtcgtttctgaagctagctagctagcgagcgacaggcgatggcgagccgcaagtgtctcggaggcgagggaagcgcgccggcaccgcacgtcctcgcggtggacgacagctcggtcgaccgcgccgtcatcgccggcatcctcaggagctcacagttccgcgtgacggccgtggacagcgggaagagggcactggagctgctgggcaccgagcccaacgtgagcatgatcattaccgactactggatgcccgagatgactggatacgagctcctcaagaagatcaaggagtcgtccaggctgaaggagatccccgtggtgatcatgtcctcagagaacgtgccgacaaggatcaacaggttgcctggaggaaggcgccgaggatttcctgctgaagcccgtccgcccgtccgacgtgtcgcgcctgtgcagccgcgtcctgcggtgagcacggcggcaagtagtagcacagcatgctggcgcgcatgctcgtggtagttcttttggggatgcatggtggtagctgtagcagcggcattcc

SEQ ID NO: 8996 - DNA, 890 bp, Zea mays
  misc_feature (890)..(890): n is a, c, g, or t
ccgaaagttctatttaattggttatcaatcgtttggcgtccgttccgatttccgcgtctctcccgctcgctgcttctccaactccgccgccgccttgcctcgctcccctccggccgtcccgtcgcccgtcgcccgcaagctctgcatcgcttctccagcttcagccccagccgccgcctccggatctgttctgtccgcctggtggggtggccttcaccgatccaacaaagggcgagttcgtcggcgcttcaaagctacgagattctttgccgtcgagttcactccatccccgcaacgagaaagctccaactcccccaccgtgcacaagaaaaacctagcggctataaccccctaatcctaccagtaattcccaacatgcctcgtctctgccgccgcgcagctcctaccagaagaaggagaccgcgggaccagcgcgccgggagatgggttacaaggcgacgccgcgccggaacgtactttgggctctcaacaatgccgaggccaacggcgggacgacgtctgtgccgcggatggaggcggcgcccatgatcaagttcagtgggaggcaggatgtggagcgcctgctaaaatgaagggcaaaagcaagagcgatttcaaggggagaatcaatcagatgagcgtctacatcaagaagctgagggcgtgcatccggtggtacatggagctggttattctgttgatattctgtagcttgcttaggtcatggttgctcgtattatctgcatagtagtctgtctatatttgattgacacagtaacgagctctattgctcaatgatgagcattctaataatcaaggatgtggtagaatagtcacagagattccttgcttcacacagtttggtcatatattagacatttgtgccaaan

SEQ ID NO: 8997 - DNA, 791 bp, Zea mays
  misc_feature (16)..(16): n is a, c, g, or t
  misc_feature (662)..(662): n is a, c, g, or t
gcacgagaccattacntagaacagcttggcggccgttccgatttccgcgtctctcccgctgcttctccaactccgccgccgccttgcctcgctcccctccggccgtcccgtcggccgtcgcccgcaagctctgcatcgcttctccagcttcagccccagccgccgcctccggatctgttctgtccgcctggtggggtggccttcaccgatccaacaaagggcgagttcgtcggcgcttcaaagctacgagattctttgccgtcgagttcactccatccccgcaacgagaaagctccaactcccccaccgtgcacaagaaaaacctagcggctataacccctaatcctaccagtaatccccaacatgcctcgtctctgccgccgcgcagctcctaccagaagaaggagaccgcgggaccagcgcgccgggagatgggttacaaggcgatgccgcgccggaacgtactttgggctctcaacaatgccgaggccaacggcgggacgacgtctgtgccgcggatggaggcggcgcccatgatcaagttcagtgggaggcaggatgtggagcgcctgctaaaatgaagggcaaaagcaagagcgatttcaagggggagaatcaatcagatgaagcgtctacatcaagaaagctgagggcgtgcatcncggtgcagttgaagatagctaatcgacaatgcaaggtcaaggcctctaccggttgtaacggattgataattagcatgtatctgaaacctcgtttgcaaccaaagttcactgctattttagtttgtcagc

SEQ ID NO: 8998 - DNA, 3442 bp, Zea mays
cgcggtttcttccgctgctgacttggacttgcctcgtcgcgctcgcggcgcccaacaacgacagtcgacaggacaaaagaaaaaataaagccccagccggagagcaacgtcccaacacgcccggtccggcccggcccatcccaaggcccgcgccgcgccgcgccgcgacacgggagccgggaggaagaaagaagttgaccgttcgtccgatgtgtgtgccgggactgcccccgcccgccccgtgtgctgcgtgcggcgagaccgccacgcggggcccaggccggcccgcccactgtcacgagcgcccggccggcgcgtcacccaccacctgccgcgccggccccagctttccccgcacaatggcacttggcagtggcaggggagtaaatatacccgccctgacacgtcggcccgggtacccacccaccctttgtcgcatcggttcaaaatatttcgaaaagcctccgccgccgcctgcacccccccctcccctcggcttctcgctcggatccggaccaacggaacaattccagttccatgcgaattcgaggctgctccatccattacgagctccgcgatttccctgaggcactcgttcccaacgaagcgcggtggggggaggccttcacccgtccaacaaagcgcgagttcgtcggcgcttcaaagccacgggattctttgccgtcgagttcactccatcccacccccccgcaccaagaaaggtccacctcccccaccgcgcacaagaaaaacctagcagctataacccctaatccccaccagtaatcccaccatggcctcgtctctgccgccgcgcagctcctaccagaagaaggagaacgcggtgccggcgcgccgggagatgggttacaacaaggcgacgccgcgccggaacgtgctatcggctctcaacaacgccgaggccaacggggggacgccgtccgtgccggcggatggcggcggcggcggcggcgcggcggaggcggcgcccgtgatcgagttcagtgggagggaggatgtggagcgcctgctcgccgagaaaatgaagggcaaaagcaagaacgatttcaaggggagagtcgatcagatgagcgactacatcaagaagctcagggcgtgcatccggtggtacatggagctggaggatggctatttggctgagcaggagaagctcctaggtgctatggattctgagaacacccgtcataccgagttggaggcccagctcagcactgctattgaagagctgaaagccactaacttggacttgacaaggcgttgtgagtctctagaggagagcttcaacaaggagaagtctgaaaaactgatcgctgtggagtcctacgagaaagaaaagcaggaaagggaatccgctgagagttcacgagatgtactaactgtggacctagaaagggtcactcatgatgctaagcggtttagcgagcagctaaaaatggtccaagacactaataaaaggcttcaagaatacaacaccagcctgcaacaatacaacagtaaccttcaggctgatgcctcgaagagtggtgagaccatctcaaaacttcagaaagagaagagtgccatgatggaaactatggctactctgagagagtgtaacagctcaatgggcaatcagcttgaatcttctagagtttctcaacaagaagctattagagtgaaggaagagctcaggaaagaagtggagtgccttagagttgagttgaagcaagttagagatgatcgtgatcattcagctattcaactgaacagtttgaacattgaacttggtaattacaaggaacagattggtaaaacttcaaaagaatgtgaaagattccgcaccaaagtatctgaacttgaggaaacatgcagtacacaacaagaacagattcggacatttcaaaagcagcttgcagttgcgactgagaagttgaagcttgctgatgtaactgcgatagaggcgatgactggttatgaagaacagaaggagaaaataaaataccttgaggagcgtttagcacaggcagagtctcaaattgttgaaggcgacgagttacggaaaaaactgcacaacactatattggaactgaaaggaaacattagggttttttgtagagttcgaccacttcttcgatttgagggtgattccaatggtccggaaggtgcctctatctcttttccaacatctgtagagtctactggacgtagcattgatttgataaaccaagggcaaaagctctccttctcatatgacaaggtttttgaccatggtgcgtcacaggaagatgtgtttgtggaaatatcgcaactagtccaaagtgcccttgatgggtacaaggtatgcatatttgcatatggtcaaactggatctggtaaaacttatacaatgatgggtaaaccaggaaatgatcaaaaagggataatacctcgttctttggagcaaattttcaagaccagtcggtttctagaatctcaaggatggaattattccatgcaagcatcaatgttggaaatatacaatgagaccattcgtgatttgttagcacctggtcggtctaacagttttgagtctagtaaacaatgcactataaagcatgaccctcatgggaatattgtgtcggaccttacaattattgatgtctttggtattgctgatgtgactagtctactagagaaagcatcccagagtaggtctgtgggtaagactcagatgaatgaacagtcgtccagaagtcattttgtattcacattaaagatatctggatctaacgagaacacaggccaaaatgtccaaggagtccttaacttgattgatttagctgggagtgagcgtcttgctaaaagtggctccacaggtgatcgcttgaaggaaactcagtcaatcaataaaagcttgtcggctttgagcgatgtaatcttcgcgatcgcaaaaggagatgaccacgttccgttcagaaattcaaaacttacatacctattgcagccttgccttggaggtgactcgaaagctctcatgtttgtcaacatttcaccggaggcatcctccgttggtgagacgatatgctcgttgaggtttgcttcaagggtgaatgcttgtgagattggaataccaagacgtcacacataagcccgtcccttcgttctaggctgaattatgggtgaaggtagctgtagggatcatggtaatgtgatatataatgtgttggtttgtgccgcatttggccacaaaggtgatgcccaacagaattcttgtaacttgtacagtgtaggtgatggtggtttgctgagagcagcatatgtacgagtgctgacatcttgtcatgctttccttactttttggtgtagcagacttgggtcatgttaattgtgatcgtgggttcgaatgtgaaactaccttttctctctcaaaaaaaaaaaaaaaaatactctgcgggggtatggc

SEQ ID NO: 8999 - DNA, 1273 bp, Zea mays
  misc_feature (980)..(980): n is a, c, g, or t
  misc_feature (1157)..(1157): n is a, c, g, or t
gcacgaggtaacttgaatccctcagttccagcgcgtggtccgccaggtccactgtccgtctttcctctggcgctcacgatccttttccctgcgtacgccgagctcacgcaggacaggagggagcggatgagatagacaaacagaaagagcccgtgtgcgtgacccgccggccccgtgactccgccgcaaagagagggagagtccacgctctgaagaagcaacggcgacgcccccgacgacgagcacagctgcccagcaaactagcagcgccctcgtcagttccgtctcgttcccaacctctcccggattcgattgacccgtccgctccaaatcgaatctaataagcagttttggagttgcggaagggagaaagagagagagagagagaggagaggggcatggatcaggtgctcaacaaggtggggagctactggttcagcaaaagggccagcaaggaaatcgactccatcggcgacgacatcagctcgatctcaagcagcattggagggtcagccaaatggatggtgaacaaaattaaagggaagatgcagaaagcactgccagatctcctcaaggaatatgacatgccagcagggctcttcccacgggacacgactaactatgagttcaatgaagagacaaagaagctgacagtgtacatcccgtcagcctgtgatgttggttacaaggactcgtcagtgctgcggttcttcacctgtgtgaccggctaccttgagaaggggaagttttccgacatcgagggcatgaagaccaaagtgctggtctggaccaaggtgactgccatcaagaccgagggcccaaaggtccatttcactgcaggtgtgaagaagactcggagccgtgatgcctatgaggtcgtcagagatggtattaccatagacaagttctagagcatatacctggcatgaaaaatgtgacgcgggtattcatatatgcttctctcctctcagttggtacanccgaaattcatacaatatcgtggggctaattctgcaatttgtaatgaaagtttaatatgctttgacgtgttaatcacactgctagagcatgcgataaatcgcagttggttcattattaggaaattgcattgagctgtaatcagatgcttctctcctcaggtggtacactcagaactngcaatattgtgtgctaattaagcggggacgtccagagataggaacgtcgcccacaaatacatttaaagcaggtggtgggctgatcaagcttggaccaactttggtgcccgtgttgt

SEQ ID NO: 9000 - DNA, 1187 bp, Zea mays
ctcgaggccggccgggactagagctggacccggtgcacgcagtaacttgaatccctcagtagcagcgcgtggtccgccaggtccactgtccgtctgtcctctggcgctcacgatccttttccctgcgtacgccgagctcacgcaggacaggagggagcggatgagatagacaaacagaaagagcccgtgtgcgtgacgcacggacgccgtgactccgccgcaaagagagggagtccacggtctgaagaagcaacggcgacgcccccgacgacgagcatagctgccccgcaaactagcagcgccctcgtcagttccgtctcgttcccaacctctcccggattcgattcgattgacccgtccgctccaaatcgaatctaatcagcagttttggagttgcggaagggagaaagagagaggagagggggcatggatcaggtgctaaacaaggtggggagctactggttcagcaaaagggccagcaaggaaatcgactccatcggcgacgacatcagctcgatctcaagcagcattggagggtcagccaaatggatggtgaacaaaattaaagggaagatgcagaaagcacttccagatctcctcaaggaatatgacatgccagcagggctcttcccacgggacacgactaactatgagttcaatgaagagacaaagaagctgacagtgtacatcccgtcagcctgtgatgttggttacaaggactcgtcagtgctgcggttcttcacctgtgtgaccggctaccttgaaaaggggaagttttccgacatcgagggcatgaagaccaaagtgctggtctggaccaaggtgactgccatcaagaccgagggcccaaaggtccatttcactgcaggcgtgaagaagactcggagccgtgatgcctatgaggtcgtcagagatggtatcaccatagacaagttctagagcatatacctggcatgaaaaatgtgacgcggttattcatatatgcttctctcctctcagttggtacaccgaaattcatacaatatcgtgggctaattctgcatttgtatgaaagtttaatatgcttgacgtgttaatcacactgctagagcatgcgataaatcgcagttggttcattattaggaaattgcattgagctgtaatcacaaaaaaaaaaaaaaaatcagttggtaccccgaaattcatac

SEQ ID NO: 9001 - DNA, 1120 bp, Zea mays
tcgcggacgcgtgcgccgccgcgatgagagggagagtccacgctctgaagaagcaacggcgacgccctccgacgacgagcacagctgcccagcaaactagcagcgccctcgtcagttccgtctcgttcccaacctctcccggattcgattcgattgacccgtccgctccaaatcgaatccaatcagcagttttggagtcgcggaagggagaaagggagaggagaggggcatggatcaggtgctcaacaaggtggggagctactggttcagcaaaagggccagcaaggaaatcgactccatcggcgacgacatcagctcgatctcaagcagcattggagggtcagccaaatggatggtgaacaaaattaaagggaagatgcagaaagcactgccagatctcctcaaggaatatgacatgccagcagggctcttcccacgggacacgactaactatgagttcaatgaagagacaaagaagctgacagtgtacatcccgtcagcctgtgatgttggttacaaggactcgtcagtgctgcggttcttcacctgtgtgaccggctaccttgagaaggggaagttttccgacatcgagggcatgaagaccaaagtgctggtctggaccaaggtgactgccatcaagaccgagggcccaaaggtccatttcactgcaggcgtgaagaagactcggagccgtgatgcctatgaggtcgtcagagatggtatcaccatagacaagttctagagcatatacctggcatgaaaaatgtgacgcggttattcatatatgcttctctcctctcgggtacaccgaaattcatacaatatcgtgggctaattctgcatttgtatgaaagtttaatatgcttgacgtgttaatcacactgctagagcatgcgataaatcgcagttggttcattattaggaaattgcattgagctgtaatcagatatgcttctctcctctcagttggtacaccgaaattcatacaatattgtgtgctaattctgcatttatgtatgaaagtttaatatgcttgacgtgttgattaaataacactgttagagcatgcgataaaacaaagttggaaaattattaaaaacaaacgggaaaaaaagcggcc

SEQ ID NO: 9002 - DNA, 1635 bp, Zea mays
ctcactcactcctgccgtcacccctagctgcatcggtccgcgatcgtacggacaggataccacgacgaacggaacctacgccggctgcgaacgcgaatctgaatacaacgaggtagatcctcctccgtaaagcgaaagcaaaaaccaaccaaacaagctagctagagctagccaagccgcggcgtgcctccgctccggccggcccgcccctgtcagagcccccaccgccgctgccacctccgccagccgtcaccccaggcgttggatcggggccctctcgatccgcgcccggcgaatccagacggacccgcattggggttggggccccttcgatccggcgcttggtgggggtttggctgggagctccaggctgaggggacggggcggggggacctgatccttcattccgttcggatttcgcttttcccccgtggggtctcgactgccggagggggaggaggacatggatttggcgtcggtcaacgaggagctggccgagatcgacgggcagatcggcgatatcctccgcgtattgcaaaatgggttccagaagctggagaagatcaaggatgccaaccgccgcagcaggcagcttgaagagcttactgataagatgcgagactgcaagagactcatcaaagacttcgagcgagttagcaaagctgaggctgagcatactgatccagcaacagcaaaaatgttgcatgacagaaagcagtcgatgatcaaagaattaaactcctacgttgctctaaagaaacagcaggcaagtgaaaacaagagaatcgatctttttgatgggccaagtgctgaagatggctttggtgaagaaaatgtcctgttagcatcaaatatgacaaaccagcagttaatggatcaaggcaatcaactaatggatgaaactgatcaagctattgcacgatctaagcagactgtccaagaaaccgtcaatgtgggcacagaaactgcagctgctctgaaagcacagacagaacaaatgagcagagttgttaatgagttggattccatccatttctccatcaaaaaggcatctcaattggtgaaagaaatcggtcgacaggttgcaactgatcgatgcatcatggccatgctttttctcattgttgctggagtcatagctataataattgttaagattgtgaacccacacaacaaggacattcgcgacatccctggcttggcaccacccgtcagcaggcggctgttgcgatagaggacaggtgaattgcatacctggtgtaaaaattgatgtggcgcggcgccttggcaagcccatctgtattctacgtcttgtaaaacgctgctccagtcatgtggtatattgctgtaaaacttctcatgggatccactcctactccttggctacacacagtgcgtatatgttcctcctagttcgccttcctgtttttgcaaaactaactctgaacggtgttctgttagaatcatgtgcacacatgatggttgagatgtgtctatgatgttcattgtgacgaacgattcttaaaaatctcatcggctttagttgaattgaacacatggttgagttgagttgaacacatggttgagcataaaaaaaaaaaaaaaaagaaagggcggccaccatcaaatgagctc

SEQ ID NO: 9003 - DNA, 1620 bp, Zea mays
  misc_feature (32)..(33): n is a, c, g, or t
  misc_feature (1617)..(1617): n is a, c, g, or t
ttgcttgatcctcatgatccctgagccttganncagtgctcgtatgctgagcgcgggattcggcccgtgcgcgagccgctgggtgaacttcgcactcgcgcgcctgcagcatgaaagactgctcgatgtctgagcttctggcctatgcgctcatcttcacgctcttgttcaccgcggcggccaccccgaccgctggcctcaccatgcgtgccgatctaacccacgtcgacaaaggtaggggcttcaccagatgggagcgtctcagccggatggccgttcgttccagagcccgcgcggccagtctttatcagcggggcggccactacggtcagccggtgacggcgactgcggtacccagctccggagagtacctcatccacttcaacatcggcacgccgcggccgcagcgcgtggcgctgacgatggacaccggcagcgaccttgtctggacgcgggccgcgccgtgccccgtctgcttcgaccagccgttcccactgttcgacccttccgtgtccagcaccttcagggccgtcgcctgccccgaccccatctgccggccgagctccggcttgagcgtttccgcgtgtgccctgaaaactttccggtgcttctacctctgctcttacggcgacaagtccataacggcgggttacatcttcaaggacactttcaccttcatgtcgcccaacggcgagggcgcgccgccggtcgccgtgtcggggctcgccttcggctgcggcgactacaacaccggcgtgtttgcttcgaacgagtccggcatcgctggcttcggccgcgggcccctgtcgttgccgtcgcagctcagggtcggcaggttctcgtactgcctcacatcgcacgacgagaccgagagcaacaagaccagcgcggtgttcctgggcacgccgccgaatggtctccgagcgcacagctcggggccgttccgatccactccgatcatacacagcccttcgttccctaccttctactacctctctctcgagggcatcaccgtcggcaagacgcggctgccggtcgactcgtcggtgttcgcgctcaagaaggacgggtcgggtgggacggtgatcgactccggcacgggcgtcaccacctttccggcggccgtgtttgagcaactcaagaacgagttcgtggcgcagcttccgctgccccgctacgacaacacctcagaggtcggcaacttgttgtgcttccagcggccgaaaggtgggaagcaggtgcccgtgccgaagctgatcttccacctggcgagcgcggacatggatttgccccgggagaactacatcccggaggacacggacagcggggtgatgtgcctgatgatcaacggcgcggaggtcgacatggtgctcataggcaacttccagcagcagaacatgcacatcgtctacgacgtggagaacagcaagctgctcttcgcatctgcgcagtgcgacaagatgtgacgaactcatcacttgctagcttgtgcgtacgtacgcgctgcacgtgtgcgtgtgtatgactgtatgcatgcttctacggctctacatatgttgttagtgctaaataaaaaaatgttactgtccaaaaaaaaaaaaaaaaaaaaaaaaaaanagg

SEQ ID NO: 9004 - DNA, 1459 bp, Zea mays
  misc_feature (1384)..(1384): n is a, c, g, or t
cttgtataaacttgcagcaaacgaatcaatcatggtactccaatgttagctctccttggccccatttttaacggataggcggaaaagaagcaagcctagccggcaacggcaagcccgaaggcgttttcttccatgtccaagatgcacgctgggtagcaagcaaccgccgccggccgtcaagtcggcaaccgccacagcaggagcgcgtccgtacattacatatcgcccccgctcccttcgcaaatgcaacttccacttccctcgtcgcccagcctccccgatcgatcaatccctgtccctggtggttcgccatggccactccggtccggcctgccgcggctgctcctgctcgtcgtcctccgcagccactgccgctgccggcggagccccaccacgacacgatgctcacgctgtctctcgcgcttccgcttccgcttccgcctcccgcgttcgtcgtccgcgcgctctcccccgacggcggcggcgtcgctcgggtgcggtcgtcgcccacgggggacgacacgccgccgtgcaccgagtgcggcaagcggttcccgtcgtggaaggcgctgttcggccacatgcggtgccacccggagcgtcagtggcgcgggatgacgccaccgcacttccgccaacaccggaccgtcgtggccgccgcggacctgcagttcaccgagcaggagcgcgagaccgccacgagcctgctcatgctcggcggcggacgccccgccggcgctggcaagggcaagaagagtgtccttggcgcctcgcctagcgccaagaaggtgacctgcggcgccagcaagtcggcttcttcgccgccgcccaccgttccaaggtgtgacgacgaccacaagtgtagcgtctgcgctcgggggttcgcgaccgggcaggctctcggcgggcacaaacggtgccactgggagaggacgacggcatgcgcggaggggacgacgacggtggctgcgatcgcaacaccggccgcctgcagcccgtcggcaacgtcgtcgtcacaagcggcgccggccaccacgctggacctcaacctgccgccgccattgccacaaaagagcgatggatatggcagcttggacgcgacgttagatctgaagcttgggatatagagagctagctttgctggctagctaggttcgtctttgtctgtgtcttctcttgacaccctgattcaggaaaaatcagcaagtttttctgatctatctgaatcggcggcttgttttatctggactgaaactgaagtctccagtggtgtactactaagtctgtacatatccgtgtatatgttgatatatatataatggaatctatctaccaagagacgaagacaggccgttgtgccattgctttatttgcttctcttttnattataggatggtcaagttaatcgtgtttaatggacttaactagtgaaacgtatgatacaatctgtatagtggtc

SEQ ID NO: 9005 - DNA, 1707 bp, Zea mays
aaaaaaaaaaacccggccggatattcgccaacaaactcatttcccgtctccacttgttcctcctctgtgctctcgcctttccattcctccaccggcctcatcccccaactccgtcgagcattaccgtcagagggcggcggcgcggcgcggcgccgccggcgacggggaccgcgtgaggcaggctcccctcaaggctcgtcctcctcgtcgggaggcgtcgccgttgccccgccctctgggctggcgcggcgtggaggggacagctggagatccgcccgtctctgcttggattgcttccttctcccgcagagggtatgagcaatgtactcaccaaaaccagagtctagttttggcccaaatcccaactcaggtacacaccagcagcaaatggaattaactggggccaacatgggtcctggtaatggagcaaataacaataccaacatggctgggaggcaacgcttacgctggacaaatgaactgcatgaaagatttgttgaggctgttactcaacttgggggtcctgatagggcaactccaaaaggagttctgagaattatgggtgtacaaggattaacaatataccatgtaaaaagtcacttgcagaaatacagactagcaaagtatattcctgatgcttcaactgatgggaacaagaccgataacaaagacccaggagatttgcttgccggacttgagggatcctctggattgcagatatctgaagccctcaaactgcagatggaggtccaaaagcggctgcacgaacagttagaagtacaaaggcagctgcagttacgaattgaggctcagggaaagtacctccagaagatcatcgaagagcagcagcgcttaacaggtgtgaaatctgaaactcctgctggaggtgcttctgtcactgtatcaagtgatcaattcccagactcggagcggactgagccctccacacctgcaccagcatccgagtctccaactcaagttggtgcttccaatagggacactggagaccgaactgaagcaaccaagagcacctgtcatggtgattctctttcccgcaacgagccactaacccctgattccaactgccagaacggttctcctgtcgctagtccaaaccatgaaagggcagccaagaggcagcgaggcagtggtactgaattcttagattctgaggctgagttttcccttccgcgccacatcttcgagtcgagttcaggctcagagttccaacaatactcaatgtcctactcaggacagtagcttctgatgttcacatcatctctgcaccgttgctagcttgttcagcacgatgcgcatggtccgtaggtctgggtaggttgatgtctcaaggagcgtgttgttggtaaacaaagctgtaggtgttcagtgattgtctacatggtatacgtgaccagctatttaagttcctaggtttgtaacatgtatgtccgcctgcagttcagttgagatgcttcaaggctaaggttctgttgtgtgacctgtagacacgaggctgtcagcttgtattctcttggtaatgtgtgtcagcagagcgttagcattaagtctaattgaacagtgctgttatctgtaacgtctgagtttgatcagaaactgaagttaattgaggaagacatcaacaatgttctgatactaaaaaaaaaaaaaaaagcggccgaaaaaccccccgccgccgttaccactgct

SEQ ID NO: 9006 - DNA, 1651 bp, Zea mays
ccgatatacgcacgtactcctgtatcgcatagccgctgccccgaagccacctctttgtgcctccacttgcgtgccgctagccacagccgctcgtcgatctgagctgccgccgccgccgtcgttcgccgattggagccaccgccgtcacccagtcagtggccgattggagccgcctccgcgaggcctgtggtcgtcagcccgtcagccgccgattggagccgccgctgcgagagaagcatgcagtcgtgcaagtcctgtgatcctaactgattatgcactccaatgggctgcggagcacaaaggggagaaaaacaaaaacgagtgggaggtggccgtgggccatgttgctgctgctgacgaggcggcgcgacccatagtaaaggcgtacaacagctcacctccctcgtccagctccagccgccgtcaggcttctgacgcaacttctaactccgttcgcctccaggcgacaccgtcgcccgctggcacgccgccactgcaggttaacacaatttgacccggagcttagttaaatcctgcttccgccactgcggacaaccatggcgtcgtcgaagctgcagctgcctgctgacgacagcgtcctcctgctcatcacccactccaatctcaccaccttcgcagcggacatccgcgtctcgcaacagaccaccgtggaggcgctcaaggacaagctctggcgcaagaccggcaccgccgtcgcttccatgcgcctccagctccgcgacgactccggcaccaagatcgccgacctcgacgacgacgccgcgccactcgcggcctacgccccctacaacggctaccggatccatgtcgttgatctcgacccttcctcactcacctcagggggttggttggaagacacttcccttgtcgacaagtacaaaatgtccgatgaaacatacgataagctcgacactaactttcgaaaattcaaagaaaagatggtcccgaaaaactctccgtcagaggataaagaagaatcagaaaagcatatggaggaactatgctccaaaatcaaggtgggtgatagatgtgaagttgagcctggtgccaagaggggcactgtaaaatttgttggtagagctgaagcccttggacgtggattctgggttggagtgcaatatgatgagccacttgggaagcatgacggcatggtgaaaggcattcgcttctttgagtgccctcaaggtcatggggcaattgtgaggccagaaaaagtaaaggttggcgacttcccggagagagcatttgaagacgaggacgatgacgagatttgagtgcgtgtgcgtttggaaaagcaaggggaatgtccttgttgaattgcattcgaaacgtgtgtaaaatgaattcggagatttgagtgtgcgcgcttgcttgcatcttcttgggcaatcatattgatcacatttcaaggcatgctgttacatctctactatttaagcgtgagctaataaattttccctccaacgcaaaaaaaaaaaaaaaatggggtggattcgaatcctgctcacttgtataaagcgcatgacttctaccactataacttatttctgtctgtgttatataaattagagatattttgtgtgtatgatactaataattttaaaaaatataatatcatttaagcaaggtt

SEQ ID NO: 9007 - DNA, 3196 bp, Zea mays
  misc_feature (2920)..(2920): n is a, c, g, or t
gcccggaccgtccgcacaagaatcccaacggctataaacggttataaaaatgtcagagcattcaaaaatgacttgcggacggtctgcccctcaaggtcgggcggtccgcgatacataaaactgagccaaaacgaagttttgctcactctacacatttgctgaaatttgtactgcggacggtccgcacctggaccccggacggtccgcaatacaaaatatttgtactgtggacggtccgcacctgggaccctggacggtccgcaatacaaaatatttgtactgtggacggtccgcactcaggccccggacggtccgcagttcaaaaaataaaaccaacacagaactactcgagttctgtccaaacaccagtccttcaactacggacggtccgccacctgggaccagacggtccgcagtacaaaaacttcacgaaacacagaaactccgcgtttctgcccatcatctcaagttagacctgcggacggtccgccatgctggcccggacggtccgcggtacctcaattcagcccacattcaagaaatcgcttttgaataagtttctttcacgaaccaaagcgttgttagccctcatgcaaatgcaccaactatatgagcaatgaggcactaaagacatgtcaagtaagataattgacccctcttgatagtacggctatctagcctactaacccggtcaattatcaacctctaagcaccttttgaccggtaaaacaaaaacctattgttatacctttgccttgagcattcaattccatctccttaaatgatgaacaatgggcatccataagtgtagccaaccatgataccttttaccatttgtccatagcatgaagttcctccaccatcatcatcaagccacttgatcaatatcccagatcaacacatggcttgataattctataatgatatgatccactccatgttatcacatggccttcttggttcatcaatctcaacatagcttgctcttcaccgttgctttatgtccatcggtgctaagtccttgctcttgcttcaccgccacgcggtccctcacacatgagcctttgacttgcccttcacactagccactcggtccatcgaagccaagccatatctcttgatcttctccatatagccacatgacaccatgtcatgtcttcatatgcaatgagctcctttatcacactagttgagcatctcaatatcaccaagccacatcaccaccatggctaaagtaactcacactagtgtacctgtggactaatcacctgtgtatctcaacataaaacacttattagtccatataagttgtcaatcaattaccaaaaccaaacagggtctcacaataatcgaattcaacagtgtggattgttctaggaatgtttgttcatgtgtttctactttttacacgttaaggaattgtagatctcgattgaagatgagcaaaagagtataacagatgagctgagagctattgctggagagcagaatatgagcatagaagaaggaaacgtcgtgcttcagattccatggttgttgactaatcgagatacattcacatatgttgcagacctgcttgcaaaaatccatcacatgatttttggacaatatggaatcctaacagtttggtagatgtattttgtggtgtctctatagtctatacctcatgtaatgcacaaaaagtattgatttttcatgaataaacttctgtagttgtccttcattaatgcattgcgattttttattgttcaatatttttgaatggaaagagagggaaggagggaaacacagggtttaagaggtagtttttaaatttcagatacttgtggctctgctattcattgaggcatcaaggatagttctttcagtttttcccctgataactcagtcatgctatgtaataacatcagctacatacttctctctaatgcagtttttccagataatgtaccatgctaatatattgttttctaaaccatgataactgaaacaaactattttaagatttttatgtgcagtagttgtcagttgaatacatgtagttcttacattaaactgaaccatgctacgaaagactatcaactatcagatagtatatatgtttttaatactactgaatcatgctaatgtgttgtttttaaaatcctattgactgaaattaacctgctcttttcagtatgtgcagtagttgttaactgaatataatatgcatgactatggtaaactggtgaactggtgaccaccctcctcccattgttccacagatgggtcacggactatggtaaactggtgaccaccggtgtcgattctcttttctcttctcgtttcttctttagaagaaaaatatcaacaaccatgcaggctaatacacatggcaatttacggactactacaaagttttaggggcttcttaattttgattaacaacataacacatggccatacatatgttattgttgtactattttttcattgcaacacacgtgtatttacctagttagattcttaataaattagtatagactagttttagtataggttttcttaagtctactatagataaaagttttttatgagcgattgacttaagtcaaccatcacaaaaatcactagccagttgcccgtgctttgctacagttgttatatatcatataaataggcattgagatatttattaaagtataattattatttatttctaaacactaaggtgtgtgtggtctggtggttagacccaaatttctaaatatggggacatgggttcaagtgctcactctgcactattttttgtgtggtgtggtagctgcacgggcagaatcaggtgctgggtaggcgcaatagagcattgggggttcacatggcagtacctgagagggcgttgcgtggactttgggcgtggggcccacatgacacggcgtcnaggcggggcgtgtgggacgggagaaccagttgggacgtgtggggtgggtcaaaaatatcagcatggaaagtgaagtcgtggtagcaccagaagcacacattagattcttaatagagtagtatagatttaatagctgtgaaaatgagaaaaatacatgtcaataggcgtggaggactatcacaagattttgtgctcaatttcacacaagtgcagttgtgcacaacaggaaacggaggaaattccaacaaacagacttatgtccgacggtgtcctgac

SEQ ID NO: 9008 - DNA, 1835 bp, Zea mays
cattgggtacctcgccgcttttctttctttctttcttgatcgagacgatcgactgctttgtctcgcctccccaagcgagaagcgaccgactcccgccgccgttgccagccatggacggcggtgacgacctcgccgccctgcacgagcaggtcgccctcgcattctccgccgccatctcggcctccgacctcgaccttgccttccagctccaggtcgccgaggccatccaagcctccctcggcttgcccaatgccgccgccccgtcatcatcgtcgcaagccgccccagagtcatcctccgacgccacctacgccttcgccgtccaggccgccgatctcgcgcgcgcagaggaggaccgccgcgacgccgaggcctgccgagccgccaacgcccgagccgccgccaacgcccgcgtcgtcgcgcacgacgccctcttcgcccgcgacctcgctgccatccccgaggaacagtgggaccacgacggcgactacttcgagcgccccgtcgagtcctcgccctgcccgccgttccgcgtcttctccaagggcatggcgagcagggaggttgtggccccgcgggaccgggaccccagcgtcgccgtgctcgccgtcgctatctgtgggccgcagggggaggaggtccttaggatacagaagctggtggagcgcttcgtgggtggccgcatgatggtggagttgatggcgctgatggaaggcctcgacgcagctctggggctgggcatccgcagtgtcaccatggttacgggttacggccctctctacaagcatatgcttggcatttggcgcccgtcagggaagaaggtggcagatatgatgaatcaggttctgtcagtgaaaaggaagtttgatcaatgtgaggtgtcactcgttggggcaagccaagtcagccatgtggtaaaattagcaagagattcattagccgctgagatcaccaaggctcgttctgccaatgctagagaggagaaaagagaaagctgcgccatctgcttggaagacactgacgctaccaaaatccatgcggttgaagtgtgcgcgcatcgcttttgcttctcgtgcatgaaggagcacgtgaaagttaagctgctgaatggaactctcccaggttgcccacaagagggatgcgccacgaagctcagtgtggagggttcgagggtatttctttcgccgcggctggtagagatcatggtgcagcgcatgagggaaggacagatccctccgagccaaaaggtctactgtccgtatcccaggtgctcggccttgatgtccttgggggaagtgattcatccgatgcaggagtcctcatcaaggcacacggctgctgatgctgccacgttgaggaagtgcgtgaaatgcagaggctccttctgcctgagctgtaaagtcccatggcatgatggcatgggttgctttgagtacaagatgtggtaccccctcgctcacccaggagatgccaagctgcagaacctggcaaggcagaggctgtggcgccaatgcgtgaaatgcaagcacatgatcgagcttgcggagggctgctaccacatgatctgcgtgtgcggctatgagttctgctacacctgtgggaaagaatggaagaataagaaagcaagctgctcctgcccgctgtgggatgaacgcaacatcatcagagatgaagacgacgatgacgacgaagatgatctttactagagaaggctgtttttgctgctttttttaatgatgatattcagcggctgcatggatacattgaaatgaccacctgatgttgaaattgaaactgctcatcctgtaaaaaatgggtactgcttaaaaaaaagg

SEQ ID NO: 9009 - DNA, 1272 bp, Zea mays
ctcgagcgcatctgttccaggcccatgtaaatttgcactgtgtccggtcccggatgccgatccgcttctatccctgcggccctccctgcccatctcccgatttccccgcgtgcgctctctctctccgtcggcgacgagcctgggcgaccagcgccgccgcccctagcccaggtctccatcggacgcttcgccaggtcttgtttagacccaccgccggcaacgagcaactcttgttatcggatcccgcatcgtggaatgcttgccaaagggaggaaggtagctggaaggcgtgaagaaatgtctgcaaattatgcgtttggaccacaggatgatgatgcgattattaaacacaggcttctgactaggacaacgaccaccaggggtgaaccgccactaaagaagcttcagaagaagttcatgtcctttgcaactgagatcgagaaggatgcagataacataagtgactgtgaaagactgtacaaggcctttctacatgaaattaacacctttgagctacctcttctgaaaagcaaggctgtggttgatgcaaacattagggagaaagaaagctttaatgagctgcaggttgagattgagcggcagatcttgcatgctaagactgatattgaggaccttaagaagcaacttgagcagagcaagattgagaggcagcacaaagaagagtgtgaagccatccggaagctgattagtttgcagcctccacggtcagaaactgaaaaactcattgcagaccttgagaaggagataactgatttgaaggcggagaatgtagcatgcataaggactttggaactgaggaagaagcagtttgcccttcttctacatgtggttgaggaattgcagatctcgattgaagatgagcagaagagtatagcagatgagctgagagctattgctggagagcagaagatgagcatggaagaagggagcgtcggtgcttcagattccatggttgttgactgatcgagatacattcacatatgttgcagacctgcttgccaaaatccatcacatggtttttggacaatatggcgatttggtagatgtcttttgcggtgtctttgtacctcatgtaaattgaactgtatgctagtatgaagtgaaattgaagtacacgttgttgtgtaacaaagtcagttcttattgatgaattcagtcaatatatgttacttcacaaaaaaaaaaaaaaaaccttacaccttcctatcttttataaacaaaaaaaaaaaaaacacccgggttccttctacc

SEQ ID NO: 9010 - DNA, 1015 bp, Zea mays
  misc_feature (973)..(973): n is a, c, g, or t
  misc_feature (979)..(979): n is a, c, g, or t
  misc_feature (995)..(995): n is a, c, g, or t
  misc_feature (1000)..(1000): n is a, c, g, or t
tgggtacctcgaggccggccgggccgggctcccgatttccccgcgtgcgcctctctctctctctctctctctctctctctccgtcggcgacgagcctgggcgacctgcgccgccgcccctagcccaggtctccatcggacgcttcgccaggtcttgtttagacccatcgccggcaccgagcaacttttgttatcggatcccgcatcgtggaatgcttgccaaagggaggaaggtagctggaaggcgtgaagaaatgtctgcaaattatgcgtttggaccacaggatgatgatgcgattattaaacacaggcttctgactaggacaacgaccaccaggggtgaaccgccactaaagaagcttcagaagaagttcatgtcctttgcaactgagatcgagaaggatgcagataacataagtgactgtgaaagactgtacaaggcctttctacatgaaattaacacctttgagctacctcttctgaaaagcaaggctgtggttgatgcaaacattagggagaaagaaagctttaatgagctgcaggttgagattgagcgacagatcttgcatgctaagactgatattgaggaccttaagaagcaacttgagcagagcaagattgagaggcagcacaaagaagagtgtgaagccatccggaagctgatttgtttgcagcctccacggtcagaaactgaaaaactcattgcagaccttgagaaggagataactgatttgaaggcggagaatgtagcatgcataaggactttggaactgagggaagaagcagtttgcccttcttctacatgtggttgaggaattgcagatctcgattgaagatgagcagaagagtatagcagatgagctgagagctattgctgggagagcagaagatgagcatgggaagaagggagcgtcggtggcttcagattcccatggttgttggactggattcgagatacattccacatatgttgncagacnggcttgccaaaatccntcacnggttttttggacaat

SEQ ID NO: 9011 - DNA, 2645 bp, Zea mays
gaccaacaatatgacttgcaccttcacttgcaacgagagctagtatttctataaaaatgattttctctaagtaaccaaataaagaaatagctagaacaattaaacatacatgggcaatggacatgtagtgcttactagatgagtgcacaacatctgtcgatggctgagactgagagccaatgatggcgatgtcacaatttggtggtggtgcttgtgcgtccattggtgaccgtccgcaatcagtaatagagagatcaatactgcaatgcacaccacacaggcacacaacgatatgagcagcagcaggctggcatgtcatagaaaaagatgacaagagaggaggggagacaaggagagaagaactcacagggaagctgcggatgacaagagaggaggggagacaaggagagaagaactcacagggaagctgcgagatagactcatcagctgacaaaggcgagggagacgcggcgacaccactcttgggccagaatggcgagggctcaagacgatgagatacgttggctgatcggcggcaggtccttggagtcttggagacgaagactgctggctgagtgggattgtctgtctggctgctaggttatctgtctggctgctagagtgttggttgggccatttggatggccggatgggccagttgaagccggtaattatcgacggtaaattaccgattaaatgtggtaattttcgaaaacggtcggtaaagcctgaaaccgtttttgctatcgtttttgatttttttgccgttttttatttagaattgtcggataccatttccattttcgtttatccctaaattccgataaaatatcaaaaacgattctcgataatccccaattatcgctttcactttcgtccctaccaactacacagccgccgcctcagcgaagctgtggaagaccagcagcaagggccccttcagccttcgccgcctctgtcccttctcttccttccggtcgaccagatggcctgccgcgcgaaggtggtaggacaggtggagcgggtcgacggagagtcgctatcctacgcggagttcgtccgccgcttcatggcgcccaaccgccccgtcgttctcacgggtctcacctcatcctggcgggcccacaaggactggactctctccgggtctggtgaccttcgccgccctaatctcggcttcttcacccaaaacttcccttcctctctcgttcaggtcgacgactgctcctcgagtgatttcacggaccagaagcggcttgagatgtccatgcaggagttcatagaccactgggttgggggtcctcattgtggttcaagtgatggagatcgtgatggttctctgttgtatctgaaagactggcacttcgttaaggagtaccctgattatattgcatataccacaccaaccttctttgttgatgattggctcaacatgtatcttgacagtcaccctatacatagagattctgacattgccaatcataaaaatgaaataaactgttctgattatcggtttgtttacatgggggcaaaaggaacctggactcctctgcatgctgatgtttttaggtcatacagctggtcagcaaatgtttgtgggcaaaaacagtggttgtttctaccaccatcacaaagtcattgtatatttgataggaacatgagatcttcggtctataacttacatgatgtttctgaaaagcagtttcctgagtttagtaagacagaatggctagaatgcattcaagagcagaatgaaatcatatttgttcccagtggatggtatcaccaagtccataacctggaggacactatatctataaatcataattggtgtaatgcctacaacctacactgggtgtggaacttgctttatgaagactacaaagttgcaaaagaatatattgaagacattcgagatatatgtgatgattttgaaggactttgtcaacggaatttggcagctaatacaggcatgaacttctatgatttctttgttttcatagtgaggtttgccttagccaatgtagttgagctttaccatcttcagcagccagaggttgcaaccttgtcaacagaaaccgcacaccatttggtctataatctgatgtcaattcgtaatgttgcatcaaaaatgacaactacagaggcttttactactgagaatcgtctttgtagtgtctcggaagataaccgcagtgctttctctaatatcaaacaaatattagaagaggagagtttcagaaggctatcgatgacactgtcaaaggcatatgaccacatagacagagggcaaagaagtctcaaatcttcgatctcgtatcggaagggctgttcgtcagtgatctgcttgaaatctgattgcaatgttgttgactacattacttctttggttgatgaaatttgtggacccgaggatttgacgagactaattgatagtgctctctctcatggataattttagtgtatctagcattgtaaacctatgcttgcatgaatccttattcatcagatatgatgggatacttaggtagtgtttggttttagagtatggttttatggagccatttcgttttcaatttgttattgtttgaatcgcctttccatccgatgaaatgacgcaaaaaaaaaaaaaaaaaaggccccta

SEQ ID NO: 9012 - DNA, 1659 bp, Zea mays
aagcgacatgttcacgcctgttggttcggttcggtttcggcatggaggtagctgagagaccgatggcctcgtcccacctggcagctctcgtctccctgctgatcccctgcctccttgcgcttctgctgctccgcctcgccgccgtgctggacccggaccccgacgccgccgtgccccgcatcaaggcggccgcgcccctccctctccggttccgccacgatggcgccttcaagatcctccaggtggcggacatgcacttcggcaacggcgccaccacgcgctgccgggacgtgggccccgaaggcggcggcgcgcgctgctccgacctcaacaccacgcggttcctgcgccgtgtcatcgaggccgagaagcccgacctcatcgccttcaccggggacaacatatttgggggcagtgcaactgacgcagcagaatcactactcagagcaatcagccctgctatcgaatacagggtgccatgggctgccatcttaggtaatcatgaccaagagtcgacaatgacccgggaggagctgatgaccttcatgtctctaatggactactcggtatctcaagtaaacccacctggttttttggtacatgggtttgggaattatcatgttggcatccatgggccattcggatccgagctggtcaatactagcctgcttaacctttacttcctggatagcggtgatcgtgaaatggtgaatggagttaaaacatatggatggatcagagagtctcaactcgcctggcttcgttctacttccctggagcttcagaaaaaaatacatgccccagcattagcgttcttccacataccaatcccagaggtccgagggctctggtactcaggcttcaagggtcagtaccaggaaggggtggcttgctcatctgtacattctggtgtccttgggacccttgtctccatgggagatgtaaaatctgtctttttgggtcacgaccatcttaatgatttttgtggcaatctcaatgggatctggttctgttatggtggtggctttggttatcatgcctatggaagaccccattggccaaggagagctcggataatttacagtgaactcaaaaaggggcagaggtcgtggttggaagttgactcgatctcgacttggaagctgctagatgatgaaaagctcacaaaaattgatgaacaggttatctggagacatagcacaggtgattctgaccacagagtctacttgtgaagaccatgaacctaaaactacttcctgtatgtgtcatgtgtataatgtttgtcgcaaagattcctccaattttataggtcgattgattattggtagtatggtgtggcacggacctattttagatttcacatttggttcaatgttgatatgctaaccctggtttgggtcgctgacctgttttcaaaaaaaaaaaaaaaatgccaattggtccccttgttttgggagcatcaccacatcataatctgtttcacaacagatgattcttattatttttctttttttttgtaattcacggcagatgatcctgactacaatgtttacttgtcaaggccagaaccataagacaacttccagcttgtgtcatctgttccatgtataatatctgtaaacaagtatggtccagttttgtttgtgggctcgttgaatt

SEQ ID NO: 9013 - DNA, 1619 bp, Zea mays
taatcctccactattcaattttagatagcaagggattatagtcctatcaatacctttcatttcacttgcttccaaacaagcccttaatgaaaaaatttcctacgaagaataaaagatcagatcccattaccatctctactccacacacagaatagtcgggaaatggctatgtgccaggctgttttgcagcagccagcagtggtcaaacctcgccggctttctggcgcggtcagcgtcgtcgtcgatcaccgacacatgggtcagcatgtgcatgctcatctgctgcggtgctgtcccccactctctcagtctcactgacgagatgcttctgcaaaccctttttctatgtatggataatataatatcgtcaacgaagaacacatgtgtctgctactaccaataatcatcatggccctcgtcaccttagctactccgatccatgcataaatacacgtgccccgcggcggccgtccggacccatcaacccacactccagcacacagcaatggcgttcacgcggcggcgtccgtgcggcatcctcctcctctccctgctggcggcatccggctcgctgtcgctggccgccaccggcccgggcgacgtggccgtcttctggggccggaacaaggacgagggcacgctgcgcgaggcctgcgacacgggcacctacaccaccgtcatcatctccttcctccgcggcttcggccacggcgccgcctactactcgctcgacctctcgggccacccgctcgcgggcgtcggcgccgacgtcaagcactgccaggccaagggcatcctcgtgctcctctccatcggcgggccgcccaacaccaacaccggcgccggcgccggctactccctcccgtccgcgcgggcggcggcggacctcgccgcgtacctgtgggacgcctacctgggcggctcgcgcgcggggctgcgccgcccgttcggcgacgcggcgctggacggcgtcgacctgtacatcgaccagggcggcgtcgacggccactacgacgagctggccaggcgcctctacgcctacaacaggagctaccgcggcaggctcggggtgacgctgacggccacggtgcggtgcgcgtacccggacccgcgcgcgcaggcggcgctcgccacggggctcgtctcccgcgtccacgtccgcctgtacggcgacctcaagtgcacctggtccgaccgggaggcgtgggagaagtgggccgcggcgtacccggccagccgcgtgttcgtcggcgtcgtggcgtcgcccgaggcggacaaggacgcgtacatgttccagaaggacctctactacaacgtgctgcagttcgcccagaaggcgcccaactacggtggcctcatgatctgggataggtactacgacaagatgaaccactacatcagcagcagctaataattaagcttcccatccacatccatccacatccacccggtttatcacctaatatataatagtattattgtatttttcttcttaactttataatacactgtaatgtaataatgtgatgatctgatgatccaccaacggaataaaatggtcagcttccagccggtgggccgcgccgaaaaaaaaaaaaaaaaaaaaaaaaaaaactcga

SEQ ID NO: 9014 - DNA, 1097 bp, Zea mays
cattgggtacctcgaggccggccgggactctgttcccagcagcgctgccagcctgccaccgtcttcccggaaccccaccgagccgacgaccgaagccgacgcgaccctcctcgcgtcaccgcgcgcaagagtcccatggccacggcgggttcgtccccccctgccagccagcagcccttcaagctgatcctagggtcgtcttcggtggcgcggaagcacatcctcgaggagatggggctggagttccaagtcatgactgctgacatcgacgagaagagcatcaggagggagaatcccgatgacctggtaacggtcctcgcggaggccaaggctgatgctatcatgtccagattgaacattgatgattatcagaaagaaggcagtcaaccaacactcctgatcacatctgacatagtggtcgtccatgaagggattattagagaaaaaccaaccaccaaggaagaagcacggcaattcctgaaaggctattccggaggtcacgtgtcaactgttgggtctgttgttgtaactaatcttacaactgggaagagacttggaagtttggacaaagctgaggtttatttccacgatataccagatgaggtcatcaagagcttgatcgatgagggagtagtatttagggtcgcaggtggtttgctgcttgaacatccattgacgctgccgtttgtcgaagcagtggttggttctagtgacagtgtcatggggctgtcaaaggaggttgcaaacaagttaattcacgacgcactgtctacttagcgtagcaatttcagcactactgtttctgatcaaattcttactgcactcacctggagatgtgatcaagcagagagcatatctggggatacccatagtgattcatgtatttttaaacgttaaaccaagacaggcgcacctggcattgcaaattgtgatcaggttgtacttgccttctgtttcacttgaaggatacgttgatgcttcttttagtgggtcagttggtatgatttgtaatatactgatatacataatctcgtctctgatatgtgactgtaagttgcaattgttaaagaacaaaaaaaaaaaaaactcgagcccgg

SEQ ID NO: 9015 - DNA, 1323 bp, Zea mays
  misc_feature (590)..(590): n is a, c, g, or t
  misc_feature (679)..(679): n is a, c, g, or t
gggtaccctcccgagcctgccgggaacttcggcagcgcggcgtcgggcatctcgggcgcgtccatccgcgtgatgcagatggacagcagcttcccgttcggcacctgcatcaacaccaacgtgatccagaacccgggcttcgtggacttcttcgccaagcacttcgactgggccgtgttcgagaacgagctcaagtggtaccacacggaggcgcagcaggggcagctcaactacagcgactcggacgcgctgctcgacttctgcgaccgctacggcaagcccgtgcgcggccactgcatcttctgggccgtcgccaacaccgtgcagcagtgggtcaagaacctggacgacgaccagctcgcgtcggccgtgcgggcccgcctgcagagcctgctcacccgctacgccggcaggttcccgcactacgacgtcaacaacgagatgctgcacggcagctactaccaggaccgcctgggcgacgacatcaacgccttcatgttccgcgaggccgcgcggctggacccgggcgccacgctcttcgtcaacgactacaacgtcgagggcggcagcgaccccaacgccacccccgnagaagtacatcgagcagatctgcgcgctgcagcagaaggggcgcggcggtgggcggcatcggcctgcagggccacgtcaccaaccccgntcggcgagatcatctgcgacgcgctcgacaagctcgccaccaccgacctgcccgtctggctcacggagcctggatgtgagcgagtccgacgtcgacctccgcgccgaggacctcgaggtggtgctccgggaggcgtacgcgcacccggccgtcgagggcgtcatcttctggggctgcatgcagggccacatgtggcgccaggacgcgtgcctcatcgacgccgacggcaacgtcaacgacgccggcgagagattcgtcgatctccggagggagtggacatcgcacgcgcgcgggcagatcgacagcgctggacacttcaaattcagggggtaccacggcacgtacatcgtgcagctcgcgacggcgacggggaaggtgcacaagacgttctccgtggagaaaggggacacccctctcgtgctggacatgaacctttgacgatcacttctaccgttccctagttatatacagacacacatggcattgatttgacccaatggaacgcaaacagaaagcagcactccgatgctagctacatgtatctatctatgattggtattgtaaggcaaacttaaggtattgtactccttaagaattattggtgatggtgaataaagtgaacgagctattcctcgttttgtagt

SEQ ID NO: 9016 - DNA, 4361 bp, Zea mays
accgaccgatccaataaagatacagtgtggtttagagtcggattggaccactgtttttatatttggtgctagcacggcacaatctaaaagttttttttgtttttttctggcttgaacctgtttgtcacgaagaatgataggcttgtgccgggctggcccggtctggcgtggcccgattcccagcactagggcggctgcaggttggacacgtcgcactctgacgttcttcggcgccagcaaatcaagttcaacaatgttggcgctcaacgtacggctgttcgctgcattgtttcttttcttggtagaccgaggcagcacacattgcatgatatgcgcgtcgtttctacgccgatcgagcctgaggttgttactcttttaacacgtactagtaggtccggaaacgagccgctgctaggctcgatacatgaacgagctcggctcgaccttggctcgtgagccatatttctggtacttattactgtattatttagtgaattaacattatttaaatttgaaatatagaatcataattcaacattatgagtaatttaaattataaattgtaatatatttattatcaaagactaaaaatgagctattatccataaaattatctaatatttattattattctataaattaatcattttgtaaggttcacgagtcagattggctgggctcgctgcaaaaacggactcaaagaaggggctcggctcgcgagccgctccgaactcgagccggctcatgagcctcgagcttactttccagtcctatatacaagttacgacgagtgtgctaacaaaccttaagagaccaaacgcatcatcagaagcctgagcatatattgagtgggcttcttttttttttcttctctctcaattataaaggaatataaaaaatggtattttggtctttgctgacctaatgtccgaatctagcctatccccaaatacatgtgcatatgtggctgtgaagtcggcagtttaagattgatgacaagagaaaaaggtatggagtgtccttggttgcgattcccaaagcgtgctagctacagtacgatataccactaacagcagcgactaaacaaacgtataccccaaccaatccttccgtttgtctcctcccgaagccaagaaaagcacggatcctttggagttggagtactggaatggtgcttactccactcgaacataaaaaagaaaatactaatgcttactacagcgagcaccgcagctaatcaacaaatactaaggctccttttggcatagcagctccggttactctgaaaacagttccggcgctgcgagttgttttacaattcatttggcaaaagtctctgttgtgtttatatcgaatcatgtattagagaaatgaaagagccgatagaaatcacgttttttgtgctttggctctaaaaaacagctctagcttctcggggctctctcgacgagaaactgttttattttgtgaccatttgatagagatttacgatgagcccgaaccgaagtcgtccaaagagccgtgccaaagagaccctaacgctgacataccgtgccgcccccggctccacatggcagcctcatgagctcatgatgcgctccgagccggacagacatggccggccggatcttgcgcatcctttactgtcactcaaaagctggagcacagagacggccacacacagaaagagaaaagacattcccgtccgtggtggttgcttcgagttcgcacgacgctatggagtggcgttcgttcggtgcgctttacgacaattttcgtggtggttttgacgaacgaacgaccgatcggctctttataagatctcccgccgcgatcctagccagtcgacagcaagcaagtttctccatccaaccaacctcccagcgatcacccctgctccgatccttgcattggtctcatccgccggccggccgggtaccaacgatggcctgcacccaggtacgtacgtgtgcgacgtacaatgctcgtcggcagcttagcagcaagcacacgtcgccatgcatttctactaccgcgccaacgcaactgcctcactagctcactcatcacattcgtattgcattgcgccgccaacgactaattcgctgccgtccaggaggtggtggtgttcggcgtgaacctcctcgagagcggcgcgccggaggacgacggcctggtggccggctgggcggcggtgggcccgtgcacggcgctgtccgcgcgcgacgaggagccggccaaggtcccgaccgagacgatcaacgacgtggcggacggctacaggcccagcggccggtacgtcctggcgtcgggccgcgccggcgaggccgacggcctgcgccgggcgctgaagcgggccgcgctccggccccgggtcacgtaccgcgtcgccgggtgggtcggcctcggggacggggacggggacgagggggcccgccacgcggtgcgcgtcagcctccgcgtggacggcggctgcgtcgtcgtcgatggaggcgccgtcgtctgcgccgagcccggcaggtggaccgagatcaagggcgcgttccgactcaaggagagcccgcgcgacgcggaggtgtacgtgcacggcgcgcccgcgggcgtcgacgtcaaggtcatggatctccaggtctttgccaccgaccgcagggcgcggttcaggaagctcaggaagaagactgacaaggtgagtcgtgacgtgagcgccgctcaggggatcggatcggatcggacttttacgcctggttggtgagctgagtgatggcttgctcgccgcgagaacgacactcgcgctcgatcacttgcactagtctatgcacgcacttgattggattgcatttgattggatggtgctctgatttgctgcaaataaaccccaggtgcgcaagcgggacgtggtcctcaacttcggcagcgcggcgtcgggcatctcgggcgcgtccatccgcgtgatgcggatggacagcagctccccgttcggcacctgcatcaacaccaacgtgatccagaacccgggcttcgtggacttcttcgccaagcacttcgactgggccgtgttcgagaacgagctcaagtggtaccacacggaggcgcagcaggggcagctcaactacagcgactcggacgcgctgctcgacttctgcgaccgctacggcaagcccgtgcgcggccactgcatcttctgggccgtcgccaacaccgtgcagcagtgggtcaagaacctggacgacgaccagctcgcgtcggccgtgcgggcccgcctgcagagcctgctcacccgctacgccggcaggttcccgcactacgacgtcaacaacgagatgctgcacggcagctactaccaggaccgcctgggcgacgacatcaacgccttcatgttccgcgaggccgcgcggctggacccgggcgccacgctcttcgtcaacgactacaacgtcgagggcggcagcgaccccaacgccaccccggagaagtacatcgagcagatcagcgcgctgcagcagaagggcgcggcggtgggcggcatcggcctgcagggccacgtcaccaaccccgtcggcgagatcatctgcgacgcgctcgacaagctcgccaccaccgacctgcccgtctggctcacggagctggatgtgagcgagtccgacgtcgacctccgcgccgaggacctcgaggtggtgctccgggaggcgtacgcgcacccggccgtcgagggcgtcatcttctggggctgcatgcagggccacatgtggcgccaggacgcgtgcctcatcgacgccgacggcaacgtcaacgacgccggcgagaggtcagtagtccctaaactaatttattatagccgctgaaaaacgatcgatcgatcgatcgatcgatctcagccccgatagtataatgcagattcgtcgatctccggagggagtggacatcgcacgcgcgcgggcagatcgacagcgctggacacttcaaattcagggggtaccacggcacgtacatcgtgcagctcgcgacggcgacggggaaggtgcacaagacgttctccgtggagaaaggggacacccctctcgtgctggacatgaacctttgacgatcacttttaccgttccctagttatatacagacatatggcattgatttgacccaatggaacgcaaacagaaagcagcactccaatgctacatgtatctatctatgattggtattgtaaggcaaacttaaggtattgtactccttaagaattattggtgatggtgaataaagtgaacgagttattcctcgttttgaagtaaaccgtattgatgttctctgtcacggatcctacgtaaaagattcgttctttttctagcttgtaggatgcattttttttt

SEQ ID NO: 9017 - DNA, 573 bp, Zea mays
aagctcaagatcatccccaaggacgtcaggtgggtggaggtctccaatgccgtctattacgcgctggtcaacgacttcatgaagccacgaatcgacgagattgatgagctgctatcgtatggtgtgaatgttactgtatacaacgggcagctcgacgtgatctgctctaccgacggcgcagaagcatgggttcagaagctcaagtgggacgggctcaggaccttcctgagcctgcccaggcagcctctgtactgcggccccggcaaagggaccaaggcgttcgtccggtcctacaagaacctgcacttctactggattcttggggctggccactttgtgcctgccgaccagccttgcatcgcgctgagcatgatcggcagcatcacccagtctccagccagttagaagggttttgtttatgtcatacgcaaagatcaaatgactctcgagtacagtgaaggtcgcatatatagttgaaagccaattcagttgatcatgatacatgcatacagttctccatcctgtgaaagaaaaaaaaatacagcactcgcgggcccggccccccacattagg

SEQ ID NO: 9018 - DNA, 4202 bp, Zea mays
ccatagtcacaaaagtctctgaattaaggaacggggtcgataaacgtggtaacgaaaatgacctcacgtaactggttctgggacgacgttctcgagtgaagggtcactaccactatatctatttcttatgactatggcactacctaggattttgtcctgcatccgccaccacgtgttatatatggtgatggacaactaaaacattaacacatgaagtaatttataagttaccaactagctagcaggatgaagctagctatacatgcatgaaccagccaattttttatgacaccataaacaaaaagtttctctaccatggatcagatgcatatcatgcgacagtagtctagacctgtcagattcaggacgacgatcagaagttcagaatgaaagcaacccagcgagctgtagcctctagtcacatgcatgcacaagcggatctatcggagaagggccaggcgtctcggactcgccgcagcacacgcgctgacggtctcgagctgcgagacgagagcatcgcccacgcagcagcactgtgcatggcaggcgcaggatgatctcgatctggacgaagcccactcgttcgatggcccgccgcgtgcgcggatcggagcagcatgcatcctgcgccagcagctgcgcacggcggcgtcatcatgagggacgagaccggtccccgtccccctatctccgcttgacgatgaccttgtctcacttgggcgccgcgggaccgcccttgtcctcgtgcttggcggcggcgagcgccagcatggacccggcgagctggttcacggcggcggccagcccagccacgcactgctcgccggcctcgcgacgctcctgccgcgcgcggccgcggcgctcctccgcggccatcacctcccggtgccgccgctcctccgcggcctcccggctctccagcgcctccgacaggatcgccgcgcaccgtccgatcgctccgcccaggacgttgtagtcgtcgtcggagtactcagtctcagactcggcggagctctcgtccccgtcgtcctcctcctcctcctcgccgtggcgtccttgtcgtccctgacggcaggcgtgcgttccagctggcgctgacggcgtgccgctccctggccgcagctcgtccagtgacggccgcctcctcttcctctccggcgactcggggctggaatgcccgtgcgtcccttgttcttgatcatatgcatggagaaagaaaacaatcatgcgtatgcgacgacatcatcgtggaccacagaaatggcgcccaagcaatagaatgcagacagtgacgagacgaccaataagtaccgggaggcagaggtcgtggcaggacttgagcgagcggggaagcttgcatgggaacgtcgagtaggctggaagaggacgccgccgtgagtccgcctccgccactgccgcagcagcccatggtcatcctcctcttgatgacctcgcccatggcgtcgtatatctcgcggaggaggttggtcgggaggcccctctccttcctctcctccctgcccatcgcccagtagctgggcgctctgccgccggccccagtgccgctgagctcgtacgcgcgcaccttcttgtagtcccgcatgaggttgtcccagcggtcgttgcactggttctggctgcgccggcagccggcccgccagcagtagtcctcgacccagcgccaccgcgccaggccctggtcccccgggtgccgctcctcgtgcacctttcgcttggcctcgatcagcagcatcgtctccggtagcgtccagttccccctccggtagtccctcgccacggtcagggcaccggcgccaaccacgacgttcctggccgcctgctcgtcgtctcgcgcttggtggccgagcagcccacgggtggcgctgccgcccatggtatcgtccatggttgctgctggagtgctggtgctagctagctctgagctacgtgctgactgctgagatcgatgaatcagctcgctatttgtagtgggaaatggccaactgggaaggcagacatggtgagagatagatcactcagtgcattatttgatggcgatgccatgctagtatctcatctcacaagaggattgtatcctagctgctagccgtagctagcagtagctagctaggcgtggtgccattgtcggtggaagctatcaagctatatctattatataggatgaggattgcatcgatcttgcattgcatgcatgaggagatgcatgagggctgaagtaccaccaagaactacttcgacttcacgcttacattgtagaatcacatgacgtattgagatagcaatgcaaggaccaagaagaaaaagtggcatctatttggctctatgcatgcattgccttttcatcctcacgtctcccctccctttctgtgggcgtcttggacccggatcgagtgggggcctactgaatttgactgcccttttcttttctctctccttcctgctggctctatctgcgcaccagcaaatgcatgtgggaggagtttattaaggttagaaagccatgaagcttgatttgcttagggtttcctgcatgtgcgtttggatgtcttttcttgctctcccagcttaatggatcactgatcagctagtactgttgctctgtgatggcagtacttctgttaaaaaacagatgttttggaaagtgggcagcagcagagctactgcaatcatttgctgaggccgggcagagagtggtgtcgtactgtcatgcatgaaagagataatcaggcgatcaggcaccgtgttaaggcatgatcgccatcttattttggcaatgcgagctgatgtgcaggcgactgaattaacatggtcttggggagcaatggtacgaccgataccagaggcatcacatgcatgcatggagagatgtggagtgtggtggcaggggaaaaggcaaggatggagaaaaggaggctgggtgggtgtagtagctcaatgcttttaggtgcatgtgatcttatgtagaaagtatgtgctcaaaaagtttatttgacaccattgctctgcccccagtcacgaagtatggtgtggttgttccttgcgttagtcttaatgttcggtcgttctcttgacaaaagcgagcgacgtttaaaattatgtttgctctcttgttcatattttgctgtatgcatccatgagatccatctcatctgtcgcctcaatattcttattaaggtcctatgtttagtggatgagaatattttttatttctatgtgcatgtcgtcttatacaaacctgaaacctgtattatctaatatgaccaaatacgatgtaccatcttgttttgttttgaacattgtgcaaacatgtataagaacataggtggccaaaaaacactacactaaaatcatacaaaatcatacagttcctatggctatttttaacttcctgcaacttttataacaaaccgtaggaaataaataacttccgagaggcaactggtagctctaggaaataaacataacttcctacggtcttttataaaagctgtcagaaagttagctttctctaggcagttagctaacttcctatggcctgctctaggaagttaggtttcaactattgaccagtcaaaagaaaagctaacttcctacggctggctctaagaagttagctgcccagctaacttcctacggcctcttttaggaagttaggtttttgctgttgactagtcaaacgaaaagctaacttcctacggccagctctaggaagttagatttcagcttttgaccactcaaacgaaaagataacttcctacggtcggctctaggaagttagttaacttcctagagtaaatgtacaaactctaggaagttacgtaacttcctacgactttactctaggaagttattttttattttaaacctctcctcaaccttatctcttctctcacatttctcaaccccatctctctcgcctttgtctcttccatggagccgccccccgccagccgcccacgccaccagccgccccgccacgaccgccctcgtccgctgcggacgcccctggcccggccccgtccaccgcggacgccaccgccctcggctccatccaccgcggccgcccccgcctaggcacgcctccggccccgccagccgccagccgccctcaccgcccacgccaccgtcaccgtcgcgaacaccattgccgccaatcaagaggacaacatcctcaagtaaag

SEQ ID NO: 9019 - DNA, 2557 bp, Zea mays
agagtgcgcctctccttattgctcaccccaaagcaaagcaagcacgaagaaatgggcgagataggcacggaccaccgcggcctagccgaggccgaggccggcggcagcggcaaggaggagggcatggtcctcggcgacgaggaggaggaggaggagacttcgccggtggagcaggtgcggctgacggtgccgtcgacggacgacccgtcgctgccggtgtggacgttccggatgtggagcatcgggctgctgtcgtgcgcgctcatgagcatcctcaaccagttcttctcgtaccggacggagccgctgatcgtgacgcagatcacggtgcaggtggcgtcgctgccgctgggccacttcatggcccgcgcgctgccgcgcgccaggttccgggcgcccgcgctgctgggcggcggggagtggagcctcaacccggggcccttcaacatcaaggagcacgtgctcatctccatcttcgccaacgccggcttcgcgttcggcaacggcagcgcctacgccgtcgccatcatcgacatcatccgcgccttctaccaccgccacatctccttcttcaccgcctggctcctcgtcgtcaccacgcaggtgctcgggtacgggtgggcagggctgctgcgcaagtacgtggtgcagccggcgcacatgtggtggccgggcacgctcgtccaggtctccctcttccgggcattgcacgagaaggacgaatccgccaaagcctcgcgccagatctctcgctccaggttcttcctgctggtgggctggcgtgcagcttcgcctgggacgccgtgccgggctacctcttcccgacgctgacgtccgtctcgtgggtgtgctgggtcttctccaggtccgtgacggcgcagcagctggggtcgggcatgagcggcctcggcctcggcgccttcacgctcgactggtccaccggctggtgcttcctctttatttttctcatctcgcccttcttcgccaccgcccacatcttctttggctacgtgttcttcgtctacgtcatcatgcctgcagcgtactgggggttcgacttgtacagcgccaagacgttccccatcttctcctcgcacctgttcatgtccaacggcagcagctacgacgtccaatcgatcgtgaacagccggtttgagcttgacctggacgcttatggtaagaacggcaaggtcagcctctagcgtgttctttgcactcacttacgggttcagcttcgccaccattgccgccaccatcactcatgtcgggctcttctatgggaaggaaatctactaccgtttcagatcgtcgcagaaggagaagcctgacatccacacgaagctgatggagaggtacagcgaaatcccagcgtggtggttctactcgttgatggcgctatcaattgtagtgtcccttctcctctgtaccgtgctgaagcgtgaggtacagctcccatggtggggcctcatcttcgcatgtggcatggcattcgtcttcacacttcccatcagcatcatcactgcgacgaccaaccagacgccaggtctgaatgtgatcactgagtatgctatgggtctaatcatgccgggctctcctatcgccgtcgtctgcttcaaagtctacggctacatgagcatggcacaggctgttgccttcctctcggacttcaaacttggccactatatgaagatccctcccaagtccatgttccttgtccagtttgtcggtaccattgtggccggcacggtgaacatcgggacggcatggtggctgctgggctccatcgacggcatctgctccgactcactcccaccagacagcccctggacatgtcctaacgaccgcgtcttctttgacgcgtcagtcatctggggcctcgtgggtccacggcgcatcttcgggccagacgggaactacggcgccctcaactggttcttcctcatcggcgcggcgggcccggtcatcgtgtacgccctccacaggacgtttcccggccagaggtggataccgctgatcaacctcccggtgctcttcggcgcgacggcctacatgcccccggcgacggctgtcaactacaactcgtggctgctcgtcggcaccgtcttcaacttcttcgtcttccggtaccggaagaagtggtggacgcggtacaactacatcctctccgccgctctcgacgccggcgtcgcgttcatgggggtgggtgctgtacttctcgttgaccatgcagaacaagagcatcgactggtggggcaccgcaggagagcactgccccctcgccaggtgccccaccgcgaaaggggtggacttgggtgacggcgtctgcccagtgttctgatcgagcttggagttccatgtcttcacttcaggtacatcgacaggttaagctgtgatcggtttgcagttatgctgccattagatttgtggtgtatatgtggagggtaatgcaacacttctcttatgtgtaaaggccatattctcatgtatttatcagctgcagaaaacaatccgtgttggttgatcctttgggcaatgcaaagcagcaggctagttcccg

SEQ ID NO: 9020 - DNA, 1653 bp, Zea mays
aatattatgtataaaaagtttggtgacaaataaaataaacttattaaactccctcacacattcccatacacacgtttccccataagcccacacaccatccagtgcagtccggcctcttctgtatttttataggagcagtaggcagtagatgctgcctcggctctgcgtgcgaaaacatgtaccggtcgagttcatggtgaccccaccccacagagaatcagagagataggatagcatagcaaagcagggggcgcctttgcatcgcgaggtcactcctgtcccctcgcctccgtcccctccacgcagcagcagctacacctacacagctgtgtgtgtgtcggtcgccagaatcccagaaattttagatagctggggttgggcgggcgacccgccgcgactgcagcgagaaccttggacatgagttgagaggccctatcttttcatgcccatgtccatctcgcgagtgatgagtgagaaaccgattgattgattgattgatgtgtgatgcctcactagctccttcgtggcaaatctcatcagcaacagagacggctggtgtgacagcttgtgaagaaaacgccggctcgctcgctcgctcgctcgctccgtctctctctcctcgctgcatatctttcctttgccgcttgctgtctccctcgtctctctccatctccagtcttcttcaccaccctgcttcctccctcttcctcttttgtttcatcagagagaaaaaaaactagatttagcgagggcggaccgacgacgcagtagaagcaaccgagacatggagcggcggaggaaggcaatgtggctgtaccccaaggtggtcggcttcaacccgccggagaggtggggccactccgcctgcttcttcgaaggcttcgtctacgtcttcgggggatgctgcggcggcctgcacttcggcgacgtgctgaagctgaacgtggagaccatggcgtggagtcttgtggccacgacggggcagtgcccgggcacgcgggacagccacggcgccgcgctggtgggccaccggatgctcgtcttcgggggcaccaacggcggcaggaaggtgaacgacctgcacgtgctggacctgcgcaccggggagtggacgcgcccgcagtgcaagggcgcgccgccgccgtcgccgcgggagagccacaccgtcaccgtcgtcgggggcgaccgcctcgtcgtcttcggcggcagcggggagggcgagggcaactacctctgcgacgtgcacgtgctggacgtgcccaccatgacgtggtcctcgcccgaggtcaggggcggccacgcgcccgcgcccagggacagccacagcgccgtggccgtcggccgcaggctcttcgtcttcggcggggactgcggcgaccggtaccacggcgacgtggacgtgctcgacgtcgacaccatggcgtggtcaatggtaaggcgctgtgtccttgtcatgtagggtggccgtggggcttggctcgaattcgcgacagctctgccagatgcacatgtttccggttgccattacctttcgctttccaaatgtgatggtgacttgcaaggttacatctctcagtcagagtaacggggagtactttccttcctaatttcgtttaaaaaaaaaaaaaaaaaaaactcgagagtacttctaga

SEQ ID NO: 9021 - DNA, 781 bp, Zea mays
  misc_feature (104)..(104): n is a, c, g, or t
gctcgttgtaaacgtaatttctgtagaagtgtgtaaaaagttatacaatactgactctgttctccaatacttatcgccctcgaatacttatcgtctgttcattntaaaataagccccctttttttgcgtcttattaaaaagaaccgagggaaatacgttactactacccgcacgtgtacacatatattcttgcagctagcaatgtagcagctttgatttggacgtatatatgcgtagcacttctacagcgttaatgtagttaattgagcttgtatacacgcgaactatactgcatgcacattgccatgtccacgctttatttatttcttgcatatgtatactagatcattcatctctgttcgtttgcgcgcacaactgcagcagctgcaggctttatggcggcgacggaacgtaaggctgaggatgctgcggatgcaggtggccggtcactgggtcgacgccgacggtcactggcatcttcaccggcaccgcggctcgtgagttgattggtatcttcgggtggtggatgatcactggcatattcctcacggttcgtcctgcaaccgtctccctcgtctcccttctcgattcaaaggttggagtacgggcagcaaatgacgaggccacgagaagggcggaggcgacaacgaagcaaagcacaaccacgctggttctggccgccattgtgatgcgctagctttcctacttgcagtggcagtgtgctctcgatatgattgtcttctaatttatttggtcccgcccggcccccggagcgccgcac

SEQ ID NO: 9022 - DNA, 1841 bp, Zea mays
gataagcagctggattccctctgtcaaactccttttgattcagggggtgcaatatagtcccagcacttagtatgagcagagagtcgagtcatgtatctggatagtccaaagtacagctccttgttcctattgcccccagcccagaaagtaatgtgcatccggctgcggacatatggaatagtaaaccaaaagtcttcaatatagtataccaaaattatcttgagcaggagcttgtcccagatagatggttcatagtttcttcctattattcacaagagatactcttatgcagctgaatcaaaccgcgtcttggcatgctatcagttgtaagacttgtcttgcgggcaagcacccatataagaagtcaacattttggcacggccgaagtttcccattctcatttataatgaacaaaagtcacagatcctaggaacaagccctcatatgcagatttggctgagtatgtgccgtctggagcaacactgaaaatatgcttatcatcaacctcaggctgcagctctaatcctgaaatcaaatcccaaagtcaagatttaaatataaaagcttaacttccattcacccacttcagagtaacatttatctatcttgctcttccaccaggcccatggccttcagctggaggcatttgcacttgctcttcaaaagctagaccctgactttcctaagccaaagattcaatttgtcggtagttgccggaataaagaggatctggacagactacaaaagcttaaggacaggtccactgaactacacatagatgagcttgtggagttccacaaggatatttcttacaggtactgtatcctacgtagcacttaaaaaagtttctcactatggatgtttttctatgggttaattggtaggatcatttgtttaacagggacctggtacaatttcttgggggtgccattgctgggctccattcgatgacagatgaacatttcggaataagtgttgttgagtatatggcagctggagctattccaattggtaagtatttgcttgagtttcatattcctttcgatttttgggttaaatactaggtaatgtggaaatctaaagccatggtcgaaatggcactgaagttgaggctggacatgcatgttctggatcatttgatggaaccagttaaaaatacacgctttaatcttgggaacataacacttggggtcttccatacttttttcagcacataaatcggcaggaccgatgatggacatcgtgctagatgaggatgggcatcaaacaggatttctagcctccgagaaggaggaattcactgaagcgattatcaaggtcttgaggatgccagagtcggggaggcaagaaatggcagctgcggctaggaaacgtgcacaaagattttcagatcagagattccaccaagatttcactgagaccgtccgccctattttgtcagcaagggaaggctgactgacaagctgcagtttccacctaacaatctgaattctctgtcaagtttcacacggtacagtgaaagacttgcaaggggcactgaattggcagattattgctgctcccttttcccagactgcttgtgtattgtgctgcatcgtgtaacgctactgtgcagaaatagatcacagaaagaaaactttcgtcagcgatatagaaacctttcaccatggtgatcgtggtgcacggttttgaatctttcttgcggcactctagtaccaagttcatctttgtactgagcaaaagcttctgcttgaattgtgccactgactggcggacccatggactttttatactaattcaatctgtcttccactctagaatgtcgaaaaaaaaaaaaaaaa

SEQ ID NO: 9023 - DNA, 1811 bp, Zea mays
ttgggtacctcgaggccggccgggaagctctgcaaacgttaaaaaaattaactctcttctcgcgggagcccaactagactcgcagtcgcgtccatggcgatcttggtaggcctcgtcggcgtcctctccgccctcttcgccgccgcgcttcggcgcctcctaatctcttgtcgccaccccgcatacgccgccgggttcttccacccgtacaccaacgatggcggcggaggcgagcgcgtgctctggtgtgcggtgcgcgccgtgcaggagcttcgcccggacctcccctgcgctgtctacaccggcgatgccgatgccgcgcccgaggccctcgccgcacgcgctctcgaccggttcggtgtccgtctcctccgcccgccgcaggttgttcacttgaataagagaaagtggatcgaagcaagcacgtatccccacttcacaatgatcgggcaaagtcttggctctgtttatcttgcatgggaagcccttactaaatttaccccgcagttttactttgatacaagtggctatgcttttgcgtatccactggctcggctatttggttgcaaagtcatctgctatactcattaccctacaatcagttctgatatggttgaacgtgttaagcaccgcagttctatgtacaataacaattctcttatcgcagggagcatttggctatcccgatgtaaaatcctctactataccatattcagttggttatatggtctggtgggttcatgtgcgcatcttgtaatggttaattcctcatggacaagatcccacattacaaatatttggaagatcccagagcgtactaagagggtgtaccctccatgcgatacttctgctcttcagatgcttcccctggaaagaccaacaacacctcctgttcttatttcagttgcacagttccgcccagaaaaggcccatggccttcagctggaggcatttgcacttgctcttcaaaagctagaccctgactttcctaagccaaagattcaattcgttggtagttgccggaataaagaggatctggacagactacaaaagcttaaggacaggtccactgaactacacatagatgagcttgtggagttccacaaggatatttcttacagggacctggtacaatttcttgggggtgccattgctgggctccattcgatgacagatgaacatttcggaataagtgttgttgagtatatggcagctggagctattccaattgcacataaatcggcaggaccgatgatggacatcgtgctagatgaggatgggcatcaaacaggatttctagcctccgagaaggaggaattcactgaagcgattatcaaggtcttgaggatgccagagtcggagaggcaagaaatggcagctgcggctaggaaacgtgcacaaagattttcagatcagagattccaccaagatttcactgagaccgtccgccctattttgtcagcaagggaaagctgactgacaagctgcagtttccacctaacaatctgaattctctgtcaagtttcacacggtacagtgaaagacttgcaaggggcactgaattggcagatttttgctgctccattttcccagactgcttgtgtattgtgctgcatcgtgtaacgctactgtgcagaaatagatcacagaaagaaaactttcgtcagcgatatagaaaactttcacccgaccgtggtgcacggttttgaatctttcttgcggcactctagtaccaagttcatctttgtactgagcaaaagcttctgcttgaattgtgccactgactggcggacccatggactttttatact

SEQ ID NO: 9024 - DNA, 1429 bp, Zea mays
aaacatcccgttaggaaaattgttggaatacacaataggtttcagtccgaaaactttttcgcctcactcaataatcagtttgtggcagaagttttttaacattctttttggagttgctctgctcttatccccaccgcggaaccagcaaaacccgctgcagcctttcgaattatggcagctgccgcagccgcgggcggagctgcatcagccgccgtcgccagccaagaacctatgaaggctctcggcacaggcatcctccgccgctccgcgccgcactggtccacagccgccgcttccttcttttccccacccttccgcccccgccgctgccgtcgcgcgcccgctcctgcagccgccgcgcgtaccccgcggtcccgcgcgagtgccaaggcccgggcgaagctcctggcggaggttgaggcccgggacccctggctcgcctccctctcgctgcttccgaccgacgacatccccagtgctgacgccaccaccaacgggtgggtgattggggtggatcctgacattggaggcgccatcgccgtcctctcgcctgacggctcgtctcaggtgtttgacaacccgttcgtgcacattgtggtgtcagaagtcatccgtaagcgactggacaccaagtcaattatccaactgctccgtggccttgatgcgcctcctggaactacggcatacattgagaagtctagcccatttccaactgatggaaagcagggatggtggagcactggtttctcatatggcttgtggattgcttctctagtggcttcggggttttcggttgtcccgattgcatctcagacatggaaggcttactttgggctaatgcgaagtgaaacaccaaaggatgatagcagacaagctgcttcaattttgttccctgacaaagatcagtccttgaagttgaaaaaacaccatgggcgagcagaggctcttctgttagcagcctatgggaaaggccttgtgctgccatcggggaagttcagcaaaacctcagtttgatgtctatggtgattgcagattgacttgccatttttttgggggtaaacagaggctcttctgttagcagcctatgggaaaggccttgtacgatgcctatggtgattgccgactgacttaccatttcctgtattgatggtactgcaaattttcatttcgcttaggaggccccaatcaagacattaaggttgaatctgctgtaagtttgcaaaccgtaatagagatcatagctaacccatcatttttcgtggaatgcattacagcgttagacatttcccattgtgtccttagtgtggcaggctacttagatgaaatctggatgttgtaaacatgtaatgatggaaactggaatgaactggtcgtcttttcggtgaaagtggaaaaaaaaaaaaactcgagcccgggtcgactctagagc

SEQ ID NO: 9025 - DNA, 1101 bp, Zea mays
agttccacttccaccaccgcggccgccgcgccctataaatggccgccatcggcagctgcactccggtaccaatccccgattccttacacgctaagccacgcaacgcaacgcaactagccatgacgatgaagtccagcagcggcggcggccatgtcatcggggtcccggtcacctccaaggcgcacgggatagaggaggtgtccagggatccgtccttcggcaagggcgccggcgatcacctcgccgtctcgttgacgcaccccagcccttacgcgtctttcggctacaagcacagcagcaaaggccaggtgacccactgggtgagcaagctgagcagaagggcgcagggcttcagagagcatgtgaccttggggccgaagctgtcggagacggtgaaggggaagctgagcctgggcgcgcggatcctgcaggccggcggggtggagcgcgtgttccgccaggccttctccgccgccgacaagggcgagcggctgctcaaggcgctgcagtgctacatctacaccacgggcgggcccatcgccggcatgctcttcgtctccaccaggaaggtcgccttccgcagcgaccgccccatcaccgtcacctcccccggcggcggcggcgacacggcgcgggtcacctacaaggtggccatcccgctgcggaggatccgcagggtgcggcccagcgagaacgtccacaggcccgaggagaagtacatccacgtctccaccgtcgacggcttcgagttctggttcatgggcttcgtcagctaccagaggtcgtgcaagtacatgcagcaggccgtctcggagatgcgatgaccggtgtctgtatcgctgccccctgtcggaacgatgtgaagtgactaggatgttatgggtctcgcttcgccatcttttgtcgccaagcagccgtagctaaaaagattgccctgtctttaattttggatcggtgcaattgtgttccttccgcgtacgaatttggaccagcatctctgttgttcccaaagtggttgctctcgatctactagtacacatggaccgaaaaaattaaccatttgtgcatctttgttgaatgcaacagttctatgtgtttctg

SEQ ID NO: 9026 - DNA, 10052 bp, Zea mays
  misc_feature (8854)..(8854): n is a, c, g, or t
  misc_feature (10003)..(10003): n is a, c, g, or t
gatgacataaatctgaaaaatctggagtaagaggtgaatccgaattgaactagagaaatatgtagattttcataaatctattttgatgtttacccgtttggttgatattctagttttttaactacgaatctagttcaaaaagctgaaccaaacacaccctaaagaaacgaatagaacaatgacttcgatgttgcctactcttggatttaaatgggctagcccatttaattcaactaatattccatgatccatactagggcatctaggttcagtaaaccaagctcaccatgcaatgtcaccaacctatgtatatcgctttttggattaaaatatatttgaaaaggcctaattttccaacaattcaaaaccgtgataggtctttttcggttcatggcttttcaagcatgttaaaatcaaacgcttttagagaactcactataaacggtggcgccaaagatgtataatttgcactgctactttattgccaaaccaagggcatttggatctcactctgctaaagacgatcgattgttccgggatgctgatattatagtcaagggggtaatagctgggcatgctaggagatccttcgttggtgtatatgtgacgatgtcctttggcaagaaaatgtgggacgcgctagaacctaaatatgagtttggtagtgagtcgtatatcatgaatcagtttcatggctatagaagctcatgaaatacatatacttatggaagaattcgagaatttttgttgtgttgctaagaaagcctgtggttggatacaccattgaaaagctgccataaatttggacacttctttgaagcgtaataggcagaagttttgcactgtcgattttattggctcttttagacgttgaagagaagacgagaataaaatatgtatgtgtcaaaaattgatgtgggaacttctagtacccgtctttgcacagaagtgtgctttgagatcctccatgctcggtaggcactgcttcacagctttgtttgaagtgtactccttggcccagcggcgcagagcagggaagtcatcgtcctcgtcgcccaccaagctcatgccggtcatctcttcgaacacagctatccaacgagacagtccactgagtgctatgtccaggtagccgacggagtcgccaccaaagaacctcttgccgtcaagctgcgcctccaggagcgccaggttcttcttcgtctcctggaggaacccctcccgcagctcgccctccgtcaagaaagacagaactaacggcctccggccggcactgcgcgcgttcatcagtaattcagataacgcatgcaggtcccttctgagccggcctgcagtaacgatgaagcatatgtaccttggtattgagcccagaaacgagcggcagcgcggccggcggggtcgctggggaggaggggcgacgtacttcacgatgacgagggactcgcagacggcgcggtcgccgtgcagcagcaccggcaccttcttgtggatggggttgttctccagcaggtcttcttggatgaactcgtagggcactcccttgatgcgcagggcggcctcagcacggtgcacgaacgggctggcgaaatggcagatgagcttaacatcataattttatctgctttctcctttctggagtagctagctatgttagcttggccatacaaattaatgtctcgacgacaaagagctgtcagcatgcatatatctttcttgcttcttcttctccaagagaatgacttgtgttatcagtgatattattatgtatgcctttcttcagtcatcagttgcagctggcttaagttgcttcgggccgagcctaccacctattgagatggcccataacatatttgggccttcttgttcatggttgggccatgaacttctattgtttctacttccctttaataatgtactactcccgtctggtaaataatgtaattttgttttagacttagccaaagcatctgaaatttaactaacaatatgtttgacactgctcagcttcacaaaaaactagcttagctttatgaactttaagaccagttcagtaaatttatataaaacaatcatattcaaagttgtttgacttgctatatcagaattgtaatgtacaaagcaacacttgctttgcgttctctgttgctccgtcgggatgaacactacgcgctctacactcgtcccgtgtccatatggccaagcctgaggcagctgtactgtattactactatccaacgcttgcatttgttcgttgttcttgtcgccaacctgccatttaccctctggatttctttttttgtttcgtgcaggacggcaatgctatgcatatgtatgatgcaattgtttgctagtcatctcctctcccaagagataagagcccgcttaaatgttcttttaaccatccaattatcaatcattggagcgtgacgattttttttaaaaaaaatttgtggtttttctataaaactaaattgatttctgtaaagtctgttggatttaaccggaattcctggctgcgaagttcttttggaccttcgaatatgataacggatgagggacgccacatgacccggtgcacagggtccctgcgccacagaagatacgacgaacgcattcaaaatccagctcccctccgaagtccgaacgcttcttggacgattcttgaaagcgtccagccacgccgccctcgccgccgccgcccccttccgaatccaaaggaacccgaatctcgcaacgatcaccaccacctgaccttccttgttcgcgtcgccccaacccttgcccgtccaggagttcagcgaaaccttccctttctttggccttgccttgcctgcctcccttccctcggtcgccgctcggataagcaacccggagtcccggaccgctccaagaaaccaataagtccccgcgccatggtgctgaggaagccagcgcgcaagaagcccaaagaccccagcgccgtgccggccgggggtccgggaagcaggggtcgctctggcggcatggccccggcgccgccggcccccaactacatgagggcgacgacctgctccggcgccaggtccagcgccgccgccgcgccgcatcctcagccagggagagagaaggcggtgctgacggctgcggcgctgcgcgcgtgcagggccacgtgctcctccgccatgaaggggcccggggccgccgggtcggcggacgcctgcccctacgcgtactgctccttcaagggccacgcccacgcggcagcacccgtgccgcccctgggcgccttcgtggcggcgcggaggcggctcatcaagacgcagcagcgcatgaagctcaagggcgcctcgccgttccgcaacgccgccgccggtcacggaagcggctacttcgtcgagatacgcgccggctcggacgtgaccagcagcgatctctcgtccgacgaagtggggcggacggagcacgtcgtgttcggtcccctgggctgctgcggtggcgacgcggagggttcgggcgctgcttccgtggacgggtcctgcgcgtccagcgacgtgatctcggctggctcgtttgagccgtcggggacgaccaagcatcgcggccttgaggagaagaagaccttggtggaccatggaggggaggacatgggtgactgcaggtctgacatctccgaggagctggacgttaaacacggaggaaacaatcctcaaggtgaggtttccagcaatgtttccgcgaaccgtatcgctcgtgcgcacgttggaatcgagcagcagtccttgatgcatgacgaaccatatggcgattttgcaggtggcgtgggtggtggtgctccaaaggaatcgtcggtcgatagcgtttccagctcgctcagtgggataagctttgaagatgttagctctgcctgtgcctatgcagcagcatcctctcagcagcagaacgggtcgagcattgccaggaggaggagaacatctgaacagggtgtcaagcgaatgcgtcctttcaaacccaggcttccgaatttccttccgtcagagaaggtcgatctcaagcatcagtcggtgggcgatcccagagccgctgaggagtggatgctcgactacgctcttcggaaggaagtgaagaagctggcccgtgctcagaagaggaaagttgagatgcttgtccaggccttcgaatctgttatgcccacgcttgcaaacgagaagaagcccgagcaacacgacaatggtgacaatgacaagagaacattcactcttgcatggccttcccaagtatgtagctgatagatagccttttaaggtatggaacagcgatgaggaatcccgctgttaatagactctattccctttggtgaaaactaattattgaactttgacactgttttttatctatcttgcagcttgtggtttagctggaaccaaccatggtctgaagtctgaacttctgaaggttctaactcagcagtcactgccagaaaaaattcttaccgctattgttttcttatctgatagttgagctactaggataggagctcgctgagttcggttagtggagggcctagtgcatgtacatatgtctcgtgtgctcagtttagtgatgaggaacgagtgtaggagactagcacaccggcaagaatgttgagatgtgttcctttaggcagatatcaataaagctctcattaacagcatttatttcccggttcagatgacaccttcagtttcatttatttgtcctgattgattttcttatcggcatcttgtatagctcaccttgtaatgcctcatttccaacatttcattgatatttagtgttgaacagctacgatccaatattccaatctgacccaactactgttgcttttctgaatgtctgagtacttctggtactatagtcctggacacagagataatcgatgcagctaattgtttactgtcaaaaccctgcaacagccctacctcagtcctggactgaaactgtagaacatcacagaccgtggcacggcatgcaaaccaaaagatttgcactcctgttcattggcgaacaggcctcggccggaaacgagctgagctcggttcggcttgctacggctcgctagctgagctcagttcggtttcgctcgtccactcaacaagctgtaaaaaaaaaggctcggctcgactcgacatagactcgcaagctacgacttgataaataatattgcattatataagaaattaatagtctataaatatgaaatatagttcataatgcatcgctacacataatctaaattataaataatcatatttttatcattaaagactaagaaacgagtcagatatttatataattatctaacattttgttattattgtgttgtaggttgattaatctagtcagcccgtgtattagctcgcgagccaaaacaagccagctttgctcggctagttgcaccaacgagttcaaaaatctggctcagctcggctcgcgagttgtctcgagccaagccgctacgagctcgagccggcttgcgagtcttaaacttttttcccacgaatttaagcacgtcttgaaaaaacttgacgagtaagtgtaactgtgtaagtcagcaaaacgcagacaactgctgttttttaagattaggaggaaccaatcgatgatacagcagctaagatgttcatcaccaagaatgaatggcactgatgaataaacataaccagaagtgctttcaacggataaaagtagatcaagcattgagtaatactcatgtattcctcaaccgcactggtactgaaaacacaacaactattacacagtgctccgactcctctaaaaatggctctggcttatctgcgagagcagctcctctataagagctgatatttcttgacaaatactttggtacaatggctcctccgtaagagcccgatttcactagcaagttgtagctggttgcagcaaaagcaaaaccagcacccattagcaagttgcaccaaaaacaaaagctgcagtccggcgcggtggctgtacgctggcaacagccactagcaagttgcagcagctaacgccagcaggacgcaatgccaggagctagccattatatttggctccggctccgagtctcattttttgctccggctctccgatgctccctgtcaagatatgtcgtttgggagggctccagagccgcccactagccctcccaaacaggctaagccgtgaccacttcaggtagatgaaacgtttcgattcaggcaaacttgaatatattcagagcaaacactagacacaacggatacaaggttcgatgctcccaccaaccaaccataacgaactgaaggagcggcaacactcgtgttgctggccatcgctcacatgttgtgctgtcaaactcccgtggaccattcagaatgtcagcataaaacgataccttctggtgtagttgagaagtttcagccttataaataaaattaactatatttcagcaacattgtgaccctctttgcacggtaccatgtgtgtattttttattttagcttttttttattaaatctcgtagagtgacaatgaagccagaccacattgttataacttagaattaaaccacgagagatactaaccacatgattggttgcgtgcggcagctgcgtccggctcacgcccgcctggtttggtagagatcctcgccggtcccgtctccacgcatgcaggtaaatggtggaaaaagtacttttgttgcacatgcacgtacaggcccgtcggtgcactacaggtaaccaatcacgcgcttagtcacagtcaacgcatgttgtgcactaccggtaaccaatcacacgcctcacttccgcctggcccggtagagatcctcgccggtcccatctccgcgcatgcaggtaaatggtggaaaacatgcacgtacataccgcgtcagtgcactacaggtaaccaatcacacgcttaggcgcagtcaacgcatgcaacggacctggttacggttggccgccaaccaatcatacggtaagaaactaccagaatgctttgagcctgagggctgaggcttgtataaacattttctacgcggagggttaatcacagatactatacttccacaggaagaccactgttaaggaagatgataaaaggcagggagaaaaaagcattactattgtttaatgtttaagaactgcaaatttataggattaacagttacaattctagttacaggttgcagcaaaagggaaatatgtaataacaggatctacagctacactccatgtctctgaagctcgagccttttgagtaccaggtccttccaaaacagaatccgtgaatcacgttcatcgacagctaaggttatatgttcagtaatctgggaactcgatgtgattctgccagacctagaaaacacggttgaaattcccgggcaccttgttcatgaatctgacgccagctcttcactcactttaatatccgagcattcgcgcaacagcaacacaaggtcctttgataggcttttcatcctatttgattctgtagctccatccgaggttgatgttacgtgtgatcctgatccatcggaaggacggttgctctggcagatactctcgtggaacatctggacagcatcatctgctgatatttcttgcactgagcggtgcaggtcctgtaatttccccctacgctgaacatccggcaccagtttttctttcaagctgtcaggaagactagctagcgcactgcttgaaaagatgacagatggaaaattaaaatccaaggaaacactagaatagaatgataatacaagacatctattattggaaggatagaggaaatgcacctgccaaccccacgaacaaggccccatttgtagccaacgtttacagattgcctgaacccaacattgaagccttcctgggcagagtccttctgcccttctgttacaccatcacgatatcccatctagagtgaaatcaaaagcaaaaatattttaaacatttcttctatcagtaaaaataactgcagaagagtagtttgtgctagcaactgtgtgcgttccagataaactctaggataattaataccttctgaaactgactctgcctgtggatccattctctgtctaaggtatccgcgtgccgaggagaacctgaaacatcctcccatacatcatcgagttcggcagcagcaacatcgccgccattagctgagacaaagttttgcataatcaactaactgcaacatgagataagatagcactagtgcaagcagtactactaattaagcacaagacatggtacggaataactcccctatgaaaaagatcaaacagcgcccgcggttgcccgcttgtgagggatacgcaccctgcttggggacttgaacctcaatcgatgaaggcgctgcttctacgctcagctccgacatggaggagctgacgtccaccgcatccctgggattggccattcagaaactccaacctgcaggaagcagccaaagcaccgcctgttgcgagatggaaatgtatttggggtgctcaaatttttttcacaaccaaaaggctaatatttaacatgtacaacgctgcatagtcaaaattgcgtaatatatgtaggaaaaatataacccaaaattgatcatgatttcatatattgaagaatttgaccataatttgaaattgtttaacataaaaagatatcaatggttgagacctaaaattaaaactgtttgacacaaaaggttaccaataactgagacttaaaactatatcaggtgactaaagtaattaaggataactcaagataaggcgctaaacgattcaaaaattgctatccctgttccctaacaaattgaatctgaatttggaatagactagccagacatcagtcacgcgctnaccacagcggagatgcagcggggctggatccagaggctgtatctgcctccgcggcggcgcaggaggagcgaggagccgaggagcaggccggagagatctggagtcgccaggcggctttccgttcgccgccttcgctcgaggcttggttcgccgccgcggtactccagtcgcgcgactctggcccgcggacgggctgaacggacagattgggctagattgaggcctgttgggccttcggacctcgccagaatccgctacaaggggagggcccgttaaagcacaccctgtggcccttggcaggtgcgccaaactgtggcaatgcccatgcggttgcaggaatgggtgactgttgcggcggcgccaaccaaacgcgtcgtgctcgcggcaggccacgtgtccctcgaggctcctccggcgaccacgtcgccgcccgccatatgaccaacgcaccaatcagactccgccggcgggaagctgatcgttcactgctactagcgcagtgcccacgctggtgcagcaccggatcatctgtgtgacaaggaagaagaatggacgcggaggggttgctggcgtcggcggcgatcaatctgggactggcgctggtggcgctctcgctcttctccctgctcaagaagcagccggggaacgcgcccgtttaccgtccccgccggatggcgaccggcgaccttcgtgctgatggtggctttctaccgctcggccacgggcgactaaccccgtcgttccggtggataggcgcggccttccggctctctgaagacgacgtgctgcggcgccacggcctcgacgctctcgtcatcgtccgcctcttcaagtttgggtacgtggtggtaggattcctggaactctagaagagttggtgacacacttcttcactaactgatcttcccttgttaccactgttaataacatctgattgatatctcatcgttcgatgtgtaggatcaattgtttcagtgtttgctcgattgttggactactggtccttgctccaacaaattatactagtgaaggtcgcgctgaaatcagaagatcgaattccatggaactgttcacggttaccaatgtgacacggggatctaataggttagctctagtctgcatactttcactttcacattcacgatgttncttggactattcagttcgagtactttttcagttcatatatatatatata

SEQ ID NO: 9027 - DNA, 4791 bp, Zea mays
ggggggatgccagatcgcacattcctttcactttcctgcgacagagcctgcacgactatatacatatctggataaaattaattactaacatatgaagaagtcatagaagcatcgagggcgtagatgtacgtgctatcatgggttagcaatactcggtttgttttgatgttttccatcccaagcctagatgacgtaccacccagttctcatccgagcgaatttatctgagtatattatatttagccgacttgttctcggtttgcttttctcctccgaaaccacacctacaaaactaacacgctagatactgatatatagtatccatcaaccgctgtaaaagagtttttagcagtattctcgacaattaaaagtatgaaaaaatagtatatggatactagctagtaaaatgataaccagccagcatatcctcttggatatttcatacagcctacttttataacttttttatacagcctacttttattatacagcttctagtctctcttccactttattatacaggctgcttttataactattttttatattaaattcgctctagaatatttgatacccgttttgaactaaaatgcgataaataaaacagaactgatggagcacttgtggaggatcaaatgcaggcggcgccctgtcccccaatcccctgtgatctactactgatcttgcaggtgggacgtgcaacattaattgagcaatctatgattaagtttcacgagacgttacacgatttttttttgggcggatgattagattgcaatgtatgatttcgacgagaattatagcgggtgcttttgtttttcttttgccgtagattgcttttaagcgggactctcggtcggtacagtacagtagaaactgaagctgggaacctaatcaatagcgcaacggcaggcattgacagcgaagcagctgcagcagccatgtttaattggcttgtgggcataaagaaacgtgatgatgccgcgctttgcatgtaggccttttgttgccggttcgttttcatcctacattggaattggctggtgcgtgcgtgcctttggaatctgaactgaaatactttagttgaatcgtatcatttggtataggcgtacgtttttaaggtccttcatcaccagaacaaaattttcttcttcgccatgttcgaagcgaataactagagtaacactgcgtcattggttccaggaatcaaggtacgtacactttgtagcggggcatggccgtgcccatttcttagtcgtgcatgcgccgaaaaaccgaagcagtttgagttacatgagatgtcaggttactgctagctacatctgattacgggtcatccaatccgaccgaaaaacccggcccgacctgacccgatcaatgcaacagacgggtataaaaaataatttttgacccataataattcacgggtcgggtacgagccgtgatttttgatctaaactctgacccaactcgaaaaaactccacccaaaaccaaaaaaatccgacctaacccgacacgtcaaacccaaacagggagccaaacagggagccacggaccaaattgacccgacactaggcacaggtcggttacagaccgtgataaatgacccacgacatttaaataggtctaataactacttgtgatacggaggattgaacaggaacatcaccttttaaaaaaaaaatcagaaccgtggacgtggcactggtggtggcattcctcgcttacttggaaggacggtatggtcggccacggccagaaaccacccggcgagccggcaacatctccgtctccgcatcgacacgtatggcacggcggggatacgccgatggcgacgctgagaaacgagaggagaggaggcccatccccagatccgcttccgatactcctccgtccgacaacgcactgtgcgcagaaccaccgggggggtgggggggacacgcgcgtggcgcgccatgccattgccatgcccccgcggcgtcggcgttcagcccaggaacggcaaagctgccggcctcccgtcgcgtcggcccttccggttgccgggttcattgcggtgcggtgtacaaggacggcccggcaggcagcagccatgcgcgtgccaacagaacagtgcccggacggttacgtggttacgtcggtaggcggtcggtccgactcggcgccgcgtcggaggtgaccgggacgtctggactcagcgggagcacgcgcgcgtggtgacttcgacggggaggaaaagctgttgtcttgccggatgccgggatcctatttctctccaaaagctggccgttttacacgttgggccgctggtccctagtcactaccccccgtccacatcgcaggcaggccaccacctccgtcctccttcctgcttgtctgccgatcgcttgcggacgcgccggtcttgggaacagcgttcgcggcgtggcctcctccatgcatgtgagcatcccctgtctacgtttagacactctcgacaggcagatgcagcgcatgtttagcttaacccctgatatcgtcccggtgcaatgcctgaagctctgctctaaacaaaacagcagcagcggtcccgggagccaaaagctcgggcccggtgcgactagcgagaatgtgcaggcacatggggcgcttctcggaaagcggcaggcgcggcgcgggcgccggatcccatagagaattccagaatcatttgcacctggccatggcctccacatggacaggacgcacaagaatcgggcgagcagttttctggtagctgcgatgcgaccaaccagttggccacgggaccgggtgtctacgctacgcctgctttaagccgaacatggactgcgccttgcctttctgagccgctggtgactcggccggccccgcctgctgactccgcaaatccactgcctttgccaaagccgctccgccccaaagggtgttccagttccacttccaccaccgcggccgccgcgccctataaatggccgccatcggcagctgcactccggtaccaatccccgattccttacacgctaagccacgcaacgcaacgcaactagccatgacgatgaagtccagcagcggcggcggccatgtcatcggggtcccggtcacctccaaggcgcacgggatagaggaggtgtccagggatccgtccttcggcaagggcgccggcgatcacctcgccgtctcgttgacgcaccccagcccttacgcgtctttcggctacaagcacagtgagtctctcgtgccatgcatgtgcatcatatatgagattaataacttccgagttcacagcatgcttactgacgtgcttctgttctgatgcagcaggcagcaaaggccaggtgacccactgggtgagcaagctgagcagaagggcgcagggcttcagagagcatggtgagtcgtcgttagttagcactccgtccgtgattacttcttccttcgttcattatccaaaggaccgctagctgacgatgagcacgcacggtacggtgtgcagtgaccttggggccgaagctgtcggagacggtgaaggggaagctgagcctgggcgcgcggatcctgcaggccggcggggtggagcgcgtgttccgccaggccttctccgccgccgacgacaagggcgagcggctgctcaaggcgctgcagtgctacatctacaccacgggcgggcccatcgccggcatgctcttcgtctccaccaggaaggtcgccttccgcagcgaccgccccatcaccgtcacctcccccggcggcggcggcgacacggcgcgggtcacctacaaggtggccatcccgctgcggaggatccgcagggtgcggcccagcgagaacgtccacaggcccgaggagaagtacatccacgtctccaccgtcgacggcttcgagttctggttcatgggcttcgtcagctaccagaggtcgtgcaagtacatgcagcaggccgtctcggagatgcgatgaccggtgtctgtatcgctgccccctgtcggaacgatgtgaagtgactaggatgttatgggtctcgcttcgccatcttttgtcgccaagcagccgtagctaaaaagattgccctgtctttaattttggatcggtgcaattgtgttccttccgcgtacgaatttggaccagcatctctgttgttcccaaagtggttgctctcgatctactagtacacatggaccgaaaaaattaaccatttgtgcatctttgttgaatgcaacagttctatgtgtttctgattagtttatttctctctaccagtagtaggtaaccgtcagaacataaataatgcaaaatacaatttcccctgcgctgtcttatttttaatatcttttacaaattaaaatcaagtgaccaatacccctcctgtcagggacggacctacatacaagcaagtgtattcaattaaatactcgttatttttggcaaaaatattatgtatacatgtatataaaatattataaaaagtataaactcatactattttacaattattttgtctaaactttaattctcgccctattcatttctctatcgtgcaacccattaaacaatacaatagtgtaattttagattgtcaaaaaaattatattatactaaaatttcgaatatccatgcttcaaatcctaaacctgccagtgcctcctgtccccttgctgaaagcttcgctaacatcttccgctagtccagtaaggagtcacgatgtcctcaagagctaggattgagaccctcatctgacagccaacatggaacaacagcagaagacacacaccacgatgtgaggccaccaacat

SEQ ID NO: 9028 - DNA, 1142 bp, Zea mays
  misc_feature (956)..(956): n is a, c, g, or t
ttgggacccccggccgggcgggactcatccccgattccttacacgctaagccacgcaacgcaactagcagcagctagccatgacgatgaagtccggcagcggcggccatgtcatcggggtccaggtcacctccaaggcgcacgggatagaggaggtgtccagggacgatccgtccttcagcaagggcgccggcgatcaccttgccgtctcgttgacgcaccccagcccttacgcgtctttcggctacaagcacacaggcagcaaaggccaggtgacccactgggtgagcaagctgagcagaagggcgcagggcttcagagagcatgtgaccttggggccgaagctgtcggagacggtgaaggggaagctgagcctgggcgcgcggatcctgcaggccggcggggtggagcgcgtcttccgccaggccttcgccgccgccgacaagggcgagcggctgctcaaggcgctgcagtgctacatctacaccacgggcgggcccatcgccggcatgctcttcgtctccaccaggaaggtcgccttccgcagcgaccgccccatcaccgtcacctcccccggcccccggggcggcacggcgcgggtcacgtacaaggtggccatcccgctgcggaggatccgcagggtgcggcccagcgagaacgtccacaggcccgaggagaagtacatccacgtctccaccgtcgacggcttcgagttctggttcatgggcttcgtcagctaccagaggtcgtgcaagtacatgcagcaggccgtctcggagatgcgatgaccggtgtctgtatcgctgccccccctgtcggaacgatgtgaagagactagtaggatgttatgggtctcgcttcgccatcttttgtcgccaagcagccggagctaaaagattgccctgtctttaattttgggatcggtgcaattgtgttccttccgcgtacgaatttggnaccagcatctctgttgttccaaaggggttgctctcgatctactagtactacatggaaccgaaaaaattaaccatttgtgcatcttgttgaatgcaacagttctatgtgtttctgattagtttatttctatctaccagtagtaggtataagcgtcagaatataaataatgcaaaatacaatttgacg

SEQ ID NO: 9029 - DNA, 2191 bp, Zea mays
actctttcggtgcaaccgggagctatatatttcttcagattttctttttttgtttcctctataaaatggaagaagtaattgaattatgggtcaggatgcctccatttcatagtgtaactccttttccttttctctgatacgagatcctggagacactagggtacagttttgagttcaagagcagtaggtagattcagcgtcctaccataccgtgcacgttggcagaatagtactatgtgcgtggtgtgaagtcgtacaggaggtgccagaaaactggtagattctggcattcttttctgataataacatgttttctgttttctgaacctttaataagtttgtcgatctgatgcctcctcctccccgtggtctgctgcagaaaaataaagaagctattgggtacagacacaagacagttttatattgggactcgatcaacttggtgtttgggaaagatcatgcaaccggtgaagcggcaaagaccccagctgatggtgcgagagatatgagtaaggaagagggaaccggtaaagagcttacttcatcaacaacctcaggaagcttgaagaggcaacgttccagtgattccttcacctcaatgatggcggagaaattagacaagttcactgaagctattagggatgaagcaccaaaagggccgacatcaaaagaaatttttagcacattggaggagatagatgggttagatgaagacacatttttagacttgtttgatatcttaacaggtgatgcgcgcaagtacgagtccttattggcacttccattgattctgaggaagagatggctgttgaagcaacttaaaaagtgaaccgatttgtggttgggtgaattgaactggtgttgggtgtgttgatgttgttgtcttagtttatgttgggtgaattgaacatcacattgagtagcaagtaatgtgttccaatgatatgtggacatttgagacaaatatgcatcattattactattcccgtgatgcattctgcttgataaattgtagggtgaaaacttgtgtatttaatgtatatgactcatcaaggcacatgtgcacacaagaaacatgtgtattttgttgtgtacaagttgatgtggttacttccctccaaatatataaattccatatataactatccaaacaggatattgaatttgattcatagaaaagaattccattagcatccaaacaaaaaaattgaattgtatcaaattctaaggaattactttctttaggaatctaatatctagaatgttattcatggaatgagtttcatttccaagcaaacaaacaggccctaaatgaatttcccacttctcgtgtcagcttaatctttttggttgaattgattggtgcatgcaacttaatatggtatcagagacagaggtcttttgagttcgaatcctagttagcacaattaaataaaataattgttgcccactcctatattacacggcagagacctaaaagaggctcgatatgaggagttgttataatataatataagtaaattgcacacatcttctatcagcttaagcttttgagttgaactggttggtgcatgcaacttaatatggtatcagagtcagaggacacgagttcaaatcctggttagcgcgattaaaataaaaataatcgttgctcgcttctattccacgtctgagacccagtgcaattaaaataaaaataattgttgctcgctcttattccacgtctgagacccacgagaggttcgacgcgagggggacggttagaatataatataagtgaattgtctgtctcttattatcagcttaagtttgtaggttgaattgtttggtgcacgcaatttaataacagtgatagatagaatcacgaaactcctaaggaaaaaaaaactgtgcgacttggacaatcgacagaggaaactattttttgttgtatgtgaagtcccatatacgttttgaatgagtctcaatacacatcaatcacctcaaattggagctagccctttggattgtcgtcggaaagcgcgcgtcctttcggagacggcatatcatggccctcgctggtgacggggaagaaagccttcaatcagcgattaaggcgtgatgctgacggtggctgccctgcctgatgatgacccttgcaacttgccagacactttggcgggtagtagctggccaacgcgatccctggatc

SEQ ID NO: 9030 - DNA, 2158 bp, Zea mays
tgggtgaattgaactgttgttgggtgtgttgatgttgctgtcttagtgtgaattgaacatcacattgagtagcaagtaatgtgttccaatgatatgtagacatttgaaacaaatctgcattattattactatcctcgagatgcatgttgcttgataaattgtagagcgaaaacttgtctctaatctatcgcacatgtatttgactcattaaggcacatgtgcacacaagaaacatgtgtattttattatgtacaagttgatgtggttacttccctccaaatatataaattcaatatataactatccaaacaggatattgaattggattcatggaaaagaatttcattagcatctaaacaaaaaaaatttgaattgaatcaaattctaagaaattactttctttaggaatctaatatctagaattttactcatggaatgagtttcatttccaaggaaataaacatgccctagaggaaatccaaatcatctagaagcaccggccggtcgtcacagccaaggcaacaaaagaccagtaacgggcagtgctcggtagtagaggacaattattgttagttgcagccttgcaggcagcaaagcaccgggaccaggacgccggccgcttcccgggttataaaagtcaacagcctccgcccaccaccctgtcggctaagcaagctaaaggtaacccccccaaacctcaccgccgatcccaccgcccggcgccgcgttctatggcctacacctcctccctcaacctcccgaagcacctcctcctccccagcccccgccggacaaggcacaggccttcctccttcgtccccgccgccgcggccaaggtcaacggtgacgcgcccgagaggccggcacccaatggcaaggcacgcatcaacggccagggcaagaagggagtcaacgggcatgcggaccggatccacctctcggtgagcacgggcggcggaggccaggacggctccggcctgcgcgtggcgttccagggcgcgccgggcgcctacagcgagttcgcggccaagacggcgctgcccggctgcgacacggtcccgtgccgcgccttcgcggacgcgctggctgccgtggagcgcggcggcgccgaccgcgccatcctccccgtggagtccaccatggaggggacggcgctgcgcaactacgacctgctcctgcggcacggcctggtggtggtgcaggagatcaacctgttcgtgcactactgcctgctggccatgcccggggtgcgcgccgccgaggtgcggcgggtgatcagccaccccatggcgctggcgcactgcgggcgcgcgctggcccgcctcggggtggaccgcgagcccgtggaggacacggcgggcgccgtggagatgctgcggtccaagcggatgctggacacagccgccatcgccagcccgcgcgccgccgacctgtacgggctccaggtcctcgcgcacgggctccaggacgagtcctggaacgtgacgcgattcctgctcctctccaggccgccgtcgcctgtggccgtggcgctgggcgtggacgccgacgccaagaccagcatggtggtcgcgcaccggggcggctccatggtggtcgtgctcaaggtgctctccgccttctcctcccgcaacatcaacctcaccaagctggaggtcatcaacaacgaaggcgctggatccggaccaggcgagcggccgccggtggtgatactggacacgagcgcccggggcgcacccacgctgcgcgccttcccgcacgtcctctacgtggactgcgagggcgccgcgcacgacccgcgcgtccgcgaggccatccaggagatggagaggttcgccgtcttcgtgcgcgtgcttggatgctacgccgccgactccaccgtctacgatctgcagtgagctctcagatatgatctagctactacttactattcagaagagaaagcagcgcgtaatttctgtacagatgcaataagaagaatcttccttcctataattatttgccaacaaggtctgctttttagcgactagttctaatcttgtttatagattgtgtcctcttttctcctgcttgcaagatgattggagcccccgttggtagtaacataacatcgcaagcaaggggcggtggtcccgtgctcgttggtggtagttgcgtc

SEQ ID NO: 9031 - DNA, 2300 bp, Zea mays
attgggtccctcgaggccggccgggaggaaagattccgcttcagccgccgcaccgctcgtctcctccccgagcgccgcgctgtcgcctcctcctccccgagcactgcgtcgtcgcctcctcctccccgagcgctgcgtcgtcgcctcctcctccccgagatctgctgcgaaaaataaagaagctaatgggtacagacacaagacagttttatattgggactcgatcaacttggtgtttgggaaagatcatgcaaccggtgaagcggcaaagaccccagctgatggtgcgagagatatgagtaaggaagagggaaccggtaaagagcttacttcatcaacaacctcaggaagcttgaagaggcaacgttccagtgattccttcacctcaatgatggcggagaaattagacaagttcactgaagctattagggatgaagcaccaaaagggccgacatcaaaagaaatttttagcacattggaggagatagatgggttagatgaagacacatttttagacttgtttgatatcttaacaggtgatgcgcgcaagtacgagtccttattggcacttccattgattctgaggaagagatggctgttgaagcaacttaaaaagtgaaccgatttgtggttgggtgaattgaactggtgttgggtgtgttgatgttgctgtcttagtttatgttgggtgaattgaacatcacattgagtagcaagtaatgtgttccaatgatatgtggacatttgagacaaatctgcatcattattactattcccgtgatgcatgctgcttgataaattgtagggtgaaaacttgtgtattttgtcgtgtgcaagttgatgtggttacttccctccaaatatgtaaattccatatataactatccaaacaggatattgaatttgattcatggaaaagaattccattaacatccaaacaaaaaaattgaattgaatcaaattctaaggaattactttctttaggaatctaatatctagaatgttatttatggaatgagtttcatttccaaggaaacaaacgggcccttattgtaatcaagaaaggtaagtaatgcaatcaatctatcattctctacctcctctattctagtctccctcctgcttgatgccattgatcgacggctccctgccagagatcgctactccttgtgcagcaggggggctacgccctcacttctacctcttccaccacacaaccgtaacactccccatcgtcccactgttggggttctaagcccaaggaagaggaaccctctgtgcccctgatgattctatggatcagcaactacaccatacttggggtgaaaactccgatagaatataggaaggtgctaatccccaggcaccttcaggcggatgcgttggtcaatgagtgcatcaactagacaccgcccagatggatagtgaagagggtgttgaaaccaccgtctatcaagggacaaccaaagcattttgaagaatccgacaaggaggaagagacgatggagtccctcaaggtggagctcacaatgttcaaggaaaaaatgaacaatgttctagagcgttgtgcgacgggagagctctagtgcatggagttagaagacaaaatagtgacccttagtctagctgaagtaaccgggtatgcagaatttataatccgcctattccttcatgtccagtgcttttgaatatattaagcgcttagtttactttaatttaggtttaagttgattaaatttagtttgtaaccaatgcctttgatttataattcaataaagtagttgaatttcattttctttgaatgcatgtttttttatcatatacaaaccttccaacctctttcactaaccctacacagatacaacataaaactaacgtgtagggtacaaaaggtttactttcaaaagtttgaaaagtttagaaaaaacacaatgatcaccagaccacaccttttcaaaaatcttatacatagaacttttcaaaacgtccacaaactagggcaggggcatatgcaccgagggacataccaccaaacccaacccaggacaggtttcctagccactccctggccacgtgaccacctttctagtcactacaacttcgaccccaactcaaggtcaaatacacatggtaacttttattataaacttgagttatgcgcttattcatgaatttagacttagattactctacataatcctagtgttaccttactcttcgatttgcattggttttatttcctatgctaagtaaggttaccttgggatactagcatgagtagggaaccactttgatctaag

SEQ ID NO: 9032 - DNA, 1091 bp, Zea mays
gccgcacgaacgtgcatcctcctccttagagtcatctcctcccgagcggtgggttcggacgcgagccgcagcgacgtcgccgcggagggcctgggcgcggcttccgtgggcggttcgtgcgcgtccagcggcgtggtctcggttgagcggtcgacgacgaccaggcatcgcagccgtgaagagaagaaggccttggtggtggaggtggcggatcatgaatgcgacgacgacttgggcgccggcgagtctgacatctccgaggagctgggtgcgaaccatgaaggaaacagtactgaaggtggcatatcatcggtcgacagcgtttctagcttgctcagtgggataagctaccaagacgttagctctggctgtgcctaccgagcatcctctcatcatcaccatcagaggaggaggacatccgaagaaaagggtgcccaccaactgcgtccttccaaacccggtccaaaggcggagaaggtcggtctcagacatgaggcggtggacggtcggagggccgctgaggagtggatggtcgactacgctctccggaaggaagtcaagaggctggctcgtgctcagaagaggaaagttgagatgcttgtccaggccttcgaatctgttctgcccacggtagcaatagcaagcgagaagaagcccgggcaacacgatggccttcgaaagcatgcatgtagctgacagatagatagatagaatcatagatagccgacactcatcttgagtcaggtagtagtaggacgtgacaatttgagtcaggtagatgaaacgtttcaattcagtcaaacactagtcacaacggatacaaggtttgatgctccaccaaccactgatccgttgtgaacttgtagtagaagcaggccaccgctggcaatgtggcatgccatgccatcaacctaacatggaccattctgaatgtcggctcaaaacgtggcaaaatactatacttccacatgaagaccattgttcaggaagatgacagaattcagggagagaaaaaaaaacattacaattgtttaaagaactgcaaatttatagttacaattctagttacaggttgcagccaaaaaaaggga

SEQ ID NO: 9033 - DNA, 1148 bp, Zea mays
cccacgcgtccggctgggtgcgaaccatggaggaaacagtactgaaggtggcatatcgtcgggcgacagcatttccagctcgctgagtgggataagctaccaagacgttagctctgcctgtgcctacggagcatcctctcatcatcaccatcagaggaggaggacatccgaagaaaagggtgccgagcaactgcgtccttccaaacccggtccagaggcggagaaggtcggtctcagacatgaggcggtggacggtcggagggccgctgaggagtggatggtcgactacgctctccggaaggaagtcaagaggctggctcgtgctcagaagaggaaagttgagatgcttgtccaggccttcgaatcagttctgcccacggtagcaatagcaagcgagaagaagctaatggatacagacacaagacaatcttatactgggacttgattagcttggtgtttggaaaagatcatgcaaatggtgaagcggcaaagaccccagctgatggtgcgagagatatgagtaaggaagagggaactggtaaagatcttacttcatcaacaacctcaggaagcttgaagaggcaaccggtaaagaaatttttagcacattggaggagatagttgggttagatgaggacttgattagcttggtgttttgatttttagtttatgttgggtgaattgaacatcacattgagtagcaagtaatgtgttccaaagatatgtagacatttgagacaaatctgcattattattactattctcgtgatgcatgctgcttgataaattgtagggtgaaaacttgcctctaatctattacacatgtatatgactcatcaaggcacatgtgcacacaagaaacatgtgtattttgttgtgtgcaagttgatgtggttacttccctccaaatatgtaaattccatatataactatccaaacaggatattgaatttgattcatggataagaattccattagcatccaaacaaaaaaattgaattgaatcaaattctaaggaattactttctttaggaatctaatatctagaatgttattcatggaatgagtttcatttccaaggaaacaaacgggccctaatggaattgagttgattttggagactaagagaggattcaatctatttgacg

SEQ ID NO: 9034 - DNA, 1888 bp, Zea mays
cacacgcgtccgcacaagcgtccgcccgcccgcccgcccccgctctccgtttactctttcctcaccatcacatcgccgctgccgcgacccgcgggccgacgagatgagagccgccgctgcggcctccttccatctggcacccgccacgaaaccggcccatcgccgcggctgcaccacagagtcctgttccctgaagcctgcgccgactgctcggccacctcgcctccgctcgctcgccggccgggcgcctcttgtctgcgcctctctcgggatatctcatgataaagggttcgacatttctgaccccaatgttgttggacagaatgatttactgattgtgggccctggtgttcttgggcgaatcatagctgagaagtggaaaaaggagcatccaagttgcaaagtttatggccagaccgcaagcaaaaatcatcacaacgagttaacagatcttggcatcatcccctcattgaaaggcaccactattcatcagaaggttccacatgttattttctgcgctcccccgtctggttcagatgattaccctagggatgtcagattggcagcatcaaattggactggtgaaggatctttcctgtttacatcaagtacagctctgtatgattgcagtgacaacagcatgtgcaacgaggattgtctgtcagtgccaattggcaggagccctcgtactgatattcttctaaaagtggaaaatgttgttcttgaggcaggaggctgtgttctcaggctggctggactttataagatagacagaggtgcacatgttttctggttgaggaaaggaactttagacacacgaccagatcatatcatcaaccagattcattatgaggatgctgcctcccttgctgtagcaatcatgaaaaagggactgcggagtcgaatatttctgggttgtgacaacaagcccctttccaggcaagaaataatggatgctgttaacaatagtggaaaatttgacacgaagtttggaggctttactggtactgacggtccattggggaagagaatggagaattcaaaaactcgggctgagatcggttgggaaccaaagtatccaagcttcaccgagttccttggtatcagcagttaacatccttgcatactgttcagttagtctgactcagctgagtagcaaccgtgattagattgtaccatcgtttgaatttttatggtctgaactggtgatggtgtacatctcagcctactttgggcctgtccccagtatttttgatctcacactatttgagctgtgaaccagacagatgccaccccatcccaccggacaatatatactgtcacgtgagtggatttgtcgatcatgaacctacgtggctacatagatttcaacaaactgaaattgttgcagagaattgacagtcaactaccgaataaacgaataatcaaccaaatgcgaacgcgtgcagacttggttctttagcacacttatcgtatccgacagtttatctattcattcaaaacattattttgtacgataaactgcactgtttatagagtagagtttaaatatgagaatgaagattttaagttgctggagatagttacgagttgtttattactcactctgttctaaattaaaatttattttagttaattaataggctcatataatacttaatatatgtgttctatatatgtttctaaattcatcttcatctatcatataaaattcaaaagctaaaacgaatattatttaaggacggagaggtacttcaggtccggttcattgagacgtagtttattcgtaatacgttcccccaaaattacagggttgacccgtttattttattataattttttaaaatttctattgacttataaaacgcctttgaactatttggggata

SEQ ID NO: 9035 - DNA, 4282 bp, Zea mays
  misc_feature (326)..(326): n is a, c, g, or t
  misc_feature (685)..(685): n is a, c, g, or t
  misc_feature (2029)..(2029): n is a, c, g, or t
  misc_feature (2051)..(2051): n is a, c, g, or t
cacctcagcgacctacgttctcctcccaccaccatcgggtgcccctctcctcctatcgccttctcccgcggcagcagacggtgcagagatcccaccgcctcacggccgtcgcaggctgcttgtttgcagcgttggcaccaacggcagcggcgacatggcagatgtgtgcgctggagttggtgtgtctagagcaccaatttgtgcgtgtgcctctcgagtccctcagcgtcaccgtccgctcgaaccaccgccacgccgagatggagatctccgtcgtcttgtcctctgcctctgctgccccaccgagagcagagttgtcaccgtcnaccacttcgtctctctcgtctctcgcttcctcggcttcaactccgttgttgtcgtcatcttctttgccatcgcccggcgccaccgtagaaaccagcctccccgagtgagctcttccggtcgtacttgtattattcggcccactgtcgtgctacaagtattaggtttgtgttgactagagatttagaattcattttttcattggtaaggaaccctaactttcttcccgatgaacaatcacatccgattttccactccattcatggcgtacgtactaatccacttgagcgtctgttttattttctgggttcaatgacagcgggtgatccattgcatgctcaaggatcggtctcgaactttngatttcctcagaggactttggttccgtgttgagggcattcaaattactactaaaaaattggaagttcaagacagccctgatgccatcagcacctagggagaaggatccacaagttactacgagccctgcaacggggcctcctcgggtgcacactctcatgcctgttaatgccacaggaagtcctgccatggacctgaagctggcgcaaccatcttgccctggccatgtagtactcctgcacccttgtgcaccttggcctcctcatttgctagtcccgttgtttcttccacaccaaaatgtggttcactctctaaccgaatttcaaatcctctctattaatggggaacaatgcctattgtccttattctatttattgatgggcaggatgctctagtggatgtggctgcagcagatgttaaccctacgaccgatacctgtgatgagaagatgtttcccaaggtgaatatgttgttcgacggtgaaagcgatgtgtatgagttctacaatgcatattcagaaaacgtgggttttctttgtccgaaggtcaacgctgtggaagacgtcaaagaatataatcactaggagaacttttgcgtgttcgagaggggtttcggaagaagggagcaaatgaagcaaagtgtccacatcttgaaacacgaattggatgccccgcaagcttgaccattagactcactgctaatggcaagtgccatttgatagagtttgtgccgaatcataaccatcaactggcaatagcctctacaattcatatgctgaaagcgaagaaaatcaggcacaaagcacgggttgtgagagaaaatctgacagatgataccgtgagtacaccagattttgagaatgaagatgaggcatatgaattttatagtatgtatgcagggaaaattgggtttatcgtgcgtacggctggcatgacagtgaataatgagaatgttataaccacaagaatgcttgtttgttcaaaagaacggttccgtgagaagaaaacaggagcaaaaagagtaaagaaacctcgacaggaaatgtgaactggttgtctagcatgtatggtcatcaggcttggaactaacgggaaatatcgagtcacagaacttgttaccttccacaatcactagcttggagctgaagcagcttctgatcttgtcatggcatctgggagtacagaaaatgatcaagatagatcacacgatgattctgtttacaagcaaaatctgattaatggaagttgcactctgaattccctagaaggtacaagttgaaaaagatacaagtgtgcaaatactccacgctcaggtgatgttggtgctacactagagtacttgcaanaagtgcagcatgataacccttncgttctctatgctgtaaaatctgatgatgatgggaactttcatattttttatgggcacattcaaaatctattatggactttttccattttggtgatgtagtatgttttgattcaggatatgcattgcaaggctatgatatgccattggctttgagtgtgaatcatcatcataagcagacaattatctttggtgctgcaattattcatgatgaaagtaaagaagctttccaatggttattagatactttcaagatggcaatgaatggaacacatcccaagacattgttaattgatagatctgttgccttaaatgaagctgttacagcccatcgttattgtgtgtggcaaatttatcaaaatgctctacaacagttgagtcaagctttccatggttcaaaaactttagattgcaacttcaagagatgtctatttgattgtgaggatgagtttgtgacagcatgtaaggaaatgttagaaaagtatgacatagaagataatcaatagctagcatatttgttctcaagaaaggagaaatgggcactgacatatggtcgtgatgcattttatgttgatatgaaaagcgtgcaacaaaaggaaagtttgacaagtgagctgaagaaacatctatcctgggaatgtgaccttttgaacttcttcgagcagtttgaaagactgttatgtgatcgtcagtctacagagatggaggctgaaccaagagaccactttgttaaatttgattcactcaattccacgatggactgtacttgtaagacgtttgaacttattggcatcccatgtcgccatatgctggaggtacttgacatgaggaatatcaaggaccttcctactcagtcaccgtgaaaaggtggaggaaggatgccaaatcaggatcctcaaatggtggctattctttctcatttgatggtgatcctgactcctctcacataaaacattataattttttgtgtcgtatcttcaatatagcagcggctagggctgcaacttttgttgaatcatttgcatatatggaaaaccagtcaaacatactgatagatcaaatagatcaagttattccaaccagccccactgacatagctaatcttattggtgctaattttgaacaaactcaaaattcggttgacaattttgtcgctgaaggcattcaaagtcatactaattttcttaatggctcctgtgttgaagtattggttttctttccatataaatacttgttgccacccagtaagcgcattatgtgcattgtaggctctctaacatttccattcacattaggtgctggcacattagattacagctaactggtacctactgttaagatggtactgtagtacagaacaaagtatttctgtttgtccatgaacaacattgtgtcattttaatgtttcacaatgaaaccatgattgtatggctgcatcatttactcgttactctatcacctgaccttctaccagaggatattttgttttcttcatttgctgaccaagtctatttaggcatgcagaatgacataatggatgttctactaatctgttagtgacttcacattcactgcagagctgcaaataacaatggtacacctactgcactggtagttggcaggtagattttacatttgctggagatccatttggttgtccttaggaagtaatctcaaaaataacttatgcacaacagctcacctccatgcgaaactacccaacatttcaggcctgatattgtctgccttaacttctcacccaaagaaaggaaggattttttccccttcgccagcactcattgtatgtacttgatgggaaacgatgtttcatgaggtagcacccgaaatatcacctggttttccagcctggtgattgtgcacagggtgctcccggtaatgagggactccgcctgctgtgttgccagtttacaaggtgatgatgctgaacttaaccaacgcgagcccatctgatttttaaccagtgctgtacgcctgtagcgtaatgctgttgcgatagccttgtcatgacagttgtgcaatgtacagattttttaacccattacgtaaatatattgacatgtggtccctggtttcaaattgccagctgtgcaatgtattatgctagggagtacatattaacagctacgtagtatttatttagaaaaaaattagaacggcttacaatttggaattgaggaagaatgtgagaatggaacatgaataagaatgagga

SEQ ID NO: 9036 - DNA, 4398 bp, Zea mays
ggatggagtttacaaatcaaattgcttcgtagttttgtctatggattgtgtgtctttttctagttatgaaaccgtggtcttttatggtgtatttcaggaggtttgtccctccatatgtggctagtcgtgtgattactccatataaaaacttcctgtgtgttggctaatcctttgagtgaggtgaagctggactggtatccattataaataaaactaatttgtgcatatgaaatgaattggttttaggtctcttttttccctaggtacttctcacaaaacccccttcctaaatccatttccttctcgctttacgtttccttcctggtcttgtgctatgggatcacccatgctctcgtgcagatttgtgctggcgtgtacttcattcttgtctagcagtcggaccgttgctctcagtcgccaccgtgttcctgccggccatttcaccgctagtagtcctaatgcacgatgtgtgctccagattccacgatgaccgcgagtccgtggtcgtcgtcgtcaaccacgtcgcacttgttacttaatcacacaagtggctcgggcccccccgcgaactgaaaactaacaacaaaagatccccgcaccgctaggctcaaacccagagctagctagcctagccatggcagagcacgcaagaggctcccaaatccttctcatttacctctgcctcctcctactatcctcctcggcgcacctggtgacgagcatggaccttgacagctacgacgactacgacaacttctccgatgagttggtggcaccggcagactacgacgacgagagcttctccgacgaggcggcagcggcaccagcacggcgccgcctgtacgacatcagcctcaacgcctcctcctccaacaggtccggcgcagccttctgcaggctgctgttcctgcagatactggacctgtccaacaacaagctcacgggagagctgccggattgcctgtgggagatgcaggcgctgcagttcatggacctgtcgaacaactccttctcgggcaagatccccgaagctccaccgtcccacaactgttcgctagcatcactccacctcgccggcaacagcttcaccggagagttcccgaccgtcgtcgggggttgccaggagctggccaccgtagacatcggcaacaacaggttctacggcgacatccctcgctggatcgggaccttcgttccggcgctgaagatccttaggctcagctcgaacaacttcagcggccagatccctccgggagctgtcgcagctctcgcagctccagctgctggacctggcccacaacggactgacggggctgatcccgagagagctgggagacctggcttccatgaagcaccccaagatcaactccagcacaggatcgctggacgggtccatctaccaggatcggatcgacatcatctggaaggggcaggatttcacgttccagaggatactggagctgatgacgggcatcgatctgtcgggcaactccctctcgcattgcatccctgacgagctcaccaatctccaaggcctccggtttctgaacctgtcgagaaaccgtctgtcgtgtggaattcctagcagcatcggaagcttgaacgttctcgagtcacttgacctctcgatgaacgaactgtcaggagccattcctccagggctgagcaatatgctgtccctcaacaatctgaatctctcgagcaacaacttgtcgggcacgatacccactgggagccagctccagaccctcactgacccatcgatctacagcaacaatcccgggctctgtggacctcctctcaacccttgccaagacacgtcacgtgttcatgaaggagatgtcggaggataccgggacggggacccatggctgtactactgtgtgatcgctggagtcgtttctgggttctggctgtggtacgggatgctcttctccgttgcgaggttgaggtgctctgttttcttctttgctgatcgcgtacagtacagagttatgcagaagatgcggcctttcaatcattttgtttcgaaagagaagagcgatccatcgtctgtgcctatgttttctacaagtgatacaagctgaagaatggactactgatatcttctctttttttcccctctgccctagtgcagcaggagatttgctgtctttctttgtacgctttaagatgtactgtaatgctgagaggaggccagaaggattatagtcaactgttgtatagccattcccgtcaaaaaaacattatatttttaaggagatctactgtctttctttgtgtgcctttctgatatgaatatgatatgtttaagaagttcttagttttttttggtagtttattcatttctactactgttataaaaagaatttgtatatgaaattatttttaagaagtggcataggtatacccgtcacccattgaggggaaaccaccaccttaaaaaaccgaaacttatatatgctgggagctgcacttccatcatcaaaaagattcagagagagaactaagaacttatcatgcacagcagaaaatggtatggaaagtaaagtgacactaagagcaccttgaacaatgtgccatataaaatgccctatattttaaaagcgagaatgttttgaaaattttagggcaccacaaaacagtaaactccaacaataaagccccaaatcaaaccattaaccgaaatctggtaacttctgcccgccattgtcatattcctgtgcgccactatcttctttccaccgcgcgcagctttctccttgtggccgcagaaatctgtctccatggccggacgctgccgccatgtctcattctacgcgtgatgctgccatccgtcaggtgtcctggtcgaatgttgctaaacgtgctttcttgatttcagggtttgcatgtacaacactagtacagcggcagagattgctttatcgctttattgtatgtattagaacatggagatatgacagttatgtgcattgacagtgtaagataatctgaagtaattttataacatttagttagctttgtttgaaatgacatattgtcatagaaatttcttaccgaacttgcactttctagactatgttgatgtcctctgttcgaatttgagaggtaccaaatagctcttcgtaatcatcgaatgtcaggtcagcatttgagaggtaccaaatagctctgttcgaatttgagaggtacaataagaatacaatggtaaccgattgtattcttctaagatatagattgatgataaacaagttctgaaatactaaacgatgcaactagcaactgcccgctgacgcaaatgaagctaacaacatgttgaaaaatggaataatcattgtaaagagaagctactacaacactgatgcaggatgtgaactacaacgatcacaaatataactagaagtttgaaaatagagattcagaactggcaacgggagcaggaagactgaatgatctacgatgataagacaacacacttgttctcttttgtatatgcctatatggtgtcgtccacatatacacgggaaaattgtgttgtttaagctggacaattagggtgcgtttggttgcaggacagtcaggacagagacgtcctctctcgtcccttcaattctgagggataactgaggacaacactgggataatcctgttccaacccttaaccctgaaccaaacaaccttatttgagggatcgtctcatcctatcactgcaaccaaacgtatcgcggcaacgaaaagagatctaaaaaatcaattcattttactaatgacaggtgacgtcgcggcgcaagcggtcgttatcaatcgacttgattctaatgttagttggttcggctagccgatcgttaggcctatcaaccaatcggtctggtcggtaccgatcgcgttggaatcaaatatgtttgtgccgatccaggtgctagtgatccgatcggtattgccacatatcaacatctggttagttcacctcattttatcattttaagagtttgagttgaagcaattcaaaaaaaccaaaaaaaataaaaaatcctagatccagactatatatagagagagtgtttaggttcattcacaccactcaccctctaattcacttctttcatattgtagtcttccattctggtttaatatagataccaaatggagtttaaactttgaaacattcaccgaccggctcaataagcaatctgtacagtgtcccaagacccctatcggtgtggagcaaaagaagttcgatgctctttctcttgtccaccatcatcgggagaatgttcttgcttgtccttgtcccttgagttcgcaacctcttcctccaaatttatatcctcctcagccatatccatatcgaccatctatggatgctcctcctactactaacaataaaaatcaacc

SEQ ID NO: 9037 - DNA, 3878 bp, Zea mays
ctcagggtcgcctccctactaccaatggtctggagttcgtagggatggttggcgacgatggggacctcatcttcgatgcactctacctggacacaagactcggactgtagctccgcaacgaggagtgaggaaggccccgatgatggggaaacaaaggttgtcattaacacatgtttatgggcctttgttgggtcttgacaagcaaggcctaagctagccctcgtggctaagggtcacctacctactatcgatgacctagagttcgtacggatggtcgacggcgatgggtggtctcgtcttcgacgcactccgctcggactcagacttggaccctggctccctaacgagcagcgggaaaggcccagcgatagggaaacaaagctcgtcatttacacatgtttatgggcctttgttgggtcttgccaagcaaggcctaaactggtcctgacttatgagggacagtgtccaacgggttgccgggtcggtatgtcggcaggcccaactgcccaagtcaagctgaactcttggtaaagaagaaagaaagcggagggtttagccagaaactagcggagaaccccttcgcggcgcagctcctttcttcctcctcggccctcgcgtctcttttcccagtcgacgcaccgccaaaagccctgggtagggtgactgggtgtctgggtctctacgcctccctcgtcatgctgcgccgcctccgtctgcgctcgccggtgtgcgctgtcgccggcgcggccgctgcaatggcgtcgctcaccaacgtcgcctacgccgatggcctcttccgccgccagtccccgccgtcgaatccaggcgacgaggacaatttgggagcctccgcgttcggccgcgacccggagaccctggagcgcatggcccgagcgctgcgggagatcaacaactcaccgctcgccaagcaggtgtttggactgatgcggaagcaggaggagacacgccttactgagctggaggccgagaaggtccaatacgccatctacgagaagctcagggacatggaaaggatggagaaaaaagctgaagattacagaaatagtttgcaacaagaagcacaagtaaaagctcaagcattacgctttgaggatgaattagctagaaaaagaatgcagacagagcatgctgcacagaggcaacaggatgctgaacttgtgaagatgcaagaggcatctgccctcagaagagaagaagctaggcgtgcaacagaacagaagattttggaagaaatgatacggactgagaaggaaaaggctgaaatagatcaggaagtaaacagagctaaagctttagcagaagcagaagctcgtgttcatgaagagaagcaatcagaagaagttacaaaaagaatgatgttggaacgtatgaagggtgaaaaggaaaagtggctcgctgcaataaatacaaccttttcacacattgaaggtggattcaaagcactgttaactgataggagcaaactaataatgggtattggaggagttactgcactggccgctggagtctatactactagggaaggtgcgagggttacatggagttacatcaataggatcttgggtcagccttcactgatccgtgaatcatcaatgccaaagttcccactaccaatgtctaggttactcaaaccaagctcagcatctttgtcggggggagcaggctttgagaatgtgattctgcacccttcactcaagcggaggattgaacatcttgcacgagcaactgcaaatacaaagtctcatggtgcaccattccgcaacatgctgttttatggccctcctggaactggcaaacctttagtagccagggagatggctcgcaaatctggcctggattatgccatgatgacgggaggagatgttgcacccttaggatcagaggctgttaccaagatccatcaaatatttgactgggctaagaagtccaagaaaggcatgctggttttcattgatgaagctgatgcattcttgtgcgagcgtaacagtacccatatgagcgaagctcagacggaagtgctctcaatgcattgttgtttcgaactggcgaccagtccagggatattgtccttgtcctggcaacaaacagaccgggtgaccttgatgctgctatcactgaccgcattgatgaagtcatagagttccccttgcccggggaggaggagaggtttcaactgctcaagctatacttgcaccaatatatactcaaggaagagggcaaaggatcttggggtgcattattcaagaagcagcagcggaagattcaggtgaatggcataagcgacgatttgctcagggaagctgcaaggaggatcgatggcttctctggcagggagattgcaaagcttgtggctagcgtgcaagctgctgtttatggccggcctgactgtacattggatccccagttattttcggaggtagttgactacaaagttactgagcatcaccaacgcatcatgcttgcttctgagggtatggcttgatcaataagaaatattttacctggaagccacaggtttcaagctatcaaagatcgggtttggtgatgagcgacaaaactgacaatcacctcccactgacttgtagtcatgttttggatcccgtgggactttttgtaggcggaggttctatttccagaatttttgttccatgtgccttgcctgaagcaaggtctggtcccggatggacatccaaataggctggttgtggtcaactgagtttagtttaactcatttagtaggtttgcgctgtgttttaacttttccttaagtctctcgtgccccattcttggtagcatctgtacgcttgtttatgccaaagaaaaggatcaaattatttaggtgataattctttgtccattttttaattgattggttgctagcgatttttctttctgagttttcatcgcttcatcatgtcatgcctggttactgaaaccgtttcatccttcatacaccaatgcatttgcttcgctcgtctgaactcggaacaatcctgcttgcaaccaatgcatttgtttcgctcgtctgagctcagaacaatgtgcacctcagattcagagcataaaataaagagcaagtgctcagaattaacattagacaagtggacaacaggaagttgagcaaaggagtttctaatgagttcgtttcttttattttttttaaatgactgccactctattttcctttttaccgattccaaaaaacaaggtctttttgattacgtagacaagtgacggacacaatagtggtatagtgcaacccagtgctggtccccactccccatgctagatcaataatgaattcttggttcaggtgggagcaagtttaataatagtgtcaaatgctgatggtaaggatctttatagcttgccatttagctcatctatatagtggttaactctttaatattaatgtttagtggttagctttttagtattaatgtagaactctacttatctttctcacaaaatttcttagttcttatgttaaaaccgtttctccttctctcttccacctcattatttagccaatttatagcctcttgttatacttactctaaatgaagtctctatctaattaataagcattataactcacattcaagcatatcattgtatcagtgtcgtcatctcaaaaatctcattttttgaaccacaaaaggtgagctgtagctattcactgcaggaattctaataattctcgtcggccaaggcagaagccgacagaataggctaattctcgtcggcgaaatagtagccgacgagcattatttttattcccgtcggccacgtcacgagccgacggggattatcttattcccgtcgacctcttcctcgggccgacggagattaactta

SEQ ID NO: 9038 - DNA, 6767 bp, Zea mays
  misc_feature (957)..(957): n is a, c, g, or t
  misc_feature (4936)..(4936): n is a, c, g, or t
  misc_feature (5738)..(5738): n is a, c, g, or t
gttccgcttcttcgggactacaccatcactcaaataatcaacccagtggcttataaactagctctaccatatgggagttccacatctccctaggaccaatcactgggcttataaactagctctaacagatgggagttccacaatgattaccaatcaccgggcttataaactagctctaacagatgggagttccacaatgatgggtgattggtgctacaaccacggtgagtttaggatcattgttcgcatgatctctagactaatttggaagccacaataccggagtggattgaaggggctaaaatcctctccttatttaattttaaataaggagaagattttagcctctaattctctccggtatttggactcccaaactagccccaggtgtcgtaggaaattcttgagaccaggcttagtcgtcgggctggtaagttcattacctagttcctgatccgatggtcaaactggccagcttcgatggtaacctgtgaagacgaggccgacatcaatcgccgcttcccatttgctccagcttaggctttgttcggttaatcccgttacctatagattggatgtgattgaaaaaaattgttaagaaatttgacttacttaggatttaaactcacccaatcccacttaatccacatggattaagagctaaccgaacaagcccttaattgaggacaaggtggctttcaagggagagaaaatgtctcagtgatcacgaggcggtgaagaaggacggtcgcgatagcccactcgggaaagcgcccagaaggatctcgcgagttcctcggcccaacacgcgcgtcactggtgcagagtgaggaagtaggccgagcccattacgccatgtaataggctgtaagcagaggaaagacagacctggtaaggctggtatcctggatgagccgtcgtaccatgatatattgatatcgttctcatcctgattgngagcgcttattacatttccctagttaccaaatgtgatccagttttgcgtgaatttgcttctatgcattgctggatgagtatggaacgagtgcgtgacgtctcttatctagcattgattctgctaatagccttatcatgccacccttttctgaggaataacttactgaagttcattgttactcgatctttttttgtgacattcaacggaacatgcatgtgataaaatgaaacggataactcaccatttaccacatgatgctacatactggcattgagaccaaacatagaacaaagatacaaaaaaaaatttgaaagcctcggatagaaggaaaggagcctcctggtttaaatctcatattatctcatctaccacttggaatcctagtagatacttcaagagccaggactcatggcaccactctcttgtggtctctacagggagcatctcgagctgctgctgcaatttggtctgttcatctctcagctgggagttttcacggaggacacggtcgcagtctctgatggcatggttcagctggtcaaggagttggcggttggtgctgcggaggtggacgacctgcgcccagagctcgctcagctgcttctgctttctcatgcgcgaccgtcgggcggactccctgttggataccatccttctcttcctgcgctcttccgcgacactgcgttggtactcgtctgactccgaattggatctgttgttaccaccaaccgggaagctggcttcaaggaccccctggtcgtaagcaacgtcttggtagtaggacggagggtgaggcagcagaaggttgctgtactgctggtagaggaagccgccgtcgtcgtcggtagctacatggtagtgaggcttgaaagaggccgcaggagataagtatggaacgctagcgatctcagcagcagggtacatgttcaccactcgatcggtcgatgagctagctatgaaatggagggaaagtgtggcttgtgaaagaagaggtgagggcacccgggtggatttatagcgtgcaagaataattaatggagatgaacaggacccacacctgcatcgttgaaactcacctttctgtgctgctttgatatactacagaagaagaagaagccagggacagcagcacgtatacatgaggctgaagttgccaaatgttttgacggaaattttcatgattcttattattactgtgccatcttttttctaaatgtactactgggcgcggggccagcatgcttgcaaaaactgtctccatcgagactgtccatttgcgaggatgcaaggccctgaataacatcactagcaccaggtgctctagccatttaaagagatggtggttggataacagtgacaggcatttgcggagaatcgtggaatggaaatggactgcgtatgcctgagagcaatgctctatcgatcgtgcagggatcagcggctatactgagtcgatctgaggcccccctttggaacgcaggaatttcgcaggaatcatacatgaccacagccggagttcttaaggaatgttgtttgattctgcagcggccgctataatcagtttctgctagagctctcattcgatgggagaatatttcagaaaaaaggaaggtaccaaggttattggtgtcctctgtccgctgctgctgtgtggcccgcagtggaaatttgcttggataaaaggaacgtgcacttctgaagttggcaacttggcattattatttttttcatgaacaagggaaaaaaaacatatccactatctagtatgctttgccacaaacatatccactagctttcaaatattttttttgaattgggttttatatataaactaacagttccggtggcctatggtgtgatgtttccattcctaggatggctttgttccgggtgggcagcatggttccgtcaggccttcagggtcccagttttcaaagtaaaatctgagctgcgctgctgatccacggtgtctgttctttttttttaatcggagcgtcggtctatgcataagcctcataaaaagaaatccattaatcatggctccactctaataattgggagttttgctgctgatttcttcagtattaaatctagaggcctggggacagtatataacgacaactcttttgagttgtttttgcatgttctgattccttgccacaacccacaataccatgttaacatctaccctttgtgttattagaagaagaaaagcaggtaacctttgaattaagactatccagatatgaaaatgcattgtgctatagtgcaaataacagatcgatgcagcagtgagcaggtcatatagccgacaagctactcgtctttgtcatctgaatattcagcatgtcgttgacagaaatgttgtggttggttatccaccggctgtgaattttcggtgttgcttctgcatgataaagaagaacgataatgagtacccgtcatctggatctaaggagcatagcgagagaaagaattagaggctccggggtttacgggggtggggggattccaggatgcagtcaaatcacctggccgcacctagggcagcctactcgttctggactcttttaatggtctacatacgaggccatcgtctttggaggacatggaaatcttatccgggtctctttggatctgaatcataagaaccaagggagaaaactcacaagtcacaacacaaaaaagacggttcacgatcagaggtaaagaagatgtctgtctgtctgtctgtctgtttgtttttcccctcgatcggtttcctttgcttctaggattggctctcctctcctgtggtgtggtggcgtacctgtcgaagatccgggctccgtccgacctgacaaatcgatgatcaggggcgtcatcaagcatgaggtaataacaagcctttgctatctcctgattgatcttccgaatggtacggtggatgtgcccctttgtctgaacctgcgtcgattcctccagtgcgacgacagtgtaaaacatcactgtccgaagaccaattgcgtgcgtgcatcagccggttaatggtcgaccgagcgtgtcgagagctcgacgattttgactgatctatatgtggattacggggggaggacactcacactctggccgccttgtctatgaccggccgggtggctacttgggtcaataatggtaccgagaggccagcacactgaaaccggaggcccgttggcctacacgaagatcggtttctctcttttcgtctacggcggggggggattcgtgcccggcaactcccatcagccgcaccaatcgtgcccgtagatccaccgacccggacaaagaatctttcagccgttggatcgcccgatcacgggtcgtatcgccgtcgaaagctttgtcctgggaaggaagagacacggggggctgtgcgtgtctgtctctttggggagacgctggacccggcggttacctaatttggagtgttctgtgggacgctgtagcctgtagacgcctagacggcggtacgggcgggcctacggcggcagaattcttttggggggcaagggcaattggtgctagtgctagagcctataggccgctgatgtctgcacactcgcacgcttgggttgggttgggtgatgcagcacggtcaagtacttgcttacaagtcagcatctaatgatgcgcatgcaagaatagggcacgtcccgcacgtatctttattttctgttattaaaaaattagccctagtgtggctagtgcgagtgcaacgacagggcactctccttctgtttccttttccccccttctcgaagaaactagctactagttaactagaaggtactaattaacagcctgttcgcatcagattaaagtcagttattcggactgttacaattataatctatagagataaaataatagaaacagtagaagtcgtttcagattaaagtcaagcgaacagtttatagcttagtaacacaataagaaactacacacagacaagtcaatgcnttgccttcacatattgctatcgcaaactatgtgaagagaaacatgatatccccacacttagagctggtttagtaacaagggaattggaggagaactcccttactattgcaaaatatggtttgtttagatgcgcctcgatctattataaatatatggtttggagccggtttgacctagttttaaactaaacttcatacaaaaatcactcgaactaatcgatacatgtgcattctaataaactcatacttgaaaaaaaaagccacgtccatacatttaaagcttctcgaattgaccaccgacacgtgcaacccgctatggctatagaggctaattcccagtcactgcatgtcccatgcacacggccggaccagtaggatgcttatgttgcacagacgacagcaaatcgccaaatccctggcgacgagacgaaataaagcagagacgtcgagacaggccaccctcataattcaaaagagacgtacgccggcgtccaatatcccacccaccaccatgcattgcatactactactagctagctagagctacaaattatagacgacgcgagcaaagctagcagctagtaggtagcctggcacacagcccagccctggccccccgtgttgtccgtgtgcttgctttcgccaagccaaggctgggaggcaatccatggcgcgatgattgcgcccactcgccttgccgccccctggcgaaccacggactccacgagagggtcaatttcaatccccgtctgggccacacgggcaggtgctgccgcgggaggcggacgaatgggtcaacactncaccggtagagcactcgaggccgcgcggacggaagagaggaagggatatgggtcaccccagctcggcaaaagccgaagacggaggcgcgcgggtgcccgtctgcccgagctatagaggaagggcagaaaaacaacagattatcacgtccaaccaaaataacatacaaataaaatattatgaatctttgttattagacacgtggcgcagtagaggaaaaacacaataatatagctagttgcccaatgtcatcaccacacaacagtgatcgacgcagggcaaaagttctagatagccgacaccgtaagagagaaattattagactagaccactaaataaaagcagctttgtgataatgtcgtgaaggttagatgataatactaggagtgtcttaaaatgacatgatactgggaaaactttttggttgtcctaggggagagccagagagagagaaagcggtgggccacggggagcgcactaggacggagcggacgtatcggtgtgtggtcatttaatagatttgtcttgtcatttaatccttatatatagttagttttatagttatactataaatacttctaactagcatcaaaacatgagctgtgatgaaactaaaatttagtcccttgaaaccaaacaggctattgaaataatgaaatatacataaaaatgtaaccttcaataaaagcatgttgagaatagctaacatgtccgaactttaatttatggctttgaattttaaatctatccaactatgacttgttcatgacctagaagctttgttattgttattgaactttttgttaagggctcgtttcactacaagaaactaataaatgttcgtgggttaatttaagaacgtgggtaccgttcttaattgagttaagttcatgggtttgttgaagaacgtgggtacccacgttcttagtttaaattcgtgcgccctagctaaaaccgtcgaacttatcatattatgaacgtgggtacccacgttcttataacacaaactagtattttttggtagtgctcaa

SEQ ID NO: 9039 - DNA, 886 bp, Zea mays
ggccggcccgcctgtccgcaaaagagcgaccagaaaagctggccggtcgctggcaacagcacgcattcctactctactccggcactgcacactcacgagctgtggatagctgatactctcccccggcgccaagaaaccacgaaatcgccccccacacacaccttcccttcggtccatcccgatcttaccaagaatccgagatccgcctgcgacagctagcggtcctatcttgatccgatggtgtcaccggcgccgggatgtagggattcgggggaggatggcggcaaggcggagtggctgatctacgcctttgtcgcgcgcggcatcgcggtgctggcggagtacacggaattcaccggcaacttccccgccatcgccgcacagtgcctgcagcgtctacccgccgggtcgtcctccgccagcaccgggcctgacggccgcggcggcgcgccggtacggttcagctatgcatgcgacgggcacacattcaacttcctcctgcaccgaggctacgcctattgtgtagttgcgaaggaatccgttccaaagaatgtctcagtggcatttcttgagaggttaaaggatgacttcatgaagagatatggtggcggtaaagctgatacagctcttgcaaaaagtctaaataaagaatatggaccagttataaagcagcacattcagtatgttcttgatcattcacaggaactagataaaacgttaaaagtgcaggcccaagtttcagaagttaaaaatatcatgttaaacaacatagaaaagactttggaccgcggagaaaagttgagtggactccaagacaagacttctgatctacatagtcaggcccctggtcccctagcatcgggccggttctgggcttcttttcttt

SEQ ID NO: 9040 - DNA, 1595 bp, Zea mays
cattgggtacctcccggccgggatgcaaacctatttatattctgtccttaattcccgtgtttctcgtccgtctccgctcctccgcaaccccttcccctcctccgccgaagcctctcctccggccgccgaaaccctagcctccgccgctgccgtcatggcaagcagcaacgtctcgaccgtttacatctctgtcattgatgacgtcatctccaaggtccgcgaggatttcatcacctacggagtcggtgacgccgtcctaaacgagctccaggctctctgggagatgaaaatgctacactgtggcgcgatctcggggaacatagaccgaaccaaggctgctgccgcgtccgtcggaggcaccaccggcacgacagcgcccgtgcacgacctgaacgtgccgtacgaggccacatctgaggagtacgccaccccgaccgctgacatgttgttcccgccgacaccattgcagaccccaatccagactcctctgccagggacagacacagcgatgtacaacatacccactggcccttccgattatgccccctcaccgatcagcgatgtcaggaatgggatggcaataaatggggcagacccaacagctggtcatccaagtccctacatgccaccaccttccccttggatgaatcagaggccgctgggtgttgatgtgaatgtcgcttatgtggaaggccgtgaagatcctgacaggggcgtgcagcctcagccactgactcaggattttttgatgatgtcttctgggaaacgcaagagggatgagtatcctggtcagctcccttctggttcttttgtaccacaacaagatggaagtgctgatcagatagtagaatttgttgtgtcaaaggaaaatgcgaatcaactttggagttccatcggcaataagcttgaaacaccaaccaagacaatcactccagttattccgcagcgtgatgggattcaagataactacaatgatcaatttttctttccaggagttccaaccgaagattataatacccctggagaatctgcggagtatcgagctcctacacctgctgttggaacaccaaaacaaagaaatgatgctggagatgatgataatgatgatgatgatgatgaacctcctcttaatgaagacgacgacgaggagttagatgaccttgagcaaggggaggatgaacctaacacacaacatcttgtacttgcacaatttgataaagtgtcaaggaccaagaatcgttggaagtgcaccttgaaggatggaatcatgcatttgaatggcagggatgtcctttttaacaaggcgacaggtgagtttgatttttgattttttggatgaagatgagctattttagaagcagctgtatggacatatctttgtcttgacataaggacagggaggtgacagtgttcttggtggggtcctggcagcatgactgcgtcgtgttttctttcctattgaatcttcgttccaccctcttgtttgtcaccgcaactgttatcgctgtaaagaagttactgcttgtgctgtgtagacaatttctgatatgggtctctcaaatccgctgcgtaactatacaaaaaaaaaaaaaaaa

SEQ ID NO: 9041 - DNA, 1780 bp, Zea mays
ttgggaccctcgggccggccggggtggtcacttggtcatcagggaactctcggaggcagggagtcagtggtcggcggtgactacaaatacccccgcccccgggccgccggcggatgcaaacgtatttatattctctccttaattccccatctttctcctccgccttcgcctcctccgcatccctcgccttcctccgcccaagcctctgttctcctccggctgccgaaaccctagccgcctccgccgtcatggcgagcagcaacgtctccaccgtctacatctccgtcatcgatgacgtcatctccaaggtccgcgaggatttcatcacctacggagtcggcgacgccgtcctaaacgagctccaggctctctgggagatgaaaatgctgcactgtggcgcgatctcggggaacatagagcgaaccaaggctgccgcggcttctgccggaggcacctccggcacgacaccgccagtgcacgacctcaacgtgccgtacgaggccacatccgaggagtacgccaccccgaccgctgacatgctgttcccgccgacaccattgcagaccccaatccagactcctttgccagggacagacacagggatgtacaacatacctactggcccttccgattatgccccatcaccgatcagcgatatcaggaacgggatgacgataaatggggcagacccaaaagctggccgtccaagtccttacatgccaccaccttccccttggatgaatcagaggccgctgggtgttgatgtgaatgtcgcttatgtggaaggtcgtgaagatcctgacaggggcgtgcagcctcagccactgactcaggactttttgacgatgtcttctggaaaacgcaagagggatgagtatcctggtcagctcccttctggttcttttgtaccacagcaagatggaagtgctgatcagatagtagaatttgttgtgtcaaaggaaaatgcaaaccaacattggagttccatcatcaacaagcttgaaacaccaaccaagacagtcactcctgttattccgcagtgtgatgggattcaagatgactacaatgatcaatttttctttccaggagttccaactgaagattataatacccctggagaatctgctgagtatcgagctcctacacctgctgttggaacaccaaaaccaagaaatgatgctggagatgataatgatgatgacgatgatgatgaagaacctcctcttaatgaagacgacgacgacgacgatgatttagatgaccttgaggaaggggaggatgaacctaacacacaacatcttgtacttgcacaatttgacaaagtgacgaggaccaagaatcgttggaagtgcactttgaaggatggaatcatgcatttgaatggtagggatgttctatttaacaaggcgacaggcgagtttgatttttgattttttggatgaagatgagctattttagaagcagctgtatggacatatcttgccttagacataaggacggggaggtgacgaagtgttcttggtggggtgctggcagtatgactgcgtcgtgttttcctattgagactttgtttcaccctcttgtttgtcaccgcaattgttatcgctgtaaagaagttaccgcttgtgctgtggacattttctgagatgggtgtctcacatccgcagcgtaactaatgctagttatacatttttgtctctaaaaaaaaaaaaaaaaaaaaataacggcccgcccgcgcccttgatggccgtagtggtgcgtatgcggaattctttctttt

SEQ ID NO: 9042 - DNA, 1725 bp, Zea mays
gtttatttagctagacttttggagttgatattagttttttttaaactaatcgcccattctattcccaagcaacgcagcacaatgagtcaattcgctgtgggccaatgcggctgtgcactgcggcctacgcccagcgaccctgccctcgcgccggccggggattcccaccacggcgcccgcactgccttgccttctcctccccattgtttccatccgcaccggagggcggtccgatacaagcaacggcaacgcctcccctctcctccacctccccacctatattgattctgattcatccacccagcaggcagcagctacagcaagatggtgcacccgatcgcggaggccgacgagcggagccccttcggccgcctgacgccggacgagttctacgcgcgccacggcgtgacccactccgcctcgtccttcgtcaacccgcgggggctccgcatcttcacccagcgctgggtgcccagtggggacgcccccgtcctgggcgccgtcgccgtcgtgcacggcttcaccggagagtctagctggacaatccagctcaccgccgtccacctcgccgccgcgggcttcgccgtcgccgcgctcgaccaccagggccacggcttctccgagggcctccagggccacctccccgacatcaaccccgtgctcgacgactgcgacgccgccttcgcgcccttccgcgccgactacccgccgccgctcccctgcttcctctacggggagtcgctcggcggcgccatcgcgctgctgctccacctgcggaacagggacctgtggcgggacggggccgtgctcaacggcgccatgtgcggggtcagcccgaggttcaagccgccgtggccgctcgagcacctgctcgccgcagccgccgccgtcgtccccacctggcgcgtcgccttcacgcggggcaacatccccgagcgctccttcaaggtggactggaagcgggcgctcgcgctcgcctccccgcgccgcaccacggcgccgcccagggcggccacggcgctcgagctcctccgcgtctgccgcgagctgcagcggcgattcgaggaggtgcagctgccgctcctcgtcgtgcacggcgccgaggacaccgtctgcgacccggcctgcgtcgaggagctctgcaggcgcgccgggagcaaggacaagacgcttcgcatctacccagggatgtggcaccagattgtcggcgagcccgaggagaacgtggagaaggtgttcgacgatatcatagactggctcaaggcacgcgccaccgctacagccgcgggcgcgcaccacggcgagcagtagtttgggcacgcctcctgcgtgcgtgcgtgccatggccaggcttgccttcaaccgcgcgtggtccattcaccatcccagattctatcctaggttccttccagctatattcgagtacggatccagcaataaacttgtgctgtctgctgattacagaatttgtttttgctccaatactacgagatctcgtctgatggtcccgatccgccatctgcaaccgctccagatgcctccatgcctgccgatgatgaatcttgcaactttcattcattaattaacgaatcagatatattatttctgccaacagctgtagctgcatggtacaagtggttgggagttgtcagttgggacttgggagagtaaatcaaaatgtgccgcattcttttataacaaaaataagctgcctttgtttcaaaa

SEQ ID NO: 9043 - DNA, 3071 bp, Zea mays
actcttttgatccccctgcagacaggagaaagattgagggcaatgcatatttcaaagaaaagaagcttgaggaggccatgcagcaatatgaaatggttagtagcatgctatactttggacattattgtagttatcagcatattctgatttcagtcgacctgttctcttctacaggcgattgcatacatgggagatgatttcatgtttcaattatttggaaagtacagagacatggccttggctgtgaaaaatccatgccatctcaatatggctgcatgcctgatcaaactaaagagattcgatgaagctattgcgcagtgtagcattgtatgttactcgaccatgcccataagtacattcagtcttgaacccacgatttacattcatgggtacatttttacagtttacggctttgcatagaccttagcaaaaaactatacaggattgtatgttccaacagtaacatttttacagtttacggctttgcatagaccttagcaaaaaaatatacaggattgtatgttccgacagtaacagcatgataattttttaaatggtgttaaaaaactgtagcaactaagctcatatcaacatgaaagattcaacattacaggtatcgaacagctgatttgcacatttccagcctttctattgcaaaaaggtgttggtctcatgatgtttcatgaagtgaacaatcccatggtcctgatacaaaatcaaacgaaaaaattaccatttgatggattatcctttttgtaaacatattagcttttgcccggtgtagcattgttttgacagaagatgaaagtaatgtcaaagcgctgttcaggcgaggaaaagctaaatctgaacttggccagacagaatcagcgagggaagatttcctcaaagcgaagaagtactccccagaagacaaggagatcattcgggagctccgtttgctcgcggaacaagacaaggcactataccagaagcagaaggagctctacaaaggtctctttgggccaagtcctgaagcgaaaccgaagaaggcaaagtacctcgttgtgttttggcagtgcctggtgtcatttatcctttatctggctgggatgttcaaacggaagaacgagtaggataatttaccagaaaattgtgtagaactggtggcctaattgaccaaccttgtattataaggagtgttgaattttctgtagaactgtcggccggtccggatcaattagttgttatgaactctatacgatgttgttcactattatgccatagtttcatacagtctttcaactggagctcaaagggccttttatgccattgtatattgcagctttcatatttagattatgctagtaataatactgttgctacaactggagctctagatttcactctcctgttggatgctgctgcaatagaaactgcagcggcttgcacaaagcacaggctctcagttcattgctatggcatgttggcatcacaaacatttgagtgcaagcagcaggcggcgtgcctgaacacacgctcctgattccatcatcaaaagacaagtgttccagttcagaaaacgtgcctgaacacacgctcctgattccatcatcaaaagacaagtgttccagttcagaaaatcggaaagaatttgtttatgtaaaatatatttatatattattattagtaagatgtcggagatatttatgtgctacatttattatggaagagtgaaacgaagagtgtcatgtaagttacaataaaaacaaattatattaatgcataaaatcatttcacatccttcacgtcataaatttgagataaactatatctgaactttagaaagtattggaatatcaaatttcaaactaaataaattattttattaagtaaattctaatttctataaaatgaagggatctaaacaccctgttagtgaaaaatcacaagacacgctcctcatgtgtctttccaaattctttagtgaaacagaccctatccctgaacacacgctcctgatgccattgccatcataagaattccattgttctacttgctccgtcttggtcaactttttaaagtttgtttaacgaaatgaattactcctataaaaatatatatatcgggttggaccctgtacctgatggatggccctatacatcaggtcgggctaggccgtacccgtgaaacattaggctgtgtcgtgctcgtacttagcaaaaataacgggcttggtgccgtgttattgggccgagggcttcttgaataacggtcctgctcctgccctcctgagcacacagcagtagaaagctgcgtcccagcccatgtcagctcagcgttgcatgtaaagtagccggcgtgttcgcataattcaaatggaagaggacggcagtgaatttgtaattcaactttgaatcctccagccattcatatcccaactttgaatcttcttctcctatccacttctccttcctccccaaccccaagttagccaccgctaataatctggtatcaggcattcaggctagcggattctggggtacgtcaactgcaaatgtctttgcgatcttccatgaactccaaacgacagcaggttactctagatgaatgtaagacccaaaattagtaggaaaaaaaataatataaacaaagtatcataatgctttggaaattaggaaaataagaaaatgatgagaaaaggatttttttcttttaaaggaaaccatttatacatcccatgaaataaataacaaggagaataaagcttaaattagtaatattaaagtagtatggtttatattcacctttgggtttcaattgatacatttgaaaaatctgaaaactaaaatagaagtataaatttgaatttggaataggaaatagaaaataaatgggaaggaaagagaagtaatatgaaaatatgaataatatattcgaataaatattctcaaaccaaatacttttaattgcaccaaaatgaaccagttacaagtttgaattgaattggtattttagatttgaatttgtgaaagaatggagaaatgaagaaaatagaagggaaaaaaaaaaaaaaaaaaaaaaaaaaaaaa

SEQ ID NO: 9044 - DNA, 1579 bp, Zea mays
attaacctccggcccacaaactaccgcagcttatcaagcaagcgctacggagcgcaggtcaccgagctctggcccgcccaagttcactacccgacccgccgcgccgcagtctagaagcttctgccggccgtctgcggcccgcccatccgcaacccatggctgtcgtcgaagaagacgctgcggcgtctgcagatcccgccgccgcgtccgatcccgccgctggctccagcgaaaacgagatcacagtagaagaggcttctttcgtgcattctgaacctccccaggatggcagcgccccacccgtggtttcctctgacatggaggcccttcacgacaaggttaagaagcaaatcatcaaagaaggccatggcaggaaaccgctgaagttcgcgacgtgctttgtgcactatagagcatgggttcaaggatcatcgcataaatttgaggatacctggcaagagcaacatccaattgaactagtacttggaaaagagaaaaaacaaatgtctggtttaggcatcggtgttggcagcatgaaaagcggggagcgtgcattgttgcatgttggttgggagctaggctatggcaaagaaggaagtttttcattcccaaatgtccctccaatggcagaccttgtttatgaagttgaactcattggatttgatgatgttaaagagggtaaatcccgaagtgacatgacagttgaagagaggattgcagctgcagacaggagaaagattgagggcaatgcatatttcaaagaaaagaagcttgaggaggccatgcagcaatatgaaatggcgattgcatacatgggagatgatttcatgtttcaattatttggaaagtacagagacatggccttggctgtgaaaaatccatgccatctcaatatggctgcatgcctgatcaaactaaagagattcgatgaagctattgcgcagtgtagcattgttttgacagaagatgaaagtaatgtcaaagcgctgttcaggcgaggaaaagctaaatctgaacttggccagacagaatcagcgagggaagatttcctcaaagcgaagaagtactccccagaagacaaggagatcattcgggagctccgtttgctcgcggaacaagacaaggcactataccagaagcagaaggagctctacaaaggtctctttgggccaagtcctgaagcgaaaccgaagaaggcaaagtacctcgttgtgttttggcagtgcctggtgtcatttatcctttatctggctgggatgttcaaacggaagaacgagtaggataatttaccagaaaattgtgtagaactggtggcctaattgaccaaccttgtattataaggagtgttgaattttctgtagaactgtcggccggtccggatcaattagttgttatgaactctatacgatgttgttcactattatgccatagtttcatacagtctttcaactggagctcaaagggccttttatgccattgtatattgcagctgccgcctttagattatgctagtaataatactgttgctacaaaaaaaaaaaaaaaaaaaaaaaagaaaaaaaaaaaaaaaaaagcggcc

SEQ ID NO: 9045 - DNA, 1496 bp, Zea mays
accactatccattttcattcaatgcgtccgcgccgcgcgcctccattcctctcgattcccttcctccttccttgttcgaggacctccgtgaccgtggccgagggattgaggacggaaagcgaaaatgatgctgacgcgggcgtcgatgggggtgatggatgcggcggcggtggacgaggtggtgcgtcgcctcgtcgagggcggccgcgggggccggcaggtgcagatgtccgaggccgagatccgccagctctgcgtcgaggccaaacaggtgctgctgtcgcagcccaacctcctccgcatccacgcgcccgtcaagatctgcggtgatatccatggacaatttgttgatctcttgaggctctttgatttgggtggttatcctccaacttcaacttatattttccttggagactatgtggatagaggcaaacaaagcttagaaaccatatgtctgcttctggcatacaagttgaagtaccctgataatatataccttttaaggggaaaccatgaagatgcaaaaattaacagagtttatggtttctatgatgaatgtaaaaggagattcaatgttcgactatggaagatattctgtgattgcttcaactgcttgcctatggcagcacttattgatgacaaaatattatgcatgcatggtggcctctcacctgaattgactagcttggatcaaataaaagatattgagaggcctaccgaaattccagactatggtcttctgtgcgatctcctttggtctgatcccagtcatgatacagaaggttggggggagagtgatagaggtgtttcttgcacttttggcgcagataagcttgttgaatttttggagaagaatgatcttgaccttgtgtgcagagctcatcaggtggtagaagatggctacgagttctttgcagagagaagactagtgaccatcttttcagctccaaactactgtggcgaatttgataatgcaggtgctctattgagcatagatgaaagcttgatgtgttcttttcagatcttgaaaccaaatgaaacaggtgcaccacattcaaggaaacctcttccaagcaaggcaccaaaaggagagaacgtctaatttgtatccagtgacctaatcacaatcgatgtcagctcgaagggggcgatctcgttgtctcggatccaccagggcatggcattagcgttctacacttgctgaatttgtgtggactcaatcggcagcgcttacattcttctgtacagcagcagtgtttctaacttggcatatcgtccgttctgatagtgacattgccacagctgcaatattttagtcgggtggacaaggcattttgttgggtacagtagctgttgttttgttagcctttttttggtaatgtttgtttggttgattgaacgctgtgagttttgtttgccgcgtatcttcgtcaggctcgggtatttacatcctgcaactgtgtaaatgattttgtctaacgaatgtctgttgacat

SEQ ID NO: 9046 - DNA, 967 bp, Zea mays
ataattataacagggatacaatgaaacatagaatgcaaaaacaaacacaaaaaaccgtactggcagggcagaacgagcgtgaaggccggtggtggtgggaggacgccaaggccaaggagtgcggcctccacaagggcaacatcgacaaggacgcccaggcggcggcccccaggtccgccaacggcaacggctcggcgcccgccccggacatcttcgagagccccgccgtcgtgtccctcacccgcaccgggatccagaacctgctgcgcctggagaaccgcgccgagccgtggctcgtggtgctgtacgcgccctggtgcccgttctgccaggccatggaggcctcctacgtggagctggccgagaagctggcggggtccggggtgaaggtggccaagttccgcgcggacggcgagcagaagccgttcgcgcaggccgagctgcagctgcagagctttcccaccgtgctcctgttcccgggccgcaccgccaggcccatcaagtacccgtcggagaagagggacgtcgactcgctcctcgccttcgtcaacagcctccggtgagagacgaagacgacctccagtgagcgagaaccatcgttctctgtcagtctgtatgatcttatgttggtctttatgagtttatctaggttcgtagagaaggaggtggaggggactgggtttggtagagacacaggaagggaagagggttcaggggaaaaaaaatcaggtgtagcttttgtaactgcaaaatgattgcagcaggtatacctgaagtctgagcttctgaggccctgtgcttggtagccgagggagagattacttgttgtgtgtgcttatagtcagtggcgagtggctactgtaaggttcacccatatggttatctaaagcactgccgtagattgtattatttatatagtagagttttaatatagacataagaatgtgtaagccgacagagatagcct

SEQ ID NO: 9047 - DNA, 5075 bp, Zea mays
  misc_feature (999)..(999): n is a, c, g, or t
aggcagcatcgaagcgctgatcaagttgctctagcggtcaaggattatggtagtaactgaaggctagttagttggctgtttttggcccagtggtttttcttttggcttcggctgtttttcttttctatttgccttctgttcttttttgttgtttttcgcctcctttcccttaagatccttggtgtttgtatttatctttcccttctaatatagatcggagcggcaatccttttgcccctccctttcaaaaaaaaaaaacaaattagcttaggtactttttgtttaccctctaaattatataatcgtttaaataagttaagagacaaacaaactacaaagattattagatggattatataatatagatttctacattataataatctataaacagttcattgacattagacatttatataatctttaatgtacccttgccgtattggttgtccaagagcacttacaattgataggccaccgatactggttttgagtctaatagaccccaaatacgtattttgatgatagcgtagaaattttgcctggcccaagcagtccaccatcagtttattctctttgttttaatctatatcaggttttttactgattctacaatatttttgtctctgtaaatttcagatatagcagttcaagcagccggctttaatcaccagttgtgtcagatacgtggcgctaagagcgttgcccctctttgactttggcagttcggtctgatccaaagtaccccatgtcctcctctacggctgcggatggatggatcttcgcaagggggcaaacgagcgtgaggtagccacacaactagccaattcatcgccacgacaggcgtccactcggcacagccgggcctcttctatgacgccactgcttcgatcggccaggaagcctcccgtgcgctctaccaattggaaaccgccacgtgtcccatgaggctgcccgctgccgctgccggaaacccgtccgggtgcgatgaacctggcntcccgcccgacctatatgtaaaccacccgcccgcttccaccccacgccacagaaaaaacgcaggtgtcgaaacacattttcttgctccagagaatttaaaccgctgcgaattcaattcgaaagccccaagagagcatccatggcttccgctaccacctccatctcgtcgcaccccgccgccctccgcgacgtcaaaggtgacatgttttctttgttctggatgctctttcctttgtataatttttgctcggatccgacgtttcagctagtgaaatgcgctgctccgcaacaaaattcaccggaattcgaagcgcataccggcctaactcttctcatctctctcccttctgttcgcgcagctgcgaggattggcgggctgaggcagcagcaggcgagcgtggccccgtcggcggcggcagcgcgtggccagcgcgctcgggcggtgcgatcgctgcgcgcggcggagcctgcgaggcagccggtggcggcttccgcggccgcggcggcgccggccgcgcccgtggccgacgaggcggcggcccttgcggccgtggactacgaggccctggcgcgtgagctggagggcgcgtcgccgctggagatcatggatcgggcgctggccatgttcggctccgaaatcgccatcgccttcaggtgcgtgacgtcctctctcgtgccactcctgaaccgtgacgggttcggttcgggtactcgttaccgcgtgcccgttagcctccgttgccgttggtcctcgtggaatgggtttaggcgcggcgacctgcatccggtatgctcgcggcgtcgtggtatcttccgaacgtgtggccgtacacattccaagtggactcgcgtatttcgctggccactgaactgtgtgtcccacctgtctgcctctgaaacagcaagagactactactagtagtcagttgtttatggtcctgaggtgctgaaatccaatcaggtttagcgaagcccactttgctgcacatgcttatgtacttggaccagtgagccaagcttgaggtgtctaggttcattgaacttgggtgatatttggttcatatatttgtaatgtaatcggtaacaaataacgttaaatcatgtttgtttaagtacaatcgtaatccgataccacactagaaattgatatcagcctattcaaacttgttaccactggtaatcgaatgcaaaccgttaccgttaccatttaccctggtgttcaaggttgtgttgtcgaccagacaccagagctagaatcatggcccaccacccacgcgcaaccgaacaaccttgtttgaatatcggacgaaaccagaaaagtcacggcgtcctaattcctaaaccgatagtggagctgtgttgggctgttctagggcagctccaagggtagacgacaaagtaaagtaggcaggcggaactcatcgtggtggtatcatccactttgttacgtaataactgtacgagaagttaaatattttaaattttaatcaaatacaaatataaattaataattgtgatagtatcattaatagattgttatatgtagttttattttatagttaaattatttagagatatagatattatagtaatttttataaatttattcaagcttaataaagtttgatcctcggaatacgggcaaacctagcttaactgacgacaccgatccctctcgtgtcgtgtggtgtggttcagcggcgcggaggacgtggcgctgatcgagtacgccaagctgacggggcgtccgttccgggtgttcagcctggacacggggcgtctgaacccggagacgtaccagctattcgacaaggtggagaagcactacggcatccgcatcgagtacatgttcccggacgcgagcgaggtgcaggagctggtgcgcaccaagggcctcttctccttctacgaggacggccaccaggagtgctgccgggtgcgcaaggtgcggcccctgcgcagggcgctcaaggggctcagggcgtggatcaccggccagaggaaggaccagtcccccggcaccagggccagcatcccccttgtccaggttgatccttccttcgaaggcctggatggcggggctggtagcttggtcaagtggaaccccgtggccaacgtcgacggcaaggacatctggactttcctgcggaccatggacgtacctgtcaacaccctgcatgctcaggtaacttcaattcttcgcctactagtttttttttttgcacagctttgttcagttatccaaatgtgcaagcgattgacgacagtctctcattctcacagggctacgtgtccatcgggtgcgagccgtgcaccaggcccgtcctgccggggcagcacgagcgtgaaggccggtggtggtgggaggacgccaaggccaaggagtgcggcctccacaagggcaacatcgacaaggacgcccaggcggcggcccccaggtccgccaacggcaacggctcggcgggcgccccggacatcttcgagagccccgccgtggtgtccctcacccgcaccgggatcgagaacctgctgcgcctggagaaccgcgccgagccgtggctcgtggtgctgtacgcgccctggtgcccgttctgccaggccatggaggcctcctacgtggagctggccgagaagctggcggggtccggggtgaaggtggccaagttccgcgcggacggcgagcagaagccgttcgcgcaggccgagctgcagctgcagagctttcccaccgtgctcctgttcccgggccgcaccgccaggcccatcaagtacccgtcggagaagagggacgtcgactcgctcctcgccttcgtcaacagcctccggtgagagacgacctccagtgagcgagaaccatcgttctctgtcagtctgtatgatcttatgttggtctttatgagtttatctaggttcgtagagaagggaggtggaggggactgggtttggtagtgacacaggaaggaacgagggttcaggggggaaaaatcaggtgtagcttttgtaactgcaaaatgattgcagcatgtatacctgaagtctgagcttctgaggccctgtgcttggtagctgagggagaggttacttgtgtgtgcttatagtcagtggcgagtgcctactataaggttcaccggtcatctaaagcactgttgtaaactgtattatttggagagtggagttttaatataggcataagaatgggtaagtcgctggagatagtctaagaaaaatcaaataagagaccaagatttgagagttttcgtttgtttataggttggttgtcaactatatagactgtagaaatcggagggtttgcatattgttagaccccgtttatttagtgctaaagtttagcttaacatttttcactaaagtttaccacatatagaactaaacatgtatattaaaaagacagtgctaaagtttagcgtccattagtacattagaccgtctccaactagagatggcaatgagatccgatccccgatttaccatggagaattcctctataaaacctagtttgggtactctagtattgagctcaatccacctatattgaggttgattgaggtgtaacttaaactaatttacaccccaatctctctctacacacatggattggaatcaatactaaagtattcaaacaaggggttaggggatgggtatgggacaaattagtccccgcggggatcaagaaacggggaaaatttaatccccatccggttcggggggacagggatccatcccgtgtacccgctcgtgaacttgtgttgatctaaattagtctattgactgattacaattatactaaaaactcaatacataacctattataaaatagcaaactaaactctaatgtagatgtctcttataattttagtttttttgtttaatttatattgatttgatataatcaatttaaatttacctttaaatattgcacttcctagcagggacagattcctcgcatagataaattccctgacggggacggagatgggaggaaaagctcctccatgagcgttcgcggcgacggggactggagaatttttatcgtcgcggggacaggtatgggactc

SEQ ID NO: 9048 - DNA, 2208 bp, Zea mays
acagaaaaaacgcaggtgtcgaaacacattttcttgctccagagaatttaaaccgctgcgaattcaattcgaaagccccaagagagcatccatggcttccgctaccacctccatctcgtcgcaccccgccgccctccgcgacgtcaaagctgcgaggattggcgggctgaggcagcagcaggcgagcgtggccccgtcggcggcggcagcgcgtggccagcgcgctcgggcggtgcgatcgctgcgcgcggcggagcctgcgaggcagccggtggcggcttccgcggccgcggcggcgccggccgcgcccgtggccgacgaggcggcggcccttgcggccgtggactacgaggccctggcgcgtgagctggagggcgcgtcgccgctggagatcatggatcgggcgctggccatgttcggctccgaaatcgccatcgccttcagcggcgcggaggacgtggcgctgatcgagtacgccaagctgacggggcgtccgttccgggtgttcagcctggacacggggcgtctgaacccggagacgtaccagctattcgacaaggtggagaagcactacggcatccgcatcgagtacatgttcccggacgcgagcgaggtgcaggagctggtgcgcaccaagggcctcttctccttctacgaggacggccaccaggagtgctgccgggtgcgcaaggtgcggcccctgcgcagggcgctcaaggggctcagggcgtggatcaccggccagaggaaggaccagtcccccggcaccagggccagcatcccccttgtccaggttgatccttccttcgaaggcctggatggcggggctggtagcttggtcaagtggaaccccgtggccaacgtcgacggcaaggacatctggactttcctgcggaccatggacgtacctgtcaacaccctgcatgctcagggctacgtgtccatcgggtgcgagccgtgcaccaggcccgtcctgccggggcagcacgagcgtgaaggccggtggtggtgggaggacgccaaggccaaggagtgcggcctccacaagggcaacatcgacaaggacgcccaggcggcggcccccaggtccgccaacggcaacggctcggcgggcgccccggacatcttcgagagccccgccgtggtgtccctcacccgcaccgggatcgagaacctgctgcgcctggagaaccgcgccgagccgtggctcgtggtgctgtacgcgccctggtgcccgttctgccaggccatggaggcctcctacgtggagctggccgagaagctggcggggtccggggtgaaggtggccaagttccgcgcggacggcgagcagaagccgttcgcgcaggccgagctgcagctgcagagctttcccaccgtgctcctgttccccgggccgcaccgccaggcccatcaagtacccgtcggagaagagggacgtcgactcgctcctcgccttcgtcaacagcctccggtgagagacgacctccagtgagcgagaaccatcgttctctgtcagtctgtatgatcttatgttggtctttatgagtttatctaggttcgtagagaagggaggtggaggggactgggtttggtagtgacacaggaaggaacgagggttcaggggggaaaaatcaggtgtagcttttgtaactgcaaaatgattgcagcatgtatacctgaagtctgagcttctgaggccctgtgcttggtagctgagggagaggttacttgtgtgtgcttatagtcagtggcgagtgcctactataaggttcaccggtcatctaaagcactgttgtaaactgtattatttggagagtggagttttaatataggcataagaatgggtaagtcgctggagatagtctaagaaaaatcaaataagagaccaagatttgagaaaaaaaaaaaaaaaaaaaaaaaaaaaaaaaaaaaaaaaaaaaaaaaaaaaaaaaaaaaaaaaaaacttaaaaaaaaaataaaaagggggccctcggcccccaggttttattccttttaataggggtaaactgcgcgctgggcttatccagggacaaagccgccccctgacgaaaacggtaaccccctcacaatcccccacaacgtccaagccgaaagctaaaagacaaaagccggggggccctaacgggccgcttaacacacatgaaacctgtcgcgccagctgcccgattgcaaccgggaaaaccc

SEQ ID NO: 9049 - DNA, 1768 bp, Zea mays
aacgccacaggaaggggaaaaaaaacgcaggtgcccaaaacacgttcgccccagagaattgaaaacttaccactgcgaattcaattcgaaagcctcagacccagagagcttcccatggcatccgctaccacctccatctcgtcgcaccctgccgccctccgcgacgtcaaagctgcgaggattggtggcgcgctgaggcaggtgggcgtggcggcgcgtggccagcgcgctcgggcggtgcccccgctgcgcgcggcggagcctgcgaggcggccggtggcggcctccgcggccgcggctgccgccggccgcgcccgtggccgacgaggcggcggtggactacgaggccctggcgcgcgagcttgagggcgcgtcgccgctggagatcatggatcgggcgctggccatgttcggctccgaaatcgccatcgccttcagcggcgcggaggacgtggcgctgatcgagtacgcgaagctgacggggcgtcccttccgggtgttcagcctggacacggggcggctcaacccggagacgtaccagctcttcgacagggtggagaagcactacggcatccgcatcgagtacatgttcccggacgcgagcgaggtgcaggagctggtgcggaccaagggcctcttctccttctacgaggacggccaccaggagtgctgccgcgtgcgcaaggtgcggcccctgcgcagggcgctcagggggctcagggcgtggatcaccggccagaggaaggaccagtcccccggcaccagggccagcatccccctggtccaggtcgacccttccttcgaaggcctggacggcggggctggtagcttggtcaagtggaaccccgtggccaacgtcgacggcaaggacatctggactttcctccggaccatggacgtccctgtcaacgccctgcacgcccagggctacgtgtccatcgggtgcgagccgtgcaccaggcctgtcctgccggggcagcacgagcgggaaggccggtggtggtgggaggacgccaaggccaaggagtgcggcctccacaagggcaacatcgacaaggacggccaggcggcggcggcggcggcccccaggtctgccaacggcaacggctcggcgggcgccccggacatcttcgagagccccgccgtcgtgtccctcacgcgcgccggggtcgagaacctgctgcgcctggagagccgcgccgagccgtggctcgtggtgctgtacgcgccctggtgcccgttctgccaggccatggaggcctcctacgtggagctggccgagaggctggcggggtccggcggcgtgaaggtggcccggttccgcgccgacggcgagcagaagccgttcgcgcaggccgagctgcagctgcagagcttccccaccgtgctcctgttccccagccgcaccgcccggcccatcaagtacccgtccgagaagagggacgtcgactcgctcctcgccttcgtcaacagcctccggtgaggcccgccagtgagcgagaaccatcgttctctgtcagtatgtactgtattacatgttggtatccatctaggtgcgctgtacgtagagagggaggcggagggaactgggatgctagaaaaaacagatgcaggtgttgcttgtaactgcagaatgatggtaggtatgcatgaagtctgaggtcctgtgttatttggcagctgagggagagatttgtgcgtgcttgtagttgtagctagtggcgatggagtattctaaggaaaatcaaataagaatcgaagttttgag

SEQ ID NO: 9050 - DNA, 6429 bp, Zea mays
  misc_feature (2456)..(2456): n is a, c, g, or t
cggacacacagaagagtcgttcgcgcgcagccgggtctccggaggtggccgttagcggtgggcgcctcgaggccgccggggctgcatgactagacgtacacgtcatatccacttctccttctcgccatcgtcatccaagctagcgcctacatttcctgcacggtcgcttggaccgttcgttcaatgtcgctgtggctccccgatcccaaccgaagattgtgcgtctgtgtgctcgtgcttacaactgttccagagggctgaccggcccagtagcgtccatactgcaatgttgtctttgcaaggtgtaaaagctaaactcaaggacgatgccgacaaacaaaaaaaaaggaccgtcttccgctcgtgacgccacacgacaccacccccctcctcgtcctcctcctgttcctgtccttgtccgccggcccacccactgggccactacggcgagggagctagcgcccgagtcccagccgcaacgttcggccacgagcacgatgcagcagcagccgcgaaccccgagtgcgagtgggaattggcggaagcaacggggaataattcccgcaccgcaaccgcgaacctctctcttttcttcttcttctcctcctcctcacagcatcggaagcacgcaatcacgcgtgccaagaactgagcccccgagcagatccgcgtccgcgcgcgccagggcctggtttttctagtcccgtcccttcccccaaccccaaccaggtctccgccgccgctgcggtccatcggttcggtctcccgacttcactttcacatggcctgccgtgccgcgtctctcccacgccactctcgccggtcaccagatcgtcgctcgcttccgttattaacccgttttgtagctgattccggggctcctgctgcccgcggtccacccttcggtcagctaataacgcctccgcctcttcccttccctcccttcccccttgggcttgggccctgcccattaaactcgagcagggcactgtttctacaacgtttgccgttctcgaccgaccattgatggccacgaagagttaagccctgctctgggaagggcactgtttctttagcttccatgcgtagtaggcacgcggcgcacgcaggcaggcaggcgggcatggaaaagggaactgtagcgcccacgcgttaccgaccgagagagagagagtcgagcgagtcctccacgtccgcctccgccccccaaaccaaaggcatacaagccgtcgtgtgttaatggaaacggacaagtgtgaggaggaggagcaaagccagcagccttttttcccttgacgcctcgcctcgcctcgccttgctgccccctcctcccgttctcgaacaggtcaagccgcgcctcctctcgcctgcctgcgtccttgctcttcctcctcctccctttgcccgtcgtccgctccgcttcgttgtctcatccgctgccgttctagcaagcggggcagcgtcgcgcctcggcctgatgctccaccacgctccagtccacagcctccccggtccttctcgttcccgttctcggcgagagcggcggcttgcccggcccccgggtcctcttcacctcacctaaccttgtttctagtttcggtccgtcggttggtgcctcgtcggctgcctctcgctgcttggcccgtttcttcctggggtcgcgggcctggagtacacaagtatataatcttcccggccgtcgtcttctcttcctcgacctgcctctcttcccattggcccggttcccgttcctcgctcccctgctgctccttccgcggcagactgcctgggatcgaagcacacgataggagagacctcctctgtcgtctgtgcctgggtgagaggtcgggtggtggtggcagtgcttggatgcttcacgcgaggccttggatggtggatgctgcgtgctgctggtctctgcgctgcgcctgaggtgaggaatccggtgcttccctccacttctcttctcctgccttttttttctgggccaaagtgatcatgtagtatctttcgcttggagattcttttcagcttaaattactgttggtgtagattaagcgtgtctggttcctggttttaattacttcttgccttgacagaggaaaaggaaagatggatgcaacttcctttcctgtttctctctctctctctctctaacccatacatagctttcctttgctgccgtgttaaaggcagcatagcaacaaagcgatttcccgttgcacccggccgttctttcccgttgcacccggccgttctttacgccggtgatgaagaacgcatttaaggtcatccttttcggctgggctttactaccgctcttttgcagcgtgggcgcggctgcgacttttgtttttaatggcacttttcttttactacagtaattaatcatgtggttcaagagtcctcttcatctctttcatctttgctcctgtacttattactgcttctgtacntgcactctgttcacctctctcgctacggagcaaagatgcatcagccgtccttcctagttcagaacctgttttgcgagtaccggcgcccacgttcttgctggccactgtccgtttgtttgacaggagacggcggtgaaacagtaatactagctgtttatcagcctttcagcttaagcaaaccaagcacgtacagtcagtacgacggtactgccctgtccctccttgtgtcgttaagacaaggaacgcctttagatgtgctgttgatggatacagtgtacgccatggatcatcatactaccaagcaagttttagggtgtggtgtaactgcatgccatttatatggtgcccctggtacttgagaggaattaatgtgctgggggggggggtgctgaggacggaggttagctgtgcctgctcccatttggagggacgaagttttatcctgtggttactgcttgtcgatgtcaagcaatttttatgtgagcacttctgcgccactcatgcgtatacctactacctccactactccagttttaatgttttatttttgagcagaggatgatccatagaaaaaaatggagtttaatttgaaacatcacatgggtacttgtacttctctatgagctgttaatcacttgcaatatttttatttctaatttgattgatcagccatgaaatcacgccacatgttcctcagttgattgtatgagcatgttacatgttccttgcttgcatgtatgatctccgtggcaaattctgaaaaatatagagagaacatgtctctctatattttcagctctttctgatgtggtctgtcagtgtcaccagagacagccaaccgggatttcttcagttttaaagtacagtatatggtagccggccacatttggctctctttgggtctgatctgttatatgttattgctgtgctgcgcaggtactctagagattagtttggccgcatcctccgtatctttaccttgttgaccagggatggagcttgtatacatggaaaggagaaacggatcgtacgacgatggcgcggttccagagttcagtggaaggggggctggaggggatcaggatcaggacccgtccgctgctgcatccgaggtccagtctgactcgcgtcagacaccggacgagaagaagagcaagggctgccaatcatgccgtgacccattctgttcatgcagcggcggcacaccccactcggaactgttccccccacatcctgccaagatgatgatcctggagttcctcgtcgcgagcctcaggcacccgacaagaacccacaacgtcagtgatctcgacgacctgatcgccgacggggtcagccaagggagcgtggtaaacctcggcccttctgagaagaaggtgctggaatctctgcacgccatggtaaacgccaagacgaggccgaagagcccgtcgccgttcatggcgggatctaagctgaggaaaatccggtccaagtcccacgtcataacgcagtcggaaatactgaagctcatctctcctgagacgtgggaagcctcctccttccctggggcgtctccgatgatcggcggaggcacggctgaggacggcgtccatgggaacaagccgccgccgccgtgctgctcgtctgtgagctcaaaccagcatgttctgtcacggtgcccgtcgtctctcagcgcatgccttctacagtgcatatggaaggatggcctgcctcattttgagctgtcactggacgatcatcccattgcggtgtacgctgcaagtccagtcagggtgctggagaaggacagggccttcgactacgtctacatgatccattcgggagagcaaggaagaaaagactggatgggccactcgagcaacgtttccagacttgtgggcaaggtgaaggtgtcaagttctcttgttcttaacccagacaagtcaggtcttttggaaaccgagtttgttctgtatggttctccggacgactatcttaggcagatgcgcagtccctacagcgtgccgaaagggaagggccttgtcaggagggtgacagagatcatgagagcaggcaatgtttccgctagcccgagacatccctggaagctgggcaaatcttcctctcatcagttcgacgacttggctggagtacttgaaggtgaaatgatcagtgctggaggatcagacctggtgagtctcaaggccgacgatctgccgtccaaccaagaattagcagcgattgtggtgagggaacagcggcgcagacgacggaaagagcctgtttcgggtggctggggcctcaagttccttgagaaagcaggactgaatcgcccacaaggcactgaagaaactgatgttcagaacagtgatggtgccacacattgtgtaactgttgttgtccccagaggctaccacggcggcgtggtatcaaagagtagtcgcccgtcaggcctcgtcgagagatggagatctggaggacgctgtgactgcggcggatgggatcttggctgccccatcagagtgctcaacggtgatggatgtggctccttgcctgaaggagagtcacgggacagaaggtcggtagagatatcgatcaaggtaactaacatcgagcttgtttgcagtaaacttttatggttttctttcatacatcgtaattgctgctaagccatttgtggtttttgtttatgagtaattcagggctggtctgatctttacaccagtactttgcagggtgcaaagaatgagacaatgttgaagctcgtgaatatcacggaggacttgtacatcctctacttcgactcgagtatttcaccattgcagtgcttctcaacagggatagcgattgtgcacagccgagcgccagagctttgccccaaactgtgaattgcgcacagccaggcacgcacccgagctttgccccccaaactgtgaattgcaaagcttggtgtagctgaattacaaagattcgtgaagcactatgtacatgtagatagtagaatgggaataattcttgttatttttaacttatataattttgagagagaaaagcaggcagctgttttcagactgcttttaaatcatcaatctgttggtttggccgattgagcgaaagctaagaaacatgaattacaaatcatgtttcgttaacaattacgattttttgaatcccttgacaaatatatagatctcttatattgactagatgattgggctactgtcgatctaccaaaaatcataaaaatttctttaaaaagttatagatataattttaatatataattctttatatctcctaaaatagaataaattaaaacgtaaaaattcaatatattaataaagtgcgtatataaaaatgattgtgcaaaggtttttaccatttagtaatttcaacagtggaaatatttatagattacataataaatattgaatgtgttgataacattttctataaaatgtagtcatttaaatttaataaagaatgacataccaattttatgccagagtaaagatacatacctgaaaaggaacgtttcccacaaatcaggggtttgaaccatgtcagcagcgatttgagagcgagcatccacgtaatagctaggtaattttttgaatctttattttaaatacaattacatctttggcaaagctaacgacgaaataagtaaaaaaaaatacatgaccatacagatgagaggaaggatgatgaccgcaaaacaattcggcggcaagggaaacaattcacgatgaaataaaagcaataaacaataccaaatccggttggaaaagaaacaactcacacgatagcaggatgtgaccaataccaacaaatttgcagacgtgaaaagaatacgtggtatacgaacagtagagtgcacatgagcaaacaaagttcacggaaaattctatataataaaagtaggattaaaatttctgataagtttaaattaaaaaacggctaaaatattttttattattacatctaaaat

SEQ ID NO: 9051 - DNA, 2660 bp, Zea mays
gttgacgcctcgcctcgcctcgccttgctgccccctcctcccgttctcgaacaggtcaagccgcgcctcctctcgcctgcctgcgtccttgctcttcctcctcctccctttgcccgtcgtccgctccgcttcgttgtctcatccgctgccgttctagcaagcggggcagcgtcgcgcctcggcctgatgctccaccacgctccagtccacagcctccccggtccttctcgttcccgttgagagcggcggcttgcccggcccccgggtcctcttcacctcacctaaccttgtttctagtttcggtccgtcggttggtgcctcgtcggctgcctctcgctgcttctgcttggcccggttcttcctggggtcgcgggcctcgagtacacaagtatataatcttcccggccgtcgtcttctctttctcgacctgcctctcttcgcattggcccgttcccgttcctcgctccctgctgctccttccgagacggactgcctgggatcgaagcacacgataggagagacctcctctgtcgtctgtgcctgggtgagaggtcgggtggtggtggcagtgcttggatgcttcacgcgaggccttggatggtggatgctgcgtgctgctggtctctgcgctgcgcctgaggtactctagagattagtttggccgcatcctccgtatcttctacttcttgaccagggatggagcttgtatacatggaaaggagaaacggatcgtacgacgatggcgcggttccagagttcagtggaaggggggctggaggggatcaggatcaggacccgcccgctgctgcatccgaggtccagtctgactcgcgtcagacaccggacgagaagaagagcaagggctgccaatcatgccgtgacccattctgttcatgcagcggcggcacgccccactcggaactgttccccccacatcccgccaagatgatgatcctggagttcctcatcgcgagcctcaggcacccgacaagaacccacaacgtcagtgatctcgacgacctgatcgccgacggggtcagccaagggagcgtggtaaacctcggcccttctgagaagaaggtgctggaatctctgcacgccatggtaaacgccaagacgaggccgaagagcccgtcgccgttcatggcgggatctaagctgaggaaaatccggtccaagtcccacgtcataacgcagtcggaaatactgaagctcatctctcctgagacgtgggaagcctcctccttccctggggcgtctccgatgatcggcggaggcacggctgaggacggcgtccatgggaacaagccgccgccgccgtgtgctgctcgtctgtgagctcaaaccagcatgttctgtcacggtgcccgtcgtccctcagcgcatgccttctacagtgcatatggaaggatggcctgcctcattttgagctgtcactggacgatcatcccattgcggtgtacgctgcaagtccagtcagggtgctggagaaggacagggccttcgactacgtctacatgatccattcgggagagcaaggaagaaaagactggatgggccactcgagcaacgtgtccagacttgtgggcaaggtgaaggtgtcaagttctcttgttcttaacccagacaagtcaggtcttttggaaaccgagtttgttctgtatggttctccggacgactatcttaggcagatgcgcagtccctacagcgtgccgaaagggaagggccttgtcaggagggtgacagagatcatgagagcaggcaatgtttccgctagcccgagacatccctggaagctgggcaaatcttcctctcatcagttcgacgacttggctggagtacttgaaggtgaaatgatcagtgctggaggatcagacctggtgagtctcaaggccgacgatctgccgtccaaccaagaattagcagcgattgtggtgagggaacagcggcgcagacgacggaaagagcctgtttcgggtggctggggcctcaagttccttgagaaagcaggactgaatcgcccacaaggcactgaagaaactgatgttcagaacagtgatggtgccacacattgtgtaactgttgttgtccccagaggctaccacggcggcgtggtatcaaagagtagtcgcccgtcaggcctcgtcgagagatggagatctggaggacgctgtgactgcggcggatgggatcttggctgccccatcagagtgctcaacggtgatggctgtggctccttgcctgaaggagagtcacgggacagaagatcggttgagatatcgatcaagggtgcaaagaatgagacgatgttgaagctcgtgaatatcacggaggacctgtacatcctctacttcgactcgagtatttcaccattgcagtgcttctcaacagggatagcgattgtgcacagccgagcgccagagctttgccccaaactgtgaattgcgcacagccaggcacgcacccgagctttgccccccaaactgtgaattgcaaagcttggtgtagctgaattacaaagattcgtgaagcactatgtacatgtagatagtagaatgggaataattcttgttatttttaacttatataattttgagagagaaaagcaggcagctgttttcagactgcttttaaatcgtcaatctgttggtttggccgat

SEQ ID NO: 9052 - DNA, 3721 bp, Zea mays
gtgcacaccagtattctctagaaaaaaatagttgggctcagctgtcctcgatcgggtcaaattcaacgtacgtacgcacgcactagctcatgaatcatgatcacggtcccccttatatatggaaccagtttcaagatccaaagagttagaaccaattccaaagctctctggtccccctgcgtacgtctcatcgtctaatgtgtcctcgactcggttttgcactttttgccttttttttttcttctttcaaatgcgcccaatcagacgatcctacactgcaccatatataatatccttttaaatttgatcatgttctaagaatggaattagctagcagccatagcatatgtttttaatctggagattgtgggggcatgggtgtgtttatgcatgcatgtatggttaattcgtagaaggccaaaacaaaacatatatattctagtaccatttggtaaggctttctccaacggtgcccgagagacctcccgtggcgcaatggtgtctatgatcttccccttctgcttggtttaagtactctagtaatgagcggcgagactaaagtagattgagatgtattaagagaagatttaatctattagagatttaaacaactcttcgatccctccaaatcactacagcccatgagtatctaaactaggcctccgtcgttcaacaataccctcccgacctccgtcacgagcgtgtgatgggaaaatcccctcgtggagagggagagctctaatctctccatccccactaattaattatatttactattaaatttatatatattttttattttaattagtatgtaacaatatgtattattgtactacatatattgtactaattattaaaactccaaaaactaaagtaaaaaagttaaatagctcagctaaagagtaaagagggagctgaatatgtggaatggtcggagaggaggtgaaatatgggaagaatagttgagagagaggtatttaagactatctccagcagctcacctgtaaacatactcatattcaaactatattctacaaacagtgtaatatacaatgtaaaatagtgcaaaacagtgtttttagtgaccatatgaattgttgtacattgcacctatatggtcactaaaaatactgatttgatatattttacactgcacattatactgtttgtagagtatattttgaatatagatatgtgtatggataagctggtgaagatagtaatatgaatagaaagtacaaataggaggatttgagagtgggaatggttggagatagcataaggcttctatgacacccgcttctgcacacatttcactagcttctaatttatgaagggagaaatatccagctagcctaaatagtgtatgttatgtctccaacaacttatccatttcatctctcattccatattttaaactttaatatgtaaacagtgcaagacatcctacagttgtgttaggaggagccgaaacgtggagagttctaccaaaggaggtcattttccaataagtgtacttttgtcttgcgcattccattccatcttcatgttggtgatgtcctcctaagcatccaacctttaacttcatcatcaccaaataatgaataatggtcatcaacatgtgtagttaaccatgctaccttgataccaatgtatgtcttcatctggctcaatttatatgaatggtatggcccacttcatattttccacatgaccatcaaggtttattagtagccttgcttgttattcaccattgccttagtttatcgacatcaagccatctattctcacttcatcacctcatggtccatcatgtatcgtgcctgatctgagcttccctgtgcatgcaactaagatgcttttttagcctgccctccaccctgcactccaccctgcagagccagcccacgctaattgcatataggttatcaaacactagtttgtgccttgggtccatgacatggtggagaacctggatgagcacgcgcagacaaccaaacacgctctatatgcacaagccatatctcctccatggcctttagcccttccagtcttgctcaacctagcttgtggactaaacacctattcatctcacgcaaaacttattacagtgcactcaatcatcaaaactaaatcgaaacttttcttagggatagacaaactgtttggattagaccaaattttagcacattttttagcattacaataacacaaatgaagatcatactaagattcgaagttttactaagttatataaaacaagggttggttggccagactgcttgcctagcgggttcgagccagacctataatagaccatcagtctagggtaattcacttggaaaattcagctcaagatgacccaactagtctacgtcgtataggctcatagcattattttcatgcaccagcaactcccattaggttgaacgtgaataataacttttgacctaaaatctaatttaacctaaaaattactttaacattcaaaaacctactccctcatcctataaataaattaaatttttagagttgtctaaatcaaacttttaaaatctaagcaaatttatacaaggaaaagctaagatttatgaaactaaattatcatcatcagctaaatcattaaaaacttataatatttttagtagttttttccataaattttgccaaacataaattaagatatgtttttttaaaaatgtttatttatggacggggtgagcaacataactcgacatgggcgtgggaaaaaaagatattagtggcatttccctttcttcactggttcacccggcatactctcactcactctctccctcggtccctcctcgtcgttctcccgtgtccgccgtgcactgtctgtctctggtggcggcgactgggcggcctccgccgctgccctacgccaggatcccaggctgcatcttccgtacgccaggagggcctcgccgcaggttgggtgggaggcggagatgagccgggggcggtcgccggagccgctggatttcttcatctggactgtgcaggatgtagggttatggttggaggaaataaatcttggaagctaccgccaggcttttgaagaaaatggtgtcaatggagagtatctagaaagcctgtcggtgttcaccactgagcagattctccgctttataagacgatgccatatgaaatggggagattttatcaccctctgtaaagagttgagacgcatcaaagttgcctgcctgaaaggggagcaggaggtccgcaggccgtggtgggcgccgtcatgcctgtcggtcgtgttcacgcgggtggccaggcacaaccggcagtcccgggtcgtctccttgaagctggaagcttagcaagttagcaggctcgccctcagccagtggaactggcagagtcccgcgtcgtctcctgatgccggaagcttagtagcaggctcgccgtcagccaccttgcctcgcgcgctgccatccccgtcgttccagtgccgtagggcacacaaggggcgcctctctctgtgtaccatatagcaagcaatgggtctcagtgttcttgaaaggtgctctcgcgttacagtcgtcgtgtgttggcatgcgtgtgttttcgttgatttgtttattttcttcacgtataggggttgtgggtttgagttcgagatggtaagatgttgtactgtagacgatgaatatacgtatgctttgcgtgttgtacaaaaaaaaaaaaaaaa

SEQ ID NO: 9053 - DNA, 1659 bp, Zea mays
  misc_feature (192)..(192): n is a, c, g, or t
ctcactcactctctccctcgttctctcctcgtcgttctcccgggtccgccgtgcactgtctgtctctggtggcggcgactcggcgtgctccgcggctgctctacgccaggatcccaggctgcatcttccgtacgccaggacgaccgcctcgccgcagttgggtgggaggcggcgctgagccgggggcggtcngccggagccgctggatttcttcatctggactgtgcaggatgtagggttatggttggaggaaataaatcttggaagctaccgccaggcttttgaagaaaatggtgtcaatggagagtatctagaaagcctgtcggtgttcaccactgagcagattctccgctttataagacgatgccatatgaaatggggagattttatcaccctctgtaaagagctgagacgcatcaaagttgcctgcttgaaaggggagcaggaggtccgcaggccgtggtgggcgccgtcatgcctgtcggtcgtgttcacgcgggtggccaggcacaaccggcagtcccgggtcgtctccttgaagctggaagcttagcaagttagcaggctcgccctcagccagtggaactggcagagtcgtctccagatgctggaagcttagtagcaggctcgccgtcagccagcttgcctcgcgctttggcgcgccgccgccatccccgtcgttccagtgccctagggcacacaaggggcgcctctctctgtgtaccatatagcaagcaatgtgtctcagtgttcttgaaaggtgctctcgcgttacagtcgtcgtgtgttgccaggcatgcgtgtgtttttcgttgatttgtttattttcttcacgtatagctaggggttgtgggtttgagttcgagatggtaagatgttgtaatgtagacgatgaatatacgtatgctttgcgtgttgtgcagatggctgctgtttaaaatggcccccttttttgcttagctacgagagaaaagagatggcattgctgggaacagcagagcgtggattaaggatcatgaaggatcgtgatgctgatgaaggtctattgctttgattgggcacaaggttgtggttctacaagataaagatcatgatagattgtgatgcagatgccggccttagtaaaaagttcctgctagtttcagctgctggtattgcttatctagtgaacaaattatggtcccgtttacatctcatggtctaaggccatgtttgtttagcctttagattatataatctagcttaataagttgaacaccggaggatgtgtttggttggacggacaagtagagatagaaggggcggccatatttattttataatgcttgaatgagagtcacgcgaggtgagatgaatatcagatcaatttttttatatagaactgtcctgtttattattatgaaatgttatctagaccagtttattttaatctaatagttatccagctaataaattattagctggattgagtcagttaatgaactaattattagatgtaagttatctaataattaggtgcagtattagttgaggacgtttgaaacccaacaactaatttttaatagctaattattatttttagaggttctaaataggaccttaatctgctgccttaaagtaccacatggatactgcaggtagactatagagggtcccggg

SEQ ID NO: 9054 - DNA, 2335 bp, Zea mays
gggaaagtgcaaacaaacaccaccccttttaggcggtcctttgccaggaggcattgttgtcaatcctgctaatatcagcagtggccttcactattttgaagtttatggcatagattacaaagcaccatggcgtgggcctattttccgtgtgccaattactgtaataaagcctattgctctattgggagagccaccaccctcgcctccgccgacccgtcggtttcaatctggtcatattgaaaggaggttcataaatgtaccttttggagcttcatgggcggaagttactatgcgaacatcagcttttgatactcctagaagattctttttggacactgttcagatctgtccactgaagcgacctgttaaatgggaggctgttgttactttctcttctccatcttcaaagaatttcagttttcctgtagaaggtggcttaactttggagttgtccatagcccagttctggtctagtggaattgctagccatgaacctacctgtgttgattttgagattgtgctgcatggaatatccattgatcagaaagtaagtacccttgatggtgagtcacccttgcttatagttgctagatcacttctagcgtcagagaagcttgttcctgttggcaccctgaacaagatcaggataccttatcgacccgtggagtgtaatctttcttcacttcccactgaccgtgataaattgccctctggcaagcaaattattgccctgaccttaacttacaagttcaaattagaagacaatgctgaaataaagccccatgtgccactgcttaacaacagaatatatgacaataaatttgagtctcagttttatagaatatcagattcaaacaagcgtatttactcgtccggagacgtttaccctagttatgtcagactttccaaaggagaatacacgttgcaactgtacataaggcatgagaatgtgcaattcttagagaaactcaaggaactggttctgtttattgagaggaaactagacaaaaaggatttcgttccattgatgttctactcccaacctgatggtcctatagttggaagtggcaccttcaaatccactgttctagttccaggcgaacctgaagcattctatgtgggtcctccgtctagtgaaaaactcccaaagaatgctccacctggggctgttttggttgggtccataacctatggtactgtaagcacatttaacaagaaagatgaacaaaaccaccgtgctccagtatcttatagtatctcatataccattttgccatcaaaggttgatgataaagaaaagggggttttagttggtacaaagagcatacctgaacagttagatgaggaggttcgagacaccaagataaagtttctttccagcgttaagcaactaactgaggaggacaagtctgcctggtcagaacttgtggtttctctgaagtcagaatatccgaagtacacacctttgctttctaagattttgcaatgtgtcctccagaaaggaactgatggtgataagattagccatgaaaaagaggttattgctgcagccgatgaggttgtgggcagtattgataaagaggaactggctaagtatttatctctaaattcagatcctgaagatgaagaagcacagaaattcaagaaaaaaatagaagaaacgcgagatcagttggctgatgcactatatcaaaagtgtcttgcattggctgagattgaatcactgaagtctgatgagtcaattgaggtatctgctaaagatatttttgaggagaattacaaagaattgattaaatgggttgatgtcaaatctgcaaaatatggcacttcgactgttttgcgtgaaaaacgctgtggaagacctggtacagcattgaagattctaaatgatttgattcaaaatgaatctgaaccaaagaaaaagctttatgatttgaagatccagttgattgaggagatgggatggaaccatgtctcaacctacgaaaaacagtggatgcaagtccgctttcccccatgtctgccaccattttgattgtgaactcatttttacaatggctctatcatcctgggttcagtagttgtcattttcattgctgggtgcgtcagttcattatttcgatggcaaacagccaactaggcaagctactggatttgtgcgtttggggacacagttattccatagttattttgtggtacaatatcaggggagtcctttctccaaggagataagacggaacagagatattttgatggacttgaaggagattttatcctcttcaatccttataatgtctatcaaaccaaataaggtttatgaaaaaaaaaaaaaaaa

SEQ ID NO: 9055 - DNA, 1151 bp, Zea mays
  misc_feature (52)..(52): n is a, c, g, or t
  misc_feature (90)..(90): n is a, c, g, or t
acgaggaaaaccaggaatcaatttccgatgctctgaagcagctgaatgaatngtgaaagaggcatcctatgtttgttgtcgcgcatgctnaagaaggcacatgaagacatgcaaagcagacttgattacctgaggaaacaagctgaaggttatgacgataaggggcctgtaattgacattgttacatggaatgatggcggtcggtggagggttgctgtcgatacccagacccttgagggtaacaatgatggtggaaaactagcagattttgttcctctgacaaactacaggcttgaacgcaaatatgcaattttcagcaaattggatgcttgctcttttgtagcaaatgtttataatgatgggaaccttgtcagtatagtaactgactgctctccccatgctactcatgtcgcgggcattgcagctgcatttcatccagatgaacctctgctgaatggagttgcacctggagcacaattgatttcctgtaagattggagacactcgcttaggatctatggagacagggacggggctggtgagggccttgatagctgcagtagagcacaaatgtgatctgattaacatgagctatggagagcctacccttcttcctgactatggcagattcattgatctcgccaatgaggttgtggacaaacatcgcattatatttattagtagcgccggaaacaatggaccggctttgaacactgtgggtgctccaggtgggactagtacaagcattattggtgttggtgcttatgtttcaccagccatggctgctggagctcactgtgttgtacaaccacctgcaaagggaatggagtacacatggtctagccgcgggcctactgctgatggggatcttggcgtttccattagtgcacctggtggtgcagttgctcctgtaccaacttggacgcttcaatctcgcatgctcatgaatggcacttccatgtcatctccttctgcctgtggtggggtagctcttcttgttagtggcatgaaggctgaaggcattccattaagcccttattctgtaagaaaagcaatagagaatacagccgcatctataagtaatgcacctgaggagaaactgaccacaggaaatgggcttttgcaagttgatagggcttttgaatatgcaca

SEQ ID NO: 9056 - DNA, 871 bp, Zea mays
  misc_feature (757)..(757): n is a, c, g, or t
cttctatatattatcgatcagaagctagcacttcagggttcaggctgcttagccggccatgtctagggtgttggagcctctagtcgtcggcaaggtgatcggcgaagtcatcgacaacttcaaccccacggtgaagatgacggtcacctacggctccgacaagcaggtgttcaacggccatgagttctttccgtcggcggttctgtccaagccgcgagtgcaggttcagggcgacgacatgaggtccttcttcacactggtcatgacggacccagatgtgccagggcctagtgatccatacctgagagagcacctccattggatggtcactgacattcctggaacaactgatgcttcttttggaagggagctggtgatgtacgagagccccaaaccctacatcggcatccacaggttcgtcttggtgctgttcaagcagagcagccgccagtcggtgtgcccgccctcgtccagggactacttcaacacccgccgctttgccgccgacaacaatcttggcctcccagtcgccgccgtctacttcaacgcgcagcgggagaccgccgcgcgccgccgctgagcgatcacctgcagcgaccacatgaattcccaaccctacgtactactcccatctcatcatcgcatgcatggcgcagcatgcaagatatatagacctatcaatctggctacgtactatgcggcctttgctgtttcctaacaggccatggtcaaataagagcttatgactcacctttgnggctgatttggtaacaacagatttgaggggattcggggagaacaacctttatattcattgaataaaaaggagtttctctcctaggatctcctccaatctctagtcacaaacagt

SEQ ID NO: 9057 - DNA, 1484 bp, Zea mays
gcacgagaccattacctagaacctcctaatcgacaaaaaaccaagactgctacgacctctcgtatatattatcagaggcacacttcttcagtgttcggcgtgtactcgaagcttagccatgtctagagcgttggaacctctggtcgtcggcaaggtgatcggggaggtcatcgacaacttcaaccccacggtgaagatgacggttacctacggctccaacaagcaggtgttcaacggccatgagttctttccgtctgcggttctgtgcaaaccgcgcgtggaggttcagggcgacgacatgaggtccttcttcacgctggtcatgactgacccagatgtgccagggcctagtgatccatacctgagagagcacatccattggatcgtcaccgacattcctggaacaactgatgcttctttcggaagggagttggtgatgtacgagagcccgaagccgtacatcggcatccacaggttcgtcttcgtgctgttcaagcagagcagccggcagtcggcgcgcccgccctcgtccggcggcagcagggactacttcaacacccgccgctttgccgccgacaacaatcttggcctcccagttgccgcggtctacttcaacgcgcagcgggagactgccgcgcgccgccgctgatcgatcatcaccgtacctacagcctgcaggcggccggctagctgcagcaacgacaaccacatccatcagtcctcgacgctacctgctcccatgcatctccttcctcatcgcgtgcatggcgcatgcaaaacctatcgatctatagctactatatatgtggctttttattactatttcctacagtatgtggctatcgtcgtcgtcaaataagagcttatgacacctttcagcgagagctagagctagctgtcctgtctcgatcgatctgctagtagtctttctgttcttcgttttttcggtcaataatcaattagaagctagcctctctagctgtgcatgaatgagcactcatgtatgcaagatgcaactcgtgtggcactgtgtgtgtgtgtgtgtgtgaccacctcaactccatcagctccttcacacggaggtgaaggacgatgcgtgaatcctgctcggaacacgcgtgcttgactgagagctagctgtgtcggtgcttctgtgatccacgacgtgtccagtggcggtgacgggagataaaggccatggcctgctgtggcccatgcatgcatggctctagctagtgctctcccccatatattacccacattatattgccgctacgcttgtgtgcctgcttgcggtcagtctacatgcgttcctgacccttttggattgctttatctcttgtgtaataagttgtgaccattatttttcgtgtggaatgtatgcatgcatgtttaatgtaccagctgtgttttatgtaatatattcattagaatggctgtgatcgtgaggagatgcatctaaacaagatgaacctccaacacat

SEQ ID NO: 9058 - DNA, 851 bp, Zea mays
  misc_feature (764)..(764): n is a, c, g, or t
  misc_feature (803)..(803): n is a, c, g, or t
accctggcttccgcgcgccccgccggggtcctcttcttctttctgttctccccgcgtgctctgtctctctcttcctctctgcctctctctctctctctcagcggcgactagggacagccgctgcctccctacgcctggtgcccaggtatcctttgccggcgacgagcacccggggtatgggaatggaggtcgttggtgctgaagcagcaccagcagaggtcaaaatatccgatggagaagtgaatctattccaagagaaggaaagcaaagcaactgcaaaagaacgtgaggaggcagctgtttttggttcagagacaactgcgaatgtcactgatctggcacctccaaaggatgcgaaggatgagtggcctgaacctaagcaaacttatgtcttctacttcatcaagatccgctcatttgaggatcctaaactgagggtaaaactcgagcaggctgacaaagaattccagaagaagatccaagctcgttctaaacttattgaggcagtaagagccaagaaggcagagcgttccagtattatcgcagagttgaagccattgagtgctgagaacaaacaatataatgaagttgtgaatgagaagataaaagagatggagcctcttcgaaacagcttgggaaagtttcgtgaggaaaacaatgccatgagggcacagagtgcaggcttatgctcttccatcgaagagcttgacctaacgatcaagatgctgaatgatcgcatggtacatgaaagcatacctttatcntggggagaagcgtatagtggaaggaattaaggaccttgngaaaaaccagatcgaaagtcatctctaatgctgctaacagggctaact

SEQ ID NO: 9059 - DNA, 1990 bp, Zea mays
tgagtggtctgaactaagcaacttatgtcttctgcgtcccccggggccgcccgggtgaggatcctaaactgagggtaaaactcgagcaggctgacaaagaattccagaagaagatccaagctcgttctaaacttattgaggcagtaagagccaagaaggcagagcgttccagtattatcgcagagttgaagccattgagtgctgagaacaaacaatataatgaagttgtgaatgagaagataaaagagatggagcctcttcgaaacagcttgggaaagtttcgtgaggaaaacaatgccatgagggcacagagtgcaggcttatgctcttccatcgaagagcttgacctaacgatcaagatgctgaatgatcgcatggtacatgaaagcatacctttatctgaggagaagcgtctagtgaaagaaattaaggaccttgaaaaaaccagatcgaaagtcatctctaatgctgctaacagggctaaactgcaaggtacagtggttgaaaaagaggctatacaggaccaggtcaaaatcatcggggagggcattgatggaataaagaaggaaagacaggcagtaagatctaagattaaggtcctggaggatgagctaaaacttgttgatgctgagattggattgcttcaagaagatttagatgcagcaactgccagaaaggataaggcatatgaatcgttgcaagaattgagagcagtgcgtgatgcaaaaaacgcatcctccatgcataaccgtacagttttaaccagagctagggattattcttcaaggaatatgctgacagaattgcaagagctccacaaaactgaggtcgacaagttcatgacccaatggtgtgaaagtaaggccttcagagaggactacgagaagagaatcctcacatccctaaatagccgacagctgactcgagatggtcggatgaggaatcctgatgagaagcccatatttatcgagtcacaggcgccagctccagctccagagcccatccctgtaaaattgcctgcaaaacaagccaaggaagtgcctgctccccaggcagatgatgctcccaagactgaagctccttcgaaaggacctgtcaagtcgcacaaggcaaaagctgctcttgatgctgatgatgattatgaggccgagcccctgaaggagaaggcaaagcctacggaggctgatgtggctaagttgaaagagatcaagaggcaggaggagattgagaagaacaagcttgcattggagaggaagaagaagcaggctgagaagcaagcagcaaaagccgcggcccgggcacagaaggaagctgagaagaagctgaagaaagaggagaagaaagccaagaagaaatctggcgcagctgacactgatgagccctcagaatcggacgccaagtctgatgaagccatggaagccccagtggagcaggaagtggccccagcttccaccatgataaagaaggaacagaaggagagtgcccggcacaggaacgtggtcagcaaggccccaccacccaaggcgatcctgaagaggaagaaggcgcagtcctactggtcatgggctggcccagctgccatggtggctgccgtgctggttgccctcctcgcggtgctgggatactaccagtactacctcccagcgaatgccagcaactgagtgggcgaggtcggtgcactcgcggccaggccattcatttatgacgtggagaccaattttgcaggtgagaagaaagagtgcaaggtctgcttgagacgtgaaggaccagaggagagtcttgttcgctttcgatgttgttagttggagccgaagatacagttgtttttggttgcgactttgctagatctctctctatatactgcgactgatatatcccgtgtacttttgaagtgatgcgtatattgacatctggaataacaatgcctttcagtttcattatctcaaaaaaaaaaaaaaaaagcgacaaaactcgagactgtctctcgtgc

SEQ ID NO: 9060 - DNA, 2420 bp, Zea mays
attgggtaccgccggcccggccgggagacaaggctggcctgttctcacccctggcgttctcttctgttctctctctctcacacaaggtctcaccctccctgtatccctctgaccctctcggcggcgactgggcgacagccgctgtctcactacgcctggtgcccaggtatctctgccggcgacgagcacctgccagctgcaggggtatgggaatggaggtcgttggtgctgaagcagcaccagcagagatcaaagtatctgatgatgtgaatctattccaagagaaggaaagcaaagcaactgctaaagaacgtgaggaggcagctgtttttggttcagagacaactaccaatgtcactgatctggcacctccaacggatgtgaaggatgagtggcctgaacctaagcaaacttatgccttctacttcatcaaggtccgctcatttgaggatcctaaactgagggcaaaactcgagcaagctgacaaagaattccagaagaagatccaagctcgttctaaacttatcgaggcagtaagagccaagaaggcagagcgctccagtattatcgcggagctgaagccattgagcgctgagaacaagcaatataatggagttgtgaatgagaagataaaggagatggagcctcttcggaacagcttgggcaagtttcgtgaggaaaacaatgccatgagagcacagagtgcaggtttatgctcttctatcgaagaccttgacctaacgatcaagatgctgaatgatcgcatcgtacatgagagcatacctttatctgaggagaagcgtctggtgaaagaaattaaagaccttgaaaaaaccagatcgaaagtcatctctaatgctgctaacagggctaaactgcaaggtacagtggttgaaaaagaggctatacaggaccaggtcaaaatcattggggagggcattgatgaaataaagaaagaaagacaggctgtaagatctaagattaaggtcctggaggatgagctaaaacttgttgatgctgagattgcatcgcttcaagaagatttagatgcagcaactgccagaaaggacaaggcatatgaattgttgcaagaattgagagcaggtcgcgatgcgaaaaacgcacccttcatgcaaaatcgtacagttttagccaaagctagggattattctttgaggaatatgctatcagaactgcaagagctccacaaggctgaggtcgacaaattcatgagccaatggtgtgaaagtaaggccttcagagaggactacgagaagagaatcctcacctccctaaacagccgacagctgactcgagatggtcggatgaggaatcctgatgagaagcccatatttatcgagtcacaggcgccagctccagagccagagccgttccctgtaaaattgcctgcaaaacaagtcaaggaagtgcctgctcctcaggcagataatgcttccaagattgaagctccttcaaaaggacctgtccagttgcacaaggcaaaagctgctctcgatgctgatgatgattatgaggccgagcccccgaaggagaaggcaaagcctacgggggctgatgtggcgaagttgaaagagatgaagaggcaggaggagattgagaagaacaagcttgccttggagaggaagaagaggcaggctgagaagcaggcagcaaaagctgtggcccgagcacagaaggaagctgagaagaagctgaagaaagaggagaagaaagccaagaagaaatctggtgcagctgacactgatgagccctcagaatcggatgccaagtctgacgaagccatggaagccccagcggaacaagaagtggccccagcttccaccacggtaaagaaagaacagaaggagagtgcccggtacaggaatgtggtgagccggagcaaggccccgctacccaaggcgatcctgaagaggaagaaggctcagtcctactggtcatgggctggcccagctgccatggtggctgctgtgctagttgccctccttgcggtgctgggatactaccagtactactacctcccagcgaataccagcaactgagtggatgaggcccgtgtactcccccccgccaggccatttgatgatgtggagaccaattttgcaggtgagaagaaagagtgcatggtctgcttttgagacgtgaaggatcggagaaaagtcctgttcattttcgatgttagtttatatatatttcgtggagcctaagatacagttggttttggttgcgactttgctagatctcgctctctctatatatactgcgactgatatatcccatgtaattttgacgtgaagcatatattgacatctggaataatgcctttcgctttaggtatctcaaaaaaaaaaaagacccatccgacacaattctgcataagttttcttttatcttgtcatctt

SEQ ID NO: 9061 - DNA, 929 bp, Zea mays
gcacgagaccattacctagaacatcctaatcgaaaagtttctttcaatattgtctagttccaaacaaggcttgcgtgttctcagttctcaccccttgcgttctacctcttgcattctcttttgttcactccgcgtgttctctctctcacggcctcaccctcctccctgtatcccactcgacggcgactgggcgacaaccgatgtctccctaaacctggtgcctaggtatctctgccggcgacgagcacctgccagctgcaggggtatgggaatggaggtcgttggtgctgaagcagcaccagcagagatcaaagtatctgatgatgtgaatctattccaatagaaggaaagcgaagcaactgcaaaagaacgtgaggaggcagctgttttcggttcagagataactaccaatgtcaccgatctggcacctccaaaggatgtgaaggatgagtggcctgaatctaagcagacttatgccttctacttcatcaaggtccgctcatttgaggatcttaaactgagggcaaaaatcgagcagtctaacaaagaattccaaaagaagatccaagctcgttctaaacttatcgaggcagtaacaaccaatgatgtatttttcttacaggtcctcattgaagtaatattcctaactgacgcaccacttttcatcaacgttgaatgctttgtaactcatttgtgtacatatgaacctgttgttgaagccttctcaaaactgtgtctgtctatgagagaggttgcatcacttttagtcacaaaaaaaaaaaaaaaatataaacctattgttaaagccttcccagaactatattgtttatgcaatctttacagacacactattactggacactgaagtaagccactttaatacaacttgctatgtattggaatctaagtttgtattactactgctatta

SEQ ID NO: 9062 - DNA, 3848 bp, Zea mays
  misc_feature (2301)..(2301): n is a, c, g, or t
  misc_feature (3100)..(3100): n is a, c, g, or t
atctccattcatccgtcttgacagctccactcctaactccagcgaccaccgcgtccccaccatggccgctcgccggagcactagccccgcccggcacggcgtcctccccgccctccttctcatcctatgctcgtccctcccttccctcgccgccgcataccgcccaggcgacatcgtcccgatgctccgctcgggccagtaccacggctcgaggtcggtgtggttcgacgtggtggggcgccattgcccggccttcgcggtcaaccgggaggtgctgatgccgatcccaaagcctacggggttcactggtgctgatccgtacaagataacatttcaaattggacatgaaaagttccatgttccttggctttatgttataaatcgcaaaacctctgaagttccactgatcgatttccatttggtgagggatatggtcgttgcttggctttttgtttacacaatcctagtgggtcttttggtttcttttgtttaatagcatttgctgtggatttcacagaagtactctggaaatgatatacttggggtgacagctaaagttgtggacatgcctcaccactgtatgtaatgtactgtctgtccttattacatttatttttttgttcatgtcattatattccttttagatttttaggccccttcagaatgaaggaatttttcctgtttcctacacttttcctgtgaaaaatgaactgtttcctgtcgaattactgtataattgagaaatttctgcattcccaagatcatctgctaaaattatgtctaggttctagatctgctaactaaaaagctagagcttacatcattgtcatgtgttgctgtctttgaaaacttattaccatgtagagttatctttgactactgttaacctgttgtgtgtgctagcgtatttgaaaatattcactaaacacacgtacatgatttctctgtcaatcaagaatatgattggcttgttttaacaattcctgagccttatatgatgtctactgcacatgttttaaactccaatatgctatagacatgtcaccttccaaagcttgcaaacatcataatggaatgcatcatcttgtttactatactttttccctctctttcccctttgttctatgtgagcagtaaattttatattaagatattatgatataaacatgtcttacatggccgatctagtaccctagccactgaccatttaattcactggcagacgtggaagttcatcctgacataaagaagaatttctgggatccacagaattggccaaaatacgttcttgttagatatacatggtataaattttatctgccctatttgtgaatgagtaaccttctgcagtaaacattaccatctttgaagaatactattaacacttgaattcatgttcagggaggagcaatcagagatagatgttactggaggattttatgtgttatttggatccggtgagttcattggctcattcagtgattcagatagctttttgtgtattttaagctcttaatctgtgttgcttttagtttctctcttgcctttggaatcggagcataccgtatcccatggacaagtgaccaaacaatttatgttgttgtttgttttgatatctcagatcctaattactatagcattcacacatgcagggcttgttttgtccttcattcttgcaatatatgtcctacagtcatctcaagagaagttgacaaggtacaacgctggcacatttaatttgtttatgggattataataatgtgaataataagttattgtgatttgaactaaatgctggagatttgtatccaacatctccctgctcaaataatctcttatgtaaaactacttaaagagttgggcagatataagcaaggtttgaaaacagtagctagtttgattaaaattaactccattgtgatcttccatttttgtcatgttttctgagcaaagaacttgattctgttggacgcaaaaacttgatgaaaatgcaggtgttgatattgattccgtgccatgctgccttgcaggtttgtgcgagaagcagttgcagatagtagcctcccagatggagttgcaaaggtcgagtgatgacctgtctacgatgagctgtcttattacccactaatttctacactgatcagaacctcaagttttttaacagtcaactttcttagctgcggaacgagtaatacaacagagtagcatacatatgaagagctagtggtttatttgattctcttgtgcatgctcttaaaccaactttgcttatatggtggaagtgcataatttcatttccangcaggagttttggtgcttgctatctcaactgtgagaatttgggactgaataggtttattgtttgcatggttttaaagacggctagggagaactaggcgcccaaccacggtctgggcgtcgccttactagtcaacacatacaaactgtagctataaacattttgtataacaagaaaataaaaccaggcaaccagcagctcataaactataaatcaacacaatagtggatctaaaatatcgataaagtagtctctaatggaataatacaaaatataaagcaacacaatatctaatctgacatagacagtttctaatagtataattaatagtaactagctgctaatgtagcaaatatgctaatatattctagtaatagctactctcccatctttcaaatcatcatcgaactcttctgagatattgggtgcctcccattcttcactatcattgatagcaccaggttcatctccacaatctatgatttttgcattatcatgtggatcattttcatctttctcttcaacctctaccacattttgtgcagcaatagaatttcttcttgaaaacacattgtggccttctcttggaaagtttcggccacaaaatgcttctgatgctccaatgacattatccacgaggtcctatgtaaggtcacacctacgcccaacttcagtgcctacatgcaaagagttagccaactcattataccagttgaagttttcatgaaccaatgtatcaaaagtttttattcttcttctggcgtagtttttggaatctagcttttatcttccggttgttanaaataaaaacgatagaattcaacctcttatgcaacaatcaatttcttttctttgtatggatctacaaaatcagaaaatatttaattactaatttctaaaatattggttacaaaagtagccaagtagttggatcagaacttgaggagtcacatatagtaacttacaaatacaaaggtacttcgatcgcgttcccaacctaatgatgacgcacaaagcaccaaacgtctagcaaatctttgtaactcaatagcacgaccaccataagaacgccaccactcaactgcaataataacaaattaacaagccaatagaagcaactacttgctagaattaacaacaacactactagcagcactgcaacaaccaacttgctgtaattacagtaacactgcaccaaccaacttgctagaattatagcagcactgcagcagccaacttactacaattacagcaacacaacaacagccagccaacttgtaggaatgtgcatcaatgcaacaaccaacttgaattacaatagcagttaacaacacttatgagaggtcatagtttgaaggttatatttggccatcttatttgaaaaagctactcctctaagatactcataatgcagtgctagagaattgatcttgtctcttgtttcttcatcatctaccattcttgcaagcacatcaagaaagtaatctcttagctgcccaacggtagcatcatcatcatttcttatgagtggatgtaacttttctgggtt

SEQ ID NO: 9063 - DNA, 1078 bp, Zea mays
  misc_feature (1043)..(1043): n is a, c, g, or t
  misc_feature (1056)..(1056): n is a, c, g, or t
gggtaccctccgggcgggtccccagaggttgggccccgatcgacctgcattcatccgtcttgacagctccactcctaactccagcgaccaccgcgtccccaccatggccgctcgccggagcactagccccgcccggcacggcgtcctccccgccctccttctcatcctatgctcgtccctcccttccctcgccgccgcataccgcccaggcgacatcgtcccgatgctccgctcgggccagtaccacggctcgaggtcggtgtggttcgacgtggtggggcgccattgcccggccttcgcggtcaaccgggaggtgctgatgccgatcccaaagcctacggggttcactggtgctgatccgtacaagataacatttcaaattggacatgaaaagttccatgttccttggctttatgttataaatcgcaaaacctctgaagttccactgatcgatttccatttgaagtactctggaaatgatatacttggggtgacagctaaagttgtggacatgcctcaccactacgtggaagttcatcctgacataaagaagaatttctgggatccacagaattggccaaaatacgttcttgttagatatacatgggaggagcaatcagagatagatgttactggaggattttatgtgttatttggatccgggcttgttttgtccttcattcttgcaatatatgtcctacagtcatctcaagagaagttgacaaggtttgtgcgagaagcagttgcagatagtagcctcccagatggagttgcaaaggtcgagtgatgacctgtctacgatgagctgtcttattacccactaatttctacactgatcagaacctcaagttttttaacagtcaactttcttagctgcggaacgagtaatacaacagagtagcatacatatgaagagctagtggtttatttgattctcttgtgcatgctcttaaaccaactttgcttatatggtggaagtgcataatttcatttccaggcaggagttttggtgcttgcaaaaaaaaaaaaaaaagggattaggnttaattgtttganaaaaaaaaaaaaaaaagcggcc

SEQ ID NO: 9064 - DNA, 4910 bp, Zea mays
  misc_feature (1551)..(1551): n is a, c, g, or t
  misc_feature (4727)..(4727): n is a, c, g, or t
ctgcagggtcgagtgggctctacgcgttcctctgcccttttttccttgtctgccaccgtccacgcgctcgggtcggcgcactgccggagtgcctttcttcttttttccacattccacatggctccctccgctgctaccccacccacacacacacacacacacacacacacacggcacaccatttttttttatttttactgttcttgtaaaatttctatgtttaaacctttgtttggttgttttattatttcattttattatctctatctcagcactactagcaataacgccaagatggttagatgtcacagatcacggcatcgagcttgacatcataggtagtcacgacatctagcttgacgtcgagctacctgcgctatgttctgttgtctcctctattctcttcttctctttactgacggtagctcaaataaaaaaaaaactaaaccactcaatagatataaatttaaagatttttctttcaaaataatttttttttgttaaaaaaaaatcgatttggctggagaagcagcgcctcggctacgtccgcggcgagatcacgccctcctgctccggtttgactcatctgaccacgcgctctttcgcaccgcggctccaatggctgacttgaccgcgcggtcagcgttccaccgggatcacgccctccttttgccggccctcccgagtctccgtcgcacgacttttgcctgtaaattaatgctgtataatttaatagtacaatataggagtagcccgtttcttcgtcataaaacgggaagccaaaaggtatgtcactgcccgtatatgctgcaaaacacaagcctgtaatatattttatctcgtggatttatggagttcggagttgaactcacgattatcttatcaccgcgatcattgattgtgaaatcaagagtaactctctctccctttaaaaaaaaaacaagagacgcataaaaggttgccgggcaacagagtggcagacagcctgatcacacaaaggagacggcgatgcgaatatggtgggccgaggctggctctctccttttcgacctgaattcttgagaaaaaaaaggcagcgtaaacatgtgttacacgagcagcgaataaacaaaggcgagattctttcatgagccacacaccctctatactgcttttaaaaaacgtaacagtatctcgtataataataacatgcaaccgtttcagtatcactgaaggaatccgcgccagccttttcttccgggttttggggaatctaccagctctttgcagcgcccgcatgttcgatacagggagggctgaatgaactatagtatatagcctaggatctcctcctgcaaaaaaacaagactgtaacttatgaaaattggtgtagatcacagtcatgaagtgtcaattccacttgctgtggttcatttctttatattaaggcaatttcaaattagctccatagcctggttaaaatactttccttcacaaaaggcaaaaggaccaatgttttttttgttgccaggaagccatttaaatgtgaaaaaaaaaactgtgaacttgtgntaacctacaatactatcttgttaaagttataaactcttgaacaggcctgaaagaactacactacacggcctgggcattttttttttaaaaaaaactaactgagctattttattccaaaaaaggttgcatgacacacatacttattaatgacctgataaagagattaagggaaagaaaggcttacttgtcaaacggtcttggcattagaactatgattacagctgtccacatagaaaacaactactgctagccatgacttctgggatcagcgacttgatgaactttcctagattcagcgctcgagaactgaccgaccactcgtgcgtgcggtatctcgggatcaccagaagcaagcgcaaccacgttgtcaaggaaatactgctttggaagtctcccgacaacattgccttcctcgtttccttccttatccagaaaggcgaagtgaggaatgccttccaccccgaactcgtcaagctcttgctcccacttcgtgttgtcaacattcagcatcacaaaattgacacggtccctggaaagaacgctcgagatgtgtaaataggattggcgagaatcggataaataaaggcaacggattcgaagatggtcttcgtaaaaaataattgtgttttgacgatcttggtcaacagaaggtccaatcaagtgcggttaataggataggcaacatgataaaatcatggagaagcattgcttctatgaaatgagccacagttgttatttgaggtttaaagtgcaaaaatgtgaaaagtggtctgaaaacacgttacttgtattgctgttccactttgtagatatccggagctaattctctgcagacctcgcaccagtctgcataaaactcaaccacagtgggcctgccatttgaaagagcctgcggatgaatttatcaggttaggtttcataagcatttatggtgaagaaaaacatctacagaataacgtgattccagcttagcagggtttttggtcaaaataaatttgtcagtcaacaaaatggagcagattaatcagaagaatgctaataacatatggcaggaactagatgaatcacgtatcaaacaaagaataccaatacgacttgaagtaaccgaagatgcatggattcagtaacagggcagagaaaaagaagaaaaatacattgctttgtctactgaaattattactttccacttttccagtcagttactattctgcatatcatgaacaacaattgcaaagaatgatacagtaacaccaccgtttgtaaataccagccaatcacttttgtttttggaaaccaaccaattaactaaataaacacaaagcgtagtattggttcgagtatatgaactctagcattttcaccaggcacataatgcacatcaaggacaaaaatgctgacctcttcatatggaaccgaattggctgcaagatctttaagagatgcctcgctaagattgagcctctgggatgcaaacagagccaccgctccaagagtggacagtagtgctacccttctgttgagatccttattcgggagagctggaagcccagcatcctcgggtgtactagtcggagcatcttcttggatagattcagctttcacagcctgctcatcctgtggaaggaaaataccacgtcagtgcgtcagtccatacttctcaatgggtgattgaggtataaccaagcaagagtattggctcaagactgcaaaatcccagtaacttgtttctgccttctaccatctacacaggttgggacttggaagagtattgacttagtagactaggttttcctcgtaattgctttggaaaataataatttccacagcttcattttgtatgcagggaaataacttgaggtaggtgggtctttggtgtgctaagaaaacgcaccgtctgtggctccgcggagtcgggcggcgcgacgcaggcgaggggggtcctcggccggcgcaggccccaccgcggccgcagacggagcgaagaggacggacgggagcagcaccgtgctccggcgaagcttggcgggaggagaaggccgtaacacctcgcggaggccacgctcgccatttctttcgctctagactagattttgcagctctgctgcttcgggttcgggctcgcagcagagtcaaacccggagaggcggaggagaactggagaaggatgatgtgggtggccagcgtggcgccacgcagcccggaatcgtgcgatgcatgaggactgggcaattatgggctttggaaaggcccaacacgtaaggcagagaagcagtaacccaatcggtccataccgcacaagcaacacgcgatcggtccaatagggatgatatgtccggcctaataaaagaataaaagcacgtaccggcccttcttttttcatcaaagcttttttatcgtacaaataaacaagttcgtaccttccaacgatatttatcatattttatatagttatgtagatgatttgtgacttaaaaatttatcaaacaatcatgccatgcatttcaattcgtcccagtattgaacttaacaaatatgttgcgacacgtggcaatctaaacacatctgcacatgaatcttaaagatttatccaaggatcgtattatgttttatgcgtttgtatgaaaaaaaggtctattttacctctctggattacgtcacagtctaccactctcaacctctaaaaacaaatatcttactcatcggcctctcgaaactattcaaatcacctcttcgccctactttaaagggggtttgaagacaactttggtattttcggtactttctataaaagctcgataaggatattagaacaaaaaaacatctaaacttttaaacattgtaaaataaaagtcttaagataggttgggatgaaataaaatatctagagctcatgaaaacacttttaaaaacttttaaaaaagatttatctataggaaaacaaaaaaaaaatctaaagcatataaatttcattctaataacattctagcatgttttgaaaaactttacataaccaaaagacacaaccatcataaatgcatttaatatcaatgtatgtgacattcatgctggttgtatatattaatttcacaatgcagagttataaacttggttatccattgattagaaaagtattgttagttagtttcctgtctttttaatatatttgtctcaatttnttagagctagatgttttttttaaaattacttttgggtatattttcatgaattataaatatttactagtactctttatattgtaatctaaccctgtaactttcgtccgtactcttagacggttagaaacgtcttctgtggtataaaaacagtatcaagtaccccctccgtttctttttatttgt

SEQ ID NO: 9065 - DNA, 1212 bp, Zea mays
tttgggttccgcggccctctcttcgtgttttttttttttttttttttttttttttttttttttttttttttttaaacaaaggcgagattctttcatgagccacacaccctctatactgcttttaaaaaacgtaacagtatctcgtataataataacatgcaaccgtttcagtatcactgaaggaatccgcgccagccttttcttccgggttttgtggaatctaccagctctttgcagcgcccgcatgttcgataccgggagggctgaatgaactatagtatatagcctaggatctcctcttgtcaaacggtcttggcattaaaactaggattacagctgtccacatagaaaacaactactgctagccatgacttctggggtcagcaacttgatgaactttcctagattcagcgctcgagaactgaccgaccactcgtgcgtgcggtatctcgggatcaccagaagcaagcgcaaccacgttgtcaaggaaatactgctttggaagtctcccgacaacattgccttcctcgtttccttccttatccagaaaggcaaagtgaggaatgccttccaccccgaactcgtcaagctcttgctcccacttcgtgttgtcaacattcagcattacaaaattgacacggtccttgtattgctgttcgactttgtagatatccggagctaattctctgcagacctcgcaccagtctgcataaaactcaaccacagtgggcctgccatttgaaagagcctcttcatatgggaccgaattggatgcaagatctttaagagatgcctcgctaagattgagcctctgggatgcaaacagagccaccgctccaagagtggacagtagtgctacccttctgttgagatccttattcgggagagctggaagcccagcatcctcgggtgtactagtcggagcttcttcttggatagattcagctttcacagcctgctcatccgtctgtggctcagcggagtcgggcggcgcgacgcaggcgaggggggtcctcggccggcgcaggccccaccgcggccgcagacggagcgaagaggacggacgggagcagcaccgtgcttcggcgaagcttggcgggaggagaaggccgtaacacctcgcggaggccacgctcgccatttctttcgctctacactagattttgcagctctgctttttcgattaggatgttctaggtaatggtctcgtgc

SEQ ID NO: 9066 - DNA, 2011 bp, Zea mays
  misc_feature (1885)..(1885): n is a, c, g, or t
gtgcggcgcgcgaccccgccgcggcccggaattcctcgccggagtgtagcggggccgaagccatccgaactccgaaaagccccccagcggcctcccctccgccccgcagccatggccgccaccggcgtggtcgccgagccgaagaccaagtacgatcgccagctcaggatatggggtgatcaaggccaggctgcactggagaaggctagcatatgcttgcttaactgtggtcctaccggaaccgaagcattgaagaatctcgtgcttggaggcataggaagtgtgactgttgttgatggctccaaagttgaatcatctgacctggggaacaattttctgttggatgaaggatgtttggggcaaccaagagctaaatctatatgttctttcctacaagagcttaatgacgctgttaaggccaagtttgttgaggagtctccagcgcatttgatagatactaatccttcattcttttcccagtttactgttgttattgctacccagcttccagagagttttttactgaagctagattatatctgcaggaaagcagatatcgttttggttgctgcacgttcatatggtctaaccggtttggtcagggttagcgtaaaggagcattgtgttatagaatcaaaaccagaccacttcttggatgatttgcgacttcacaacccatggactgaactaaagcagtttgcaaaatcaattgacataaacgataaagatcctgttgtccacaaacatactccatacattgttatccttgtgaggcttgcagaaaaatgggcagatgcacatgatggtaacttgccttcaactaggcaagaaaaataggaattttaggatctaattcgagcccatatgcttaatgtagatgaagaaaattacaaagaagctgtggactcttcatataaagtatcagtcactccaggaatcagtaatgagattcgtcagataattgatgatgactctgccgaagtcaattcctcatcgtcagatttttggattttagtggctgctttaaaggagtttatcgcaaaggagggcaacggtgagctacctctggagggaacaatacctgatatgacttcccttactgtgcggctcgtgagcctacaaaagatttacagctaaggcagaatttgactgtcttgccctggagcatcatgtaaaggaaatcttaaagaggattggtagagatccggattcaatttcaagagcatatatcaaaacattttgtaaaaattctagaaaactaagggtttctaggtatcgtagttttgaggaggaatttagctctccgtttgtctctgagattcagaggtatttcaccgatgaagactacagttacgcaacgaacttctatattctactacgtgctgttgatcgattggctgccaattatagcagattgcctggaatcttcgacaggctgaagactgttgcggcttcagtggcaagtgagatgggtttgaatggagcatccttatccgaagacctgataaccgagatgtgccggttcgggggtgcggagattcatccagtggctgcttttgtcggtggagttgcttcccaagaagtaattaagctggtcaccaagcagtttgtgccgttgccgggaacattcatatttaatggaatcgacctcaaatctcaagttttgatgctataacatggatgtggaacgttgtctgtgtggactggatttgagttggcccagattttgtgccagggcacaacgctgcaaatggaatctgtttgcccaacgcgtagctaaatatgtgttgcataatattttagagcctgtttgtttccttgcaggattatataatccagcttactttatatagattatataatccaatttatataattttattangagatggttgtttatacaaattattagtgggtacaaagctaaacaataatctagaataagcacctaatgatatgcttatgaataatcataatctagttacctagattgtaaaaaaaaaaaaaaaaa

SEQ ID NO: 9067 - DNA, 2023 bp, Zea mays
attgaggggttggcccagcttcgcggagaagctacactaccatccttcctcccccgcgccggccctatattcctcgccggagtgtagcggggcgaagccatccgaactccgaaaagccccccagcggcctcccctccgccccgcagccatggccgccaccggcgtggtcgccgagccgaagaccaagtacgatcgccagctcaggatatggggtgatcaaggccaggctgcactggagaaggctagcatatgcttgcttaactgtggtcctaccggaaccgaagcattgaagaatctcgtgcttggaggcataggaagtgtgactgttgttgatggctccaaagttgaagcatctgacctggggaacaattttctgttggatgaaggctgtttggggcaaccaagagctaaatctatatgttctttcctacaagagcttaatgacgctgttaaggccaagtttgttgaggagtctccagcgcatttgatagatactaatccttcattcttttcccagtttactgttgttattgctacccagcttccgaaagcagatatcgttttggttgctgcacgttcatatggtctaaccggtttggtcagggttagcgtaaaggagcattgtgttatagaatcaaaaccagaccacttcttggatgatttgcgacttcacaatccatggactgaactaaagcagtttgcaaaatcaattgacataaacgataaagatcctgttgtccacaaacatactccatacattgttatccttgtgaggcttgcagaaaaatgggcagatgcacatgatggtaacttgccttcaactaggcaagaaaaaaaggaatttaaggatctaattcgagcccatatgcttaatgtagatgaagaaaattacaaagaagctgtggactcttcatataaagtatcagtcactccaggaatcagtaatgagattcgtcagataattgatgatgactctgccgaagtcaattcctcatcgtcagatttttggattttagtggctgctttaaaggagtttattgcaaaggagggcaacggtgagctacctctggagggaacaatacctgatatgacttcccttactgagtattatgtgagcctacaaaagatttaccaagctaaggcagaatttgactgtcttgccctggagcatcatgtaaaggaaatcttaaagaggattggtagagatccggattcaatttcaagagcatatatcaaaacattttgtaaaaattctagaaaactaagggtttctaggtatcgtagttttgaggaggaatttagctctccgtttgtctctgagattcagaggtatttcaccgatgaagactacagttacgcaacgaacttctatattctactacgtgctgttgatcgattggctgccaattatagcagattgcctggaatcttcgacagtgagattgatgaggatatccctaggctgaagactgttgcggcttcagtggcaagtgagatgggtttgaatggagcatccttatccgaagacctgataaccgagatgtgccggttcgggggtgcggagattcatccagtggctgcttttgtcggtggagttgcttcccaagaagtaattaagctggtcaccaagcagtttgtgccgttgccgggaacattcatatttaatggaatcgacctcaaatctcaagttttgatgctataacatggatgtggaacgttgtctgtgtggactggatttgagttggcccagattttgtgccagggcacaacgctgcaaatggaatctgtttgcccaacgcgtagctaaatatgtgttgcataatattttagagcctgtttgtttccttgcaggattatataatccagcttactttatatagattatataatccaatttatataattttattagagatggttgtttatacaaactagaaggggggcccgggccccacaataatctagaataagcacctaatgatatgcttatgaataatcataatctagttacctagattgtact

SEQ ID NO: 9068 - DNA, 1715 bp, Zea mays
cgctcggctctactgggcagatgcacccatctgtttcgcggagaagcccgtcctcgtcggagactcggagtgtagaggactagaggggcgaagcgatccgaactccgagaaccccagggccagggctcagtccacagcgagagcagagaacgcagcggcctgccggcctccgcccctcactcccgcagccatggccgccgccgccgccgtggttgccgagcccaagaccaagtacgatcgccagctcaggatatggggtgatcaaggccaaactgcactggagaaggccagcatatgcttgcttaactgtggtcctaccggaacagaagcattgaagaatctcgtgcttggaggaataggaagtgtgactgttgttgatggctccaaagttgaagcatctgatctggggaacaattttatgttggatgaaggatgtttggggcaaccaagagctaaatctatatgttcattcctacaagagcttaatgacgctgttaaagccaagtttgttgaggagtttccaacgcatttgatagacactaatccttcattcttttcccagtttactgttgtcattgctactcagcttccagagagttctttactgaagctagatgatatttgcaggaaagcagacatcgttttggttgctgcacgttcatatggtctaactggtttggtcagggttagcgtcaaggagcactgtgttatagaatcaaaaccagatcacttcttggatgatttgcgacttcacaatccatggactgaactaaagcaatttgcaaaatcaattgatataaatgataaagatcctgttgtccacaaacatactccatacattgttgtccttgtgagacttgctgaaaaatgggcagatgcccatgatggtaacatgccttcaactaggcaagaaaagaaggaatttaaggacctaattcgagcccacatgcttaatgtagatgaagaaaattacaaagaagctgtggactcttcatataaagtctcagtcactccaggaatcagtaatgagatccatcagataattgatgatgactctgcggaagtcaattcatcatcagaagatttctggattttagtggctgctttaaaggagtttatttccaaggagggtaatggtgagctacctctggagggaacaatacctgatatgacttcccttactgagagaagaagaggtgctccaaaggtgatgataaatttgcccaatcagcacgcatgcagtcttcaacgatggttctgctttcttttcacggagtggaggggcctcaacatagacaatgggttcaaacgtttccgtgttttgatatgtgttaattattgtaatgtcatgtatgctttcctgagaactaaaatacacggtcaaacatggtaaacccttttatttctgttcaggaatgctgggaagaattagggttagggatcagtttcttacccataaacgaaggaaaagtgaccatatgttcctgaccattatagcagttataatacatttccttcctcttcttaaacttgagctccacgcggctatcctaattagaggcgcttgtggtactagggtcgtaagtaccaaccagagtcagttctatgcatccatggaacgtactgatgaatgtttaggaatcttgagttgtggggtcttaactaattacctttacgtcctgtttggatcaaaaaaaagaaaaaaaaaaaaaaaa

SEQ ID NO: 9069 - DNA, 1819 bp, Zea mays
agaaaatgattagtgcagggacaacaattgtttttcatttaggacacactctatttagtggtgcacctatcagtggtttctgttttagtttcaaatttgtatattcataatcgatcataagtgtaaataagtacctcagaatgtcaattttacctgttaatcatccgtgctgaataatttccaatgcttagatttgtagatatcgtagtttcaaggaggaatttagctccccgattgtctctgagattcagaggtatttcagcgatgaagactgcaggtcagcatccattactctggtttttttttttttgcttttccacctctctatttcgtgttcctttagttgatgtatataggaagtgatatatatgttctggatttcttgttattaattcagttaccattttctgcaatggttaattaattactggccctttgttttaaatctttttaaattaaatgtcttcaccaatgactatcaaatgtgtcactgcagttacgcaatgaacttctacattctactacgggctgtcgatcgattggctgccaattatagccgattacctggaatcttcgacaggtactagagagaaatgttcatttgctattggtgaacattattatcccacatgcagagaaacggtctgttttttttaatactgattatgcactggattcaatagtgagattgacgaggatatccctaggctgaagacagttgcggcttcagtgctaagcgagatgggtttgaacggagcatccttatcccaagacctggtaaccgagatgtgccggttcgggggtgcggagattcatccagtggctgctttcatcggtggagtcgcttcacaagaagtgattaaggtacgtggccccctttatacagcatttcctgaaatagatatgtaactctagtagttcacgcaatatcgggggagtgatttgaattcataggatggtatatatacttggacgctagtgggaatgttcatgcatttggaatggaaagttctcaagtacttatcgatgttcatttccccatttcatctttcagctggtcaccaagcagtttgtgcctttggggggaacattcatttttaatggaatcgatctcaaatctcaagttttggtgctataacatggatgtggagcgttggatttgagctggtccagattttgtgccagggcaccgcgctgcccaacgagtacccaagtctcgcagaaaatatcaatacttgcttcgtatgatttttgccaaatgaccagcaaattcctagctcacgcggctgttatgcgtaaaaccagagagctgctgcttttagactacgcctgttatagattagtaggcgaagtaatatgtcagtggggctgatgtgataagatggatggtgttaaagactagcatgtgcgcgatttgacgaagacgactacgagagtggaatgagcaatgagcatgtcggccgacctcggccccctccccgcatatcatggaccgacatcaatgtgcatatgatctcaggtgtccatcgacagaccgaatcttccgtggccagtattccttcggcgacgcggttgccgttagacgaaggaaactgtcgtgtgacagcgaaatgtggttgctacatgctggtagcgcacatagcacactttgggcgtgtttggttcggcttttttctaaatagcttttctgaaaagctggctgtggagaaaagctggctgttgggaaaaactggtggttagaatttaggtgtttggttcgccagctgtgcaaaaaagttgttcgttagaatataggtgtttggatacacagattctcaga

SEQ ID NO: 9070 - DNA, 3561 bp, Zea mays
  misc_feature (45)..(45): n is a, c, g, or t
  misc_feature (137)..(137): n is a, c, g, or t
tttcatgttacatatgtagtaggagtgtctgccctacatttggtngagggtctaatatatattttggcaatgatgataccaggggaagctgctgcttgtgattggaagtagtgtttagactgcgtatctgacaaagnagtatcatgcacactaaaagcatcaacttttgcacacacaacatgttgtggttgttctttaggtcttagcaacattaccagatactctatgcttcatgcagtgatagcgtgcctgtgttgcttcgaactattagattctgttgatatgggtctttcattatctccctttgcatgtttccctagattaaacgaacaagcttttaaaaccaaggattacaaccgaaggggattatacccccaaggggttcaaatgataaggagaggattaactcaatccctctctggattaaatccccctctagaataaaaacctgtgaaccgaacaaggccttaaagatttagcactctcaattcccttgctctagaacaagtaggcgttattgtgcaatggatgatgagtaatgagtgtgtggtacatgtcatcaaacgagagttcatctttcgttcctttcagtggagctagtcctcggccacagaccaagtaaacatacgtcaccgcatccgtgcatctggcccaggtccaacccaactccagcaaaccacagtgacctgggccgaccagagccagccattgcaaccgttgtcttcttccacggcagcgcctcttctcttcctcccctcgattcgcggcgtaccagtggaatgagagaacagaatgcatgaatggctctctggacactgctgcgcccgcggctgtgtagctcagctcgctggttgttaaagaagggagaggtacagccatggcgcggcgtgggtgccatgccatgcgtccagaccaaaccaggacaggagagacagctggccctaattttggctgccccccagaccggccgttactagctagcgatcgacaagggggtcagggacaggctggtggtggtgtgtgctaagcttcgcggaagttcgcgctgccgtgcgtggccggctggccgcgccgatccatccatataagaggctccggcgcctccctctcttcctccctcccgcccgcccacgcgtccgacccatcgtccgctcgcgtgtcctttgcgctcgcgaactccgtcgccggacacgagccagggacaccgagtgtggtgaggttgccccttcccttcccccacccccatcgtcgtcttggaccagctctgtacgtaccgtccgtcgatcgtcctttcccgtcccctctagcatcgatcgcagcctcctctgctactgccacgtctctgtgcctgccgagacaagcaagggggtcgtcggtcggggctaggttgttcccttaattcattctaggggcagatcagatcgaaagaaatcaaactaacgtagccatggaagaagctccacgtcattccatgtagttacttcttcagagcgcgcggtggcggccggctagaagctttgttcgttgcatttgaattcaccaccaaaggagaaggcgcctgttggcgttccaccaattccatcccatcgccacaaggtcgtcgatcacgcggatcgtcgcgactgaccggccggcctcctcagccgtccttgttgtgctacaagatcgaggcgacaggatccagccagccacgatgtcggcggccggcgccaccgccgtctgcacgagggacggcggcctcctcccgctgcgtccgcactgcgcgaggtcgtcctcctccttcgccgccgccgccgccgccatcgtgatctacctgacggcgccgggcctggccgtgttgccgatgcgggtgatggcgtccgactccatcgcctcggtgaagctccgcgtgcagacgtcccggggcgtgagggcgcgcaagcagaagctcgtcttcggcgggcgcgagctggcgcgcgacgacgggcgcatccgggactacggcgtggcggacggcaacgtggtgcacctggtcatccgcgtcccggacgtgcgcctcatcaccgtggagaccgtgcagggcggcaagttcaggttccgcgtggagcccgggcgcaccgtcgggtacgtgaagcagcagatcgccaaggaccaccccgcggcggcgcgccccggcgagcagcggctcgtgctcgagggcgaggacctcgacgaccgccacctcatccacgacgtgtgcagggccgacggcgccgtgatacacctgctggtgcggcgctccgtcgtcgcgcgcgacgccgggtccgggcggccgtcgccaccgccacggcgtgacgacgtcaggatcgagcccgtaggcggcgaccataaggcggcggtgcgtggcatggtcgacgcggcgctcgccgggatggagagcgggaacgcgcccatcatgtcgtcggagggcacggggggagcctacttcatgcgggacgcgacggggcagcggcacgtggccgtgttcaagccggcggacgaggagcccatggccgccaacaacccgcgcggcctccccgtgtcgtccaccggcgaaggcctgaagaaagggacgcgcgtcggggagggggcgctgagggaggtcgcggcctacatcctcgaccacccacccaggagcgggaccgcggatgatgggttcgccggtgtgccgccgaccgcgctcgtccggtgcacgcacggagccttcaggcagggcggagccggagccggagcgagggcgccggtgcccaagctggggtccatgcaggccttcgttagtaactgcggcagctgcgaggacatgggacccagcgcgttcccggtgcaggaggtccacaagatctgcgtgctggacatacggctcgccaacgccgatcgccacgccggaaacatactcgtccgcaagcacgacggcggcggaggcggaggcatgtcgctggttcccatcgaccatggatactgtctgccggagagcttcgaggactgcactttcgagtggctctactggcctcagtgccgggagcccttcagcgacgagacggtggagtacgtgcggtccctggacgcggaggaggacgtgactatgctgaggctccacgggtgggaggtgtcgcgcgagtgcgcgcgcacgctgcgcgtcgccaccatgctgctgaagaagggtgtggagaggggcctcaccgccttccacatcgggagcatcatgtgcagagagaccctgaccaaggagtccgccatcgaagagatcgtccgtgaggcggcggaacggggaggaggatgcgagactgtcttcttgcaggctgtctcggagatcatggaccgccgtctcgacgacatatcaaaggacatgttagcctctagatatgcacatggctgacaaaataacgatgtaatcaactcaatggctaatgcaaagaatggtgtactatttcctcccaaaaaaaaaaaaaaaaaaaaaaaaaaaaaaaaaaaaaaaaaaagaaagaaaaacaaaaagataaaaaaaaaaaataaaaaaaaaaaaaaaaaaaaaaaaaaaaaaaaagggggggcccccctaaaggt

SEQ ID NO: 9071 - DNA, 1997 bp, Zea mays
cttgtagttgtgcttaaagtttgtaaatttcagattccgcctattcacccccctctaggcgactttcaaaaactgcttcatgtccatatacaagctaaaaggaaagactttagtagcacagtgcttagatattctataagcccacaaagcctgagacaacacctagtgccagcgtctgggatggtcgactattttctttttaataaggccgatcaatgtcctattacttgactcggcttgaccattggactgagtgtaatatggataagaattgagcaatttaattttatataattcagcaaactcgcgtacctcttttgacatgaagaagttttgatcggtggtcagagtctagagaatgttgaatccatgaataatatgctcaatcacaaactcacttacctctctatgtgtcatattttttagagcaatgacttccggcaactagcacaagccaatcataggtggtatgcaaatagctaaatgcctatcggaaaatgtttttcttgttgtcgatagcctatagattgcggggttaatcgatcattaatgttgccatcccaaaatttcaaccggaacaatcatatttttccaagtgatttctatattaccaaagaaaaatagactaattttctttagaaaaataaaaatttattgaaaaaattgtggttggcaaactagcttaagaaattgaatttgaaaatccgaaatattgtcattcgccaattctcaaagatgaaggattcccaggcccaggcccaggcccaggcccaatgcgcagtgctccccgaagccgaagcagaacgaaacggtccacacgctggctagcccccgtcccgactccgaaatccgaatccatggccgtcctccgcgcgtcgccgccgccctttctcccccatccgctctcgcgcccctctcagtgcaagcggcgccccacctgccgcgtggtcgcagccacagccagacccagtcctgctccttccaggcccaggagcggcggcgtccatggaggccgccccaagagggggcttcttgcggcaaggagaaggccgggggaggggcgggtaccctgcttgcgggccgcggaggcgggggtcggtgcggcaggcgtcgcgaaggaggaagacgagttcctggcgcgggaggccgggtggggcgtgcggcggatggcacgggttggggaggagatgcggcgggtggcgcaggtccaggccgaggccttccacgtccccgtcgcgctcttcaacgacttcttcttcgacttcttcaaagtgagcacgtgtctgagcttgcttgcgcttcaattggatctgttcgtccgtcctcacggtgcttgtactggcggcgtttgttgcttgcgtcaagattaggccgaggtgctgtcggcgctcatctacagagtgaggaactcgccgcctgacaggtgcgatcaatgctcttgattgctgtgctacttcataacgctggtagcaatgccaaatagtacttgtactggattttgattagaaagtttaatttgtctagagcaacgtggtggtgtttttggtaggagttcttattcgaatgaacaagttaatgtaatgttcaaatttacatgttctctgatcatatattttacacctgaaatgcattcttgttgctctcaatctgtgctccgaaggcggcaaacatctatgtttttgggtttttttttgtaccagtatatcatcaatcttagttcggtagtgttatgtttgtcaaagacagtaatttaaatcaattgacatttgccatttagtatcgaaataatcccaggcatctgatttactggcaagttattacgttgtgcctcatgacccttctgctaaaattgcaattgacatgtgttggcctgcaggcttcgttaaatccacgcgttaggactagtcgatgcctgaaccttatttagttcgctaacaatgccgcctacaccaactgaactctgttctccttagatacgcttgtttggtggctgaaga

SEQ ID NO: 9072 - DNA, 1497 bp, Zea mays
cattgggccccgaaatccgaatccatggccgtcctccgcgcgtcgccgccgccctttctcccccatccgctctcgcgcccctctcagtgcaagcggcgccccacctgccgcgtggtcgcagccacagccagacccagtcctgctccttccaggcccaggagcggcggcgtccatggaggccgccccaagagggggcttcttgcggcaaggagaaggccggcggaggggcgggtgccctgcttgcgggccacggaggcgggggtcggtgcggcaggcgtcgcgaaggaggaagacgagtacctggcgcgggaggccgggtggggcgtgcggcggatggcacgggttggggaggagatgcggcgggtggcgcaggtccaggccgaggccttccacgtccccgtcgcgctcttcaacgacttcttcttcgacttcttcaaagccgaggtgctgtcggcgctcatctacagagtgaggaactcgccgcctgacagatacgcttgtttggtggctgaagaagctgaggcagccgaccagccgtcaaaggcaccatatgagaagatcgtcggggttgtggattgcacggtgcaggacgaagacggcatcctaaagcaccttcgaggcgcggatgaatacctctacgtgtcaggaattgcagtcttgccaccattcaggaggaggaaggtagggaccgcactgctgaaggcctgcgaggcactggggctccaatggaggcacgtgttcatggttctgagggcgtacgaggatgacgacggcgctcgaggcctctactccaaggcagggtacagggtcgtgtcaagggatccagactgggtctcctgggtggggaggaggaggcgagttgtcatggtaaaggagctgccggttcacgatgatcaatgacgccggcacggttttgttgaatatgtgtgtgtgtgtcaccagctaatttgtactgtttcttgtccatattcgcggcatcatgcatgtctttttggacaatagaggagagacagttgcctatcttcccacctaaaaaaaaaaaaaaaagggggagggccagttgacaagttccgtttcagagtctgccaccggcaagtgtacagtatcagctgtattttgcgacattacacaagcactcgtaagcacatacagatagcatatggcacaataatttgaagctttgttgtaaaaggcaacaaacctacaaatctagcgatcatgttcagatcatatattgcataatgcgacaacagtttataaccatcaaacactacaagactacaagcggcaattagagtgtcgtcccgaaagcatacacatcgtgcataacacgcttcatacgtagagaagagaaaattacacatttttctgtggcgaccatcattaaacataagctaacaacaacggttagttcgatccacggataaacatacatgtaatttgcttcctccccgcatggacaatagacgcttcatgtaatgagatgaatcaagcatc

SEQ ID NO: 9073 - DNA, 2142 bp, Zea mays
  misc_feature (2125)..(2125): n is a, c, g, or t
cacctcgcggacggcggacataccccgtctcggttctgcacgagaccattacctagaacatcctaatcccaaaatctccccgtccaggtcgttgggtcagcccctatccttcaccttcacgacttcacctgcttctccactgcgcgccccgcccccggccccgtcgtgcgccctgctcagatccatcgcacggggcttgccgcaccactgcgccaagcaaaaggtgggcggccagcggcgcgtgcgcagatcatgcactggtaggactaatttgcaagatcttggacgggatggttcgcctgttagttgtcttatgaagattggtaaggggagaaagaagatgaggaataaacagcgaaaatcatctgccctcggttctgatgcaggatgtggatcttctttatcttgtattgtatggagcttggtgggttttggtcttgtctgcttccttttccttaaacatcaagcagacagtggtcagacccatgtttatttcagtcctcttcatgcgaccagaaaattagaggacatcgaggaggatcatttccgcttgccacctcctcacaaggtgaatcctcgtgcagtgaaaaggaggggacctcgtaaacaaccaaaggttatagatgattatctggaggagtcttcagcagtacatgcactgttctttccagatcaaatggctgttgtggatccaacaaaagggggaaatgatagcatgtatttctatcctggtagagtgtggctagacactgatggaaacaccattcaagcccatggtggggggattatgtatgatcacaagactgccagattctattggtatggagaaaacaaggatggaccaacataccaagctcgccccaaaggaacacagagggttgacatcattggggtaagctgctactcatcaaaagacctgtggtcgtggactcatgaaggaattgtgcttcgtggtgagccttctaatgtcatccatgacctttataaatcaaaggtgcttgagagacctaaggtgatatataatgatcgcactgaaaaatatatcatgtggatgcatatcgatgatgctaactacaccaaagcatctgtcggtgtggccgtgagtagctctccgactggaccttttacttacctttacagctttcgtccacatggttgtgagagtagagacatgacagtcttcaaagatgacgatggaatggcttacctcttctattcttctcgtgacaatactgagctccatgttagcccattgacagaggactaccttcagatcacagcagcaatgaagagaatactaataaggcggcatcgtgaggctccagccgtcttcaagcaccaggggacctactacatgatcacctctggttgctcaggctgggctcccaacagggcattggcacatgctgcagagtctatcatgggcccatgggagacactgggaaacccttgcgttggaggcaacaggttttaccgccttacaacattcttatctcaaagcacatttgtgcttcccctccctggtttgtctggtgcatttatcttcatggcggataggtggagtccgtcaaacttgagagactcccggtatgtgtggcttcctctattcgtcggagggctcgcagacgaacctttagattacagttttggtttccctctgtggtcaagggtgtcgatttattggcacaagaaatggcgcctcccagaagattggaagattgcaaacacagcaaatacataagatagctagctatacttgaaccgatagatcgttcataaacttgcttgaggattctaatcgcttgctcctcaagcttttgtacaaaacagtcatcctaaacatgcttcagtgatatatcttttttttggcgtgtgcatgtgtctgtaacttctcttggaaaaagaagtgtgtttcagataactgtattgataattggtatgaccatactctgtcgtttatgccaggacagcaaggtgcatcttgtcatgtttttttttgtttatcattaaacaagcatcaatagaggcttccctatgtccagcatcgtgacttcatcttctagactagatcacatttgtttggaaaccaaacttatataaatccagtgagtgatttaaaaaaaancaaaaaaaaaaaaaaaa

SEQ ID NO: 9074 - DNA, 897 bp, Zea mays
ttgggtacctcgaggccggccgcggctcggggcacaatttcaaatcgaagtcttcctacacccagcgacgaaaaggctgcgacaattcgaatcaaaaatccatccgagtcgaatcgagccagcggaaactccgcggccgatctcctgtgctctcaccgcccgcctcccccgattctgcagcccctcgctgcgaatctggacgcgatttcgaggctagggtttgggaggctccggatcgcgagcccgtgcggaggcaagggtttggattcgggggttgctgctgcatgtcgggggtgctggattgagctactccgcgccggcttgtgatggtggtgaccggcggtggaagacgagtagacggcggcggtgagtagggtttgttgactgagttggggtcgagggtgcgccggccatggtgcggcttctcgggctgcggagcctgagcttcggcccggaggactcgccgcgggagatcccctccactgccgacgtggccccgcccgttggcagcagcggctggctcgtgcgcttcttcgactccgccttcttctgcgagtggattgccgtcagctatctctacaagcacgaccatgctggagtgcgcgactacctctgcaaccgcatgtacacgctcccgctgccggggctcgaggcctacctcttccaggtctgctacatgctcgtccacaagcccagcccttccctcgaccgcttcgtcatcgacacctgcgccaagtcgctccgcatcgcgctcaaggtgcactggctcctcgctgcaaagcttgagctgggagatgctgacgatctcgacgggatcgataaggtgcaggagcagtgcccagttgcagcgaccgtgcagggcgagtgggccacgcttgtccgggctttcactcatcc

SEQ ID NO: 9075 - DNA, 1822 bp, Zea mays
cattgggtacctcgaggccccccgcgggcccgccctgtgcctgcagctgcaccctgcagcgctcactcgctcactgactcactcccctcccctggcctcctcctcctcctcctctctctctctccactatctcccacagccgaaccaacatgcaggggcgcagcagggacgccgccaccgtcgctgcagcggtggcgtgcgcagctgtgctgctcctcggcgacgcctggaccgtctcggcgcaggcggcggcggaggaggacaagataagcgccttgccggggcagccaccggtgggcttcgcacagtactccggttacatcccggtggacgccgcggggaagcgctccctcttctactacttcgccgaggcggaggcggatccggcggccaagccgctcgtgctctggctcaatggagggcctgggtgctcatccgtgggagtgggggcgttctcagagaatgggccgttcaggcctagcggcaatgcgctaacgaggaacgagtacagctggaacaaagaggccaatatgctgtatctggagagccctgcaggggttggcttttcatactccactgatcctgccttctacgagggtgttggtgacagcatgacagccagagacaacttgaagttcttgcaaggctggttcgccaggttccctcagtacaagggcagggacctgtatatcacaggagagagctacgctggccactacgttccacagttagcccagcgcatggttgagttcaacaagaaggagaagctattcaacctgaaaggcattgctcttggcaaccctgtgctggagttctccaccgacttcaactcgcgggcggagttcttctggtcgcacggcctgatatcggactccacctacaacatcttcacgacggtgtgcaactactcgcggtacgtgagcgagtactaccgcggctccctgagcacggcctgcgacagggtgatgagccaggtggcgagggagacgagcaggttcgtcgacaagtacgacgtcaccctggacgtctgcatctcgtcggtgctcatgcagtcccaggtcctcgtccctcagcaagggagcagggagctggacgtgtgcgtggaggacgagacgatgcggtacctgaaccggaaggacgtgcagcaggccatgcacgcgcgcctcgacggcgtgcagaggtggacggtctgcagcagcgttctggagtacaagcagctggacctccagatcccgaccgtgaacaccgtgggcgcgctcgtgaaggcgggcatccccgcgctggtgtacagcggcgaccaggactcggtgatcccgctgacgggcagcaggacgctggtggggcggctggcggccaggctccggctcaacgccacggcgccgtaccgggcctggttccaggggaagcaggtgggcgggtggacgcaggtgttcggcggcggcgcgctgtccttcgccacggtgcgcggcgcgtcccacgaggcgcccttctcgcagcccgagcgctcgctcggcctcttcagggcgttcctcgccggacagcagctgccggaatcgttccagtgacgacggaacgtgcctcttccacgtctagtgtatgttcattgtaagcgtatgtacgtgcagctgaccgtctgtcgtcatcatccggccgctcgacactggcaaaacaacccaaatgggttcttctccaagtgtaatcaggacgaaaataatatcattggaacttggaagggatgagactgtgtgtcgtcggctttccatgttgtaggcttgtagtacaagtgtaatatgcatatgctggttcaaaaaaaaaaaaaaaa

SEQ ID NO: 9076 - DNA, 2413 bp, Zea mays
ctttattttagtcctgtggatctaaacatgcccttagcgtgacagttctttgaaatagcagttcttgtgggggtgcgagcggcaaatacagcgccggctcttggtttccaagtggccccctacgtggaaccttctgagacggctatcctacgtgtacgctagcctccaaacttcaaagcgcgtctctgcagggctcgcacgtgctctttttccctcctcaccccgaattaacaatcgcgaaatcccaggtttgacctttcccccagccttgttgttccagtggggcccactacacccatgtccccttcttcctcgcacacgcgggacactgcacctgagcctctcaagccctcaacacgccaatttgaccacgtgaccgtaatcttgatccacggcctccttgcacttgcaccgcaccggtgcctatttaacccgcgctcgaacaactctctgccggcaacgcaaccaaaccgctctcgctctcggctctcggctctccaccagtctccgctctctggacgccggaaatgcagatggactcctacaactacaactacgccagtttcttccacgacgaggctccgtccttctacccgcacgttgcggtgccgccctccccggagctgcccatcggcctcattgcctcgccaggggagccggagccgcccttcgcgccgccgatgccggcctcgttccaggactacacgggcgccgtgggcgtgggcgtaggggtgagagcgccgttcgggggtgccagcgtgcacgggcaggcgatcgacgcgctgggcgggggcgacgggcagcgcgagcagagcatggcaatggcggaggacggggaagagccggcgccccggcggcggcagccggcgggaggccccgccgccgccgccgtcgagagcagccgcgggttccggcacatgatgcgggagcggcagcggcgcgagaagctgagccagagctacgccgacctgcacgcgctggtggcggcccggtccaggggcgacaagaactccatcgtgcaggccgccgccgtgtacatccacgagctcaggggcgcgcgggaccagctgcagcgccggaacgaggagctcaaggcccgcatcctgggccacgacgccgggcagcagtgcgtcaaggtgcagttcgaggtggacgagccggcgtccgccatcgactccatgatcggggcgctcaggcgcctcaagggcatggacgtcagggccaggggcatccgctccagcctggccgggcgcaggctgtggacggagatgaatgtggagaccacggtgagcagcactctcgccatcctcgttgaatcgtccttgtgctttgctgacaatgactgatccacttcaaaattaaccgcaacatgtcagcgccctcgaaagaatcattgtcaatggacaatggggtgtgccacttgttagttgttagttactcgatcgacgcaacactggagctaaaccacgcggttcctcttgtcgtcctgggtttgcagatggcggccgacgaggtggaaaggggcgtggaggaggctctgctgcaggaagtggagaggaagcagcagcagcagcttggagctgggagcgccgcccctggttttccaggcccgtcatcgcacgtgcaaaacgtgttttgacacgcgatcctcccccacaacaagaagccaaaaagaaacatgaaccccgagcctcatttcttgattctttttttttaagaaccggatgcgcaaaacgagcatccgcgtccctggctctattgatttgtttttaagtagaaatcggtgctgtttgtgtacaagtgttgtcgcagcctccaagtgagattttgagcacgtgtataaagttctagggctcgtgttcttacaacacacacacacacaaaaaaaaagagacgtgcggacagtgaggactgaggacatgtgggcagggatcaagtgggccggaggaagcgggcgagaaatggggtcgagggacaggcacgttccggtcgtgccgtgtggagattcctagccgcggcggcaaccggtcaccagtgtgctctcgttgtccttggtctctactactcctgctacaaatggtgacgcctttattttatcgtgtggagtggatgtaaatggacgccaccccaataaatcagagtcctaaattaattttagtttaaaaataaataaataaaaatagagtatgattcttatcctattcactcttaaattttataatataaaacctagagtccattaccaccctatcggcattaggaggaaggggtgcaaccagcctcgcctgtcagcgtcatgcttaattgactggagcagaatatttttttttgtttgcattagccgcttcctagaaatttcacgtgagttagctggttagagttggcctctgaattatatggctgcaggcatgca

SEQ ID NO: 9077 - DNA, 1842 bp, Zea mays
ttccaagtacgtggaaccttctgagacggctatcctacgtgtacgctagcctccaaacttcaaagcgcgtctctgcagggctcgcacgtgctctttttccctcctcaccccgaattaacaatcgcgaaatcccaggtttgacctttcccccagccttgttgttccagtgggacccactacacccatgtcccttcttcctcgcacacgcgggacactgcacctgatcctctcaagccctcaacacgccaatttgaccacgtgaccgtaatcttgatccacgccctccttgcacttgcaccgcaccggtgcctatttaacccgcgctcgaacaactctctgccggcaacgcaaccaaaccgctctcgctctcggctctcggctctccaccagtctccgctctctggacgccggaaatgcagatggactcctacaactacaactacgccagtttcttccacgacgaggctccgtccttctacccgcacgttgcggtgccgccctccccggagctgcccatcggcctcattgcctcgccaggggagccggagccgcccttcgcgccgccgatgccggcctcgttccaggactacacgggcgccgtgggcgtgggcgtaggggtgagagcgccgttcgggggtgccagcgtgcacgggcaggcgatcgacgcgctgggcgggggcgacgggcagcgcgagcagagcatggcaatggcggaggacggggaagagccggcgccccggcggcggcagccggcgggaggccccgccgccgccgccgtcgagagcagccgcgggttccggcacatgatgcgggagcggcagcggcgcgagaagctgagccagagctacgccgacctgcacgcgctggtggcggcccggtccaggggcgacaagaactccatcgtgcaggccgccgccgtgtacatccacgagctgaggggcgcgcgggaccagctgcagcgccggaacgaggagctcaaggcccgcatcctgggccacgacgccgggcagcagtgcgtcaaggtgcagttcgaggtggacgagccggcgtccgccatcgactccatgatcggggcgctcaggcgcctcaagggcatggacgtcagggccaggggcatccgctccagcctgtccgggcgcaggctgtggacggagatgaatgtggagaccacgatggcggccgacgaggtggaaaggggcgtggaggaggctctgctgcaggaagtggagaggaagcagcagcagcagcttggagctgggagcgccgcccctggttttccaggcccgtcatcgcacgtgcaaaacgtgttttgacacgcgatcctcccccacaacaagaagccaaaaagaaacatgaaccccgagcctcatttcttgattctttttttttaagaaccggatgcgcaaaacgagcatccgcgtccctggctctattgatttgtttttaagtagaaatcggtgctgtttgtgtacaagtgttgtcgcagcctccaagtgggattttgagcacgtgtataaagttatagggctcgtgttcttccaacaaaaaaaaaaaaaaaaaaaagccagaaaaaaaaaaaaaaaaaaatcaaaaaaacaaaaaaaaaacaaaaaaaaaaaaaaaaaaataacaaatcaaaaaaaattaaaacatacaaaaaaaaaaaaaaacaaaaaaaaaaaaaaaaaaaccaacaaaagaaaaaaaaaaaaaaaagggggggccccccaaaaggttccaactttatttaccctgaaaggcaggtttaaacccctccaaaagggcccccaaatttcaattcaggggccgtcttttaaaaaagtccgcctgggaaaaacccgg

SEQ ID NO: 9078 - DNA, 5000 bp, Zea mays
aattcggcacgaggcgcccctaccttggaataagtaagaggtttcaagaacaagcatagaaacttagaaccaaaaaagatactgggtaggccttgaccacacacctaatacaacattaactactggcccaaaccctgaacttgacctaagactcatacagtttgctcccgcgaaataccagttatgacatttcagtttcgaagaagtgggagagctgtctgtagattgggttggatcttgtcaaagaccattgcattcctgtgcttccaaagtgcctagaataatcacgaattgagtttttataactttctgttgcagatgggtaaacccaaataagtacatgggaactctgagtgcacacaagggagggtttgttcagccatctccacgactccacctgatctggatcacattgaataggaattacacgccctcgccgcagcggcggggctgcgcttcatccataggcttgagaaacatgaccacatcatttgcataaaggggaattcattgcttttgtagatcattagccaaaggatgaaggagcccaaactcaccagccttagagaagatgctattaagaacgtccatgattagaatgaaaaacataagtgggagggggtctctatgatggatacctctcattgcttgatgtcagcttttgtcggtccattaagaatggttttagtggatgcagtcctaagtaatttagaaataatgttgcaccaaataggaacaaatcctaagtgagtcatcaccttcaggagaaactgccaggagacagagtcaaacactttcggcacattaattttagaaacagacttggagtcttttttttgtgaaggagcttgatcgattgctgcaccaggaccaggaggtagttatcatggatacatcttctgataaaagcattttggttggtagcaatcaaagaatctagatgtggggcgagcttgttagctagaactttcatgatcagtttagcaaaactatgaattaagctgattggacggaaatctttgggagtcattgcctcatctttcttttgggattaacgtgagataagtaggattcagtaaccaaagcttcgtagtattcttttgttgtaacatgatgatggcttccatgaagtccgatttaattgttggccaacatgccttgtagaaacgcctagtgaatccatctggacccagcgccccatcagcaggcaattcttttattgttgcccaaagctcttctgtcatgtccctagtcagctccaaaagattaactctttacctatgaaagatttccaggttcagagaggacgaccgttcggaaggactcccaagcagattattaaaataagagaacatgatatcttgtttctcatcatgcgttgttatccccctgccttcatgaaccaatttagctacaaagttttccctcttcctaaaaccagctgcctatgaaaggaggtattagcatctccatcttttaaatacctaatgcgtgagcgaagcctaacaatggttctctcaagagatgccagtactaagcagctctttttggcttctcttctcagcccttcacccacagaaatctgtctactgtcttgggctatttccaatttgtggagaatctttcttgcaatcccaagctgtgatttgacatggccaacttgtttctgccccttagattgaagaacacgggctaatctctttagcttgatcgaaattcgctccatgggacaaactgccactaccgattcattccacaaattcgccactgtttcgaggaagttaggcaaatccatccaaagttcaatcactgtttttctagaacattttttcagcaataaagattctctgtgtatgtctaaataaaactatagttgattggttacttatgagtcaggaaatatttggcacatttcagctgtaagttctttaaaaagcacacttctagaattcaatatcttcaatatcacaatggttgtgatatcacaatggctgtgtatgtagacagtttgatagcagaacttgtttaatgttacacttatatttcaaataactgtagtttgtgttgaagtgtataagtccattgtccaattcttcttgaaagcttaagtttttaagttgaactggttggtgtgtgcaacttaacatgatatcaaagtcataggtctcgagttcaaatcctgttagaagcaatttaagtccttgaccccttttatttctacgtttgcgcctctctctggatgcatgtgagtcacatttgtgtctctctggctgcacgtgagtgggtgtgttgaagtgtgtaagtgcattgcccatctcttcatgaaagctttaaactatttgattgaactggttagtgtgtggaacatgacagtttggaggctcagaatttccaaaacatctacgtttgtcttcattggcataatacatttctgttttaattcatggatggtctgctcataggtaccatttgtgtgcaaaatttcaaaaaactacatttgtgttcatacaataatcttctggaggaagtaatagtaatacccatgctgctctcaagattatagaagctgaataatggagatatgataatcttatttcttttttcgtcttagcatagctaagcaagcttcccagagtaaaggagtcggaacatgtatccttgaggttgtgggaaggcccaaggcctgtttgttttcctatggctttgtgaggggcggtttggcagttggtggcacttggcagtctggcgttttgtcagtctggcacttggcagtctggtgttttgtaaactgtcttgagtaggtggcacttggcagtctggcgttttgtagtgtagaccagtaggtagagttccgtaatattctctattaaaattttgaaagtttcaaataatttttgttagctttttaatactctaattaactttacttgtttgttattccattatcctgtttcagaaagaagtggtaagagtgtggttgaattgccacccgaactgtgcatagttgtcatgtcaccaatgtccgcaattactttgcgcagcttcacatttattccttctataatgtatcggatccagtgtatgctcctttctatgaatttgaaaatgcaattgggtccaagcatgcagcagtttgatattccagcactaaagattcgggaagcacttacaacaaagaattgccaagaggaattttcgcaggaatcattagagacacttggggactcttttctcaagtatattacaacccaacacttttttgtcaaatacaaacatcagcatgaaggcatgctaaccaagatgaagaaaaacgtgatctcgaatgcagctttatgtcagctggcttgcagtaacaatcttgtgggatacattcgaagcgaagctttcaatcctaaaacatggatcgttccaggggttggctatgacatatgtgataggagtctgaggaagctgaaaagtaagagaattgcggattcagttgaggccttaatcggggcgtatctcagtactgctggtgagcaggcagcatatattttcttaaaatctttaggaatggatatagagtttcacaaaatgccaattgagagggtaatcacaatcaaagcagaagagttcattaatgttaaaagtttggagctattgcttgactatagtttcaatgatccttcattgttgatggaagcactgacacatggttcatatcagattgctggcactactccatgttatcagcggctggagtttcttggggatgctgtattagatcatatttttactgattatttctaccatcagtaccctgaatgcactcctgaactgctgacagatctgagatctgcttctgtgaacaatagctgctatgctcatgcagcagtaaaagcaggattacataagcatgttcttcactcgtcatcagcactgcacaaaaggatggccgactacctggacaagtttgagcagtcattttcaggtccatcacatggttgggaagcaggcatcagtctgcccaaggttctaggtgatgtggttgaatctatcgctggtgcaatttacatcgacgccaagcatgacaaagggatcgtttggagaagcatgaaacggatactggaacctcttgtgacccccgacacccttcagaatgaccctgtgaaagagctccaggaattctgtgatagcaaaggttacactttggagtacacggtaactcgtgacaacggtgtatcctcggtggtcgcagaagtgcggaccgaagggactacgtacaaggccactcggacaggcttctctaagcttgacgccaaaaagttggcagccagttccgtgctccgtgatttgaaggctgcggacacaaagcagtactctgcaaatggtatcagttgcacttaaacttcatagctctatggtatatacttttgtacaaaatcgtcgaatcagtaaggtgtgcaggtgcctaggcacgctaccctacttttactgcatctacgtctacggccacactaaagcagtacgtgcagcaatgttttgttttggtcatgtctcttgagagtgaaagtgtagcgttatttttattttgattcgcatttttgggataggcctggtggtgcaccagggcaccaagcgagtatgtggtccgtagggtttttagattactcttgtttcgagatgattggattaaattcttgtagagctgattggatggttcaatatcttggtttttagaatggtcatacgagtcttaatcatatcgagagctataatttttatacacaaagtattttttttatctaacactataaaaattgatttataatattttttagcttcttaacaaccttaaataaaaaaacttgaaactataaagttttagatcaaaagctacaattaagccttagtgctgaaatgttgatattggtgtaagcgctaaggccattccaaacctcaaaatttatattttggcgccttgcgtctactacgttggcctcttgaggtggctgcgagtg

SEQ ID NO: 9079 - DNA, 840 bp, Zea mays
gcacgagcaaagttcaacgattcacacgctttggaactagaacaactgctgttggaaacctcctggtgaaatctcaccctattaataccatgctgatgagccaatagcagacccatcacacactaatcaacaagcaggaccagctagctagctcctcccactgctatcacccgggccccggccagccatctcgctgaaagagaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggcttcttatatccgtgtctaatctcgcaagtgctcgtgtttgcaactataccatttataatgtcaacttatcatgcttgtcattcgattcaaaaaaaaaaaacaaat

SEQ ID NO: 9080 - DNA, 1986 bp, Zea mays
cgattcggcacgacgagagagagagagaagagaacacaaatggaaggcaaggcataagcaaaatcccatctgctggtatcagcacctcaattcagaatgtacctctggtatcttctgatggctggagctccatgctagcagatcttcctttattaagtgatccaaagaaaagcctagccacttcttctctattgcacattgctcctagtaaacagactgaagtggtgccaaacactgggactgcattaagcatggcagagacagtgatgcaagctcctctgagaatttccattgggcctgagttatcgaccgaggctcagaagattgaagaaagaaccttgaagcagcttactctaagacctattacacctccagcaagcaaatcttctgctcttagttctttgaaaataaaaggtacaaggcttggagatcatcctactggtcctagtaagacctcacaactattaaaaatacagtcagccaacacttcttctagagctccagttaaagcagatgtttcaaagctctctcagccaggaagcttccaagttctcagtcgagagcaaaacggtactgcacacaccgccaaagactgccctgtgaaacctgtgagtcctccaactcctttggcgtcgctggaaacacagaaaaaaacagtggcgagccaaaagttgaagtttggcaccaatgagagtcttctgcccctgcaaggtccatctcgtgacagaaagtcaaatgcaagagacaaggttagattctttgagatgctacggaccaagtcttcaaatggttcaagcactgcctttgagccaggaagccaaccatccccatccagcttagttgatgtgaagcaggattcttctcttaatcttggaaatgacttccacgtgttctgttctgagatcaaatgcacggagcacaggaggtgtttctgtgaagaagcaaattcttctgatgggtctcagaggcacctatctgataccgaggagcacattgcatccttgaaactgagcgttatgggtggaatgcctcagcagcctctagttgaaaggagagaagctaactcatcatctgaacctgcggacacaggtgatgaaggatttcagtcgttcctatcggacagcgcagaagtcagtttgtcctcaacacttgcagattcagatgatggatggaatagatcccaatctggcaatgaggaagcaagttcattatcagaggatactgaatcagatgatgatttccatccagctgacatttctccagaagataagcgtttcatgatgttgcttggttggaaagaagatgaaatagtgcaagtgacacctttggatttcgacgagattgcagacacggtaaaaggctgtgaggaactcaagaagaagcttcagtctatgcagttcaatgaagaagtcaagagcattctcctccatattgagctggacgagaagcagcagcagcagcacaagagtacaggggactaaagataattggaacacccgaggccggccatgttgggacgctgagaatcatttttggcatgagtttttgtcttggatcgttagcaaggcgatatattttttcctatattgccgcgtgtccaacagttagggatttagtgctcacagataggtctgacatgtttttcgcacaccgaaaggagctttggttttccctgtgtaagtccgatcttggaatcatgctgccacatgcctttgtttgctgttaaaaacatgggttttggcatgaaaatgcatctcaaaaggttaattcatgaaaagacgtctcaaaaggttaatcagaagaaagcccctatgttgatttgttgcacgaggaagtgtaattcttttctacgagacagtcacgaatagaaaatagatttcctaataggaacaagatttgctaaatcaacaatccgtccacggctcatatgttacagtatggtgcactctcatgaatgaatgacagaaatgtgtggaaagaacccgc

SEQ ID NO: 9081 - DNA, 1235 bp, Zea mays
attgggaccctcgaggccggccgggagcagcaagctaccagtacactgatgactggtcgagagagccagctgatcgatcgagttacccttagttattagacagacatggcttcgttccggaccagctggcattgcttgctcgccgcctgcctgttcctgctcgcttcggcggcgcacgggcagcagctctcgtcgtccttctacgcggcgacatgcccgacgctggagctcatcgtgcggaccaccatgctcacggcgctcctcgccgagcgtcggatgggcgcgtccctcgtcaggctcttcttccacgactgctttgtccaaggctgcgacggctccattcttctggacgacgtcggcagcttcgtcggcgagaagggcgccggccccaacgtcaactctctccgcggcttcgacgtgatcgaccagatcaaggccaacgtcgagctcatctgccccggcgttgtctcctgcgccgacattgtcgccctcgccgcgcgagacggcaccttcttgctcggaggaccaagttgggcggtgccgctgggccggcgcgactcgaccacggcgagcctggccctggccaacagcgacctgccgtcgccggtctccggcctcgccgctctcctcgcagcgttcggcaacaagggcctgggccccggggacctgacggcgctctcgggcgcgcacaccatcggcttctcgcagtgccagaacttccgcgcccacatctacaacgacaccgacatcgacccggcgttcgccagcctgcgccagcgcacctgccccgccgcgccgggcaccggggacagcagcctggcgccgctcgacgtgcagacgcagctcgtcttcgacaacgcctactaccgcaacctgctggccaagcgcggcctgctgcgctccgaccaggcgctcttcaacggcggctcccaggacgcgctggtgcgccagtacagtgccaacccggccctcttcgcctcagacttcgccaacgccatgataaagatgggcaacatcagcccgctcaccggaaccgcgggccagatcagggcaaactgtagggtggtcaacagcagctgaaacgtgacatatagcaccatcagtattgagtgcgaacgtactactggggggtgtataaatatgtaacaagcacatccaaagatactgtttgctacttcggttcttccagggattacattttccggccgcaattttgggaaaccgttttgttgacc

SEQ ID NO: 9082 - DNA, 2946 bp, Zea mays
tcactttggacgggtcgccggcacgggccagccgggaagcacgctgtgacaccgacacggcgacacgtcgtcgcgataagaacgacgagggcgagggacgcgccatggcacggcacgccgcacgcaagcacgcgcctgagtcctcgcagggtcgcagctgacgagccgggcccagccggtccgacagcgaccgggcgagcccgagccgaggcgaaaccgcgggcacggcggggagccgtgggcgcgccaaccgttccgcggccggccgtgcggggcccgcgccatccacgtctagaactagaaggcctggctggccgcctgatccgttcccttcgccccttcggcgcgcggcgtctatataagcacggggccgaggaccccgagtgacacacagacacagacacggacacagcaaccaacaagtcgtccaacgtccaggcttttctgttttgtttctctctcacgcaagtcgcaaagcaaagcgtcccccaccatggcttccacgacgacgacggcatccaacaacctggcgggcgtgtggctcggcgagctctcgtcggcgctgcatgggacgtggcaggcggtggccgtggccgccacccacgggctcggcgaggacgacgacccgcggctgccgtgccagcagcagcagaggccgtggcgaggcgacgacaggagcagcagcaacaacaaggcgttgcgaggagccgcggcggccgggacggacaggcgggagggggacgtcgcgaggtgcggcggcgccatgtccgacaccacgctctacctcctcctcgaccggttcgcgcccagctgagcgggccccttgctcacccgccgctgccgccgccgccgccgcgatcgatcggcgcgtgctgtactgtacaggcggaataactgcacgtctgcacgccatggtttctgtaaataaatgctgtatataaactgcaatggcatcttgtgttgctttctgaaaaaaaaaaaaaaaaaaagcgactcttgtcgctaattcgcaccgtgagcaaagacagtaaatttcagtatggactggaacgaggagcaaatgagcaatgcgccactgaatgcaattcgaatctttacagtttagggaacccaaaacgtaaagaaacgtcgaaacccacagaaatccgaatccaaatccgtgctaagttttgagtccatgctaaatttttgaaatacagtataatctgctagagagagccatctgaacgcttggtcgcgtcaacggacaactataccggcatagccacgtacattttacttacggcgaagctctagctgttttgtagggctagtttaaacaaggtctttctttaaaaaacacacacaaccatctgcattatcatagcatgcaagtgcaagttttcatctaccaatgatcaacggttattactcgtaaatcggaagacagctacagaaaaaaaaatcttaaaaaatctctaagtgacaaccctattttttcgagggcttttcatttttttcctaaagaaaattagtttatttttccttaaaaaataagaatcccttaaaaataaagttatcaaactagacctacaattttttccgcaagtttgcagacgcacaggatttacttttaggcccacggttgaagatgacgcatctcaataatggacatctcccagcaaaagtgcaaaacacctcaaagacagatgacgcatctcccagcaaaatatctcagcaatggagcaaagcatccttcccatggtatggtctctcttgacactgatggcgaaccagacaatatataccagaagtaaccagcatacaagccgatggtctggcagacttaacttcgcgccagcctaataatgcatcaaacgcaagcttccctcttttcttttttctagaatcagaatgggccggggcgtctccaccattctactttgcaaaaacaactgaacagccacacaagacggacgatctgcgacgggacggatgggggtacagctctaagagagcgtgctggggaggaaagaaatgcacagatatttacacctcttcttctgcacacgacgaaggaaggtcaggcagtgaaggagctcggctcctcgctgtagactgtctcgctggcaccgaacacgggcttctcctcctcccacttgacgacctcccgcccgtagcggatcgccgaccggacggactcctggtccagagcgttcacgtacgacacgtagagcttccgccccgtcatcgactcgaacagcctcttgaacttggtcgccatgtagtgcgcagccatctggggcagtgtcgcgccggtgctgctgcgcgcagtcctgcggccgccgccgccgccgccgttgaggaggttgcggctgatcaggggagtgaagtcgctgaaccagtcgcacgaggtcagcggggaactgctgatcttctgctctaggagatcgaacttggtgaggagcagaaggaagtctgcttgctcgaatgtcggatggagggtgatgctctcgaacagctgcctgctctctaccatcttgttgacaatggtaccgtttgcatcttcgtagaactcatcgtagtcgctagcagcaacacagaagataacaagccttacgtcatcaaacatttgcagccatttgcagttcccatgcaaacctctactgtttatcctgatcaattggtaccttagcaaagtgtcttgtgcatcgggctcatcaacacccagtccacccaaagacagctgagggaaagagaattcagttgatgctaccccatctgaggatgtaatcccatcagcatacagtatatccatatctgacagctcatattccgttcgagatatatcaacagccttgtcaagaaaataacttgcagcaggtggaaggaatggcagttcacttcttctatatgtagcttgaatagcaggatctttccgtcgtgcatcaacaagtggtgcatatt

SEQ ID NO: 9083 - DNA, 834 bp, Zea mays
cccctgacgagccgggcccagccggtccgacagcgaccgggcgagcccgagccgaggcgaaaccgcgggcacggcggggagccgtgggcgcgccaaccgttccgcggccggccgtgcggggcccgcgccatccacgtctagaactagaaggcctggctggccgcctgatccgttcccttcgccccttcggcgcgcggcgtctatataagctcccccccgcggccgccgcgggacccacagacacagacagacacagcaaccaacaagtcgtccaacgtccaggcttttctgttttctttctctcacgcaagtcgcaaagcgtcccccaccatggcttccacgacaacggcggcgtccaacaacctggcgggcgtgtggctcggcgagctctcgtcggcgctgcatgggacgtggcaggcggtggccgtggccgccacccacgggctcggcgaggacgacgacccgcggctgccgtgccagcagcagcagaggccgtggcgaggcgacgacaggagcagcagcaacaccaaggcgttgcgaggagccgcggcggccgggacagtcaggcgggagggggacgtcgcgaggtgcggcggcgccatgtccgacaccacgctctacctcctcctcgaccggttcgcgcccagctgagcgggccccttgctagctcgcccgccgccgccgcgatcgatcggcgcgtgctgtactgtacaggcggaataactgcacgccatggtttctgtaaataaatgctgtaaactgcaatggcatcttgtgttgctttctgaattctgattgctcagctacccattcttttcgctggcccctagggcc

SEQ ID NO: 9084 - DNA, 914 bp, Zea mays
  misc_feature (897)..(897): n is a, c, g, or t
  misc_feature (900)..(900): n is a, c, g, or t
cccagcaaaatatttcagcaatggaacaaagcatccttcccatggtatttttttttttttttttgatggcgaaccagacaatatataccagaagtaaccagcatacaagccgatggtctggcagacttaacttcgcgccagcctaataatgcatcaaacgcaagcaacccacaatacaatttacaagaatcagaatgggccgggtcgtctccaccattctactttgcaaaaacaactgaacagccacacaagacggacgatctgcgacgggacggatgggggtacagctctaaggctctaaaaaagcgtgctggggaggaaagaaatgcacaaatatttacacctttttttttgcacacgacgaaggaaggtcaggcaatgaaggagctcggctcctcgctgtaaaccgtctcgctggcgccgaacacgggcttttcctcctcccacttgacgacctcccgcccgtagcggatcgccgaccggacggactcctggtccaaagcgttcacgtacgacacgtaaagcttccgccccgtcatcgactcgaacagccttttgaacttggtcgccatgtagtgcgcggccatctggggcagcgtcgcgccggtgctgttgcgcgcggtcctgcggccgccgttgccgccgccgttgaggaggttgcggctgatcaggggagtgaagtcgctgaaccagtcgcacgaggtcagcggggaactgctgatcttctgctctaggagatcgaacttggtgaggagcagaaggaagtctgcttgctcgaatgtcggatggagggtgatgctctcgaacagctgcgtgctctctaccatcttgttgccaccggtaccgtccgcatcttcgtagaactcatagtagtcgataacagcaaccagaagatancgnacgcgtggtcggcc

SEQ ID NO: 9085 - DNA, 1824 bp, Zea mays
  misc_feature (1778)..(1779): n is a, c, g, or t
cctcgaccggccgggcactgggtccgtcgctccgacactccccttcggcctctcctctcctttcagttctttctcgccactccgtttgcccgttcacgctcccctctccctctcccacctcctgttcttcgtcttcgtggagactactgagatggccgtcgacaagcaggcggacgccaaggagagggagaagatcgacgccgttcgcaagctgctgcgcaagcaggcgccgctctccataaagcaggcgcagtactgcgacgacgcgtgcgtggagcggttcctgcggtggcgcggggagagcgtcaagaaggcggcgaagcacctgaggaccgtcctgtcatggagggagaccgtcggagctgaccacatcatggccgacgagttctccgccgagctcgccgacggcgtggcgttcgtctccggccacgacgacgacgggcgcccggtagtggtgtttcgaatcaagcaggaataccccaagttccgctcgccgaaatcgttcgtgcgcctgctggtgttgacactggaggtggccgtggcgtgcatgtcccggtccgtgcaccagctcgtcctcctcttcgatgcaagctttttccgatcggcgtcggctttcctcaacctgctcatgggcacgctcaagatcgtcgccgactactaccccggccgcctccaccgcgccttcgtcatcgacgcgccctccctcttctccgtcctctggaagggagtgaggccgttcgtggagctggcgccggcgacggcggtggtgtgctccctggacttcgaggactcgctggaggacgcctccttcacggcgtacccgcggaccgcgtccctgcggttcgagccgccgccggcggtggtcacggggaaggccggcgtggggtcggcctcgtcgcggttctccgtcacccccaccgacaaccccgtcaagccgtggtacctctgcaccatccccgcctcggtgggctcccgctccgtggtgcccacctccagcagcagcccgtcgctggtcggcgcgtccccgctctccgcgcgctccttctccttcgcctcgcccgccgcgctgcgctccacgccgttcccgcgcggcgggggcgcccccccgacgccttcctccgccgtcacgggccacaagatcccgccgccgccgcagttcccgcggacgccgcggccgtcgttcctgcagtcgccgtcgacgctgttcgcgttccggaaggacgggcagcagaccagccgcgtggagcgcgagcgcgggtccttcctcccgtacctccgcttctaccgccgcccctacgacgagatttcctaccgcgccatgatgcgcccgccgctcggcggcctgatacccatcgtcgagaagttcaagcacaagccggtgcagcagacgctgcgtcgacacgctgggctccaccagcatcagcagcagcagcaccaccattaccaacagcagcagaggatctgagtctcgtctctcagtcggtactgcatggcgacccgagaattttctccatacagcataaaggcgatgctatattatgctaagttaatcttttgccaagtatgatattcttaaaggcatgtataataacatcccaaaaaaatgtgagtaaaatggactcctttctgcgaaaaaaaaaaaaaaagcgaccccaggtcagtcgggactacccgctgagtttaagcatataaataagcggaggagaagaaacttacgaggattcccctagtaacggcgagcgaaccgggagcagcccagcttgggaaatcggggcggnnctcgccgccccgaattgtagtcctggagagggcgtcctcagcgac

SEQ ID NO: 9086 - DNA, 1622 bp, Zea mays
gccggccgggccggggctccgacactgcccccccttcggcctttcctctcagtcctctctcgccactccgcctcgccgtccacacccccctctccgtgaaaattgctgagatggccatcgacaaggtggacgccaaggagagggagaagatcgaggccgttcgcaagctgctgtgcaagcaggcgccgctctccgcgaagcaggcgcagtactgcaacgacgcgtgcttggagcggttcctgcggtcgcggggggacagcgtcaagaaggcggcgaagcacctgaggacggtcctctcatggagggagagcgtcggagctgatcacatcatggccgacgagttctccgccgagctcgccgacggcgtggccttcgtctccggccacgacgacgacggccgcccagttgtggtgtttcgaatcaagcaggactaccccaagttccactctcagaaatcgttcgtgcgcctgctggtgttcacgctggaggtggccatggcgtgcatgtcccggttcgtggaccagttcgtcgtcctcttcgacgcaagctttttccgctcggcgtcggctttcctcaacctactcatgggcacgctcaagatcgtcgccgactactaccccggccgcctccaccgcgccttcgtcatcgacccgccctccctcttctccgtcctctggaagggggtgcggccgttcgtggagctggcgccagcgacggcggtggtgtgctccctggacttcgaggactcgctcgaggacgcgtctttcacggcgtacccgcggaccgcgtcgctgcggttcgagccggcggccgtcgtggggaagaacccgggcgtggggtcggtctcgtcgcggttctccgtcacccccaccgacaaccccatcaagccgtggtacctctccaccatccccacctcggtgggctcccgctccgtggtgcccacctccagcagcccgtcgctggtcggcgcgtccccgctctccgcgcgctccttctccttcgcctcgcccgccacgctgcgctccacggtcgccacgcctgcgccgttcccgcgcggcgcgggcgcgcccctgacgccgtcctccgccgccaaggcccagaagaccccgccgccgccgcagcagttcccgcggacgccgcgcccgtcgttcctgcagtcgccgtcgatgctgttcgcgttccggaaggacgggcaggccagccgcgtggagcgcgagcgcgagtccttcctcccgtacctgcgcttctaccgccggccctacgacgagatttcctaccgcgccaagatgcgcccgccgctcggcggcctcatatccatcgtcggcgacaagttcaggcagaagccggtgccgcagccgcagccgcagccgctgcgtcgccacgctgggctccacctccaccaccagcaccattaccagcagcagcagaggatctgattctcgtctcgtcgctgcatggcgaccagagaatttttctccatacaccatagatccgatgctatattatgccaagttaatcttttgccaactttttttcccctccagtgcttagtgcctatgatattcttgaagccatgtataataacatcccgaaaaatgtgagtaaaatcgacccctttctgc

SEQ ID NO: 9087 - DNA, 7563 bp, Zea mays
  misc_feature (6887)..(6887): n is a, c, g, or t
gtactagctagtatctataataaatagttgatttttaagtgtaagcagtatttttttttatataaatctagtaaaactcaaaataatttacttagaacaagtctagaagctgatttatttttgggcaaagaaagttttctcctctatttcatacaatgaaattcgttttagttaatcaatgaattcatacaatattgatgggatgtgtttttttatatgttgaatatagacataaaaataaagagagctaaaacgagtaataatttggaatagatggagtaacttttagcagatcgaggaagaatcccttctacatataataaacgagtgtctagcacattttctaatgtatatataacacggttcacgtttggagtaatatgttgcaactactattttcttcgcaatacaaatgcacgtggtcctccactcctccggtgtatttgatttgacaaaaaaaatgtgggaatgcctccagcgtgatcaatgatttgaaaatattttttaagaaaaaaaacataattttgccatgacatgctatttgatgtgattagcattactatatgtttcatctattattgtactgacatatagtactagtcgaaaaatacgaaatgctacaccatggaaatgagaaattaatattattggcattccagaaagaactgtaggggcagatgattgtaccaggtgtgaagaagagacgggatgggagcccaatgtgaggaggaacgaagacaatttcgttggcaatttgttaagtggcgggctcaggctcagcccaccctccatgttccatggctcgctgctctctgattgcttcatccatccattaactccccccctcctttattgtgcatgcatgctttcctcctttataacccctgccgcgctagctgtctctccaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacgcagaccgtgctggacgagctcaccgggtacgcggagcccgggtcgctgaccgcgctcatggggccctcggggtccggcaagtccaccctgctcgacgccctcgccggccgcctcgccgccaacgccttcctctccggcaacgtgctcctcaacggccgcaaggccaagctctccttcggcgccgcggtatgtgtaaatatccattacgcatatatacacctgtgacctgacctaagctaagcctgcttcctcttccccacatgagctaagcttgcttacctagatcatgcactactctcaagctcaaccgggaaaagaaaattagaatcatggatcactcttctatttttgagcaccaaacactccgtattgctacttccgtcagatcatccatatatagcaggtagaagtacggttaagtgttttcttaggtaaggatctgtgttgaagttcgttggaaactatcatccataactggcatctcagcgcaacacgcgaatcgtatttgaagggatcgggatctgggcatccggtaatctgtttgatgccagtaataaaacgcccgttgccaattaatgggtgtgccttttggtctatgtttttccaaaagaagtatggctcactttttaaaattatataaaagatgttttgatttttgtagacgcagtagtttttatccaaactgtctagcgtactgtatgtctaagcgcatatagtaaaacaaatatatttttttaaaaaaagtgaatataagcgagaacgaagccagtatatgcggccggatcatcactatactcatttaatgacttaactagtactctcattctgtttttttaagacctagtactatacaggcatacagctacactttgaccactaatgctataagcagaggggcgaggggctttacttcacgtcgggcagttagtaggcgctaggatacccgtccaatccaatcgattcgggtcgtttttttcgcatccgtccgagatgtcgaaagcacgggtacgcgtagagattaggtgcatggatttaatgcaattcgccagccatcggtgcgcctctccacttccagttcatccaaaacccaaaaaaaaaactctggtgccgatacagcgagaacggctgaagccacctacctacacagcataaatactgacagctggatttgctctctgatcctgctgcgaatttatggtgatacgaaccatccggctgtggcctgtctcactctcacgtctcaccagcagttatacggaacggaacggaacgtgatcctgcaggcgcaaacgcgtagcagctccctgttgggaggaagtgcggtatttgtgtagttctgaaacaatactgtgttatttgatgactatattattgaaactcttatatttgatgataattatatttaatgatactatagttttaaaaatatccttatcatttttgaaacaataatatgattttactgtggtaaagtaataccataatatttgtatcatgtacgattataaactatggtatatcaaaactacgacactcctttcttgaagcagcgagatgtgcgtttgttgtaacagaacgtagtagtatggctagtaccggagaagactactgatccatccagaggcgtggttgcaggcgtacgtgacgcaggacgacaacctgatcgggacgctgacggtgcgcgagacgatcggctactcggcgctgctgcggctgccggacaagatgccgcgggaggacaagcgcgcgctggtggagggcaccatcgtcgagatggggctgcaggactgcgccgacaccgtcatcggcaactggcacctccgcggggtcagcggcggcgagaagcgccgcgtcagcatcgcgctcgagctactcatgcgcccgcgcctcctcttcctcgacgagcccaccagcggcctcgacaggtgagcgccctgcctcctcttcactgtcgctggcgtggtcgtgtctgcgttcttgtatgtatgtgcgtgtgcttgcttggcttgcagctcgtctgcgttcttcgtgacgcagacgctgcggggcctggcgagggacggcaggacggtgattgcttccatccaccagcccagcagcgaggtgttcgagctcttcgacatgctcttcctgctatccgggggcaagaccgtctacttcggacaagcatcgcaagcatgcgaggttgtgtagtagtaattctgtctgttttcctttttttcttctaaaaggaacgcatgcataacacagcctgtctgactcagtactccttgcttgtttgcagttctttgctcaagccggtttcccttgcccggctctgcggaatccgtccgaccatttcctgaggtgcgtcaactcggacttcgacaaggtgaaggccacccttaaaggatcgatgaaagcaagggtacgtaagaagaagaagaagcatgtgtccatgggcaaatcagaaccaataaataaaggataaaatgacgtttaattggtgttcatgaacaggtcgagaggtccgacgatccacttgacaggatgaccacatcggaggccatcaggaagttggttgcatcctacagcaggtcccagtactactacgccgcaagggagaaagtaaatgacatctcgcgaatggtacgtaggcgttctggctcatcaaacagaacactaatacatagtactccgtccgttgtatctgtttcctgcgtccacataataaactctgcaatgttgcagaaaggaaccgtgctggattccggtggcagccaggccagcttcctgatgcaggcctgcaccctgaccaagcgctccttcatcaacatgtcgcgggactttgggtactactggctcaggctcctcatctacctcctcgtcaccgtttgcatcggcacgatctacctggacgtcggcaccaaatacacatccatcctggtaattaagtaggaggttacgggctggagtggacttgacatgaacgcagtcacatggctgctttttttaatgctttcgctctacaccttgcctctgcaggccagggctgcctgttccgcgttcgtctttgggttcgttacgttcatgtccattggaggattcccttcgttcgttgaagaaatgaaggtgtgcatttaagacggggtgtgattttcatttcattcgcagctaaacgctagctgtgagtttcgcttcatttttttttcttttcttcttcttatacaggtcttccagcgggaacggctgaacgggcactgcggggtcgcggcgtttgtcatcagcaacaccatctcggccacgccgttcctgattctgatatgcttcttgtcgggaaccatatgctacttcatggtgcgcctccatcctggcttcgagcactacatcttcttcgtcttgaacctgtacgccagcgttacggtggtcgagagcttgatgatggcgattgccagtgtcattcccaatttcctcatgggtatcatcataggggccgggattcaggtatggcatttccacccgattcggtttatgtaaaaaacatgaaacatttccattcagatatatcaggcccgccccatgcatcctgaacaaacgtaaaaagagaaggaaaaaatgttatcttttgaactcggttgttaaggctgcttttagatgtggcataaggtgacacagccatgtgatatttaagatgaattcatgagcctaaagaacctccatagttgatgcggttttctgttctgggaccagcagacatcaaaggacttgaacatctattttgatccaacaaggcatccagcttgtgtgtgtgaccaacattatttggagtgttggccaacattctagcgcaagctcagcatatacattactggcgattcaatgttttaaagttgtgttctccttgaaaagattgtggcttttggaatttatcatgatgagatcttctcaacaattttcctggacagggaatattcatgctggtctctggctacttcagacttccatacgacatcccgaagcccttttggagataccccatgcagtacatcagcttccacttcgcggccctgcaggtaaactcggttccactcccacacagtggagcaagagcaacccacgacacttaaactccatgcgtgtaaaacagggccagtgccagaacgacatgaagggcctcgtgttcgacaaccagtacccggaccaacccaagatccccggggacttcatcctcaagtacatcttccagatcaacgtggaccgttccaagtggatcgacctgtcggtcattttcagcatgatcttcatctaccgcatcctcttcttcctcatgatcaagatcaacgaggacgcgctgccgtggatccgcggccacatcgcgaggaagaggatgcagaagaagggccctacccccaccatgggcaagacgccttcgctgagaggctacgtcgtcgatccggagctcggttccaacgagggctagaggtcgtgcttgttcttttgggtagcggaaaaaaaatagggtgtttctcccccccggctcttggtgttatattgtatatttaagatcaggggataaaaaaactggtatcacacgttttggaaccgaagctaatttgagtacaggtatacatacatgcatgtaatgtgagcgaagtggcatcggagagatcgatgccgagtgacacatgcatgactcgttgttcagaatttattgccttcgacttcgacagacgaacaagtggttggagcactaattaaagcggccgggtaccggctcgcatggccgtgtattattatcacattgatttcgattgcttgctgcttacataaatcagtactactaggtattggcaggattgtaaatgccccatatataaagtgtaaactaacaaataggatccgtgccgtactgcttgtgattaggtagattgacaagtttcaaacattccacatggattcattcaagtcgtgtctgtaataatcgaccagttcttcttcaggatcgtcaaccctaattggtgcaacaaccggtctacgtttccaaagccacctttggagaacttaaaggtatggaaacagaggcgtcggtcagataatattcattttagcccctagatgccatggccgtacgtgggagatgagaggcacagtacagataccatgtggtatgtgggcagatgatacagtcacttgacttctgaaaatcggtatctcgaacagcgtaattggaattttagtattataatccgttgaactttggaatttcggtatctgagtaagatttagccggcgctcaactcgttgttacgtcatagaacggatccacggccccggcgctcgactgggctccccgacgctctccctcccgagccctatccacgcccgtgcaggagcggcggccgcgctcgtctgctcctctccctggtgcttctctgcccggctcctgtcttctctgcccggctcctgtctgcgcttctctgcccagcggacggcgcgcctctccctggtgctcggcggcgcgcaaagcgtcgttcatgatccatcactccatcagacacaaaacgcagtccagtcatatacggaatacggctcnaacttccagtgtaccgacgaaatgatacagcatgcgtatcacctgcatatatctagctttccttattgtttttactttgctggacgaagttatgtgctgtctgatgcatcatgccctgtgactgtcgtcaagtcaaaagtagtggctggcctctaatttccagaaatatgaatctgcaattaacctaggcaaacccaaacaataaatccgatgtattgttgcaccttactttcagtttcagctgttagcaccatactttctctagttgcaactggactctttttttttatgtgtgcagtgaaaggctggcagataaactgcccagcttgtttcactacactacaggagaaagtcactggacagcatgactaaaccactgaacactaaaatctgatagctggtttctttcttagttactgggagtgctatatgcgattagataggaacagatatcagaacactgaaagatgcacatatttgcactagtcactcgatgaatttcaaattgttgttgtaaaaaaattggaatcagacactgaaaatccacgatgtgccatactgtgctatagatggccataaagcacgaggcccacgagcccggcacgaagcccactgtttgggctcggtccgagcccggcccggcacgaataagcgggccgagctcggacaggaaact

SEQ ID NO: 9088 - DNA, 2738 bp, Zea mays
caatttgttaagtggcgggctcaggctcagcccaccctccatgttccatggctcgctgctctctgattgcttcatccatccattaactccccccctcctttattgtgcatgcatgctttcctcctttataacccctgccgcgctagctgtctctccaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggcgctgggccccggcaagacgcagaccgtgctggacgagctcaccgggtacgcggagcccgggtcgctgaccgcgctcatggggccctcggggtccggcaagtccaccctgctcgacgccctcgccggccgcctcgccgccaacgccttcctctccggcaacgtgctcctcaacggccgcaaggccaagctctccttcggcgccgcggcgtacgtgacgcaggacgacaacctgatcgggacgctgacggtgcgcgagacgatcggctactcggcgctgctgcggctgccggacaagatgccgcgggaggacaagcgcgcgctggtggagggcaccatcgtcgagatggggctgcaggactgcgccgacaccgtcatcggcaactggcacctccgcggggtcagcggcggcgagaagcgccgcgtcagcatcgcgctcgagctactcatgcgcccgcgcctcctcttcctcgacgagcccaccagcggcctcgacagctcgtctgcgttcttcgtgacgcagacgctgcggggcctggccagggacggcaggacggtgattgcttccatccaccagcccagcagcgaggtgttcgagctcttcgacatgctcttcctgctatccgggggcaagaccgtctacttcggacaagcatcgcaagcatgcgagttctttgctcaagccggtttcccttgcccggctctgcggaatccgtccgaccatttcctgaggtgcgtcaactcggacttcgacaaggtgaaggccaccctgaaaggatcgatgaaagcaagggtcgagaggtccgacgatccacttgacaggatgaccacatcggaggccatcaggaagttggttgcatcctacagcaggtcccagtactactacgccgcaagggagaaagtaaatgacatctcgcgaatgaaaggaaccgtgctggattccggtggcagccaggccagcttcctgatgcaggcctgcaccctgaccaagcgctccttcatcaacatgtcgcgggactttgggtactactggctcaggctcctcatctacctcctcgtcaccgtttgcatcggcacgatctacctggacgtcggcaccaaatacacatccatcctggccagggctgcctgttccgcgttcgtctttgggttcgttacgttcatgtccattggaggattcccttcgttcgttgaagaaatgaaggtcttccagcgggaacggctgaacgggcactacggtgtcgcggcgtttgtcatcagcaacaccatctcggcaacgccgttcctgattctgatatgcttcttgtcgggaaccatatgctacttcatggtgcgcctccatcctggcttcgagcactacatcttcttcgtcttgaacctgtacgccagcgttacggtggtcgagagcttgatgatggcgattgccagtgtcattcccaatttcctcatgggtatcatcataggggccgggattcagggaatattcatgctggtctctggctacttcagacttccatacgacatcccgaagcccttttggagataccccatgcagtacatcagcttccactactgggcactgcagggccagtgccagaacgacatgaagggcctcgtgttcgacaaccagtacccggaccaacccaagatccccggggacttcatcctcaagtacatcttccagatcaacgtggaccgttccaagtggatcgacctgtcggtcattttcagcatgatcttcatctaccgcatcctcttcttcctcatgatcaagatcaacgaggacgcgctgccgtggatccgcggccacatcgcgaggaagaggatgcagaagaagggccctacccccaccatgggcaagacgccttcgctgagaggctacgtcgtcgatccggagctcggttccaacgagggctagaggtcgtgcttgttcttttgggtagcggaaaaaaaatagggtgtttctcccccccggctcttggtgttatattgtatatttaagatcaggggataaaaaaactggtatcacacgttttggaaccgaagctaatttgagtacaggtatacatacatgcatgaaaaaagagcgaagtggcatcggagagatcgatgccgagtgacacatgcatgactcgttgttcagaatttattgccttcgacttcggcagaaaaaaaaaaaaaaaaaaaaaaaaaag

SEQ ID NO: 9089 - DNA, 1162 bp, Zea mays
aggctgatcgttttttccttgagaaatgatcctctgaccctcatcccccagacggccagaccccagtgcactctatcccctcagctatggcgacaaccgtcacgcccgcctccccgttccgcgactacctccaccgccgccgcgtccgcctccacgccaagccgcacccgcattcccagcgccgcctatcacgcaccgcgcggctacgctatgctccggacggtggcggcgctgaggtctcgggccctcccgcttccgcggccgtcgaggagcaaacgccgcaggaacggccggaggacttcatgctcctggctgccaaccgcagcgaattcaacgagatcatcatggtcatcgactcgcccgtcgcgcggtacctcgtcctcgaccacaacaagaatatccacagcattctccccaaaacaaccgtttggaccaactcgtactgggatgagtttgtgagcctgccagctattgttccacggggccctgttgcactactaggtttgggtgctgggacatcagcacatctgatgctaaagttttggccttggttacaacttattggctgggagatcgaccctatgataattgaattgtcaagggattattttggtatgtctgatttagagaaggccacagaatcaggtggttcacttttggtgcgcattggtgacgcactttctccatcagcaacagtcgaaggaggatttgctggaattgttgtagatttgttttgtgatggaaaggtcatacctcagctacaagaagccaaaacttggttgcaaattgcaaaaaggctaatgccagacggtcgaatcatggtaaattgtggtggatcagacactgaagaatctctctcatcgccttgggttcaaaaccctacagttaaagcactttgttccgcatttcctggacaggtaagctggaagagactatcggagaaagagagtgtaaactatgttgccctgactggacctctcccagacctggacgggtggtcggcgtcggttcctagtgagctaagcacgaatagggccggccctaagcctatgctagagaggcgacggccgggggcctaaaattcttaggggcccaatatttagtatatataacactatataatatatcaatttacactttacaaacaaaaaaaaaaaaaaaa

SEQ ID NO: 9090 - DNA, 1958 bp, Zea mays
accttacctttttactcctccagtccagtcagagaacaccataagtggccgctacacctgctcactccattgcaccactagcaagtagcaacaggagcgcaggcagaactagagcggtcttggtatggcttcttccctcgcgcccgcgtcgtgggcactgccgctgcagatggtcggggctggggcggcagcggcggggccttcctgccgcgcgacgctagccgtcgtcacggagccccgctgggccgcgtcgctgcgccgggcaagggttctcgtggcgctggcgccccggtgcgtggcgctcgacgggcccggcgccagcggcgaggaggaggcgcccaagatcgaggacgagaggaagaagagcggtgagacgaagaagccggcgcgcggccggccggtgtggagccggatcctcttcgcctccaagaagacacgaagtatcatcatcctcaacgccctcacggtcatctatgcaagtgatattccggttttgaaagaggtcgaagccctgacagagcctgcggtcttcaacatggtgcggttcgttgttgcagccatccccttcgtaccattcgcgctccgttccttcggtgaccgcagtgtacgctacgcgggactggagctgggagtctgggttagcttagcttacctttctcaagcaattggattgctctcatctgatgctggccgagcatccttcatcacggccttcacggtcgtagttgtgcctctaattgatggtcttcttggtgcttcgatccccagactcacatggttcggagccatcatgtctctgttcggaattggcctgctggaatgtggtggatctcctcccagtgttggcgatattttgaacttcttcagtgccgtgtttttcgggatccatatgcttagaacagaacaaatatcaaggagtacggacaagaagaaatttttagctcttcttggcttcgaggtccttgtggttgctttctcctccgttctctggtttatgttcaaagatggctacgttgataccagcggatccagctttgaatcttggacgttcgggatgctctgggataccacagtttcgtttccttggataccagcattgtacactggggttctttctacggtgttatgcatgtgggcagagatggtggcgatgggcgatgtttcagcaaccgaaactgcagttgtttacgggttggagccagtttggggagctgcttttgcttggttcctccttggtgaaagatgggatgacgctgcatggactggagctgctctcgtattatgtggcagtttgacagttcagctatttgggtcagctcctgagaagtccaagaaagtcaaaaaacgcagcagcaatgctttagaaactccagtgaaacgacgagactacttatcgttgtctcccataccagttgattccgggaagatcataggaaggcaattagaaaggaagaacaaagcagtataggtagcccaactacaaggcaagaagaaaggaaacgctgcgatgataggggcgcgcatgtaccaaatcattgtcctgaggcatcgtctgtttggctccgtcaatggccatatggggatgctgctcgattgtccgcatggagttttttttttcctttgtccgtattgaaaatggtcgtatttggatttctgttgtctcggttgaccgtgctagagtacctcatgcgtattaggaaatgaggcattggtagtggcaactcgaggagaatacttagacacatctactggcgtagtaatgacgttcagtgagataacttagtatgttttgggcactgctaaccgtaaaggttcatgtattaatatagtgggtaaatggttctagagtactgaactgagcataccattgtatagtactgaaataacaaataccacgcatggtattatttggctcccagtcaatagatccaggaatcagggcaaaaaaaaaaaaaaaa

SEQ ID NO: 9091 - DNA, 2218 bp, Zea mays
  misc_feature (29)..(29): n is a, c, g, or t
gggtcgcccagcgtccgggtttaccgtgnaaacagttgacccatagtccaattatatttcagagaacgaaagcaacatgttttgcttatggccaaacaggtagtggcaagacgtacacaatgcaacctttgcctctgagagctgcacaagacatggttcgtctattgcaccaacctgtctatcggaatcagaattttaagttgtggcttagctattttgaaatatatggtgggaaactatttgatcttctatctgacagaaggcaactactgatgagggaagatggcaagaaacaagtttgcattgttggtctacaggaatttgaggtgtctgatgtacagatcgtaaaggaatatattgaaagaggaaatgcagctagaagcacagggtcaacaggggccaatgaggaatcatcaaggtcacatgctattctacaactggctgtgaagaagcatatcattgtaaaagataccaggagacagagagatcgtgatgctaatgaagctaaaaatacaaaggctgtggggaaaatatcatttattgaccttgctggaagtgagcgtggtgctgatactaccgataatgatagacaaacaaggattgagggagcagagataaataaaagtctgttagctctcaaggaatgcattcgagcacttgataatgatcagatacacattcctttcagaggaagcaagcttactgaggtccttcgtgactcatttgttggtaactctaggacagtgatgatttcttgcatttctccaaacgcaggttcatgtgaacacacactaaatacattgagatacgctgatagggtcaaaagtctttccaagggcggaaatacaagaaaagagcagtccacaggaccaactaccacttctagccgggattctttgtcagctttatcatattcattgcctgctgaagctgaagaaattcctaatcaagttcaagagaagagaccagtcgatacttataggaagggcactgaaaattttatctccaacccttctgtggagtctgaccgaaattcctttagtacgattccaaattattccaatagagggagagaagaaaatggtgcagcatctggtaatgacagggagagctatgatttgaagtccagccaacctgcttacactagtaagccacagttggttcagaattcagcaaacacacaggaggaggagaaagtcacaaaagtctcacctcctcggagaaaggcttatagagaagacaaatctgataggcagagcaactatatgaaaaaggataatggtcctgagacaagtcgggttgggtataagatgcagcaggcaaagcagctgcaacagcaacaaagaccagcatctgcttcagcctcatcaaggcaatctgaaaaggaaagttcttgtgatgatgtagaaattgatgcaattcttgaggaagaggaggccctcattgcagttcacaggaaggagatcgagaatactatggagattgtgcgggaagagatgaaccttttggcagaggttgatcaaccaggcagcctgattgacaactacgtgacacaactgagctttctgctgtcacgcaaggctgcaggtttggtaagcctccaatcacacttggcacggtttcagcaccgcctcaaagagcaagagatccttagccgcaagaaaccttccagatagtatgctcaacaatggctctggattttgcctggaaatcttattgcttggagctcaatcgcagtctattagttggttttctcctgtgcgctccagtaaatgttagacccaagcaaagcagtgatagagaggacacatgggagttgcttgagggtgtggtgatcttgatgttgaggatggtgtggtcctggttgatgtctccactttgtgtttgtcagggttgacaaccagtttggtagtagtcctttttacagtggggctgcttgggtgtttttttttggcagatgtcatgtatggcttgcccactttgcctttttttttcttttccccattttgtacgagaaactggaatgtctggaatgttgtttgcagacaccggtgggtcgatattcaccgagggggtctgtggaaaccgatacattgttgtatactagtcggttgaccgtgcgttacaacggcttacaacaatatccacgtaaactattcataaaaaatttttaagattttttaaaaaaaaaaaaaaaaaaaaaaaaaaaggccccgcc

SEQ ID NO: 9092 - DNA, 1031 bp, Zea mays
aggccctcattgcagttcacaggaaggagatcgagaattccggcgcgagggtgcgggaagagatgaaccttttggcagaggttgatcaaccaggcagcctgattgacaactacgtgacacaactgagctttctgctgtcacgcaaggctgcaggtttggtcagcctccaatcacacttggcacggtttcagcaccgcctcaaagagcaagagatccttagccgcaagaaaccttccagatagtatgctcaacaatggctctggattttgcctggaaatcttattgcttggagctcaatcgcagtctattagttggttttctcctgtgcgctccagtaaatgttagacccaagcaaagcagtgatagagaggacacatgggagttgcttgagggtgtggtgatcttgatgttgaggatggtgtggtcctggttgctgtctccactttgtgtttgtcagggttgacaaccagtttggtagtagtcctttttacagtggggctgcttgggtgttttttttggcagatgtatggcttgcccactttgcctttctttcttttccccattttgtacgagaaactggaatgttgtttgcagacaccggtgggtcgatattcaccgaggggtctgtggaaaccgatacattgttgtatattcgttaatgatattatttgcattgaggaagaaaaaagatggataaaaaaaaaaaaaaaaaaaaaaaaaaaaaaaaaaaaaaaaaaaaaaaaaaaaaaaaaaaaaaaaaaataactaaaaaaaaaaaaaaaaaaaagaaaaaatcacacaacggaaaaatcaaaaaaatggaacattaaaaaaacaatgacatttaaataaaaaagaaaaaccatagccaaaaaaaaagaaaaaactcctggaggtgacggggggggggattaaaaaaacagagaaaaaccttttcttgcaaaaaaaagaatatatttgcccaccacccgagggagaatttatcttggtgcgggggatggcccatatatggggggggccaccaagagccc

SEQ ID NO: 9093 - DNA, 752 bp, Zea mays
tcgcagcccctgcgcccgtccgctgcagggggccccgagggcccacgcgtccggcaacgagccatggcctccggtggcccgaaacccaaactggcctacatcatcttgtacgtgagggacgtggagaaggccgcctccttctacgacgccgccttcggctacaccgtccgccgcctcgaccagtcccgcaagtgggcggagctggagagcggggcgacgaccatcgcgttcacgccgctgcaccagcgggagacggacgagctgtcgggggcggtgcagctgccggactcgtcggccgccgggaggggctccgtggaggtctgcttcgcctacgcggacgtcgacgcggcgtacaagcgcgccgtggacaacggggcggtggccgtgagcgcgccggaggacaagccctggggccagaagtccggcttcgtgcgggacatggacggcaacatcgtgcgcatcgcgagctacgtgcgagagtagtcgcattccgctgcatcaccatcgatcaatcgatcagcctttcccatgcatgtctcgtatactacacgtttacacgtgtaccaaaaaaataaatataatcgttgtgcaggtcatgtttgtcttgggaggtaaggaccgtggaagatgtaaatggaaccgtggagcagtgaatacaaaaggcgctatctcgtccctgtttccattgatctgtacaattaatgaatagggacttcgaaatccgtgtcttagttcttatatttcttcaaata

SEQ ID NO: 9094 - DNA, 903 bp, Zea mays
  misc_feature (1)..(1): n is a, c, g, or t
  misc_feature (70)..(70): n is a, c, g, or t
  misc_feature (79)..(79): n is a, c, g, or t
  misc_feature (100)..(100): n is a, c, g, or t
ngcggagctccacgcggtggcgggcgctctagacttagtgatcccccggctggcagggattcgcacgagnaccattacntagaacatcttattcgaaaanctggactctggactggagggcaccaagctaacatttagttgcaaaggagcgctaggaagaagaagcaacgagccatggcctccggtggcccgaaacccaaactggcctacatcatcttgtacgtgagggacgtggagaaggccgcctccttctacgacgccgccttcggctacaccgtccgccgcctcgaccagtcccgcaagtgggcggagctggagagcggggcgacgaccatcgcgttcacgccgctgcaccagcgggagacggacgagctgtcgggggcggtgcagctgccggactcgtcggccgccgggaggggctccgtagaggtctgcttcgcctacgcggacgtcgacgcggcgtacaagcgcgccgtggacaacggggccgtggccgtgagcgcgccggaggacaagccctggggccagaagtccggcttcgtgcgggacatggacggcaacatcgtgcgcatcgcgagctacgtgcgagagtagtcgcattccgctgcatcaccatcggtcgatcgatcagcctttcccatgcatgtctcgtatactacacgtctacacgtgtaccaaaaaaataaatataatcgttgtgcaggtcatgtttgtcttgggagaggtaggaccgtggaagatgtaaatggaaccgtggagcagtgaatacaaaaagcgccatctcgtccctgtttccaaaaaaaaaaaaaaaaaatctagagccgctcgacccccgcggggggcccggaacccatcccccctatatgagtcgtattaccgcgctcactgccgccggtttaacac

SEQ ID NO: 9095 - DNA, 1147 bp, Zea mays
ccggggtcccccggcccccgccggtcacactactcagccagcccgctctatctctttcctctatccaagccagaaaggtagaaaccccccggaaacaatttccggccatggcgaccgcagcccaccaggttgccgccaccttcctctcgtacctttccccctccactcaccacctcgccccttcctccgtctccctcgggacagcctctgtcctacccgtctcccttcgggtcgctggcacaggtggcccacggctcgcctaccgcctccggggccgccgcgtcggtgccgccgtcgcccagctccccaccacgcatccagaggtagtttctggggagaagaagatcagatggtcatcaagggctgtgcggtcttttgcgatggcagagctggaggcccggaagatgaggtaccctacgacaggcactgaggggctcctcatgggcattcttgttgaaggaactagtggtgcagcaaaacttttgcgggctaatggaatcacacttctcaaagtgcgtgaggaggcagcgaatgtgcttgggaaatcagaaatgttttactttagtcccatgcatccaccattgacagaagctgcacagcgagcccttgattgggctgtcaatgaaaaattgaaatcaggtgaggatggagaagtaaatgccaatcatttgctactggggatatggtcagatgacgagtcagctggtcataaaatcctgtattcgctcggatttgacgatgtgaaagccagtttactggccaaaacggctgacgaggaggctgcaatgagtcctagatagcaaagggagcacctaatctgttattcaacttacaagagatgtgttagggtcaaatacgatatttgtactctcgcgattgccatgccggtgcctgtaaaaacgttgcggtttgtttgccacggtgaatgcttgtgttcctttgtcagctggatttgtgatcagctcatagaaaaagaaaagaacttgtagggtccagtgggcctgacgagcccttcaaattttttgttcaatttgcagcctgaatcctaacaggcgagaatttcatctgaactgtgatattacacagaactcttggtttctagagactgattttagtccctccattttaaaaaaaattggttacaaga

SEQ ID NO: 9096 - DNA, 1226 bp, Zea mays
  misc_feature (1187)..(1187): n is a, c, g, or t
  misc_feature (1192)..(1193): n is a, c, g, or t
  misc_feature (1203)..(1203): n is a, c, g, or t
  misc_feature (1218)..(1218): n is a, c, g, or t
  misc_feature (1220)..(1221): n is a, c, g, or t
  misc_feature (1224)..(1224): n is a, c, g, or t
gggaccctcgaggccatcccaaatttctcgatcaaacatgctctattgccctgtatctatcctctatcgaagccggagaccccagaaagagtccgtaaacaactcccggccatggcgaccgcagaccgggtcgccgccaccttcctctcctctttccccactcaccatccccgccccttttcctccgtttccctcgtgacaaaccctgtcctacccgtctcccttcgggccgctgtcacaggtggcccacggctcgcctcccgtctccgggtccaccgcgtcggcgccgccgtcgcccagcttcccaccacgaatccggaggtagcttctggggagaagaagatcagatggtcatcaagggctgtgcggtcttttgcgatggcagagctggaggcccggaagatgaggtaccctaccacaggcaccgaggggctcctcatgggcattcttgttgaaggaactagtggcgcagcaaaacttttgcgtgctaatggaaccacacttctcaaagtgcgtgaggaggcagcgaatgttcttgggaaatcagaaatgttttactttagtcccatgcatccaccattgacagaagctgcacaacgagcccttgattgggctgtcaatgaaaaattgaaatcaggtgaggatggagaagtaaccgccaatcatttgctactggggatatggtcagataaagagtcggctggtcataaaatcctgtattcgcttggatttgacgatgagaaagccagtttactggccaaaacggctggtgaagaggctgcaatgagtcttagagagcaaggagagcacctaatttattcgtcaacttaagttggtattgtgcactagcttttatgcacttcttggtgcctcgagacgttgacctggagaggctgcctctacaaactttagaacttattatggagatatgctaggtcagatacgatatttgtactctcacgattgccgatgcctgtgaaaacgttgcgctttgtttgtcacggtgaatgcttgtgttcctttatcagctggatttgggaactgctcgtagaaaacaagtcaacaacaacaaaacttgtagggtccagtgggcctgacgagtccttaaaaaaatttgttcacttgcagccttaaatcctgccagtcgaggatttcctctgaggtccctggtctcccccgtccccctnttttnnttgtttgttnttgcgttataaaaantnnaantt

SEQ ID NO: 9097 - DNA, 1099 bp, Zea mays
ctcgaggccggccggggtcacactactcagcttggccacccgcgccggccgggatccaagccagaaaggcagaaaccccccggaaacaatttccggccatggcgaccgcagctcaggttgccgccaccttcctctcgttcctttcctcctccactcaccaccccgccccttcctccatctccctcgggacaacctctgttctacccgtctcccttcgggccgctggcacaggtggcccacggctcgcctaccgcctccggggccgccgcgtcggtgccgccgtcgcccagctccccaccacgcatccagaggtagtttctggggagaagaagatcagatggtcatcaagggctgtgcggtcttttgcgatggcagagctggaggcccggaagatgaggtaccctacgacaggcactgaggggctcctcatgggcattcttgttgaaggaactagtggtgcagcaaaacttttgcgggctaatggaatcacacttctcaaagtgcgtgaggaggcagcgaatgtgcttgggaaatcagaaatgttttactttagtcccatgcatccaccattgacagaagctgcacagcgagcccttgattgggctgtcaatgaaaaattgaaatcaggtgaggatggagaagtaaatgccaatcatttgctactggggatatggtcagatgacgagtcagctggtcataaaatcctgtattcgctcggatttgacgatgtgaaagccagtttactggccaaaacggctgacgaggaggctgcaatgagtcctagatagcaaagggagcacctaatctgttattcaacttacaagagatgtgttagggtcaacttacaagcgattgccatgcccggtgcctgtaaaaacgttgcggtttgtttgccacggtgaatgcttgtgttcctttctcagctggatttgtgatcagctcatagaaaaagaaaaaaaacttgtagggtccagtgggcctgacgagcccttcaaattttttgttcaatttgcagcctgaatcctaacaggcgagaatttcatgtgaactgtgatattacacagaactcttagtttctagagactaattttagtccttg

SEQ ID NO: 9098 - DNA, 1953 bp, Zea mays
aggccggccggggcaaccgtccgccccgcggggcaccgcgaaacgggtccaaatctcggacccgcaaacggacctcacccacccgttcctccatctccgccccttgccggcgatggcaccggcgccggcagcggcctcggcggggcggaagtctcatgtcaccgttctcctcctctacgtagtgtgcggcttgatcctgctgcttctcctcgcctcctactcgccccgcctccagccccacgcccacggccgcagcctccaccgccgcctcaagctccacccaaagagctccttaccatccgacgcttcctccggtgggaacggggggcaacagaagacgcagcaccaaaaccaccatgcggcctccttcgacccgaccatcgccgagctggagcgtcggctggacgacaaggagtgggagcgcgagcactacagcctcctccacggcggcgagccggatgaccatatgaaggagtgggaggagttcctcaaggaggaggaggacttcatcaacgacgacgaccgattcaacatcgccgaccgtatccgcgcgctcttccccaagatcgacgtcgccccgcaggacggattcgtctccctcgacgagctcaccgcctggaacctccagcaggccagggctgaccagcaccaccgctccgccagggagatggagctctacaacaagaacggcgatgagatagtctcattcgaagccttcaatgctctgcgccaagaatcccatggagagggcaatatgcttgggttcgaatggtggaaggaggatcatttcaatgcgtcagatgcaaacgctgatggtttccttgataaaactgagttcaatgatttccttaatccaagtgattcggataatcccaaaatcatcaatttgctctgcaaacaagaaataaggcagagggataaagatggtgatggaaagttaaactttgaagaatactttactgggctacatgaccatatacatggttatgatgacgagaatgcagatatttcccaaattgggaacataacagttgcgaaggatcggtttttcaaacttgacaaagataatgatgggtttatttcggagcatgaactagagcctgttcttgataagctctatctttctgaacgctattattctagacagcaagccatccatgctatttcagaggcagacaaagatcatgatgggaggctgactttggaagagatggttgagaacccctatgcattttatggcagtgtttatctcagcagcagcgacaacgacgacgaagactacttccacgacgaatttcgctgagaccaatattgttactatcctgacacacgcaaggaacacagctgacgagcatcaaggtgcgcacagaggttcggaacgtctagcatactatgtgtgatgcccgggctgggctgctgacagaatgggagagcttagagttacggccatggagtgaggaactagtttttagccgcttggttcttcaagttgtttgtgttaaatggaacgacgacagcatcctagtaccggccaggcccagcagtgatggatgttacgcggcaagttgagccacctttatctaggctgagctgcattggtctccatcctgatgttcctgcagcaggggaaatgtagttcaggagaacaatgagtggaggagcgtcatctctgtggcgagcggcttcagaaatctaacgggaacgtgttgtttggtgtccgaaatgtatgtgtgtgtgtgtatgctatgaattcaattatttctggcagaatgtcgcagtctagcgagctggcccatcccattgagaaacattccatcggctgcatgagtgcgccatggacgggagatggatgtgccgaattattggagggaaagggttcactttattcgtgcctagtcatcagtgtcatcagtacggaggttacagcgtatccacgtggtctgccacgtcatg

SEQ ID NO: 9099 - DNA, 2144 bp, Zea mays
gtccaggaaaagcactcccgctctcggaaagaaggcgccgctctagcagaaacagcacctgcgcagcggaaatcatactcctttcgactgttctcgtgccaaggcgatataagcaggaacgtgatcagccatcccaaagcagcgaagaaggaacccgtggtgtctgtcgagaaagagctggacagcagcgagctagctcctgctgtcgtgcctctgctggaacgagcggtttccgtggtatccagttcggacagcctgagtcagtgcgaggacgccgtgcacgaggtcgccagagcatgctcggcctgggacccgagcctcgtgaacctgctgtcgtgcgcctctttcatccaaggccttctcgaggtcacgctgacctccaaagacgacgccgtgctggagtcggccatgtcgatcatggggaagctggttctggggaacgaggtgatcagacagctcgtgctcaacgcggacccgcagctggaggttttcctgaggctcctgaggagcagcgagctgttcctcaaggcggccgtggtgctctacatgatgaagcctaaggccaagcagatgctgtccctggactgggtaccgctcgtgctgcacgtactggagtgcggcgacgaggtgcagtctctgttctccgtaagatgcgcccccaagatcgccgcgttctatttcctggaccagctgctcatggggttcgacgttgacagaaacgtcgagaacgcgaagcagatgatcgctctcggtgggctggacctgctgatcggcaggcttggcgctggcgacgctcgcgagagcaggcactgcatcgctctcctgaccacgtgcgttcaggccgatggcagctgcaggcactacttggctgatagtctgaagaaggagcctctcgttcagcttcttgctggaaatcagaggaagcccggggccgcgtcccttaacctgatgagtgaactcgtctgccttaacagaacaagcaaaatcgtggagttcgtcaaggagctgaagaacagcgggtgcttgaacacgatgcacgttctgctggtctacctccagcaggctcctctcgtccagcacccgctagcagctaccatgctactccagctcgatctcctgggtgatccttcgcagtacagcgtgtacagggaggaggcgatcgaggccatcgtagccgctctggagcacagctcgcagagcaggaaggtccaggaacagtgcgcccgagctctcctaatcttggcagggcggttctcgtcgtcaggagagcccgtagcagaagcgtggctgctaaagagagcgggcctagacgattccctctctgagtccttcaggagatcagaagtattcaaagacaagagtgttcgagcggtcagctacgtaggcccccccccccgacatgtttgcttgcactgatgatgacttaggaggaagagaagctagtggaagaacggcagaagaacctcgccttgatgctactgaagagcgggggcagaaggttcctcacggcgctgtcgagctgcatatccgatggaaccccgagcctcagccggtcgtgcctcgtcagcgtggcatggatgagcagctccctctcgccgctgcgcggatgcaacgacttccagcccctggcatgctccgtcctcgcgtctaagcttttggacagcttgagctacgacagagtcctggaggagagggtgctcgcttcgctgtcgcttctgaacgtcgtgagacacccagaatgcatggagaaggtcttcccgctgaagaaagaaaccatcgagtcactccaagatctcgcggaggtgacgtggactgcgaaggagctcctctttgcctgttgcagatgagatgcaagaccagatcgtcctcagcgatgaagaactagacaccagcatgtaattggaagtgattgttttgggagaagagtgatcgccactgctgtacacagattgtttcgtacttccgttgatatgtgaagccctacagatcctttccctcgtcatggactttggctttcgctgttgaattgaaacctgcacatggcttcctttcttcttcttgagggggcttgtttagattgccatgtatccatatcaatacacatccatgtgtattgtacgttaacacacaacacactatattga

SEQ ID NO: 9100 - DNA, 3847 bp, Zea mays
aattcggcacgaggcggagaccaaacttgccatgccagcgcagtagccagtccagtgaacacaacgcagcgcagagcagaaaagaaaagggccaggaagccaccaaaacctgatccttaactgccctccgaacgcaaactcctcccctcccccatccttccctgccatcctcgacgccacgccatctctctccctgccctgccctgccttgcgttgtcttggtcggtttcgtttcgatcccgctcctgaacaggacgtcagcggccgcgtgggggcagcgctgcctgcttcttcttgctcacgcgaagggaaggggtagccgatctcggcccgcgttgatccggttgcgggggcttgtctctcgcttggtcctccaccgcgccgcgccgcaccgtgaatcgacgaccggccacgatgttcgtcaagaagctcgtggagagggcctccaagaagcaacatatcggcagcatcagctcccttcgccccgagaacgtcagcccgcggctagccttccactacggcgtccctgcggacgccgccctccttgcctacgaccccgttctccacgtgctcgccgtcgccaccaggaatggacagatcaagctgttcggccgcgacaacacgcaggcgttgctccagtccccctcccctctcccttccaggttcttgcagtttgccgagggccaaggggttctgcttcaatgtcaatacccagaaccagatcgaggtttgggacattgatgcgaaaaaactctgttatctgcacccggctgaaaaggcgatcactgcattctctgtgctgcagaagaccttctacatatatgttggagatagttctggaagtgtgtccccattgaagcttgatttggctcagagatgtctagctgacctgccgtactggattccttttactgaatcttatggttccactaccagtgccggtaatgatgtggaagttgtatttgtttcaccccagcctttgtctgaatcgaacagggtgctcattatcttcagagatggggttatgagtttgtgggatattaaagctagcaaagcagtatccatatctggtaaaactacgcagcagcaatcacagaaggaggctaaaaatgtaacatcagcatgctgggtttgtgccaagggaagcaaaattgctatcggatacgataatggcgatttatacatttgggccattcctgaggttacaagtacacaaaattcctcatctatgggtggccagaatctacctattcagaggcttaacctaggatacaagctagacaagttgccaatagtctctttgcaatggatccctagcgatggaaaggcaggccgtttgtatatcaatggtttcaatgatcatggacacctatttcaggttctgattctgaatgaagagagtgagtcgcgaattgtaaagatggttttgcctatcgctgaatcttgccaaggaatggaacttgttacagggcttagtgacccaaataagcacagacaaagtgcccttgcactcttgttgaaatctggtcacatctgtttatatgatgattcagaaattgagcgctatctccttcactctcagtctagatccccccccacgcggccaaactgttcatatgtgaagcttccttatggtgattcaggcatcagtgttgcaaagttctatacaagtaaccctgcagcgttagcttctttggacgaggattatttttcatcagctaccaaatatccatgtctgttttcaatgaagggtaaaggtcagactttaacaagttttaccaacattcataagacccggaacctctatataactggacatctagatggaaccataagcttttgggatgcatcttgtcctcatttgctgcagatttttatgataaagcagcagaataaagacgatacatcaactggtaaccctatcacatcattacagtttgatatgtcctctagcattctattgtctggagaaaggagtggaatggtccatattatcacattcaaaaaggactccagcgacaacatattctcctttttaaatgcaaagcaaggagacaactatgatgtcagaagtataaagctcaaaggtgctgtaaccacaatgtcttctatctcaaaatcaaagcatttttgctgttgggacagaaaaaggaattgtatcagttatcaacgtagaagatgctacaatattatatcaagaaacagtttgagtgtcgactgccctggtggaatcgcctcttttgcaatttgaaatctatagccataatggatatgacaaggacattttgatattagcgatggaagattcatctatttttgttatcgaggaagaaacggggaaacttttgaaccccaacccagttcagacagacaaaccctctaaagccatccttctgcagatgttggagttatcgcccaatgacacaccagcagtttcagataaccaagatacagtatcgaaggaatcattgctgctactttgcactgaaaatgcgatccgtttgttttccttgggccacgcaattcagggcacaaagaagataatcaataagaagaaattgagcagctgttgttgtttcgcctctcttattcatagttcttctaatgacattggacttatactcgtcttctccaatgggaaacttgaaataagatccctgccagacttgtccttgttgaaggatgcctttttacgaggttttgtgtactcaagaaacttgaattcaagtagttccataacatgttcatctgatggagaagccatcttgattaatggagaagagacctattttttctctacgctctgccaggatgagatatacaggcacgtagacagcattagtacagtgtacagaaaagagaactcaaccagggaagactcttcttttgtagtgaaatctcctaaagaaaagaaaaagggtctgtttggaatgattatgaaagataacaaaggaagcaaatcaaaagaaagtgatgcaattggcagcgaacaatgtattgcaacgacttctgaagagctggcttcaatattttcatcaactaactttgctccgccatctgagggagggaacaggtcactacgagatgatgaaaatgccgagctggacataggtacatgctattatttttgctattacttgtgtagcagtatatacttatgtttatagtatatattttttgtctgaagatgatatcgacattgatgacaacccacagaagccaaaaggtccacatttccctggtctaagcaaagataaaatcagcaagggactccaaacccttaaaggaaagttgaagcccaagactgaagaaaagataagctcgggaaacaaaaaaactgaagatgaaacatcagtgagtcaagtcgatcagataaagatgaagtatggatatgcaaatacaacaaatgatgactcaaccagtgtcacaaaaatgattgggaacaagctgcaggaaaacatgaaaaagttggagggcattaaccttcgagctgccgatatggcgagcggcgcccagtcattctccacaatggcaaaagagctactccggacaacaaagaacgagaaggggacctcataatcacctacaccaatttcccctcctttgtatagttcgtcttttcctttttttttcatccctggatcgtggatctgacgatctggacctccccgttgtcagactctaaatagtgaatggagtgtaagtgactgaagtaccctttacatcttggtatagggtaacagcagggacttcacatagttattttttgccgcggcaaaaaaaaaaaaaaaatctacactcgaatgaggattgataccaaatatttgttataaagaaaggtgttttc

SEQ ID NO: 9101 - DNA, 1723 bp, Zea mays
ggcaaaaccaacagaacaggcctatgttcccatcgagtcgagtcgagacgagaccgtcctccgcccgagtctcgctcgctagctagggtttccaccaatggcggcgcccaccacctcccgccgcggccccggcggcgcgcgcaacatggacgacgagaacctaaccttcgagacctccccgggggtcgaggtcgtcagcagcttcgaccagatgggcatcaaggacgacctcctccgcggcatctacggctacggtttcgagaagccctccgccatccagcagcgcgccgtgctccccatcatcaacggccgcgacgtcatcgcgcaggcccagtccggtaccggcaagacgtccatgatctccctcaccgtctgccagatcgtcgacaccgccgtgcgcgaggtgcaggctttgattctctcgcctactagggagcttgcttcccaaacagagagagttatgctggctattggggaccacctcaacgtccaagtgcacgcttgcattggtggaaagagtattggtgaggacatcaggaggctcgagaatggggtgcatgtcgtctctggaactccaggcagagtctgtgatatgatcaagaggaggacactgcggaccagagccatcaagcttctagttctggatgaagctgatgagatgttgagtagaggctttaaggatcagatttacgatgtctacagatatctccctccagaacttcaggtggttttgatctctgcaactcttcctcatgagatcttggagatgactagtaagttcatgaccgaaccggttaggatccttgtgaagcgtgatgagctgaccctggagggcatcaaacaattctttgttgctgttgagaaagaggagtggaagtttgatacactttgtgatctttatgatacactcaccatcacccaagctgttattttctgcaatactaagagaaaggtggattggctcactgaaaaaatgcgtacaaataacttcaccgtatcagctatgcacggtgacatgccccaacaagaaagggatgccattatgggtgagttcaggtctggcgcaactcgtgtgctaataactacagatgtttgggctcgaggactggacgttcagcaggtttcacttgtcataaattatgatctcccaaataatcgtgagctttacatccatcgcattggtcgttctggtcgttttgggcgcaagggtgtggcgatcaatttcgtgcgcaaggatgacatccgtatactgagagatatagagcagtactacagcacacaaattgacgagatgccaatgaatgttgctgatcttatttgagcagcaagaggatcgggaggggagcttcttgtgttggcttgaggcccttggcgctagtgtggctgtggactggagcagatgggctttgtagttgggggtggagcagagattatttccgtttttgccatggcatgaactgtatatattttagctcgctccagctcatgtaacactttgttgctgcgtttgtgcttgggacacgaagacctgtgttgatggcttcgttagtgtgacactgatttggcgtcggatttttgtttgtcatctgtcattcctgtgctgatctgaattgctgtttgtttattattattattattacaattactatcaattattatggttgactggtattacaattactatcgtgcattatggtttaaaaaaaaaaaaaaaaagggcggc

SEQ ID NO: 9102 - DNA, 1943 bp, Zea mays
cattgggcccctcgaggccggaccacgcgtccacgcctcaccatcgcagaagcgcagtaggaagccggacaaagctacgcaaggagggagaaagcgtgtaaaccatggcgtcctccgcgttcctcaacgctctcgtcctccgatcgccatcaccgtcgctctcgtcctcgtctaaccgccgcagcaccggcgccttcgcgttcccgaacccaccgcgcttcccatgcctgcgttctgcgcgtcgactcgtccttgcgagggcggcggcagcgccggcgccgggcgatggccccgaggacgagtgggggccggagcccgagggcggttccgctgtcacgggggccgcggtggcggaggcgccggaggcgagagaggtcgcggagctcaaggcgcagctaaaggacgcgctgtacggcacggagcggggcctgcgggcgtccagcgagtcgcgagccaaagtgctggagctcatcacgcagctcgagacgcgcaaccccacgccggctcctacggaggcgcttacgctccttaacggcaagtggatcctcgcgtacacatcattttcccaactattcccactattggggtttggtaatctgcctcagctggtgaaggtggaggaaatatcacaaaccattgattctgagaacttcacagtgcaaaactgtatcaagttttcaggacctttggctacaacctcagttgccactaatgcaaaatttgaaattagaagccccaagcgtgtgcagatcaaatttgatgaagggattgttggtacaccacagttgaccgactccattgtgctaccagagaagtttgagttatttggacagaacatcgacctgagtccactgaaaggcatattttcttccatcgaaaatgcagcatcctcggttgcaaagaccatatctgagcagcctccgctcaaaataccgatcaggacaaacaatgctgaatcgtggttgcttacgacataccttgacgaagagctcaggatctccagaggcgatggcagcagcatctttgtgctgttcaaggagggaagtactcttctatactgagatccaaatcccgagtccatgatcgttgaagctgaaccgtgaagtagttatactgcttatgcttttctttcttatagtaatatgctccgtctcaaaataagtcaatttctagaatcacttaaagtcaaattatcttaagtttgaccaattttataggaaaggcaccatcgtctatgtctctatgacaccaaatgagtacattatgaaaaatattttatggtgcattagtgacactaattcagtgccatgctctttttatgaatttggtcaaacttaaaaatagtttgatttaagataactctgagaaattgatttattttgggacagagagaatgtttctgggttgtcttgtaaatacagttcttgtcattagagtatatgatgactaggaccggtttaatccgaattatataaactctctatatatcagcgaaccccttttttatagttaaaaaaaaaaaaaaaattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttaaagggaccaaatttacctcccgggggatggaaaggaaaaattttttttagggggcaccaaaaaaaaaaaaacggggcggggtttaaaaaaggggggaggggaaaaacccgggggtacccaaaaaaaaaggctttggaaaaaaacccctttttcccagggggggaaaaaagaaaaaggccccccccaaacccccttccaaaaaattggccaacccaaaggggaaaggggaccccccctttaacggccctataaagcggggggggggggggggtacccccaagggga

SEQ ID NO: 9103 - DNA, 1645 bp, Zea mays
ccggccgggctgatttatagttaatgagaaggctcttctcctctcgtcttcctctccccaacccgtcgagaccatccttcccttcttccctcctcgccagaggagagtctcgctagctagggtttccaccaatggcggcgcccaccacctcccgccgcggccccggcggcgcgcgcaacatggacgatgaaaacctcaccttcgagacctccccgggggtcgaggtcgtcagcagcttcgaccagatgggcatcaaggacgacctcctccgcggcatctacggctacggcttcgaaaagccctccgccatccagcagcgcgccgtcctccccatcatcaacggccgcgacgtcatcgcgcaggcccagtccggcaccggcaagacatccatgatctccctcaccgtatgccagatcgtcgacaccgccgtgcgcgaggtgcaggctttgattctctcgcctactagggagcttgcttcccaaacagagagagttatgctggctattggtgaccacctcaacgtccaagtacatgcttgcattggtggaaaaagtatcggtgaggatatcaggaggctcgagaatggggtgcatgttgtctcgggaactccaggcagagtctgtgatatgatcaagaggaggaccttgcgaacaagagccatcaagcttctagttctggatgaagctgatgagatgttgagtagaggttttaaggatcagatttatgatgtctacagatatctcccgccagaacttcaggtggttttgatctctgcaactcttcctcatgagatcttggagatgactagcaagttcatgacggaaccagttagaatccttgtaaagcgtgatgagctgaccctggagggcatcaaacaattttttgttgctgttgagaaagaggaatggaagtttgatactctttgtgatctttatgatacactcaccatcacacaagctgttattttctgcaatactaagagaaaggtggattggcttactgaaaaaatgcgcagcaataacttcacagtatcggctatgcacggtgacatgccccaacaagaaagggatgccattatgggcgagttcaggtccggcgcaactcgtgtgctaataactacggatgtttgggctcgaggactggacgtccagcaggtttcacttgtcataaattatgatctcccaaataatcgagagctttacatccatcgcattggtcgctctggtcgttttggacgcaagggtgtggcgatcaatttcgtgcgcaaggatgacatccgtatcctgagagatatagagcagtactacagcacgcaaattgatgagatgccaatgaatgttgctgatcttatttgagcaaccgctcctcgcaaggtttggcttggtgtggcggtgagaagtggacgagaggggctttgtaatctgagtggagcagagatttgtttgtttacttttttggtgacggcttgaactgtatgtatatatattttagcatgctccagctcatgtaacactttttgggagacctatgttggtggcttattgtgacaatgacacggagaactgtgctgctgtgaattgctgtttgattattattaattattatggttttggttggttgccaaaaaaaaaaaaaaaaagcggcc

SEQ ID NO: 9104 - DNA, 1383 bp, Zea mays
acttgtgaaatgagccaccagttagctcaaccaaccttttgtcagccctagtcaaattgtagttttctggcacggtcgcacggagggagtatcagtctaccacgctaaacaggaagccggagaaagcgtgtacagtaccggaatccagcaccatggcgggatcagcgttgctcaacgctctcgtcctccgcgcgccatccccgtcgctctcgtcctcgtctaaggtccgcagcgccggcgcctttgtgttctcgaacccaccgcgcttcccatccctgcgttctgagcgccgcgtcgcccttccgcgggcggcggcgggcggtgaccccgaggacgagtgggtgccggagcctgagggtgggtccgctgtcactgggaccgcggtggctgaggcgccggaggcgggagaggtcgcagagctcaaggcgcagctaaaggatgcgctgtacggcacagagcggggcctgcgggcgtccagcgagtcgcgggccaaggtgttggagctcatcacgcagctcgagacgcgcaaccccacgccggcgcctaccgaagcgctgacgctcctcaacggcaagtggatcctcgcgtacacatcattttcccaactgttcccactgttggagtttggaaagctgcctgcgctcgtgaaggtggaggaaatatcacagaccattgattccaagaacttcacagtgcaaaactgtatcaagttttcaggacctttggctacaacctcagtttccaccaatgcaaaatttgaaattagaagccccaagcgcgtgcagatcaaatttgatgaaggcattgttgggacaccacagttgaccgactccgttgtgctaccggagaagtttgaaatatttggacagaacatcgacctgagtccactgaaaggcatattttcttcgatcgaaaatgcagcatcctcggttgcaaagaccctatctggccagcctccactgaaaataccgatcagggcaaacaacgcagaatcgtggttgcttacgacctaccttgacgaagagctcaggatctccagaggcgacggcggcggcatctttgtgctgttcaaggagggaagtactcttctaaactgagatcgaaatcctggtcgttgaagatgaaccttggagtagttatactgcttatgctttccttttcttatagtagtatactccgtcccaaagtaagtcagtttctagaatcacataaagccaaactatcttaagttcgatcaattttatagaaaaggtaacgtcatctatgaagatatatttcatgacgtgttactgatactaattgagtgtctaaatattgtccaccaaaaaaaaaaaaaaaaagtatatccatctaaatacccattaccaaatttctgcatcatgc

SEQ ID NO: 9105 - DNA, 1804 bp, Zea mays
  misc_feature (16)..(16): n is a, c, g, or t
ctgcggtacggtccgnattccgggtcgcccacctccgcccgggcggctggccggccggggccccgcggggtaggtggaactccgcgccgtgtattaaaacattgggtccctcgaggccggccggggccgttctttctccctcagaccctcaccaaccaggcaaccaaaccttctccgatggccgcgcccgtgtcgcagccgccggtgtccgccagggcgtccacacggtttctcccccgcgggataggcgcgctcccggagtccgctcccacgtccctccggttatccgtcggccgccgtcgccgcgccgccagcctagaggtgaaggcatcgggaaatgtgttcgggaactacttccaggttgcaacctatggcgaatcccatggagggggtgttggttgcgttatcagtggctgcccacccagaattcctctcactgaggcagacatgcaagtagaactcgatagaagacgtccgggtcaaagtagaattacaaccccaagaaaggagactgatacatgcaaaattctatcagggacacatgatgggatgactactggtacaccaattcacgtctttgtcccaaacacagatcaaaggggtggtgattacagtgaaatgtctaaggcgtacagaccatcccatgcagatgcaacctatgacttcaagtatggagttagagctgtgcagggaggtggaaggtcatcagccagagaaaccattggcagggtggctgcaggagctcttgcaaagaaaattctaaagctcaaatcaggagtggagatcttggcatttgtttctaaagtgcaccaagtcgtacttccagaagatgcagttgattatgagactgtaaccttggaacatatagagagcaacatcgttagatgtcctgatccagaatatgcagagaagatgattgctgccattgatacggtacgagttagaggagattcaattggtggggtcgtcacatgcattgcaagaaatgttcctcgtggtcttggctctcctgtttttgacaaacttgaagctgaactggcaaaagccatgctttctcttcctgcaagcaaggggtttgagattggcagtgggttcgctggtacggactttactggaagtgagcataatgatgagttctatatggatgaggctggaaatgtgaggacacgaactaatcgctcaggcggtgttcagggagggatatcaaatggtgaaattatttacttcaaagtggcttttaagccaacagcaactatcggaaagaagcaaaatactgtgtcaagggagcatgaggatgttgaacttttggcaagggggcgccatgacccctgtgttgtccctcgagctgttcctatggtggaatccatggctgcgctggtcctgatggaccagctcatggcgcatattgcccagtgtgagatgtttccgctgaaccttgccctacaagagcccattggctctgctagcagtgcatctgaactgtcaccaaacctatcataatgtttgtcgtggaacatgtcccagctttccttctatcgaaattctggtctttgctaagcagtttgcaattcggaacccccataaaccctcgactattgtacctagagataaagtgaacggatatcaagatagaaatgcattaatgtttttgtgatgtgtagtataactgatatttaccccttttctttttttgagagaggacgcatgatgtcgtttgagcaataaagtttaatttgggagagacaaaaaaaaaaaaacaaggccagcccttgaccggtctaaataaaggaattctgttaagccc

SEQ ID NO: 9106 - DNA, 3117 bp, Zea mays
attgggtcccccggggccggccgggcgccactctcgtgcacaagactagcagagagaacataatccaaagatgggctggagaccacacgttgtctctgcgtcatcatccgcactagtgcttcagttcctcgtgctgctgctgcccctgcccctgcccctgctgtccgccgatgcatcgtcaagccaaacgacgacgacgatctacgtcgtgtacatgggcgagaagaagcacgacgatccttccgtcgtcatggcgtcgcaccatgccgcgctgacctccgttcttgggagcaaggatgaagccctccgttcgatagtctacagctacaagcacggattctctggtttcgcggcgaagctcacccagccccaagcggaggagcttacaaaataccctggagtcgtgagcgtgaagccaaacgcgtaccaccacgtgcacacgacccggagctgggattttcttggcatgagctacggcgaatcgccgtcgttgtcgtcgtcgtcgcggctcctcaggaaggccaagtacggcgaagatgtcatcgtcggcgtcatagactcaggcatctggccggaatccccgagcttcgacgacagcgggtacggccccgtgccgaaacggtggaaaggcgtgtgccagaccggccaggcgttcaacgcgagcaactgcaaccggaaggtcatcggcgcgcggtggtacggcgccgacgtcagcgaggaggacctcaaggccgagtacaggtcggcgcgggacgccaacggccacggcacgcacacggcctctacgatcgccggctcgccggtgcggggcgcgagccacgctggcggcggcctagccgctggcatagcgcgcggaggggcaccgcgcgcgcggctggcgatatacaaggtctgccacgacgtcggcggcggcacgagctgcggcgacgcgtcgatcctcgcggccctcgacgccgccattggggatggcgtcgacgtgctatccttgtcgctgggaggaggcagtgacgaggtctacaggacgttgcacgtcgtggcggccgggatcaccgtggtgttctccgcagggaacgatggcccagtgccgcagtccgtcaccaacgccctgccgtggctcgtcacggtggcggccaccaccgtggatcgcaccttcccgacagtcgtcacgctcggcgacggagagacgaagctggtggggcaatcattgtattaccgcaaccgatcggcggcggcatcgacgagcaacgacgacttcgcttggcgccatttgatggctttcactggctgcgacgacgcggagaagctgcggtcggaaaacatcaccgggaaaatcatggtatgccgagcgccggagttcaagtccaactatcctcccacggcgcagtttagctgggccagccgagccgccatcgccggcggggccaagggcgtcatcttcgagcagtacagtaccgacgtcctcgacggccaggcctcctgccaaggccacctgccctgcgtcgtcgtggacaaagaaaccatatacacgatcctaaatagcgacagcaatgtggccaggatttcgccggcggcgaccatggtcgggccccaggtcgcctcaccgaggatcgcgacgttctcgtcgaggggccccagcgcagagttcccctccgtgctcaagcccgacatagctgcccctggagtgagcatcttggcagccaagcgtgactcgtacgtgctcctgtctgggacatccatggcatgccctcatgtctccgcagtcgtcgccttgctcaagtcggttcacccggactggtcacctgccatgatcaagtctgccattgttaccacagcgtcggtgaccgatcgattcggcctgccaatccaagccaactcggtgcaaaggaaaccggccgacgccttcgacatgggcggcggcctcatagcgccggacagggccatggaccccggcctagtgtacgacatccagccggaggagtacaaaagcttggacgaccgcgtcgaccgcctcaacctcccgtccatcgccgtgcccaacctcatgtacgactccgtcacggtctcgcgcaccgtcaccaacgtcgggccggtggaggcgacgtaccgggccgtggtcgaggcgccggccggcgtggcgatggacgtggcgccgccggtgatcgccttcgagagaggcggcgtcaggaacgccacgttcaaggtgacgttcgtggcgaagcagagagtgcagggcggctacgcgtttgggagcctgacgtggctggacgacgccaagcggcactcggtaaggatccccgtcgccgttcggaccgtcgtccgggacttcgtcgccgatgtgtctcgatgatgaacactgaacgatgtgtctgtcaaagaagaacaccgtctcgatgatcgtccatatatgcgacactgtgtcactgtgtgtgaacactgaacaacgtgtcaaaactgaacttatgttgccaatttatttgcaagcaacaaggcgctcccagctgatcttgtgcctttatgcagtttatacagttcaaataaactatgaggctcagcctagaattcattacaaagcataattattgagcgagagacccgatcgatgatagttttgtctgtaattcatacatgggcactctcttatttgcttgcatgcttcgttgcaaatacaaacaagttttatgtggatttgtgtgcacacattcgtaatccacattcaagtgagtcccgttggatgcagcctcaccctcgcagcccatgttgtctagggctgggcatttggttttttttctaaactttggttcggttttttggttttaaaaaactttggttttttagacattagaaactgatcggttttctagaaaatgaaaaaccgagtagttcggtttcggtttttcggtaaaaaccgaataccaaacttatactcaagacaatacttacaataagtttacatgatacattacacgtaattttaaaaagtaaaaattatatagatacaaatatttagagatacatcatacatcacatataaataagtgaataacaatttaattgcttcacacatttagttcacataatcgaatagtgaaattttagaattgataaagtttggtattc

SEQ ID NO: 9107 - DNA, 1120 bp, Zea mays
aatgcaggccttctccggcctcggcaccttcttcaagctctccgccgcgtccgccgtcatgctgtgcctcgagacatggtactaccagatcatcgtgctcatcgccggcctgctcaagaacccggagatctcgctcgactccctctccatatgcatgaccgtgaacgcatgggtgtttatgatctccgtgggcttcaacgccgcggcgagcgtgcgggtcgggaacgagctcggcgcgggcaacccgagggcggcgtcgttctcggtgctggtggtgacgtcgctgtcgttcgccgtgtcggcggtgtgcgccgtcgccgtgctctgcctccgcgaccagctgagctacctgttcacgggcggcgaggccgtggctcgcgccgtgtccgacctctgcccgctcctcgccctcacgctcgtcctcaacggcgtgcagccagtgctctcaggcgtcgccgtgggctgcgggtggcaggccttcgtggcgtacgtgaacgtcggctgctactacgtcgtcggcgtgccgctcggcgtcttcctcggcttctacctcgacctcggcgccaagggcatttggagcggcatggtcatcgggggaaccatgatgcagacgctcatcctgctctgggtcaccttcagaacagactggaccaaggaggtggagaacgccagggcgaggctggacaagtgggacgacaagaagcagcccctcctagcctagaagaagactgattgaaggtcactgtagcgcgcgctgatgcacctttttttggcgatgattgagagaccacaccaggcgcgcgtcggaggggatgcaacgcaacgcaacgcaatcatttgggttttgaagctatttaatattatcgcattatagagtgtgcgcgtgcagtttcgagtgattaaagttttgttacgctttcttcggtgtcagctccaacttagggcgactagatgcgaccatcacaccagggtttggaccgtggtgggtggattctattcgtttttttttaagcacaaatatgtctagggcgaaggaaaaaaatgtagtgtgcaattattgtttcttgagctctcaataaatctcacgattctcacgaggaaaaaaaacaaaccaagtccg

SEQ ID NO: 9108 - DNA, 2351 bp, Zea mays
gtgcgggcaggcgtacggcgcgcacaagcaccgcatgctgggggtgtacctgcagcgctcgacggtgctgctcatggccaccgccgtgccgctgaccgtcgtctacgccttctcggagcgcatcctggtcctcctcggcgagtcggagcgcatctccagggccgccgccgtcttcgtctacgggctcatcccgcagatcttcgcgtacgcggccaacttccccatccagaagttcctgcaggcgcagagcatcgtggcgcccagcgcttacatctccgtggccacgctggcgctgcacctggggctcagctgggtcgccgtctacaggctgggcctgggcctgctggggggctcgctcgtgctcagcttcagctggtgggtcatcgtcgcggcccagttcgggtacatcgtcaccagcgcccggtgcagggacacctggacgggattcaccacgcaggccttctcgggcctcggcaccttcttcaagctctcggcagcgtccgccgtcatgctgtgcttggagacttggtacttccagatcatcgtgctcatcgccggcctgctcaagaacccggagctctccctcgactccctctccatatgcatgaacgtgaacgcatgggtgttcatgatctccgtcgggttcaacgccgcggcgagcgtgcgggtcgggaacgagctcggcgcaggcaacccgagggcggcggcgttctcggtgttcatggtgacgtcgctgtcgttcatcgcggcgacggtgtgtgccgtcgtcgtgctgtgcctccgcgaccagctgagctacttcttcactggcggcgaggccgtggcgcgcgccgtgtccgacctctgcccgctcctcgccgccacgctcgtcctcaacggcatacagccagtcctctccggcgtcgccgtgggctgcgggtggcaggcgtttgtggcgtacgtgaacgtgggttgctactacgtcgtcggcgtgccgctcggcgtcttcctcggcttctacctcgacctcggcgccaagggcgtttggagcggcatggtcatcgggggaaccttgacgcagacgctcatcctgctctgggtcaccgtcagaaccgactggaacaaggaggtggagaacgccaaggcgaggctggacaagtgggacgacaagaagcagcccctcctagtcgaagattgaaggaagaatctagtagatcacgcagtgtagcgcgtgctggtggattttttgtgtgtcgtgtgtgtgttttggagtggattgaatggaccatttggcatttgggttttagagagcatgcatgcactcctatcatgaatgctttggccagcaaatcatgcattgttagaaaattaatagggactaagattaatttgataatgcaacataaacgtaaaatccagaactacttgcagatagtagctatgacattagaacagaatagatctgaactaactcaacaagattaacgcataacagaagaactgacaccggatctaaccataagaccgtcatcgcaataaactgaaaatacagtgatttccacgagtgttggtgaggaacccgagcggacgtgcgcaaagcacttcccagaaacctaattcgtcggcacctgtgcaggtcgccaaaacgtcggcagtggttcggagacaccgttctcccttgatctgttgcacgatagacaaagggacgacatggcacagaagcaacggcgcagagaattgagaagaagatgacgagtcggttgctgttcgcctgtgtcctctgactgaagaacgtctgccctttatagatgggtcgccgcaactccttgattcgatctgctaaattataggaaacgctcccctggaatatctttacatgcaaccgtccgaagatctcgcacgtaacgtgcgtgcccgttactcctgtttgacgtgacagcctaggtgtgatatttgataaccaaataaacaaaaggtaaaaataaactatcgtttagaatacgtcacgacgcgatcgcgtatcgtcacaagtcacgcgataaataacgcgaaaaaacgtgaaacacgagcgtgcggcagcctccatagacttttatttgtctcatgtgaagcgtagtgaacactcaaacatataagatgtttctcttcacctagataggcaatataggactaaaaccttatacaatatatattctctatacatcacattggcttccttattaaattatgacacacaatagtgggtctaattctaacatgagctttcaatttatacggagaaaaagggagccaagcgctgcaatggggagagggaaagaaacgacggccgacaccaacattgatgacaatgggcgaagatgaagaaactgcag

SEQ ID NO: 9109 - DNA, 513 bp, Zea mays
ggcgccaagggcatttggagcggcatggtcatcgggggaaccatgatgcagacgctcatcctgctctgggtcaccttcagaacagactggaccaaggaggtggagaacgccagggcgaggctggacaagtgggacgacaagaagcagcccctcctagcctagaagaagactgattgaaggtcactgtagcgcgcgctgatggaccttttttttttttttttggcgatgattgagagaccagaccaggcgcgcgtcggaggggatgcaacgcaatcatttgggttttgaagctatttaatattatctcattatagagtgtgcgcgtgcagtttcgagtgattaaagttttgttacgccttcttcggtgtcagctccaacttagggcgactagatgcgaccatcacaccagggtttggaccgcggggggtggattctattcgttttttttaagcacaaatatggctagggtgaagagaacaaaaatgtagggcgcaattattgtttcttcagctc

SEQ ID NO: 9110 - DNA, 994 bp, Zea mays
ggactgacaaaagtgcagtgcgttgcatgtgcgggggggccatacaaactgctgctgttcaacttcacgtcaactgattattatccttttcatgaccggatactgaatgtggcggccccggtgtaatgtggccataaaacgcgttaaaaccaaccgtttctagacacggcctttgtgctgctggcctgctgctgcttgttctttctgttcaccttcctcctccttcctatatgttctctggcaaacacacacacacacggtcatgttctttggcaaacacacacacacacacatcgtttgctgttgcaacaaagctctacacgggaagacaggctgcttctttcttgcagtctctggtccagaagcctgaagaaatggcgtcacccaacgtcacattcctcgccttcttcgtggccctcgcactattggcgcttcacaccaccgacgcagcagcggcggcggcagaaaccttgcgccataggagcgacacatggtgcgtggccaagccgtcgacgcaggaggcggcgctgcggggcaacctggagttcgcctgctccgagagcgactgcggcgccatccagggcaccggcggctgcgccagcccgacagcctgctgtcacgggcgtcggtggccatgaacgcctactaccaggcccgggggaggaactcgtggaactgcttcttcaacggcaccggcctaatcaccatcactgaccccagccttggcacctgcaaatatgcttgacacgacgggctgctctgctgctgctgtgctcaacggacgatgaataaggctgtaggggaatgatgcatcttttccttctctttgttttgttattgtgtctgtgtgagtgagcagggagtatccttgcagaaccaaccagtatcatgtctgagcactgtagagagaatttcgtgcttttatttcccaaatacagttctactccaggccagtggctggaggggagtttaggaacaggtgtcaaaaaactca

SEQ ID NO: 9111 - DNA, 1873 bp, Zea mays
cattgggtacctcgaggccggccgcgccggctgcttcccggccccccgccccttcttccccgactcgcccggcgctgaataagattcccctgtattctgttccagagatgagctgatcgagcagcccgtcgccaagccaaccggacatggtgagcgacggcgcgcgcgggctgctgggcgcgtacgagctcgggcggacgctcggggagggcaacttcgggaaggtgaagcaggcgcggcaccgcggcagcggcgggcagtttgccgtgaagatcctggagcgcgccagggtgctgtcgcagcgcgcggacgagcagatatgccgcgagatcgccacgctcaagctgctcgcgcaccccaacgtcgtccgcctccacgaggtggctgccagcaagacgaagatctacatggtgcttgagctcgtcaacggcggcgagctgctggacaggattcaggcggccagtgagggaaagctcccggagcaggaggcaaggaggctcttccagcagctggttgatggtgtaagctactgccatgaaaagggcgtctgtcacagagacctcaagctggagaacgttcttgtcgaccggaagggaaacatcaagatctctgatttcgggctcagcgctttaccgcaacatctcgggaacgatgggttgctgcacacgacctgcggtagccccaactacattgcccctgaggttctgcagaacagagggtacgacgggtcgctatcggacatctggtcatgcggggtgattctctacgtgatgctcgtagggcacctcccgttcgacgaccggaacatcgtcgttctctaccagaagattttcaagggcgatgctcagatcccggagtggctctctcccggcgcacggaaccttctccggaggatccttgagcccgacccggcggagcggatcgccatggcagagatcaaggcgcacccatggttccaggagcactacgtccctgtccttcctccgtacgacgacgacgacgacgacgacgattcagtgaagcaaatcggtgcgggtagtaaaaccactcatcacatcaacgcgtttcagttgatcggaatggcgtcgtccctagacctctcagggttttttgaggaagaggacgtgtcccaaaggaagatcaggttcacgtccgcacaaccgcctgaggatttgttcgccgagatcgaacgctctgcgactgacatgggcttccatgttcacagagggcatagtaagcttaggctgacgcgaaactgcgaccggtcgaagaatcagaagaaccctatgtcgtcgtcgtcgtcgtcgtttctagtctgcaccgaggtttttgagcttagcccctctttgtatgtcgtggagctcaacaagtcccatggcgaccctgcactgtacaggcagctctgtcagaggatctgcggtgacctaggtgtgctcgagatggaccagatctttgggacgaggccgccggtcgccgacgatctcgcgggcttggccttggcgttggagagacgatctgcgacgcctttggttgcgttgtgacgaaaggctgcccccgccggcccccctgaccgtgatgtttgtagcgtcagattatttagtgacgacgaagcagttcagctgcaacgcagctcggaacggttgtgtgatccctcccagaaatagaggacaaggtaaaagagtgtagccgtacacgtgtaggatcatgctccaatgtaaataaagtggtagtagccaccgatgtaaaactgaatgtaaaatctaagaaataaatcgtttatccagtacacagaagctctatagtgacggtactagagctatttgtactaacgtttttcagtgcaaaaaaaaaaaaaaaaaaggcccctagggcc

SEQ ID NO: 9112 - DNA, 1018 bp, Zea mays
aattcgcccccgcgctacagattatcttcgttgtcgctctctccgttgcctcttcgtcctcgcgctctgccgctccgtgctacagttccctctcatcctcgatctctccgccgtttcttcctccctctcacggccgccgcacattctgctcatccgcttcggcggcatcgttttgttcagggttttctcgcctttgtggctttagggttcgtgttcttcaccagaatccatccggaaaaatgccctttccccttacattttcgactggaggttgtgtattgaagaaccttatccagttcgacgtcagtgccgccaatgctttcctcgacacccacgccgcacatcggcatcggtagctccgctgtcagccactacaactcctcgctgatccataccggccttcatcatcttcgtctttggccgtcactatcgcgcgttgctccaactgcaccaccatcggcatcgaatgttatgattgaaggacatcttcacgctactactttgggtgacaaaaaaggccaattgttgttcacgaaatcacgctgggaactctgggacaacttcacgctactaactctgggaactcaggttgtcgttgaaggatatatttatgctgctacctctacgagctctgtgaaaaaagccaattgttcttcacgctggggactttaagaactctgtgacatcttcacgctgccaactctggaaactcaggtaactattttgcatacctatgatgagcatcatcacttttggagcatgaatgcttttgtgtacatataaccaaaccgctaaaacatttgcagctctgtttttatttaagcgttccgtagctcttcaattactgatgtactctataaatttgtatgaccatgtcggttgactcaacaactactataagcgctagaattatcatctctgaacattgtatgactttttaatcactagaacttggttaaatttggctttgcgcttaaaaaaaaaaaaaaaaaagcttatcgataccgtgacctgaggg

SEQ ID NO: 9113 - DNA, 1608 bp, Zea mays
tgactagaaaaatcaaatgtattgtagtttttttacaagtattgtattgtactattgtagtttggaattgagggaccatatgaaagagccagtgatttttggagttttgacctgtcactttcccgtatttgactcattagcgacgcatgtttgatgccgccaaacatgttttctgttccgcgagcgagcaagtgtggtgtggagtgttgaccccacagtacagaggccaccaaccttttgacaccccacagtcactctctcccactcattaaatacgcgcgcacgcgcccctcccccctctcacgacactccacactccaagcgagctagagctagagctatagagatcactctccttctccgcgtgaggtagtgacgcccagccatggcaacaatggcactgcgcgccgtggcaacggcgctgctggtggtggcggcgtccgtgtgcggcgcgtcggcgtcgacgctggtgctgtacaaccggtgcggggagacggtgtggccgggcatccagccgagcgccgggaaggaggtgctggcgcgcggcgggctgcagctggcgccggggcggtcggcgtcggtgcggctccccgcggggtggtcggggcgcgtgtgggggcggcaggggtgctcgttcgacgcggcggggcgcgggcggtgcgccacgggcgactgcggcggcgcgctctactgcggcggcgccgggggcgcgccgccggccacgctggcggagatcaccctgggcaccgcgtcgtcccaggacttctacgacgtgagccttgtggacgggtacaacatccccatcgcgatgacgccggtgcacgggtcgggcgcccggtgcgcggcggccgggtgcgtgagcgacctgaaccgcgtgtgccccgcggggctcgccgtccgcggcgagggccgcgtggtggggtgccgcagcgcctgcgccgcctacggcgcgccgcagtactgctgcacggggcagttcgggagcccccagcagtgcaagcccacggcctactcccgcctcttcaagtcggcgtgccccaaggcttactcctacgcctacgacgacccgacgtccatcctcacctgctccgccggcgcctcctacgtcgtcaccttctgcccgcaccgccgctgaacttttatttttttaaggtcttcggccgcgtgttgttagttatcctctgcctgcgtttgcgttttgatgttctggcgtgcgttcgtttcacttgcctccgtcacgcgtcttcggaatctccagatcttcctccctaagtatagcaatgcactcggctctactgctgctgcgttttgaaaacctgggatctgaaatcttgaacagtaaaaagtagctgcgggcattctccagatctggatcgttgcacagcaggacaaacacaaaagggaagcaggtcgtgcagtgaaccaacagtacgccgcattagctacaggagggtgaggcgagtagctagtgtaggcctcttttggccgccacagggagagtgagggacgggacgtcacggacgatcggaccggacgcccatcataatttaaaaatttattccggggagcgcgatctccgaggctactttttccctgcaggcatgcaag

SEQ ID NO: 9114 - DNA, 2983 bp, Zea mays
attcaaggaaccaaacgggccctaagtgaaattttcactatattggagtaaaataaaagatgagcattctaagtaattagcagggagttacataaactccgtccagttggccgttatatatacatacatacagggatagtacaagcatggcgatacacactcgcttggttaattagaaatcacaacaattgcggatacagttattagaatcccgctctctattcgccccggtcaagcctgcagccagtgactgcaagcaggaggcacctggcgcgcgccctcatggaccttcgatctggatgctgctgaatgaatgagcgagaccgccgcttcccctcaaattctggagctctgctttgatcgtctccgcaatcttggcctcctcaaggccaggcgagggcacatccacgtggaccgagccttgttttctgggaccaacggagtcctgattcagagattgctgctgcttcatgtagttgtacagctgctggtggaaagggtggtcgtaggagtagcaatctactccatccagcgagtcgctggatgaacctgacccttctctcttgcagaagtgcggaagtgactcgtagtccatgaccttcagtaactcatccctcccagagccatacaggacttggatcttctttttagttctttcttgtaagagtggcttcacaaccttccaacacgctgaaaaaacatatggagcatttacaatgtaataagtttccgttttctcaggataattaaggtcatcaacagtagtaatcatcgtcaacatctttatttggctcagtgcagacagcttgaggccagtcatatccataaccttcaagcaggtattaatctgtctcccaaacttctttgatgcagccggcaggacaacacgatctcgatattcattcatctgtatgtgtgattgcacatagtagttcaccgaggccttgtcaaaagtactaagacccacaccaaatgcataaacaggttgtccctgcttggagtaccctgtcaatccaacaagtaacgtgtcccgaataactctatatatatcagatggcagaatgggtttagctaacacgatgtcaatctcattctgtactctccagtttaagcaatccattagcattttataagctttaggcacactccattctctagccttcagaaaacgcatcaaagtccctctcagatttccttgatgcacattctgcaaacatatttcaaccaatcactttttggtgatattattcgtattttaaaatattatatcaagtgtctacagaaaaaaaatgatgtccactgatgaaagaacaaggtcgatagaacttaacaacaaattgcaatacacatgtccaaaacacataagctaacagaatgcatctagcaccagccttctgatgccagcatgctgacgtaaaaaagaaagaaaaaaaacattgtttcttagtggggcatattgtgattccagagtggttgcacaaccgcacacgtcctcggttctgagaccaaccatgggccttgtcacacttatcatgagtcatgacaaggacttaaggaccaaataaaaatccgaatctacaattgaaacatctccaccaggaacagtccaggccacagatgtcaggaacacgtcaacatccaggtccaccatcagcacacgtccaactacaggcttggacagagtcctctcatgggttaaaagactaatgcagcatgcaacacaccaaaccaatactttatataatctcttgtcttgggagtgtctgaccctaaaatatttctagtattccaacacatgcttagaaagtaggaagtctagacggcctcctagccggcagccaagaccagaattagttgcgagtcaaacaagaggaggagtatttgggctccaaatggtgaactgggaacagcacatgacatcgacaccacaacttgtaccaaaattgcagttgcagtgaggacccaaccagagtactactttcatctatatacctcgtgacatatcgaaacaaatatctcagtatgcaacccaaacaaaaaaggaaaagttcattttcgaaatcataaaggtgtttctaaaagcaccaaattgattattccaaaaacactcagacacaagaacaagtttattaagctttacggcaacaaaaagacgttctttacagaaccaagttgagagctcaaaatcacttcaatccacaacacaagaaagtcgagggaaaaggccaaaattctacctctgccgaaaattcgaaataatgagcacagacaaaaagtatactcgagcacaagccgtaaaatgagcttctctcatgaaaagaatcaaaacaacaagtctaagatccaaatttgatgtacgccagaacaaataacagaaataagtagcgggagcaggaaacgaaagaaattaaagcatgcgcaattttcaattcgatggaaattccaacgagatcggcagtaaaaggtcagcgaaattgagctctggacataatgaaaaccaaagatctaagccctacgcagctaacagggcaacagactaactcgcagttcttcagatttttttttatgttgaagcgctcagcagcaccccaagtccacaaaaaatgcgagaactaaagcaaaactcgactttgaaaaacacgcgcaaaatctgccggggtattcgttcagaaaacaaccagaatcaaatcaagcacaaaacggcagatatccaacaggaacagccgaacagcgagcggagcagatcgacacctggaatgtgctctttagcggctcctctagctgctccatgagcgccgagaactgcttgattgcctcctcggaggtggccgccattgccctcaacagggtacttggggtcaaaagccgggtctttcctgccttttccagctctccgttcctctcctcctttctccctgtgtttctcgccctcttgttctgttcttgtgcgcttcgtcgccagtcgccacaccaccaaaccgtg

SEQ ID NO: 9115 - DNA, 1691 bp, Zea mays
  misc_feature (1)..(1): n is a, c, g, or t
  misc_feature (3)..(3): n is a, c, g, or t
nanacggggcgggggggttttttttttttttttagaaatcattcgaggtcaccatttcaaggaaccaaacgggccctaagcgaaattttcactatattggagtaaaataaaagatgagcattctaagtaattagcagggagttacataaactccgtccagttggccgttatatatacatacatacagggatagtacaagcatggcgatacacgcccacttggttaattagaaatcacaacaatcgcggatacagttattagaatcccgctctctattcgccccggtcaagcctgcagccagtgactgcaagcaggaggcaccattaccaagagcttctcttcgggtcactggcgcgcgccctcatggaccttcgatctggatgctgctgaatgaatgggcgagaccgccgcttcccctcaaattctggagctctgctttgatcgtctccgcaatcttggcctcctcaaggccaggcgagggcacatccacgtggaccgagccttgttttctgggaccaacggagtcctgattcagagattgctgctgcttcatgtagttgtacagctgctggtggaaagggtggtcgtaggagtagcaatctactccatccagcgagtcgctggatgaacctgacccttctctcttgcagaagtgcggaagtgactcgtagtccatgaccttcagtaactcatccctcccagagccatacaggacttggatcttctttttagttctttcttgtaagagtggcttcacaaccttccaacacgctgaaaaaacatatggagcatttacaatgtaataagtttccgttttctcaggataattaaggtcatcaacagtagtaatcatcgtcaacatctttatttggctcagtgcagacagcttgaggccagtcatatccataaccttcaagcaggtattaatctgtctcccaaacttctttgatgcagccggcaggacaacacgatctcgatattcattcatctgtatgtgtgattgcacatagtagttcaccgaggccttgtcgaaagtactaagacccacaccaaatgcataaacaggttgtccctgcttggagtaccctgtcaatccaacaagtaacgtgtcccgaataactctatatatatcagatggcagaatgggtttagctaacacgatgtcaatctcattctgtactctccagtttaagcaatccattagcattttataagctttaggcacactccattctctagccttcagaaaacgcatcaaagtccctctcagatttccttgatgcacattctggaatgtgctctttagcggctcctctagctgctccatgagcgccgagaactgcttgattgcctcctcggaggtggccgccattgccctcaacagggtacttggggtcaaaagccgggtctttcctgccttttccagctctccgttcctctcctcctttctccctatgtttctcgccctcttgttctgttcttgtgcgcttcgtcgccagtcgccacaccaccaaaccgtgtggtacagtgatgtttgtggggctcagctccggtggttcgccggcgatcctaaggttcgggccttcgggacctacagagtggtgaggggtcccgtctcccgtcttcttaaaaaggatcaggcgagcttagttttttttttctcttttcttctgtatctctatcgggttttt

SEQ ID NO: 9116 - DNA, 822 bp, Zea mays
cacccacgcgggcaaggtgtttgtcgatatggacaagagaggtctggaggccgaggaaccacgtgtagctagcgatagtgagaaagagatggcaataagtacggctaacagcattgtctctgcgctgaacagctacagcaagctaactggtctagtggtgagcaggaagagatgtgactcgattggcatcccagcactcagttcgtcgttaaaactctctcttggtagaatcaaacagagctttgtattgactgactcccgcttgcctgacatgccaattatttatgctagtgatgcttttacatcattaacaggttactcaagagaagaaatattgggctgtaactgcaaagtcttaaatgggccaggcactagcttggaggttttagaggagataaatcagcatatttgttctgagcaggcatgcacggtggatctactgagttacaggaaagatggaagttcattctgtgatcatctacatgtatctcctatccgagatgcttcgggcaaggtggcctttcatatctgggttcaccttgacatgggtgcaaagcacgattttagtgggctgacccccgagaaatggctgcttggcgctgttggtgcggtgagggttgctgtgagaggcttgtcggcgtcaggtagcctgttgagaccatcccaatagcagttttagtctcctcgccatttcatgaccacggcgaccggccttccacgatgtacattgctgcttgctattctgtgtaaagcaactgcttagcatgacaaagtaaatgagttcgttttgaaggaaataaaaaaaaaaaaaaaaaaaaaaag

SEQ ID NO: 9117 - DNA, 1960 bp, Zea mays
cttttgatgagaacactcctccattaagtgacccgaattatatatcttcgttgggtgctgcaacgttcaggggtatgcagagtggtgacaacgatgctatttggttgatgcaaggttggctgtttacctatgatcctttctgggaacctccacaaatgaaggcactactgcattctgttcctgttggcaaaatgattgttctcgatctttacgctgaagttaaaccagtgtggataaattctgatcagttatatggtgttccctacatctggaaagttctcttttctctttctgccaactccatgcactattaccctccttttattttccttcataaaaaaactcgtgtgaccctttttcaggtgcatgctccacaatttcgctgcagattttgaaatgtatggtgttttagatgctttggcttctgggcctattgatgctcgattaagtgataactccacaatggttggagttggtatgtctatggaaggtattgagcaaaatcctattgtttatgaccttatgtcagaaatggccttccatcacagacaagttgatcttcaggtttgggtcgagacatatccaacaagaagatatggaaaaccagtgaagggactgcaagatgcttggtggattttgtatcgaactttatataactgcacagatggtaaaaatgacaaaaatcgggatgtgatagtggccttcccagatgtcgaaccttttgttattgcgacaccagggttgcatgtgaatactagacagccggattctacagtgtcatcgaagaattacatacggaaggacgtttctagtgatgcatatgaacatcctcatctatggtatgatactaatgctgttattcatgccctggaactttttcttcaacatggagatgaagtatctgacagcaacaccttcaggtatgaccttgtggatttgactcgtcaagttctggctaaatatgctaatgacgtttttctaaagatcatcgagagctacaaatcaaacaacatgaatcaagtcaccatcctctgccagcactttctcggcctcgtaaatgaccttgacacattactatcctctcatgagggttttctgcttggcccttggttggaaagtgccaagggccttgcacgaaacagtgagcaagaaatacagtatgaatggaatgctagaacacaaattacaatgtggtttgacaacactgagacaaaagcaagtttattgcgcgactatgcaaacaagtactggagcggcctgctgcaagattactatgggccaagggccgccatctacttcaagcacttgttattaagcatggagaacaatgcacctttcgccctcaaagaatggaggagggaatggatcagtctcaccaacaactggcagagcgataggaaggtgttttcaaccacggctacaggagaccctctgaacatatcgcagtcgctttacaggaagtacttgagcaacgctgatctacttgggttagtagaaggtacaggctctccttggaagtctgcaaacttataagtaggtgatgcgtgcaatcatgggtcatttcagattcacagttactttttttctctctcatgtttttcctcgtactcataactatcgtttggctgcgacatggttgctacgaatcagttgtgtgtgaactgtgaagtactgaagtctttctgtatagcagtagaaggacgggtttcttttctttttccagtgttccttgccgtaaatttttcagttctgtatctatccccattagagcttgttcggttattttccatgaccatgcacagtaaagtagcccttaggagaatggtcatggaaaaattcggcctagttcagggtgtcggaactttactgtgcgtctgtacctgagaatcgtgctgctttctgtgaaatccatgtctttcaaacacgacctcggtcataatgactcaaaccgcttatgcgt

SEQ ID NO: 9118 - DNA, 2235 bp, Zea mays
atataccaaatggattagcttcaggagttgcaactgcatttgttccttctgatgtggactattcaaatgaagctcaaacccatgtccttccccacagcacactggaagcatatccaagtgatatgtctgttgggaacggcacaacttatcctaatttgggaatggcatgtggaagtgcacatgttactcaagatgcttatgcttatgctgctcctatcgccagtaatgagcctttggacattgatcccttgtatcttgcaaaatatggtgatggtttgctgcaaagattggacctgctggaaaggctctgtggctcgaacaaaggtcttgaattgataagaagagaaattgagatacggatgtcggacttaaatgcactttcatcttatggatcttctttgctcccattgtggttgcatgctgaggtgcacctgaagcaactagactcttctatttccaagctggaaatgaactatcatgcagattcagaacctaggaattcaaagacagaggttgctgaacacagggcacctgatgatgctgacttgataacaccctccaatggcgaggctttgaagtatgaagtttgtgctgggattactatcgatgcaaatatgaagattggtaagccagcttcaacgtctcagaattcacaaggtagggataatgcagctgttcctccaaaaattgaatctgacaatgatgaagatatggatgtggaaatggaagttgatgaagataatgtcgaagagcaggcacagtgcagttctgtacctgaaaaggagcatcctccttcagaacagttgagttcatctaatttgccatcatttgaagatcctacacctcctgaggataattctgttcctccacctccgccagaagaggaatggattccacctccaccacctgaacacgaacacgaaccagctcctccagcttccccagaagagccggctgcatcatatgttcaggtggatacaattcctcagccatatatagctcaagaaaatgttggctatacaatttcaggaatggagtattatagtactgaaggtacaaatgccaattactatatgcaagtgagtgagcctcatgtccttcaagcacaacattcttattatgcaccagtatctgggagtggcatatctgtttctgttgatggcacatctattgccccagaatcttattatacctatccttcagtcactgtggctgcaagcgctgtagcagctgaacattctggatactacgcttcatcagtctctgccatttatagcagtgcagcagatatcaaaacaagctcagcttctcttgtttctgcaattagcaattcggatctaaaaaatcatgataatgttatatccaatgatgcaagtattgtgcctttcacccaagctgtagtagcaacatcagctgcaggaacgacatctgttcctgaaagttctacacagccttctagcagtactacaaaccagatcaaagttattcgcaacaagaagcgggttgttggtattacatcgtctctgaggtctaataagaaggtttcaagtttggtagataagtggaaagctgcaaaagaggagcttcgtgatgaagaggaagatgagcctgaaactgctctagaggcattagaaaggaagcgacaaaaggaaatagaggagtggcggaaacaacagatagcttttggacatgctcaggaaaatgccaattttgttcctgttcgtggtgattggcgtgaccgtgtaaaacgcagaagggctgaagcaaaaaaggagtcaaaagatgacattgttgttgcatctttaagtagttccaaacagcataaaggatctcctgatctagcagagctttccaagggtcttcctactggttggcaggcatacttggatgagtctactaagcaggtctattatgggaacagtctcacgtctgagacgtcctgggagcggccaacaaatgaatgaagatctataaccttggtgtgcggtcaaccgaacgatacaagttgatttgttaatgtagttgatgctgttgaatgggcagcccaattttgtttggcagccaaccccatcctttagagaagaacaaaccacacctcaccaggagatggctgattgtttcattgtcttggtcacaaggcacaaaatttttgatgggataggttttgcttggctaacctatctgcagtacaacatctcttattaatcactaactagatgaaggcacatttcggtc

SEQ ID NO: 9119 - DNA, 5539 bp, Zea mays
  misc_feature (5444)..(5444): n is a, c, g, or t
tttcattttttggggtcttgcaataatatattttacttgtttcagttaactagtcagcgtgcggatatagctggtgataacagtgaggcaaaaattgaaccatcggcttctgtcggtgatcaacaagaagcagcacctcaagctggtgacgttaagaactacacccaaagtgttactgaagaaaacactatagctcctgagccaactgtacaagaagagagtgtgaaagcaactgaatctcttcccgattcatctggcatgcagattgttggtgatgtcgggggaaatgggtttgcagtaatgcttgaacagagtaatcagtgttattactggaacacagttactggagaaacttcttgggatataccaaatggattagcttcaggagttgcaactgcatttgttccttctgatgtggactattcaaatgaagctcaaacccatgtccttccccacagcacactggaagcatatccaagtgatatgtctgttgggaacggcacaacttatcctaatttgggaatggcatgtggaagtgcacatgttactcaagatgcttatgcttatgctgctcctatcgccagtcatgagcctttggacattgatcccttgtatcttgcaaaatatggtgatggtttgctgcaaagattggacctgctggaaaggtgcttttattttctgtagtcatatcttttgttactttgcatgcattattgttccttgagtgtagaaaactaatgagttattatcattgtaggctctgtggctcgaacaaaggtcttgaattgataagaagagaaattgagatacggatgtcggacttaaatgcactttcatcttatggatcttctttgctcccattgtggttgcatgctgaggtgcacctgaagcaactagactcttctatttccaagctggaaatgaactatcatgcagattcagaacctaggaattcaaagacagaggttgctgaacacagggcacctgatgatgctgacttgataacaccctccaatggcgaggctttgaagtatgaagtttgtgctgggattactatcgatgcaaatatgaagattggtaagccagcttcaacgtctcagaattcacaaggtagggataatgcagctgttcctccaaaaattgaatctgacaatgatgaagatatggatgtggaaatggaagttgatgaagataatgtcgaagagcaggcacagtgcagttctgtacctgaaaaggagcatcctccttcagaacagttgagttcatctaatttgccatcatttgaagatcctacacctcctgaggataattctgttcctccacctccgccagaagaggaatggattccacctccaccacctgaacacgaacacgaaccagctcctccagcttccccagaagagccggctgcatcatatgttcaggtggatacaattcctcagccatatatagctcaagaaaatgttggctatacaatttcaggaatggagtattatagtactgaaggtacaaatgccaattactatatgcaagtgagtgagcctcatgtccttcaagcacaacattcttattatgcaccagtatctgggagtggcatatctgtttctgttgatggcacatctattgccccagaatcttattatacctatccttcagtcactgtggctgcaagcgctgtagcagctgaacattctggatactacgcttcatcagtctctgccatttctagcagtgcagcagatatcaaaacaagctcagcttctcttgtttctgcaaatagcaattcggatctaaaaaatcctgataatgttatatccaatgatgcaagtattgtgcctttcacccaagctgtagtagcaacatcagctgcaggaacgacatctgttcctgaaagttctacacagccttctagcagcactacaaaccagatcaaaggtaattctattttgaatttcattatttggacaattcatctttaccctgatcacattgtttgatcttttgtgctgttctgtagttattcgcaacaagaagcgggttgttggtattacatcgtctctgaggtctaataagaaggtttcaagtttggtagataaggttgctctctacaacgaatctctgtattctgttattattgcatattaggtgcctgaaatttacatttttagcatgttcctgtatattcatggaattaacaaatcctagtttcttactctcgatttgagacgttctctcaactctcaaccatctaagaattcagtataaaatacgaagggtttaacattgttatggatggctgggggcactacagcaatcgtggcgctacagtactgccggtactgtttttgtgatgctgcaccctgcgctacagtacccccgggtgctgttcatggttagggctgcaagcgaggggagggagaagggggtggtggctgcgttgtcgccggcggaggcgaggaggatgtgcatggcgcagggcgtcgtggctgatctagagagagaacttgcggctaggactaggaggcgctgggaaggccgaccgcagggctttgccgacagctggcaagagagaagggatttccttctaatctcttgcttaccttcaattgatacaatctcttcttatatagagagggttacttgaccccttaacactagatctaatcttatctctaattctaatcttatcccaaactagtctatctttatctaaacaacctgagggcgtgctacagtgccacttggcccctgacaaacatcatggtatgttttgcaagatcccctatgtatcatgtcaagaagaaatagtggcctccgtcttttaaccttctgtttcctggttatttggtaaccatttgctagttagttttatcagtctgctttcgttataaggtttaaactaaggttagtagtgatgtgtaaataattgttgccctagcaacgtcactttgtggaatcagtctgttttgctttccttttaacagtggaaagctgcaaaagaggagcttcgtgatgaagaggaagatgagcctgaaactgctctagaggcattagaaaggaagcgacaaaaggaaatagaggtaaatttcattttacctctctaaagcatgcatgcagaaatttgtagaagttttctgattttaaatgtgccccatttgatccaggagtggcggaaacaacagatagcttttggacatgctcaggaaaatgccaattttgttcctgttcgtggtgattggtactctacctttcctgtgtgatggttgattttaatagctagatgcaaaatttaccacaaattttctggtgtttgtcatggttatggccgattttgttcctcctttcaccatttcactccatgtgatgtcctctttgcttagaagcagccaacttccttttttggccttagaatattttttagaaacagacaacttcctgcatataaagttgtgttagaaggaaatgttctaactagttcaagtacttaactacttacctttctcatcaatgtggatttttgatcgctctgccatgcctaatagtttcttgaatactgtgcatacatgtgtaccatattttcatgtagactttcccttgcatcaagtgatttgcatgttttggtacatagtggtataaaagattgaagcaacatcctttttctatatgttctctgcatggcaccagtgctaactggttggagtccagacaaaagacatgttggaaaatttttaggttgctggcatagctgagagacaaatcagttcagtggcagcttcttgaagcttaacggaatataccagtttagcattttcttcattatggtatacctttaagggcctgtttgcattgtagggtattcttcgaatgttttgggatttagttaaaatttgaactagaacccaatactccccacaaccaataaattgccgctcatgcaagtgagtctttaatgccatgcttagtgtacattcttaatgttagattaaagaaggcccgtttttagctagatacatttaataatagtctccagggactgatttgcctatgataacatacctattattaggataactgagaaccttggtattctgaagctgaacatcatgaatggcgacatggtttcttttatggattttacctggtagctgtagtgatgattgtttgaattttttgcaggcgtgaccgtgtaaaacgcagaagggctgaagcaaaaaaggagtcaaaagatgacattgttgttgcatctttaagtagttccaaacagcataaaggatctcctgatctagcagagctttccaagggtcttcctactggttggcaggtaagtattctcgattgtatcatatcagatgctaacatagtgtgctgtgtttaaggtagcttccgctgcagcttccaagaatttgatatctattgcaagtttgtaactgatacaaagaagtgaacaatcgtgaaacactggtcatgagtgcaccctctgttcctgtgtagtgtactgtaaaaccttgttaatctgccatgccatgttttacaaagtggttagcactgcttatttgcgttatcctctctgtgcaggcatacttggatgagtctactaagcaggtctattatgggaacagtctcacgtctgagacgtcctgggagcggccaacaaatgaatgaagatctataaccttggtgtgcggtcaaccgaacgatacaagttgatttgttaatgtagttgatgctgttgaatgggcagcccaattttgtttggcagccaaccccatcctttagagaagaacaaaccacacctcaccaggagatggctgattgtttcattgtcttggtcacaaggcacaaaatttttgatgggataggttttgcttggctaacctatctgcagtacaacatctcttattaatcactaactagatgaaggcacatttcggtcataggccccccgactgacgatccatgcaacaaaacctcacgccgatttggctgaatacttgccaatgggtgaaaacatctaggtatgcttatccagctacccctgctgcagggagacaatggaaaggagctcccagacttcaaaaaatccctgtaatatttcctatgatactgacccatcattccatcaatatcatgcacctaggactagtcaaacaaggcatcattcaccagtcgcttgttaaccaagcgtcttgggatcaatactgaatatcaaagggtcaaatctttaatcctttgaccgtacaaccacctatcttgccaaaagtgagtagaggatccatctccaatttctaaaactacaaccatataaagaagactacctcagggtacaccgaaaacttaggcaccaaaggtttgctaggaccagtcgccttcttgagccataaccacctcactcaaagcccagctcagcttttgaatatctaaaatccgaaaacatctcaacttcntaggcctggtaacttttggccaagcaataaggcaatgttcacctttgcctcctttttgcctttccaaaagataactcctaattatataccactca

SEQ ID NO: 9120 - DNA, 5188 bp, Zea mays
aagaaaggggccacacacttgttgatgagataagaatcctcatggtgcatgggctattgcatttattgggctttgaccatgaagtcagcaaggtggctgaagaagagatggagaaggaagaagaacatattttaaatactcttgaatggagaggaaagggattaattaagagtgcttatgatattgctactgattcactcacagaggctgatagcaatatagagaaagtgatcctacaagagaaacatcaacataaactaagccatatcatctgtgatatagatggtactatcatggatcatgaaggtggcctgcatgaaaaatcaataggatctttgagagaggcaattgcaaaaggagtaagagtgcttatgatattgctactgagtcgggcttccactattagaaccttcaagcttcttgatttctacgaaaaaggtgattttatttcagagacttcgcctggtgtatttttgcagggttcacttatctatggaagggatggcaaaaaagttcatagagcagaattggatttagatgtctgcaaggaggcattgctgtactccttgaagcatagaattcctcttgttgcgtactgtgaggaacaatgtctaacattgtttgaacacccatttgttgaattgttgcacactgtacataatgaaaacaaggtaaaagtgatgcattcaattgaggaccttttggaatattcatctattcagaaattacttctttttgatagtaccaaagaggattcatctgttctaaggcagcatttttcagaactgagcagagggaaagcacatgttatcaaaatgcattcaaatacaattggatattggttcccctcaatgcttcaaaaaggggtggtttaagaattctacttgatcatcttggaataacaaaagattgcgatcttgattctattggagactataccagatggctaagcaataaatgattcaactgacatcattactgggtcgttcttaagaaaaaaatgtggaatcgtaggcgcgccaaaggaacaaaactattgctctgaaggttgcaaaaattgtatgtttgtagcaacatctcttttagttggcaattcatgtgtttttatatttcgaaaaggaatgggtggtgaatgacagcttagatattccttcagatcatttcgttgagatacatgggaagagaattaaatgggccacatccttgtgcaactggagcttaccatgtgacatttgcttttgtccaaagtcatctgcaacgccatttttaactctacatagattttttgtagttttgttttgtgtagcatagcattgataaatgttgctaaataaatgagttaatggtttctccacgttgttgatattattcgtatgaaactaatgctgaagtataatttatgggtaggaattcaatggatgcattgtgatgacgataactgtattttctgccatgttgggctttgtttattatgactcaccgttactcattacatccatttgattgatcgatctttttattgatcatgaaatgaagcacataagaaatcaggttgattgtagaaacaaatattgttcagatttttcatgcataaagcacacacgaagcacagctcgtcaatggaaagtggaggcttgtcaccctagtttcccctttgttacagatcaatatgtgttgcaactctcttgttctggtgggcatatgatttagtgctgatgttcaaattgctggtgttgctagttcctggcattactctagcaaatgaaccatttgagggcctctttgctatcatcttgttgcacggccttgatacaatgattgtccgttggttcatgtctaatcctactgaatagcttttgcttgctctcatcctcttactgtatgaaactttctttgcaaggtcttgaacacttgtagcatcagatatagacgtgaatgattgggccttcccttggtagtaattggacagccctttcctgtggaaatcgtgttaattgaacatgagttggaatgctttgcatctgaagtgaaatttatagaagtaatgttgactatccatcttttataatcatgacattgtgttatatatccactcagtcttttttcctttcagcaaatatacatatgaagttgaactctgctgcatgcttatcatagatcttgtgcaaaagggaacctctactagttatcacagagcagtatcaagttttgttgagctgaaagtgaatttgcaagctttttataacaaataacagatcattccattgtatggtagggacagaagcttgctggtttaatagaagataatagtgcaaagaaatcgcaaaacttattgaagcatttgtaattttgaggctatatctttttctaccttcatcatgaatgtaaaagttacaaaactacattgtgaagccacattgtgatttatttgtagaaattggacagcttttatgacttttcttcaaggtaaatgattataaacatgcacctgattggaagctcatctagcagcgaggataactcatacaggggaccctcggcgtccagatgcaacgtgctcgaagatgctgaggatggctcagagcgatggccaggtggggaagaagttgcatcatcagacacgttggaagctgatgagcacaaggacccactggacgcgcccgagaaggaattgtaagactcggagctttcgtcacctggtttattgcaaatctccgtgtgacacgagggtactccatgaggtgctaagttgtaaggctctcccattcaatgttttgacatcaaagggacgcagcttatgtggatatatataggagaaaaagggagagctatccaagtggttggataagcgtcttgtttagtcggagaaattttgtgaactcacggccggagagcgagtgatagttgcccttactccatgtgatcttgatagattagcacattaatatttcttcatttcttgtgctattttattacttatgaactccgtctcttcgttgttgacatgaagcaagaaatggacatctgtcacttatttggataaatcaatgataacttagctgatggggagcatgcggaacaacgcccttcgggctgagacagacaagcatgttacctccggccaagaaaaagagagttatcccagcggattaggaaggataaggtagattatggcggcaagaaggtgctttctgttagcctggggctcatgcctagggtgttaataatgttaaataagagtgagattagtttctttattgtggtgtggtagacttgtggagccaatcggctggatctcagtcaggtcgtcgtcaacactcccttatcatgcacacacatgaatctttttaactaggcaacgactgctatacaaacagtctaagcgtacaagcaaatatctgatttattatatcgtgatccaaccgtagatcatatttaacacttaaaccctttcaccaccagctcaataatttttataaaaaacctctaacaaatcatggttgtatttatggttggatcgtaatctaatggatcagatagtttacttgcacgtttgaaaaaaagactgcttgtatagcagtcattgcctatgcttgtcgatcatcgaatcagctacgtctaccgaccgtactgtcgatttcattatctaccatcgtcaaacatagtgtttcagggtacaacatttaccgtttgtctatagtagtttcaacgtcgttacatcaacttttttttacagactttagcacaacgctttattaaaataaaaaaatcatatgagtccataattaaacaaataaaacaaacaatttataaaaacataaatgaaaattacataatttccgaagctaagaaaattacataatttataaaaagaaaaaaaatactataatttacggaaacaattgccagttgcgtacgtgtgttacgcgtaaagggtgatgcatctgtatgcatagtgcttttggagccaagcactgaacgctaccgtgtaaagagtgattctcacgttacggttaagccacgtagaatttctaaaatatataactgcatatgatttgccaggcataaagcagtagactttttctgcagaaaacactagccacagcaacgcatctccaatactacctgaatacctgaatgaagagataccctcactgtacttgcaacgttacgtgcaagcttgcaacgacggaggcgcacaggcatggacacctcagcaactcgcacaaggtgaaggtaggaagagaatgccttttgtcgccttgttccggccttccctgcagctccagagcactggttgtcagagcctaactaggcccaccgaggggctacggtagcagcagtcataggctcttcaaggaagattagataatgatagttagagataagattagaaaattagttgagactatttaagagattagttaaaattatttaggaaagttatcagttagtaatttgttgagagttttaagaagataaggatctctagctagataggggtagtcagccgacctatttatgtaatcaatggatgagatataaatcagttaagaattagaagggagaaacactctttttgctcggccgtgggtacaggcctccggccgacgttcctgcccatcgatatccctctccaatccgtcaccgatctagcgaccataacagtggtattgcttataattcagaatttcgacactggttttcactgtgcttaatggtcaatggacctctaaaatcgaccttggttgctcgaccattcctctcatccattttttgagagaacttctcaatagaaagaactttaactaaatattctaaaatattccgctgttgcaacagtaaaacctcaaaaaatctagattataggacaacctactacagcccctctgttattttctatttgtcgtgttttagttcaaaactaaactaacaaatgacaaatattcgagaacggatgtagtagtatatttgagacccttaaaagggtgttctataattttttgaccaaattttataagataagtattgttggagtagtttttcatgggtagaaccatatattttaatttgagccaaaggtttaagatattgttggagttactctaaggcccaccaaacataaatggcgtagaatggatccatcattcagctagcatcagtgtacgttacatccatgctattcgca

SEQ ID NO: 9121 - DNA, 1126 bp, Zea mays
aaaaatcctgagctcatcattgtcgtcgtcagagtgtaatcaacaaattaatgaccgcgcgagcatcggctgctgtgtgatatatatagctaggataggatagtaggagtagtgctaataatggcggacgacggccgtcgcaggaatgtctccatggacttctcagtgagcatcccttcagcagcagcagcttccatgctggtggacaaggagaacacgagcgacgataggatatcaatcatcatcccgcacagcaggtctccttccaacaagatcctgccgctagggttccagcattcacctcgtccggtctcagcaaagagggtggcgcttgcactcaccaagaaggtggcagcagagctcctggggacgttcctgctggtcttcaccgtgctgtcggcgctgatcacgaacgaggcgcacggcggagcgctgggcgtgctcggcgtggcagtggccggggggacggccgtggtggtggtcgtctcctccatcttccacgtgtccggaggccacgtcaacccggcggtgagcgtcgccatggcggtgttcggccacctcccgccagctcacctcgcgctctacgccgccgcccagctcctcgggtccgtggcggcctcgttcgtggccaaggcgctctacgctggtccggcgaacctgctaggccccaccgtcgccaccgtgcctagcgtcggcgcctctcacgcgttttgggtcgagttcatcaccaccttcgtcgtcctcttcgtcgtcaccgctcttgccaccgaccccaaagcagtgaaagaaatggtggcagtgggagctggcgcggcggtgatgatgagcgctctcatctccggggagtcgaccggagcgtcgatgaatccggcgagaacgctggggacggcgatcgccacggggacgtacaccaagatctgggtctatatggttgcgcctccgctgggcgccattgctggatgtggagcttaccatgtgctcaagtgatgtatctatcatccatgtaatctagctagtgatatggatcggaaacagaaggtgctcgatatatatgttcgcaactaaatgcggttgcatgcatgcatggtagaaaaccactcaaacgtacgcaaaaaaaaaaaaaaaa

SEQ ID NO: 9122 - DNA, 1998 bp, Zea mays
  misc_feature (1979)..(1985): n is a, c, g, or t
aaaaaagatttagaaacggaagagccaacagcaagcgaagcatcgccagattggtatatcgatcgattgatcggtggcggaggaaggggaggacggggggcagatggcggcgtgccggggcttcttcgagtgcctgctcaggctgctcaacttcatcctcaccgtcgccggcctcgctatggttggttacgggatctacctgctcgtcgagtggatgaagatatccgaggacggcatcggcggggcttcgacggcggaggtgctcgtctctggccggccgttgttgggggctgtcattctcggtgacagcttcctcgacaatctacccaaagcatggtgagatggtttccttgcctgtggacttttttttctgatgtatcaatactggtttcgtccatgtgatgtcgccattgattatgattttggattgagaggaactgcaaggtttgcttagtaggggtggcaatcacaactgtgaatgtgtgaaatatgcaattgatagccaaaacacgcagttccaaattgcagtctgacgaagcatttgttactcgcctttagattattggtgagcatgttgggtagggggtaaattatgtgtggatttgaatgttccaagtatcattgactctttagtttggcaactgtgggttttctctgtttgtttttactgccaaggtgattgtgtttcatatttaatagcctctgttccctgcaggtttatttatttgtttattggtgttggcaccatcgtcatcttggtgtctctgtttggctgcattggagcagggacaagaaacacctgctgtttgtgtttcgtatcctgttatgtgcctcttcggcgtcattatgttgtcctctctaaagaagattccatttgtcatgcacaagacactaaaaagtacttggaattatgctcaacattaattccagacgggatattattagttgctgaacatgtgaaccaacaaaattttgtttctgtgctactctgaacgctgatcttaattcttatagaacagcagtagcagaggcaataagattatcactatttctgcagcccaaaaaacgtttcgtccaaggcacttggcattttataatgatagggtcacagtattacacgcttgtttccttttacttgtaaacaagtatgctttcttggtcatattgttgatccttgctgaagctgcagctgctgcattcattttctttgaccatggctggaaagatgtgagtattctattgggtgcttatctcaggaactaaactactataatgtaccttgccttaccatttccttgagtagctgtagttatcaatagacttcttttgcaggtaattccagtggacaaaacacataactttgatgttatgtatgactttctgaaggaaaactgggagattgcaagatgggtcgctctgggcgttgttgtttttgaggcagtgctcttgctgttagctctggctgtcagggcaatgaacaaacctgctgagtatgacagtgatgacgaaattatagcaattggccgaagccctaccatccggcagccactgatccatacccaaaatgttcctgccactggtgttcctgtcccaacacttgatcaacgtgcaagtagaaatgatgcctggagccaaaggatgcgagagaagtatggtctggacacgagccagttcacatacaacccttcagacccaagcaggtaccagcaaaatggcacgccacgggctgaagaaaggagtcgatgcactataatgtgaagaattcttcatgaggtcctacgagataatagactttcttgaaggggctactgtagtttggtgttaccagtgttgttcagactttacacagcggtgtgtggaatagaagaatcccgaccatattttttgtcacgctcgatatgacttctcagcaaatgctctatgcacctaattttactgtgaatgaggaactgctagccgttgacatcatcgactctgannnnnnnaaaaaaaaaaaaa

SEQ ID NO: 9123 - DNA, 1398 bp, Zea mays
ccacgcgtccgcaacccgtcctcctgtccttcttcccctcacccaccgcgccggcagcctcggcccccgcaaacactaaaaaagaattagaaacggaagaagaacagcaggcgaagcatcgccagattggtatatcgatcgattgatcggtggcggagggaggggaggagggcggcagatggcggcgtgccggggcttcttcgagtgcctgctcaggctgctcaacttcatcctcaccgtcgccggcctcgccatggtcggctacgggatctacctgctcgtcgagtggatgaagatatctgaggacggcagcagcggggggttgacggcggaggtgctggtctccggccggccgttgttgggggctgtcgctctcggtgacagcttcctcgacatgctacccaaagcatggtttatttatttgttcattggtgttggtgctactgttttcctcgtgtctctgtttggctgcattggagcagggacaagaaacacctgctgtttgtgtttctatgccttcttggtcatattgttgatccttgctgaagctggagctgctgcattcattttctttgaccatagctggaaagatgtaattccagtggacaagacacataactttgatgttatgtatggctttctgaagaaaaactgggagattgcaagatgggttgctcttggcgttgttgtttttgaggcagtgctctttctattagctctggttgtcagggcaatgaacaaacctgcggagtatgacagtgatgatgaaattattgcaattggccgaagccctaccatgcggcagccattgatccatgcccaaaatgtgccggccaccggtgttcctgtcccaacactcgatcagcgttcaagtagaaatgatgcctggagccaaaggatgcgagagaagtatggtctggacacgagccagttcacgtacaacccctcagacccaagcaggtaccagcagaatggcgctccacaggctgaagaaaggagtcgatgcactataatgtgaagaattcttcatgacgtcctacgtcataatggttttcttgaacgggctacctcagcttgtgtagtttggtgttgttcagacttcatagctgtgtgtgtggaatgcaaaaatcccgaccatattgtttgtcacgcttgatgtcttctctgcaaatgttctatgcacttgtaattttaccgtgaatgacgaactgttagccattgacatcatctattttgtattttaggggggttgtttcttcttgccagtcctaccattttcatgtagctctgtttaatcatgatgctttactcaaatatatgtaagatttggttgtgccgtgaaaaaaaaaaaaaaaaaaaaaaaaaaaaaaaaacaaaaaaaaaaaaaaaaaagcggcc

SEQ ID NO: 9124 - DNA, 1358 bp, Zea mays
gccggccgggccgggagaacggaggacagaagcaagcgaagcatcgccagattggtatatcgatcgattgatcggtggcggaggaaggggaggacggggggcagatggcggcgtgccggggcttcttcgagtgcctgctcaggctgctcaacttcatcctcaccgtcgccggcctcgctatggttggttacgggatctacctgctcgtcgagtggatgaagatatccgaggacggcatcggcggggcttcgacggcggaggtgctcgtctctggccggccgttgttgggggctgtcattctcggtgacagcttcctcgacaatctacccaaagcatggtttatttatttgtttattggtgttggcaccatcgtcatcttggtgtctctgtttggctgcattggagcagggacaagaaacacctgctgtttgtgtttctatgctttcttggtcatattgttgatccttgctgaagctgcagctgctgcattcattttctttgaccatggctggaaagatgtaattccagtggacaaaacacataactttgatgttatgtatgactttctgaaggaaaactgggagattgcaagatgggtcgctctgggcgttgttgtttttgaggcagtgctcttgctgttagctctggctgtcagggcaatgaacaaacctgctgagtatgacagtgatgacgaaattatagcaattggccgaagccctaccatccggcagccactgatccatacccaaaatgttcctgccactggtgttcctgtcccaacacttgatcaacgtgcaagtagaaatgatgcctggagtcaaaggatgcgggagaagtatggtctggacacgagccagttcacatacaacccttcagacccaagcaggtaccagcaaaatggcacgccacgggctgaagaaaggagtcgatgcactataatgtgaagaattcttcatgaggtcctacgagataatagactttcttgaaggcggctactgtagtttggtgttaccagtgttgttcagacttcacagcggtgtgtggaatagaagaatcccgaccatattgtttgtcacgctcgatatgacttctcagcaaatgctctatgcacctaattttactgtgaatgaggaactgctagccgttggcatcatctattttgaattttttgggggtttgtttcttgttggcaatcagcccccctttcatccttctacgtaagttccagattgtcactccgtttgatttagatgctttactcaaatgtgtgtaagatttggttgtgacgtgaagtgagatgggaatgggagaatctattttgctttcaataagaatcaagatgtctaaaagagtaaaac

SEQ ID NO: 9125 - DNA, 1587 bp, Zea mays
gaaaagttaaagaggtctaatatgacggcctcggaaaccatgaccgagtatgagaacatgaagaaaatgctggaaagtgttcagtctcgccttgaagaggccgagcaaacaattcgcgggggagagaatttacgaaaaaagttacataatacaattcttgagttgaagggaaacatcagagtattttgtagagttaggcctttgctgccaaatgaatcaggagcagtatcatatccaaagaatggagaaaacttaggccgaggcattgagttgttacataatgcacagggatattcgtttacttttgataaagtatttgatcattcggcgtcacaagaacatgtgttcatagaaatatctcaacttgtccaaagtgccctagatggctataaggtctgcatatttgcctatgggcaaactggttctggtaaaacatatacaatgatgggcaaccctgagttagaagatcaaaaaggaatgataccacgatctctggagcaaatttttcaagctagccagacacttaactcacagggctggagatataagatgcaggcctcaatgttggagatttacaacgagactatacgcgacttgctagcaacgaatcgcatggctgctcaggatgttggggcttcaaagtacagtatcaagcatgatactaatggtaacacgaatgtgtcggaccttacgatcattgacgtaactagtatcaacgaagtttcttctctccttaggcgggctgctcagagcagatcagttggtagaacacaaatgaatgaggaatcatcaaggggtcactgtgttttcactcttcggattttcggtgtaaatgagggaacggatcaacaagtgcaaggagtgctgaatcttatagatctagcaggcagtgggcgcctgaacaaaagtggtgccacgggtgatcggttgaaagagacagtggctatcaacaaaagcttgtcatgtttaagtgatgtcatcttctcgattgcaaagaaagaggaacacgttccatttcggaactcaaagctgacatatctgctccagccgtgtctcggaggggactcgaagacactgatgtttgtgaatctgtctcctgaagcgtcctcgacaggggagtctccttgctcattgcggtttgctgcaagggtgaactcctgtgagatcgggatccccaggcgccaaacccagatgcggagctcacaatgatgaaatacggcggaagcgagctgccagtgtaatgcttgacatttgcatccccttgtctggaggtggtgtgagttgccaattttttatttggtttgtggccttgttgattgcgctaacggctggcagcggtgggtgtgctggcctaattatattaatcttaggacctgatctgatttgtatgttgggatgtgttgccattttcattttttgcttgcatttgtagtctttattgatttgtcgtttgccaaatgcccaatgcctctgagctgagctgggcgtgtatgtaaacaactgtgtacccgttgtcggacacgcacacaggctgacatgataattgtatttccctgctctgggaattctgcaaaaaaaaaaaaaaaa

SEQ ID NO: 9126 - DNA, 1990 bp, Zea mays
ctagacattgcaaggtctttgcaaaatgaagccacaaaacaaaagaccgatttattaaaggaagttgaaagtattagaatggagcttcaacgtgcaagggaggaccgtgacactaaatctgctcaagtagattctttgctggttgatattggaacatacaaagaaatgactggaaaatccgtcattgagttagatagcgccatggcaaaaacctctgccctagaggaaacatgttcgtctcaaaggaagatgatagagacattggaaattaagcttgcagctgccaatgaaaagttaaagaggtctaatatgacggcctcggaaaccatgaccgagtatgagaacatgaagaaaatgctggaaagtgttcagtctcgccttgaagaggccgagcaaacaattctggaaggagagaatttacgaaaaaagttacataatacaattcttgagttgaagggaaatatcagagtattttgtagagttaggcctttgctgccaaatgattcaggagcagtatcatatccaaagaatggagaaaacttaggccgagccattgagttgttacataatggtagagtcatcattacagtcatttttctagttttaaactttgatatattatatttgagaatacaaattatgatacaattgcgttgtatttcttattgttttcagcacagggatattcatttacttttgataaagtatttgatcattcggcgtcacaagaacatgtgttcatagaaatatctcaacttgtccaaagtgccctagatggctataaggtctgcatatttgcctatgggcaaactggttctggtaaaacatatacaatgatgggcaaccctgagttagaagatcaaaaaggaatgataccacgatctctggagcaaatttttcaagctagccagacacttaactcacagggttggagatataagatgcaggcctcaatgttggagatttacaacgagactatacgcgacttgctagcaacgaatcgcatggctgctcaggatgttggtgcttcaaagtacagtatcaagcatgatactaatggtaacacgaatgtgtcggaccttacgatcattgacgtaactagtatcaacgaagtttcttctctccttaggcgggctgctcagagcagatcagttggtagaacacaaatgaatgaggaatcatcaagaagtcactgtgttttcactcttcggattttcggtgtaaatgagggaacggatcaacaagtgcaaggagtgctgaatcttatagatctagcaggcagtgagcgcctgaacaaaagtggtgccacgggtgatcggttgaaagagacagtggctatcaacaaaagcttgtcatgtttaagtgatgtcatcttctcgattgcaaagaaagaggaacacgttccatttcggaactcaaagctgacatatctgctccagccgtgtctcggaggggactcgaagacactgatgtttgtgaatctgtctcctgaagcgtcctcgacaggggagtctctttgctcattgcggtttgctgcaagggtgaactcctgtgagatcgggatccccaggcgccaaacccagatgcggagctcacaatgatgaaatacggccgaagcgagctgccagtgtaatgtttgtgtgttgatttggtgatgcaaccgatcatttgcatccccttgtctggaggtggtgtgagttgccaattttatttggtttgtggccttgttgattgcgctaacggctggcagcggtgggtgtgctggcctattatattaatcttaggacctgatctgatttgtatgttgggatgtgttgccattttcaattttttgctttcattcgtagtcttgatttgtcgtttgcccaatgcccaatgcctctgagctgagctgggcgtgtatgtaaacaactgtgtacccgtcgtcggacaagcacacaggctgacagcctgacatgataattgtatttccctgctctgggaattctgc

SEQ ID NO: 9127 - DNA, 1806 bp, Zea mays
tgggtacccggccccccctcgtgtttttttttaccttttttttctgcaaataaaggtacatcttcagccatatgcaagtgagcacacgtagcattctatacatttataatctggtgatgtcagaacagacaaataattgcatgctgcagggccaatgaggggccatcagtggttacagctcaaaaaagggtaacgggaaaatggctgaaagaatgcgacaaaacttgcatggaatttcctgataagaattagcatggtagctgacctgactccactaaaaggcgagtgccctggtttctacatattaaactgtgatatcaagccgcggttcaaagcagaagccagtgaatagctggagaggaaatcttttgctcacagggcattttacggaccacctccattgcttttgcatcatgtcaaaaacaagcaaagcagttgcaccatagctttgtatgtagacaaggtcatctataccgctgcaggcaaaaacatcatcgaattcaccaaatccttggaagaacttgtggggcatccgagctacctcatgccactgtctttcatggagctcccatattcctatgcctttaatgatatcaggtctgttgtgttttgcgatcccaccaaccagaaccagcttctccttcaagtttaccagacggccacacgtgagagaacaaggtactgagattgacgtttgcatcaacgaagtctcggatggttcaccggcaaggtcatacatgataaggccatgacgggggttgacattgccaagagcaccagtggaatgaatcaagcagtacaggacaccgtcacatatgacactattatcacctcctctccaaccaacgaacacttccctcacagaagttacccatgaaccactcgatgagtcgtacttgtatactgaaaagtcccatcggacaaaatcttcaggaatctgcttagattttgccaatgcaatggagtacttatgggacagccgatccacattcatggcaatggtactgtagtctggcaatgtctcaccgggcggctctaaaagcctcctggagtgctttgttatagggttacatacagaaatggtgttcctgttgtcattgtccatgaagcaaactaggccacaagaagaagagataaagcagctgctcttgtcaatataaggaagctctaaatcataccacttgcggaggatggggtcaaaagcataaccagcagcagttttattagaggtgaacatgaagtaccatggccgctgaggcagcatgtgggtccacagaaatctccttgaacagataatgtcgtgccatctcttgcacactgatgttgccctcatcatgcttgctataggcaggaatgtgaaaatcctctccaggatatcatcagggacgacggcatccaatgatattgagaagtcgttgcctccattgctagcttcggaaacaactccagagttgaatacaggagttctaatgtgctcaactggaagatagtcccatgatgaatggccttccattagatggattgtgaagcaagcagacggatgacctggtgggtgctgctcgtgagaggcgaatagcacgagaacggcggcggcgctcggctcgtccccgccgcaaggaggacagagagagagagggaggggggtgaacggaagaagaataagcctgttgggccccgcccccccggccgcgtctggccaaataaatcgcgaacggacccgaacgcacagccttgtccagcgcctgtgggcgatgatgcaaggacggccacgctacccgtcctcgggcggctcctctgaatgggtgc

SEQ ID NO: 9128 - DNA, 1617 bp, Zea mays
  misc_feature (1351)..(1351): n is a, c, g, or t
  misc_feature (1421)..(1421): n is a, c, g, or t
  misc_feature (1510)..(1510): n is a, c, g, or t
gcacggcacgacaacacgagcgcgggcgcgcacaagttcgccaacccccacgccccaccccccaccccccgcgtgctgcgcgtcgttggaaccaaggattggattagcctcgccgaggaggaggtggtggtcggcgaggggctcgcggggatggggatctcgaggccccttgtgatggcgatggcggtggcgctgctgatcgccgtcgccggtgcgaccgccgaggagcaggagcccctgctggcggcggacgcggtggccggcgcggtggaggcggcgctcggggaggtggagaccgcggcgctcagggccgagctggggcaactccgggcgaagatctcggcgctagagtcagacatagaagagcgatctcaagaactgaagaataaggatgatgccatcatgaacctggagaaagccattgaagagaagtcaaaggctattacctctatgctggacgagattgcttccctccaggcaaaagggtctgtagctgccgaggagcaggctaacaaggccaatgccaaggttgttgagcttgagaagcaggttgacaagataaaaaaggatattgaagcacaaagtagccagaaagcagcactagagtatagggccaacgatgcagagaagaaggtggaagtactgaatgaaaagcttaatacaatccaaaaggaaagtgatgagaaaaaacgcaaaatcaagaagacagaacgtgctcttaaagtcgctgaggaggaattaatgaggttgcagttagaagtaactgctaaatcaaaacagctgtcagaggttcatggagcatggttaccaccttggctaatggcacaatatgctcgttatgcggaggttgtctcaggtcactggaatcaacatgggaaacctgctgtgcagaatgttttgcataaggcatcagaaaaatcagcacaggcaaagaaatgggctgaacctcatatcgagactgctaagatgaaatggattcctgttaaacagaaattggttttcctcaagaaaaatgcagaaccttatgtacaaaaggtatcaacaagatcagtggagttttacgagtcatcaagggatgctgtgacacctcatgctgtcaaagttaaagtgtttgttcattcctactaccagaaagccaagaagttttctaagccttacattgatcaaattgctgagattactaaaccacatgttgagaaaattagaactactctgaagccatacactaagagagcagttcatgcatatgggtcatttctcaagtcggcaaccacataccatcgacaggctcaagcaagcatcatggactaccttcaccagcatgatataacaaaatcattggcaactaagnagttaagtttggttcctggcttctgctttgctggctctgcctgtcttcattatatacaggcttctagtanggaccttctgctccaaaagaataaaggcctcgtagtaataatgggtaccatgggccacagagatacagcggcgacatgctgacagtaanatcagttactgacctttttaagggtcagtaatgctgggtaccgtggcaaatcttgaccaggaatgggtcatgggcacccttaccttgaaagcttgaccacaccacat

SEQ ID NO: 9129 - DNA, 2082 bp, Zea mays
gaacgacaaacacgagcgcgggcgcgcacaagttcgccaacccccacgccccaccccccaccccccgcgtgctgcgcgtcgttggaaccaaggattggattagcctcgccgaggaggaggtggtggtcggcgaggggctcgcggggatggggatctcgaggccccttgtgatggcgatggcggtggcgctgctgatcgccgtcgccggtgcgaccgccgaggagcaggagcccctgctggcggcggacgcggtggccggcgcggtggaggcggcgctcggggaggtggagaccgcggcgctcagggccgagctggggcaactccgggcgaagatctcggcgctagagtcagacatagaagagcgatctcaagaactgaagaataaggatgatgccatcatgaacctggagaaagccattgaagagaagtcaaaggctattacctctatgctggacgagattgcttccctccaggcaaaagggtctgtagctgccgaggagcaggctaacaaggccaatgccaaggttgacaagatcaaaaaggatattgaagcacaaagcagccagaaagcagcactagagtatagggccaacgatgcagagaagaaggtggaagtactgaatgaaaagcttaatacaatccaaaaggaaagtgatgagaaaaaacgcaaaatcaagaagacagaacgtgctcttaaagtcgctgaggaggaattaatgaggttgcagttagaagtaactgctaaatcaaaacagctgtcagaggttcatggagcatggttaccaccttggctaatggcacaatatgctcgttatgcggaggttgtctcaggtcactgggatcaacatgggaaacctgctgtgcagaattttttgcataaggcatcagaaaaatcagcacaggcaaagaaatgggctgaacctcatatcgagactgctaagatgaaatggattcctgttaagcagaaattggttgccctcaagaaaaatgcagaaccttatgtacaaaaggtatcaacaagatcagtagagttttacgagtcatcaagggatgctgtgacacctcatgctgtcaaagttaaagtgtttgttcattcctactaccagaaagccaagaagttttctaagccttacattgatcaaattgctgagattactaaaccacatgttgagaaaattagaactactctgaagccatacactaagagagcagttcatgcatatgggtcatttctcaagtcggcaaccacataccatcgacaggctcaagcaagcatcatggactaccttcaccagcgtgatataacaaaatcattggcaactaaggagttagtttggttcctggcttctgctttgctggctctgcctgtcttcattatatacaggcttctagtagggaccttctgctccaaaaagaataaaaggcctcgtagtagtaatggtaaccatggccacaagagatacaagcggcgacatgctgacaagtagatcagtttactgaacactttagggttcagtatgctgtgtaccgtggcagatctttgagcaggattgggtcatgggcacccttaccttgaaagcattgtacaccaccaacatactcttctcttttgcattttcgtcccaggtgtaatatggacttcagtgcagcagaccttttatctgcactttgctgggttcatgtggttatgcctcggcctttgtttgattggtcatttgtttattgtaacttgtgaatgcgtttgaatttgtatgcttgttcttgtcggcgacctacattcgaacttattacttatgtatacagtggttggtttagctaataactggatgtctcctgttcacttcgttcaaatacggcttggtcgacaccatgatctggtagaatggtggctgactcagctgctgaagtgttacgaacaggattacaggaaaaagagagtgtctataaattgctagccatcctgtatgcttggtgtgttatatcaaaatacagaaactcaacatcagtttgtcatgtagggtccgagtactgaacctgagctgctggaattacccaatggaatcacgaccttgaattcttctc

SEQ ID NO: 9130 - DNA, 813 bp, Zea mays
cattgggtacctcgaggccggcctgcatataccgagtagaatagagaggggagagggctagggttcagagcacgacgagccataacttcaacaagcagcgggcgggtctcgggcggcgcgcgggcgcttggtggacgacactcaagcggaggcgggcagcgcttgggagtcaggcatgcgaccttgcggctgtgctcaggcggggcgttgcgtgaagcgctagggagtcgggtgtgcgacgggcggcgctcgttcctcaggcatgtgcggacgatgctcagacgacgccgacacaggtccaggtccaggtccagttcatggagcatggttaccaccttggtttgcggcacaatatgctcattacgcggaggttgtcgcaggtcactagaataaacaagggaaacctgctgtgcataatgttttgcataagagaaaatggttgccctcaagaaaaatgtaggaccttatgtataaaaggtatcaacaagatgttaatgggataaacctcatattgagaccgctaagatgaaatggattcatgttaaggagaaattggttgtcctcaagaaaaatgcagaaccttatgtacaaatggattgtcttcaaaatgttgttcttgtagctacaacaaagagaaacaacaatggtggtgatgctatacgtgtagaagtagcaatgttggtcttgtagctccaagattttgttattttgttgttgatgaatgatatctatgataatatattgccaaaaaaaaaaaaaaaaagcggccgcttttttttttttttttttggttctactttgaaaaggcttacc

SEQ ID NO: 9131 - DNA, 1956 bp, Zea mays
cctaaaaaacgataccgggcgggcaggcacacgagcgcgagcacgcacgagttcgcgagtccccctgacccccacgtgcgcgtcgttggaaccaaggattggattagcctcgccgacgacgaggagagaagagctggtggctggcgaggggctcgcggggatggggatctcgaggcccctggcgctccttctggcgctgctgatcgccgtcgccggcgcgaccgccgaggagcccgtagtggcggcggactcggtggccggcgcggtggaggccgcggcggcgctcagggtggaggaggctgcggaggccgcggcgctcagggccgagctggagcagctccgggcgaagatctccgccttagagtcagacatagcagtgcgatctctcgaactgaagaataaggacgatgtcatcgtgaacctagagaaagccattgcggagaagtcaaaggctattacctctatgcagggcgagattgcttctctccaggcaaaaggatctctagctgccgaggagcaggctaacaaggccaatgccaaggctgttgaacttgagaagcagattgacaagctcaaaaaggatattcaagcacaaagtagtcagaaagcagcactagaatctagggccaacgatgcagagaacaaggtggaaaagttgaatgaaaagcttaatacaatgcaaaaggaaagtgatgagcaaaaacgcaaaatcaagaagacagaacgtgctcttaaagtcgctgaggaggaattgatgaggttgcagttagaagcaactgctaaatcaaaacagctgactgaggttcatggagcatggttaccaccttggttagcgacacactatgctcgttacatggaggttgtctcaggtcactggaattatcatggaaaacctgctgtgcagaatgttttgcataaggcatcagaaaaatcagcacatgcaaagaaatgggctgaaccacatattgagactgctaagatgaaatggattcctgttaaggagaaattggttgtcctcaagaaaaatgcagaaccttatgtacagaaggtatcgacaagatcagtggagttttatgagtcatcaagggatgctgtgacacctcacgttgtcaaagttaaagagtttgctcatccctactaccaggaagccaagaagttttctaagccttacattgatcaaattgctgagatcactaagccacatgttgagaaagttagaactactctgaagccatacactaagagagcagttcatgcgtatgggtcatttcttgggtctgcaaccacataccatcgacaggctcaggcgaccatcatggactacctccatcagcatggggtacccaagtcatttgcaacgaaggagttagtttggttcctggcttctgccttgctagctctgcctgtcttcgtcatatacaggcttgtagtagagaccttctgcaccaaaaagaacagaaggcctcgtggcggtaatggtaacggtaaccatggccagaagagacacaagcggcgatacgccgacaagtagaccaatctacccaacactttagggttcagcatgctgtgtttgcattgtcgcgcatctttgagcaatgagcaagattgggttgctcctccctcccggaggcactgctgaaccatacatggaggaaggagactcgggtcatgggcaccctttaccgtgagaagcgttgtagcctacaccaccaacatttctctttcttttacttcttcccaggtgtactatggacttcggtgcaggtgcagcggaccttttatattatctgcactttgctggggttcagggggttaggcctttgttttattggtcgttgtttattgtaacttgtgaattcgtttgagttcgtctgtttgtttttttggctggcgacctacattcgaacttgttagttgatgttgaagtttgactctagttgctggagtgtcatgaac

SEQ ID NO: 9132 - DNA, 1506 bp, Zea mays
  misc_feature (1395)..(1395): n is a, c, g, or t
ggttgcctaaataacatggtttgttcttcgtagcgttaattgttagcaactaaaatgaatcagtcatggtagagggtatcaatatctaaacacaattaaatctctttatattctcattctttttagaataggattttttctggatcagcactttctccattctacagtgtgcccaactactgttgttagtcaagctttatgcagcttgttacttgctggtgaactgtagaacggtagtctgatgagttaaagcagccatactttatttgccaggtcaggtgttaggtatcgcttatttttctttatcttttatgtttatcagtcaacgagagatcccttcttcgaacatcgacttgcattctgtacattgtgcccgtaacctccaaaagtgccagcactgtggagaaatgattcctaggaaacttatggatgaacactatgatgcaaaccatgccccggtatgtttgcaattgtttgaactttgaagtgtgatttcttatgacatccatgacatacttaatcattctctctttgcatgattgacaatacttattttcattttaataatgttgtaaatttggctcttatagacatagtaaatgggatcatatgtatgattgcaccatgcttaccttttaagctaattgcactattgcagaatttacacagttagaattaacatatttattacaccggtccttttcttatcaccttgataatgtggtagctgcttcatatacttgcaatttgcatatgcattttgttttgtgttacattgagcaattgaaactatgagctagtgaaataatgtcgatgtataggagcaagaggagtaaatgtagcttttatgcccaggtcgtttagaactcctggtttaggtaattatattttactgcattaaatattttttccttcttgcatacagatcagttgctctctttgcaaagaaacaatagaacgtgtgaggtgggatcttcataaaggcgaaaagtgcccacaaagaatcgtcgcttgtgaatattgcgagtttgaattgcctgcagttgatctccatgagcatcaggatgtatgtggaaaccgaacagaactttgccaaacatgcaggaagtatattagattgcgtgaatggatagggcacgaaatacagtgccatacaagctcaaatggttctgcagacacatccagtgccagagcaattccagagagagaactacgaccgccgccgccggtgcggccagcacgaccagcacgtcctgctcatgcttcaccacacaagcggctcctcttcacaatcgctgtcactggaatagcagttatggttggctccatactgttccaaagggacgagagtttctagctccagtggccatggacttactctgtctgtcatggtgnttcttgaccgggagagtcatgccacagggagtgtatttatgtataataactcctcgatcagtgcataaatcgagtttgtttgagagcaaaaaaaaaaaaaaaaactcgagg

SEQ ID NO: 9133 - DNA, 1227 bp, Zea mays
cgattcggcacgacgcatgccacgcctgaccgcccccctcctcgcctaatctacccaccacccggccacccgtctcgccctctcataaattctctctcgctgcccaccgatcaaccaccccgcttcccccgaccgcgtctcggagcacccttctcaaccgcatcctgcctctgctcggtgtcgccgtctcgactgcaggagaggggagcgccccgtcgccgatctgatcgggagccggaggccaagcgtcgaggtgagcccgtcaggaaccgccatggcagcggccgccgccgattccgacaccgccgcagctgtgggcgccatgtccacctgcgcccactgtcagcgagaaatcccatttttgaacatcgacttgcactctgtacattgcgcccgcaacctccaaaagtgccagcactgcggcgaaatgattcctaggaaacttatggatgaacattatgatgaaaaccatgccccgatcaattgctccctttgtaaagaaacaatagaacgtgagagctgggatcttcataaaggtgaaaagtgcccacaaagaattgtcgcttgtgaatattgcgagtttgaattgcctgcagttgatctccatgaacatcaggatgtatgtggaaaccgaacagagctttgccaaacatgcaggaagtatattagactgcgtgaatggacagggcacgaaatacagtgccatacaaactcaaatggttctgcagacacatcccgagcaattccagagagagaactacgaccgccgccgccgccagtgcgacaggcgcgaccagcacgtcctgcccacgcttcaccacacaagcggctcctcttcacaatcgccgtcactggaatagcagttatgatcggctccatactgttccagagggacgagggtttctagctccagtagccatggactcgctctgtcaaggtgcttcttgaccgggagagtcatgcggtcatgccacaggaaggtggtattaatgtataataactcgttcgaatcaattacaataactggagtttgttagggagtatagccccaggcatgcattcgtcaaaaggcgaagttatgttctgcccctggcagttctgagacttgtgtttgctttgacactgcacttgaatttgttcatctgtaagtcagagatgagttatacaatcggccactgtcagatctggaaaaaaaaaacggtgcagcagatgttaatactttggctt

SEQ ID NO: 9134 - DNA, 5112 bp, Zea mays
  misc_feature (4594)..(4594): n is a, c, g, or t
  misc_feature (4693)..(4693): n is a, c, g, or t
aagctgcgcgtgctgcgcaccgacaacggcagcgaattcacggcggcggagttcgcgtcgtactgcgcggatgagggcgttcagcgccactactccgcgtcgtacaacctgcagcagaacggcgtcgtcgagcggcgcaaccagacggttgtgggaatggctcgggctctcctcaaacagaggggaatgtcggctgccttctggggagaggcggtggtgacagcggtctacatcctcaaccgctcgcccaccaaggcactcaacgggatgacaccgtacgaggcttggcatgggcgcaagccggcggtctctcacctacgggtcttcggctgcctcgcgttcaccaaggagcttggccacatcggcaagctcgacgacaggagcaccccgggggtgttcattggctacgcggagggctcgaaggcctaccgcatccttgacccaagaacacagcgtgtgcgcacggcgcgcgacgtagtgttcgacgaagggcgaggatgggcgtgggacaaggcggtggacgacggcacgactccgacgtacgacttcaccatcgagtacgtccactttgagggagctgggggagtaggcaactcttctccgagcaggtctaccccagcccccaagtctccaccgactccagcgccacactctccagctcctgctacaacgagctcttcaccaccacgcactccagccacgactccggctacagcgagctcttcgccaccacgtactccagcaccgacggtaccctctccgggaacgtcctctccgacaccagctcgtgtcgagcacgacccagtggagctcgtgacccctctgtcccgcgacgaggagcgcgtcgacgcgtgctacgacggcgagccgttgcggtatcgaagggtggagggccttctcatcgacccgtcggtgccgggccctgcgtctcgcattctggcaggagagttgcatcttgcatgcgacgatggtgagcctcggtctttcgcggaggccgagaaacatgcggcttggcgtgccgcgatgcagtcggagatggacgcggttgagacgaaccgcacttgggagctcgctgatctccctcatggtcatcgcgcgatcacccttaagtgggtgttcaaactgaagagggatgaagccggcgccatcgtcaagcataaggctcgcttggtggcacgcggtttcttgcagcaggaggggatcgacttcgacgatgccttcgcccctgtagcacggatggaatccgtgcgactcctcgcgctggcagccctgaagggctggcatgttcatcacatggatgtcaagtcggcgtttcttaacggcgacttaaaggaggaggtctatgtacaccagccgccaggttttgcgatccctggcaaggagggcaaggtgttgcgcctgcgcaaggctctctacggcttgcgacaggcaccaagggcgtggaatgccaagctggattccacgctcaagaggatgggcttcatgccaagcccgcacgaggcggccatctatcggcggggcaatggaggaagtgccctgctggtgggtgtctacgtcgacgacttggtgatcaccggcgccaaggatgcagaggtggcagcgttcaaggaagagatgaaggccaccttccaaatgagtgacctggggcatctctccttctacctggggattgaggtgcaccagggagactccgggatcacacttcgccagaccgcctacgccaggcgcattgttgagctggctgggctcaccgactgcaacccagctctcactccgatggaggagaggctgaagctgagtcgcgacagcacgacggaggaggtggatgctacacagtaccggcgtcttgtggggagccttcgctacctcgtccacacacggcctgacttggcatactccgtcggctacgttagtcggttcttgcagcgaccgacgacggagcatgagcaggctgtgaagaggatcatccgctatgttgcggggactctcgaccacggtctctactacccgaggtgccctggggaggcacaccttgtcgggtacagcgacagcgaccacgccggtgacatcgacactagcaagagcacaagcgggatcctcttcttcctcggcaagtgcctcattagctggcagtcggtcaagcagcaggtggtggccatgtccagctgcgaggccgagtacatagcggcgtccactgcttcgactcaggcgctctggctgggctcgactgctcggtgatctcctcgggagagacactggagcggtggaactcagggtggacagccagtccgctctggcattggccaagaaccccgtgttccatgaacggagcaagcacatccggctgagataccacttcatccgagactgcttggcagaagggagcatcaaggcgcgctacatcaacaccaaggatcagcttgcagacctgctcaccaagccccttgggaagatcaagtttgttgagctttgctccaggtccgggatggcccaactttctcacaagacgacgcccaagacttagggggagaatgatggaacgatggaataagtcttgagcatctagaggacaacagtcgcttttgactgtcctctgtagtcctttagcatctagaggacagcttgactgtcctctgtagtctctttagcatctagaggacagcagtcgctttttgactgtcctctgtagtcgctttagcatctagaggacaacagtcgcttttgactatcctctgtagtctctttagcatctagaggacaatcctgttgtatagtgtgtgtgagaaggtgtggtagtgcagcctctagggctataaatatgggtctccaacccttagatgagtatgtcattgtgtagtgtttgaggaaataaacagaaaattgccccaactcatagtgtcatcctcttgatgagagttagagtccctcttgcttacagtcttcttcctagcatgtcgttctttcccgtttctgattctttctccggtgatcgccgggaaactcggtcgggccatcacaaatagatttaactcgtgcacagagaacggaaatcaccgggttgaactcaatatctagtctcgccaagatgtatgggacttgttcttcttcatcaattggcttcatctcatctacaagtgacttcatctttacgatatactcagaaattgacatgttacctttcctgagttgttgcaagtgcaatccttgtattgactattcttgcttgagaacttggcgcattggtctgctcaaggatagtccacaccttatgaggtgtttcacaagtcacgatctgactcatgacttctttagtcatgaaggtgagaaggaaaccaaatacttgttgctcaattgctaaccaccatgtcaactcaggattgatctacatcttcttgtcaccgattgaaacttcaatcttctcggtcagagcggcacacaagccgtcaagataacattgcagttgggcgccctggaggataggcaggacttgcgccctccatagagaataattgttcttgttgagtttctctgcaattgcttgtctcaacagaagttgcgaactagcagagaaagttgaagaactcaccatggcatattgatttttttggcggctaggattagggtttctggatagtcctagcagctagggtttaggtctttaggaggtgggctctaataccatgagagaaaaccaccaaattgtttaagcatatatcctccataggaggccacatgatgtatatttatatgggaagaaactgccaacaagttagagtccaactcagttacaatgtggtagccgctcatgattctatatctagccatgttcggctacaactctatctataattagaatacatctctatgtgtagaacaaggcatgaaggcttaaataattaatccttcttattgggtacccagggacagggtacactaaataggtatgtaacctcatttccaacccaagtccctgccgagcaagtctgcgaggcagagcagccgaccaagtccctgcgagcaagcctgcgaggcaggacggctgaccaagtccctgtcgagcaagactgcgaggcgcggcggccgaccaagtccctgtcgagcaagtatgcgaggcggagcggccgaccaagtccctgtcgaacaagcctaagcctacgaggcagggtggccaactaagtctccgccgagcaagcctgcgaggcggagcggccaaccaagtctccactgaacaaacccgcgaggcgaaaatccgaacctagtggtacgagcccacaccagatgcgacaagacacgccatcacctagccacgcccggacatgcgcacactgtacaggacgagcgccaagggttcatcatcatcacacttgtacgcccctgcaaatagttcaaacatgcccccgattgccccgtaaggtcggtcagcctcagtcatgggagacctcagcacaggggtctcaacagtggcccacatattggaaaagacgggacaacacaccataacgagcgtatgtaccacgtatgatggaaggtgacgcagggcatacaacgggcgaaaccacgccgcgtatgatcacgccctaggacagactcgcangacccgccacgtactaccaccagggcgtcaataacggactcgctacagggaccaacatgatggacaacaccatatcgggggtacggccatgcacggganagaagacctagctcgttgacctagggagataggcctctctctttccctctattttctcgtcaagggcgagactccactgtaaaggctaaaccagtataaacccactatctcaaacccaccgttcgagtcccgacgattcaccattcagattgagtccacgctagcattctctcctccgaacacaaatcttattgtcccctggttcccaaaaccatgacacttctatattctaacacatgaaaagcactatgtcctcagtacgagttacaaagcactcattttcagttgatcaaacaaccagaaccagttgcctgttaaacttctaatttatatctatctgcatacatttcccttccaacatacacaagcatgaagtagcaaaccaatggcattcactgaactgctaggtgcacttacat

SEQ ID NO: 9135 - DNA, 948 bp, Zea mays
  misc_feature (901)..(902): n is a, c, g, or t
  misc_feature (907)..(910): n is a, c, g, or t
  misc_feature (917)..(917): n is a, c, g, or t
tccggccccccccgcgcctaatctccccgccccgccggcggctccgccccgcctcacccgcagcctgtctctgctcggcggcggccgtctcgactgcgggagaggggagcgccccttcgccgatctgatcgtgagctgcaggccaaacggcgaggcgagcccatcaggaaccaccatggcagcggcagccgccgactccgatcccgccgcagctgtggccgacatgtccacctgcgcccattgatcagttgctctctttgcaaagaaacaatagaacgtgtgaggtgggatcttcataaaggcgaaaagtgcctacaaagaatcgtcgcttgtgaatattgcgagtttgaattgcctgcagttgatctccatgagcatcaggatgtatgtggaaaccgaacagaactttgccaaacatgcaggaagtatattagattgtgtgaatggatagggcacgaaatacagtgccatacaagctcaaatggttctgcagacacatccagtgccagagcaattccagagagagaactacgaccgccgccgccggtgcggccggcacgaccagcacgtcctgctcatgcttcaccacacaagcggctcctcttcacaatcgctgtcactggaatagcagttatggttggctccatactgttccaaagggacgagagtttctagctccagtggccatggacttactctgtctgtcatgttgtttcttgaccgggagagtcatgccacaggaggtgtatttatgtataataactcctcgaatcagtgcataaatcgagtttgtttgagagcatagccccaggcgtgggtttgtggaaaatgcaaagtaaccgtggataaatgcgttcgcccttggcagttctggaaaaaaaaaaaaaaaaaagcgcccaannaatannnnaaaaaanaaaaaaaaaaaaaagaaaaaaaaaaaaaaaa

SEQ ID NO: 9136 - DNA, 1257 bp, Zea mays
aaaggtgaaagtcgatgccagtagtagctacagcagttaatgcgaaaaactgaagcatgccacgcctgaccgacccccttctcgcctaatgtccgtgccccgactgcgtctccgccccgactcacccgcagcctgtctctgctcggcggcggccgtctcgactgcgggagaggggagcgccccttcgccgatctgatcgggagctgcaggccaaacggcgaggcgagcccatcaggaaccaccatggcagcggcagccgccgactccgatcccgccgcagctgtggccgacatgtccacctgcgcccattgtcaacgagagatcccttcttcgaacatcgacttgcattctgtacattgtgcccgtaacctccaaaagtgccagcactgtggagaaatgattcctaggaaacttatggatgaacactatgatgcaaaccatgccccgatcagttgctctctttgcaaagaaacaatagaacgtgtgaggtgggatcttcataaaggcgaaaagtgcccacaaagaatcgtcgcttgtgaatattgcgagtttgaattgcctgcagttgatctccatgagcatcaggatgtatgtggaaaccgaacagaactttgccaaacatgcaggaagtatattagattgtgtgaatggatagggcacgaaatacagtgccatacaagctcaaatggttctgcagacacatccagtgccagagcaattccagagagagagctacgaccgccgccgccggtgcggccggcacgaccagcacgtcctgctcatgcttcaccacacaagcggctcctcttcacaatcgctgtcactggaatagcagttatggttggctccatactgttccaaagggacgagagtttctagctccagtggccatggacttactctgtatgtcatgttgtttcttgaccgggagagtcatgccacaggaggtgtatttatgtataataactcctcgaatcagtgcataaatcgagtttgtttgagagcatagccccaggcgtgggtttgtggaaaatgcaaagtaaccgtggataaatgcgttcgcccttggcagttctggaacttctgtttgttctgacatcggacttgcatttgttcgtctgtaaagtcgagatgagttatacaatcggggtatcatatctggaaagcgacacgatgcagcagttgttaatagtttggtttatactgtatcctgtagtgttctaatgtaccaatttgtgggaaactgggactatctcc

SEQ ID NO: 9137 - DNA, 1274 bp, Zea mays
  misc_feature (1229)..(1229): n is a, c, g, or t
  misc_feature (1243)..(1243): n is a, c, g, or t
  misc_feature (1258)..(1258): n is a, c, g, or t
  misc_feature (1263)..(1264): n is a, c, g, or t
  misc_feature (1271)..(1271): n is a, c, g, or t
  misc_feature (1273)..(1273): n is a, c, g, or t
tggtggcgaagctgccgcacccatcgccgccatggcctcctcagcagaggtatcctcttcctctttggcttgctcggcgcggaagagcggcaggatgaagccgcggtagctgggcacgacgtagcggtcgtcatcgtagagcggcaggatgattgccccgagccatttagcgacggatgtcgagttggtgagtagcgtggttgacgaagacatctcgttggaccccagtgacgcgagcaccgtggcgatctgctgcaggccgaagtcatggcgcgaatcgctgatgaactcggcgatggagtcgttgggctcctcgtcaaaaatagcctctccctcgaatcttggtctaagcatttggtcgaacaccttgagcgcggagtgcgcggtggggacctcgtcgatagcgcatgtcctgacgcactcggaggtggcgcgcttgaactcgatgacgagcagggactggcgggtctcctccgactccaactctgactccatacgcggcgcggtgtcgaagcggggttgtcgtcgtaggaaggagatggcgtcacagaacgtgcacttgtggcgaacgcgtcgtcgtacgccagagccgccgaaaagccaccactgctaaccagcgcttcggtcaaacatagctccatgagcgccatctcgttgagaatcttctgtatcgccatatttatggagtcctagtctgataccaaatgttagcgtcagtaatgggaagcttcttagaagagagcagaaaggagtgaggattgaggaagaagacttggaaacgggatgctgggtggaagacaaggctgaaaactagcgtttttgttctattcattaattcttcgatgccgatacaaagttctgattgttgcttaagtactatagacgaccggtcagcgcctgcacaacacgtctttctcaacgcacagcccactcgtggttacccagctcattgtggcccgctgtacttgacatttacagcgtgtttggtttgatggtttggctcatccatcgtggcctggctccggacgaagtggtcttgcactttcttgcggagtgagctgatcccacgtgttagtatattattagaacaacgtagtgacggacgacatcgttccgcgattcaaaccaaatgataatataggctcggacgtaggttcggatgactctggaagcagtccaacctgcacaccacgccctcctctacgcgctgttctcgcgctcgagttgtnttcccatcaagttnttccaattgttgacnccttnnacgccgncna

SEQ ID NO: 9138 - DNA, 1540 bp, Zea mays
  misc_feature (66)..(66): n is a, c, g, or t
  misc_feature (142)..(142): n is a, c, g, or t
  misc_feature (161)..(161): n is a, c, g, or t
ggctttttctttgaaggcaagaagtgcgttgtaagacattcgtcctgagttctggactcgatttcntgacctcaaccttgcgccattgatgcgtatgaccgaccatggattcacaatgttcatgcttctaaaggtgtggatncatttggggaaatctgatnggtctccagaagatggcctgaccgggaagctagagaagcataaaaccaatgataccgaggtttctaaggatagcaatggggaaaatatcgaagttcaacctgaacctataaactacggaaggctggtatccttcggtaaagatgtagcagaggcaccttcttcagagattgaacagatagaatttcgtgatgctgttaaaggtaacgatatcgtccattcaaatgcatcatgccgggagatctggacagagtaccatgaattaggatggggtggaataaaggcagtcgcagactacaaagtttacactgccagttctgttatagaccttcttcactttgttgctccaaggatgatgcagcgtggaaatgtccacttttcatatggaattgctgataacttggatgatccgaaatatcaacattacaaatattggtcaaaccccttggaaacaaagctaccgaatgctcctgacatggaaataatttccatgtacggagtaggcattcctactgaaagggcatatgtctacaagttggctccacaggcagagtgctatataccattccggattgacgcctcggctgatggcggggaggaaaacaaatgcttgaaagggggtgtttacttagctgacggcgacgaaactgttccagttcttagcgcgggctacatgtgtgcaaaagggtggcgtggcaaaactcgtttcaaccctgccggcagcaagacttacgtgagagagtacagccattcaccaccctcaactctcctggaaggcaggggcactcagagcggtgcacatgttgatataatggggaacttcgctttgatcgaggacatcatcaggatagctgccggggcaaccggtgaggaaattggtggcgaccaggtttattcagatatattcaaatggtcagagaaaatcaaattgaaattgtaacccatgggaagttaaaagaagtgcccaacccgttcattgcgttcctaaatgcttgcctgagcgcaactctggattttgcttaaatatcgtaattttttccacgcctcatccgtccctctagtaaatttacattgacaggaccccggtgcgacgcggatgttgtaccgtatttttggcattgtatattaaaatgtacaggcgtaagttacatttgctagctgaaattattgcagtagcttgccttttcttttgagcacggaagtgtgctctccattacgtgataacctgtgccaaatctttgacaatcatatcctgaatataagatggaacattatttcgttgtgtgaccatattacaagagcggggaatgtaattgactatccttgacacaaaaaaaaaaaaaaaaaaaaaaaaaaaaaaactcgcggcacgagctcgtgc

SEQ ID NO: 9139 - DNA, 4274 bp, Zea mays
ggctggtatccttcggtaaagatgtagcagaggcaccttcttcagagattgaacagatagaatttcgtgtgagtattcagaagcttcttaacacgttcttgcctgtttccctggtgtggtgtttttcttctgctacttgtcaatgccttgtacagttttgacctgtttccgatatacttttcttgtgtagtatgcttcatttccatatgtttataaacttgctgatcaagttatcagttgtgctagctagaacctttctattcaccattgtctgtaaataggtttggacccagatgtagcctttgactcagtctcccaaacaacaagtcgagaaaaatcttgaaagactattttggttgcggtagcaagttgttaacaatctggacttattgtggtttaaagttaatactaaactctgtcttctactgagaccattgaaacaaaactagattttccttatgtgtgtgttgctctgcatcaatatatactgtgacctcattgcattgaaaatggattataagctgtgcatgatgtatttttaatattggagcaaaactgtgctttgatcatttcaggatgctgttaaaggtaacgatatcgtccattcaaatgcatcatgccgggagatctggacagagtaccatgaattaggatggggtggaataaaggcagtcgcagactacaaagtttacactgccagttctgttatagaccttcttcactttgttgctccaaggatgatgcagcgtggaaatgtccacttttcatatggaattgctgataacttggatgatccgaaatatcaacattacaaatattggtcaaaccccttggaaacaaagtgcgattcctttgccaacattcctattctatattttatagtagcttttctcaggctgtttatgcttccattgttgtagtattatatcttgctctgaccccttggtctccaggctaccgaatgctcctgacatggaaataatttccatgtacggagtaggcattcctactgaaagggcatatgtctacaagttggctccacaggcagagtgctatataccattccggattgacgcctcggctgatggcggggaggaaaacaaatgcttgaaagggggtgtttacttagctgacggcgacgaaactgttccagttcttagcgcgggctacatgtgtgcaaaagggtggcgtggcaaaactcgtttcaaccctgccggcagcaagacttacgtgagagagtacagccattcaccaccctcaactctcctggaaggcaggggcactcagagcggtgcacatgttgatataatggggaacttcgctttgatcgaggacatcatcaggatagctgccggggcaaccggtgaggaaattggtggcgaccaggtttattcagatatattcaaatggtcagagaaaatcaaattgaaattgtaacccatgggaagttaaaagaagtgccccaacccgttcattgcgttcctaaatgcttgcctgagcgcaactctggattttgcttaaatatcgtaatttttttcacgcctcattcgtccctctagtaaatttacattgacaggaccccggtgcgacgcggatgttgtaccgtatttttggcattgtatattaaaatgtacaggcgtaagttacatttgctagctgaaattattgcagtagcttgccttttcttttgagcacggaagtgtgctctccattacgtgataacctgtgccaaatctttgacaatcatatcctgaatataagatggaacattatttcgttgtgtgcccatattacaagagcggggaatgtaattgactatccttgacacaaaattacataacagcaagtctttcaacttccaaattaggccacttgctgagctctttgctgaaagttgcgtttccttcgatatctgaagaaccttgttcacttctatgtattttgactccctcgtgttagggtggtggcaacgtggccgagatgcagcggaataacttattttacatctacttaggaggtgtttggttataaggactaaagattagtctttagtttttagtctcttttttgccaaacactaggactaaaatgatttagtctttagtctttcacatatgtgctaaaagggactaaatcatattaatttcacatttaccactcatttagttcaattgtactaatagcagaagaatgttaaaggctattttagtcttcttataagtcatttattatttcttactatttttagcccctaaaaccaaatatattagggactaaactttagtccctagactaaaggaaccaaacatgaccttattcagcctacatctaaaatatgcgggtaactaaacaggtgctcgtataaagtcaaggcatactatggtttaggattagacgatgcggataaccacgttcctgttcctgccgcctgtctgctgcatgcctctgccgttccgcgcgtcgtcgaccggtggcctgcttgtatcactctagcgactggcggctgatccgcgcgccgctgtgcatttcactcacggtatgtcgtcgcaggcagctgaccgtacctgagagaccgccagatcatccaaacttccgtcccaaatcggtggtgtacgagctattcacgcgaagccacgatgacgagttcagggaaccatgcattatatgccttgcatgcatgcatcgatctaaactgaacactgcacgacacggccattcgcaccggccggtgcactgcaccgccgcccaggggccggcgtggcgtttggggggaacgaatgaggctcgacccaatcctgacctgctggcacgtacgctgtcttcttcccgacatgatcgaccgagcgaggctcacagaaatgagcgctgccgctccggcgctgtccttgtcgcgtcgcggccatgcatcctgtccagatcgtgctcccttcgcatacagatcagccgtccctctcgccgctccttgtgcagttgtgcggtgtgctgtgtacttgcattgcatcggattcggatccttttttctacactcccatgcatgcagcgcgcgcggcgccacgtcaagctagacgacatgaatgagcgacctcgaaacgaaaagcaaatactaatagcagaaggtgcattacatacaatataaaatagttctgctaactggcggacagcactgcaaaaaaaatcatgcaatgcccttttgtattgttctgggtcgctattaaaagacttgtgcgtctgcgagcggacacgagctgcgctccgcccatgccggtgctcgtgctaatcagatcgatcgactggaccgacgcgccgatcctgggggcacgccatgcacatgcatggccatgcatggcattggcatcttcgatcagtctcccagtgtcgcgcgtttccgtggcatgccgcactgtacagacccgagattccttccatctccaatggctgatgaggctatccacaacagcatctctatttaaaaatcgtttaggatcacattgctccagctacttgatcctcgtcaccttcctcgaaactgagctgctggaaatattgtacagtacatgctgatcggttatgctgtgtacatatgtatacgtcgtacgtatcactggactactgacaagtatttataaatactcccccatttagctcttgatttttatgtctatatttagatggataaagatgaacttatatatgtatatatatatatatataaatataacacatacatcaaatattatataaacctaatagttaactaaaatgaattttacagtgtgttttgtttggtttgatggtttggctcatccatcgtggcctggctccggatggagtggtcttgcactttcttgcggagtgagctgatcacacgtgttagtatattattagaataacgcagtgacggatgacatcgttccgcgattcaaaccaaatgataatatagccttggacgtaggtccagatgactccggaagcaatccaacctgcaaaccaaacacgctgttaatgcttgatgctccagcgcgagggggccaatgagccatggccctctgcagaaatggtcgttcatgcctgcagagttgattaggttcggatgttctgttgatcgagtgtgcgaagaaaacaaatgcttcaagtagtagtagtagatgctacacaaacccatccaaagatgcaggctaggcacacacatgccagtcgaaaaagaatgcgagaagatgacgaagtcaattaaagagttttggtcggtggagccagacctagttcgatgtctgacc

SEQ ID NO: 9140 - DNA, 1631 bp, Zea mays
  misc_feature (1568)..(1568): n is a, c, g, or t
  misc_feature (1594)..(1594): n is a, c, g, or t
  misc_feature (1612)..(1612): n is a, c, g, or t
  misc_feature (1624)..(1624): n is a, c, g, or t
tatgtggcgacattcctatgagggcttaaatgaatacagacactgttaacatgcggatatccagggtactaatgtaaacacatttgaattgtgttttttgatttcatttcaaacatgaacttaggctgctggatacctttctatcctgattttcttatatttatttgtccaaagaaaattgctctctggtgaaagtaataaaattagttccctactaagttttgttgttatgtacagagctatcgctcctgatgtcttggactctgatttccttgggcttcaaactttgcgccatttgatgcgtatgacccgaacatgggattcaacaatgtcaatgattcctaaaggtggtgatacaatttggggaaatctggattggtctccagaagatggcattgaatgtaaagctaagaagcacaaagccaacgatactggggtttctaaggatagcaatgggggaaatatcgaggttcaacctgaacctattaactatggaaggctggtatcttttggtaaagatgtagcagaagcaccttcttcagagattgagcagatagaatttcgtgatgctgttaaaggtaataatatcgcccattcaaatacgtcatgccgggagatctggacagagtatcacgaattaggatggggtggaataaaggcagtcgcagactacaaagtttacactgctagttctgttgtagaccttcttcattttgttgctccaaggatgatgcagcgtggaaatgttcacttttcatatggaattgctgataacttggatgatccaaaataccaacattacaaatattggtcaaaccccttggaaacgaagttaccgaatgctcctgacatggaaatattttccatgtacggagtaggcattcctactgaaagggcatatgtctataagttggccccacaggcagaatgttatatacctttccgaattgacacctcggctgaaggcggggaggaaaatagctgcttgaaagggggtgtttacttagccgatggtgatgaaactgttccagttcttagtgcgggctacatgtgtgcaaaaggatggcgtggcaaaactcgtttcaaccctgccggcagcaagacttacgtgagagaatacagccactcaccaccctctactctcctggaaggcaggggcacccagagcggtgcacatgttgatataatggggaactttgctctaattgaggacgtcatcagaatagctgctggggcaaccggtgaggaaattggtggcgatcaggtttattcagatatattcaagtggtcagagaaaatcaaattgaaattgtaacctatgggaagttaaagaagtgccgacccgtttattgcgttccaaagtgtcctgcctgagtgcaactctggattttgcttaaatattgtaatttttcacgcttcattcgtccctttgtcaaatttacatttgacaggacgccaatgcgatacgatgttgtaccgctattttcagcattgtatattaaactgtacaggtgtaagttgcatttgccagctgaaattgtgtagtcgttttctttacgatttaatancaagtggcggagcagtgccccaagcnaaaaaaaaaaaaaaaacncgagggggggcnccggtac

SEQ ID NO: 9141 - DNA, 2887 bp, Zea mays
  misc_feature (2500)..(2500): n is a, c, g, or t
gttatgtacagagctatcgctcctgatgtcttggattctgatttccttgggcttcaaactttgcgccatttgatgcgtatgacccgaacatgggattcaacaatgtcaatgattcctaaaggtggtgatacaatttggggaaatctggattggtctccagaagatggcattgaatgtaaagctaagaagcacaaagccaatgatactggggtttctaaggatagcaatgggggaaatatcgaggttcaacctgaacctattaactatggaaggctggtatcttttggtaaagatgtagcagaagcaccttcttcagagattgagcagatagaatttcgtgtgagtattcagaggcttattaacatgtttttgcctgttccccgggtgtggtctttttccacttgtcaatgccttttacagtttggctgatttgatctgtttcatatatagttttcttgtgtactatgaactcatttccatatgtttataaacttgctgatcaagttatctgttgtgctagtttgaacctttctattcaccatagagacgtagtctgtaaataggtttggatccagatgtagttcttgatgtctccaaaaaaaaaacaaatcaagaaaatcttgaaagactattttagttgtggtatcgagttgttaatcaggacttagtgtggtctaaagttactgagaccattgaaacaaaactagattttccttctgtgggttgtgcatgatgtattttaaatattggagcaaaactgtgctttgatcatttcaggatgctgttaaaggtaataatatcgcccattcaaatacgtcatgccgggagatctggacagagtatcacgaattaggatggggtggaataaaggcagtcgcagactacaaagtttacactgctagttctgttgtagaccttcttcattttgttgctccaaggatgatgcagcgtggaaatgttcacttttcatatggaattgctgataacttggatgatccaaaataccaacattacaaatattggtcaaaccccttggaaacgaagtatgaattctttgccaacattcctattctatattttataaaatcttttctcaagctatttatgtttccatttattctacatatgataattttatcttcgaaacgaagttaccgaatgctcctgacatggaaatattttccatgtacggagtaggcattcctactgaaagggcatatgtctataagttggccccacaggcagaatgttatatacctttccgaattgacacctcggctgaaggcggggaggaaaatagctgcttgaaagggggtgtttacttagccgatggtgatgaaactgttccagttcttagtgcgggctacatgtgtgcaaaaggatggcgtggcaaaactcgtttcaaccctgccggcagcaagacttacgtgagagaatacagccattcaccaccctctactctcctggaaggcaggggcacccagagcggtgcacatgttgatataatggggaactttgctctaattgaggacgtcatcagaatagctgctggggcaaccggtgaggaaattggtggcgatcaggtttattcagatatattcaagtggtcagagaaaatcaaattgaaattgtaacctatgggaagttaaagaagtgccgacccgtttattgcgttccaaagtgtcctgcctgagtgcaactctggattttgcttaaatattgtaatttttcacgcttcattcgtccctttgtcaaatttacatttgacaggacgccaatgcgatacgatgttgtaccgctattttcagcattgtatattaaactgtacaggtgtaagttgcatttgccagctgaaattgtgtagtcgttttctttacggtttaataagaagtgatggagcagtacaccaagcagaaaaagatccacttctaaaccagttttcattgttttagagaaggtttggacaaaatatgccactttaattttgtttatcttatttgatattgtaaatattctaattcttttttagggtctgtttgattcgatatctaacttgtcactttttgacattttattttggtctaagattagtgattaaatataatcgactaatgttaaagcaagttgtggcgcagttagctgaaaatcaagcagaccattctttcatgcagcagaccattctttcatgcattgccattggcctcgaaggattaggacatgcaattttgttacccttttatgccaccgatggaagggtgagaaattatatttgagtgccatagaagagattagaacatttgcaatggtaagtaagatactgaataaaattgtagtggggtatctgtcggtaccctaaccgtctgtttggttgttgtatggtggtagcctgacctgtatgtgaggagccaggtctccggtgtacaggctaaatccatgtgtatgcttgtgtttggctgcttgtattgatgcattcaggatagataccgctcgtgtttggttntttgccttagacgtgtactagagaaaagtgtataaataaatctctaaatgttatacaacatttgtcgtctagttttattcctaaaaatctcagagacaagaatagaaaattatttcggtcattaaatcttttatttgtaagatataatggaaaataatctaaaaacaattttctgtttatgtgccgctacatgcagctactgcatgggctcggcctgcatgccggcgtacgtagatctccagcatctcgcacgagcctggttgacggtctgtttctgcatctcttcagcctgtgtgcgtagaaaaggaaaccaaacaaactgcgctttaaatctccgcggatacaactgcacgtccagagaaagaaaccaatcacgcgataaaggtg

SEQ ID NO: 9142 - DNA, 2206 bp, Zea mays
ctcgaggccggccggcccgaggcttttcccattctcgttgatacgagcgagagtcgagacaggtcaaaaggagattgagtaaggaaaagaaaaaaaaaatcgctgctcccgaggcacggcggcggcgagcgtgcgacacctccggcggctccacagatccggcgaccgatctccggccgcctgcggatgctccggggccggcgcggtaaggcccaggggtccacgctcgtagccagatctcggggcgctgctgggaagtggggttcgttccgtccctgcctccctggtggtggggatggggtggtccgcggggctgtggtggctcgtggccgcgctgtgggtggtggcggcggcggcggcggcggcggagggtgaggtcgtggtcgggtcagcgccgaggcggcacgcgtacgcgtcgatgatgtacatgggcactccacgggactacgagttctacgtggccacgcgcgtcatgatgcagtccctgcgccggctcagcgccgacgccgaccgcgtcgtgatcgcctccctcgacgtcccaccgctctgggtccaggcgctatgatggtgtaaaggtggtctctgtggagaatttgaaaaatccatacgagagacaagagaatttcaacatgcgattcaagttgaccttaaacaagctgtatgcatggagcttggtttcgtatgagcgagttgttatgcttgactccgacaacattttcctccaaaatactgatgagttatttcagtgtggtcagttctgtgctgtcttcatcaatccctgtatcttccatacaggtctctttgtgcttcagccctcaatgaacgtttttaagaatatgctacatgagctatcggttggacgtgaaaacccagatggtgcagaccaaggctttcttgctagttatttcccggacttacttgatcagccaatgttccatccaccagctaatggtacaaaacttcagggtacttaccgcctccctctaggctaccagatggatgcgtcttactattatctgaagcttcgctggagtattccatgtggaccgaacagtgtgattacatttccaagtgctccatggtttaagccatggtactggtggtcttggccagttttacctttggggctctcttggcatgaacaacgtcgtgaaaacctagggtattcatctgagataccagtagtattaattcaggctgtactgtacattggagtcatagcagtgacccgactggcgaagcctaccttgaacaagatgtgctacaacagaagaatggagaaaaacactatgttcttgctctctgttctcagagtcgtggctgcttggtccatacttgctgcctacaccatacccttcttcatcatcccaaggaccgtgcatccactgcttggctggcctctctacttgctcggttcttttgctctttcttccattgttatcaacattttcctcttccacccgatcaccgtcctcacaacatggtttggattcataggcgcactcctggtgatggccttcccttggtatctaaatggttttgtcagggccttggcagtgtttgcgtatgctttctgctgcgcgcccttgatctgggcatctttgggtcaagacaatgagctccttgcaggtcctgattgagagggatgcattcaggctcggagaacctagccagaatgcggagttcacaaagctatactgaggtgggcatggcagatacatgtgatttatcactttcgttgctcagtttgaacagttaatctgcattcacattgtcaaattctgatggccaattcaaatgtacaactaaacctgcagcctgggagcaagagtggttgtacacaatggaactatctggaaacctctagaatccatgaatgttgttatcttagacatgtaggtgacatatacagtggaaaaggggggagggctgtagaattggtgctgaactgaagaggaactgactggggtcagttgttagttattttgatttattgttcctctgaaaagccaaggcatttttggctttgtttgtaattgatatgatatgttccttcacaaatgaagaaaagggttgaaagtgcaaaaaaaaaaaaaaaagaaacagtactttgattttaccgtggtaaaattgtgtggcttgtgctgaacagttttcctttttataactgcttcgcctgaacgttgagttcagctcgtgtcgctgc

SEQ ID NO: 9143 - DNA, 5282 bp, Zea mays
agttaggtcagctgaaaaccgtgttcctcgtctcgcgtcttcttctactcctccctccgttcccgttgatgcgagcgaaacagataaaaaaggagattcgagagagagaaaaaaacagggaaacaaaaaaaatccaccgctcccgaggcacggcggcgtcgagcgcgcgacacctccggcggctccacagtgccggcgatcgagctccgcccgcccgcggatgctccgggctcggcgcggtaaggcccaggaatccacgctcgtagccagatctcggggtggtgctcggaagtggagttcgttcggtccctgcctccctggtggggatggggtggtccgccgggctgtggtggcttttggcggcggtgtgggtggtggtggcggcggctgcgacggcggagggtgaggtcgcggtcggggcggcgccgaggcggcacgcgtacgcgtcgatgatgtacatgggcacgccacgggactacgagttctacgtggccacgcgcgtcatgatgctgtccctgcgccggctcagccccaacgccgaccgcgtcgtcatcgcgtccctcgacgtcccgccgctctgggttcaggcactgaaaaatgacggggtaaaggtggtctctgtgaagaatttgaaaaatccttacgagaaacaagaaaatttcaacagacgattcaaattgactttaaacaagctgtatgcatggagcttggtttcatatgagcgagttgttatgcttgactctgacaacattttcctccaaaatactgatgagttatttcagtgtggtcagttctgtgctgtcttcatcaatccctgtatcttccatacaggtctttttgtgcttcagccctcaatggatgtttttaagaacatgctacatgagctagcggttggacgtgaaaacccagatggggcagaccaaggcttccttgctagttatttcccggacttgcttgatcagccaatgttccatccaccagctaatggtacaaaactttggggtacttatcgcctccccctaggctaccagatggatgcatcttactattatctgaagcttcgctggagtattccatgtggaccgaacagtgtgattacattcccaagcgctccatggtttaagccatggtactggtggtcttggcctgttttacctttggggctctcttggcatgaacaacgtcgtgaaaacctagggtattcatcggagataccactagtattaattcaggctgtactgtacattggagtcatagcagtgacccgacttgcgcggcctagcttgtcgaagatgtgctacaacagaagaatggagaaaaacactatgttcttgctctcccttctcagaatagtggcagcttggtccatacttgctgcctacaccatacccttcttcatcatcccaaggaccgtgcatccgctgcttggctggcccctctacttgctcggttctttctcactttcctccattgtgatcaacattttcttcctccacccgatcaccgtcctcacaacatggtttggattcatcggcgcactcgtggtgatggccttcccttggtatctaaatggcgtcgtcagggccttggcagtgtttgcgtatgcgttctgctgcgcgcccttgatctgggcttctctggtcaagacaatgagctccttgcaggtcctgatcgagagggatgcattcaggctcggagaacctaaccagaatgccgagttcacaaagctatactgaggtgggcacggcagatacgtatggttggccacttctgttgctcggtttggacagctatctccattcacgttggcaaattctgatgggcaatttcaattgtacaagtaaatctgcagcctgggagcaagaggagttgtatcttgtggaacccatcaggaaaacctcaagaacccatggttgttgttgtcttgcacatgtaggtgacaatgacatacaggggaaattggtgcgggaactgaagaggaacggtctggggccagttcttagctattttgatttattgttcctcggaaaggccaagccatttttggctttgttttgtactgtaaatgatatgatcggtttcgtcaccaatgaagaaaagggttggaagtccagacggcatgatgttagaaacagtacttcgtttttaccgtggtataattgtgtggcttctcctgtacgttttatacccctttcgttttataactgctgttcctgaacgttggggttgtcgttgcatgtgtggaccttacatttaaacgaaaagagaaacggacagactcacgatcacggggaggcgaggcgggtagtacaaagcacagaaaagcaaagctctcgcgattcgcgaacatgggctgcactggactcatcacctgtatcacagtcacttcatcctgatgaggacgttggattggatgcgacaagtattctgcgaactcgatctagcgaatttagttcattttttaactaaaacgtgacagtagttaaaaaaaagagaatcgtatattttcaatttgacagatatgtttcaagcggaatagtatttcgtgcgaaaaatgttcagtttactagtacgtaccggccaaaagcgagcaagtggtcgtggtggcccccgcatactacgctacgatacgacttttcattgtctgaatcggggaggagctgcgattctctggtctgatgtgtcattctcgccgagcctgctgcctgcggaccgccatccggcattccggcgctcccccaacgttttaaaaaagctccaggctagagtgctagaccacgcaacgagacgctctgctaccctacaaaaccgcacgcaagccggtcatcacatcgcgcgcgcccgttcgcaccgcacgctggctgccctagatttgctcaatttccgtatggggtagagatcgtcccgtgcgcgcggcagagctaagcaggcaagtcgcagcgttcgccaattggacaccggacggcctcacgagcgcagacggcaagtgaccgttgcgctcgcctagctagctgccgcgcgcggtctgcgcctggcctcttgcggcaatcgcagtacagtgccggtggtcacgcccctatcgagaagcggtacggggccccttgcgagaatacccggcgtccctcctgttttctgctgcgtccgcgacgtgtggaacacaggtaactcgttcgaccgttcgtacaaagctactaggtggatactgtagttctgcactctgcagcaatacatgtacacgtacactatggatccactgtttgctgggttgccgatccaaggctaactttctccgtctagctaagactggaattgcactgtaaaatgcatggcccagaaaggcactcgagtactctgacaccgcacatacatatacccgcgttttttttgacacggcatcatgcatttgcaggtagacaagtagggtgctctacacctgacgacgagcagaccagacgtggttaggagtgagtagtgaggaggaggtgcccatgatgacccagaagagaacaaggatgaacgacgatgccttttaatcccacacctcgatcgatcgccatctacaacaactgctacaaagagaataatgtactctcgtatggcacggacagaaaagcgccccggctttgctacttgcagggcggggccggccgcggcggcgtggccacctccgccatgagtccatgaccatgccgcgcccgcgcacgccctcccaacgcacgcgagaggccttttgcctttgtgcggctgctgctgctctcgccgtcgcccctcgccctccctccccctccccgcccgcggcgtgcgcgttcgtgcatgcaggcatgtgcgcgcggcatgcatgcgggtgtacgttcgttcttggatcgttgctgttgtttaaggttctcgacgcggattagtttattctgaccactctagtttccgattagcgcagctctttgtaatatgctgcggctgcatgcgagctgccctctggggacggcatgagacccgtatctaggatgatgcatggcagcggccgggcgcgttcttaccgttgttcttctatctcgtgccttgcggtggcatctcttggcgggccgccgcgctctgcagtgactttcttctcactcgcggggcgtgcgcagtgcatgcacgctactactacctgctcgatgtcggcgctcctgtgactgtccttagtgtacgcttgtgtctgcatccgatctacctaccctttcccggagggccccggcccccaccgtcgatctggaccatgcatcgtctagggatttggtaaagctgacctgtctgtcacacacattttttcatgcactactgcatgcatgttacatgtacggtacgtaatacggtatgcagggatcgcatgcacgcaagaatttgttcgagcaacacatgttttagtgcttcaggacaccagtaaaaatcaaaggaagctgcgggcgttaaacacattctattaactagctagttaattaacctagctagctagcaatgcaagagtgaaaagtgtgaaactgaagagagagcatgaccgttggcatccgaccaaggcaagaagttccaaatcacgcccgacggcgtctgcaggctggccggttgctaggttgcatttggagcgttcccgcctctctctcgactccattatttccgttggttcttgacctcagctcgctcctctcactcacctctatatatgccccgccctcttgcccgtgttggtggtaccccgcgtcgccctccgtcgtctcagcgtatgttgtgcatgtgaagagagagaggaagagggtgacgagcgagaaaaaagctagtagagtgatagcttgacaagacgcattgaagcgaaggccacgcataccaaagcaacctcaccatcgctcgcaagctactcgatcaaggacattattgtcgcaacgagctagcaagaataatccgcgttagtttcgcgaagcggtggtacatatggctcgcatcctcgtgctggctctgctcaccatcgcgagcctcctcctgccgccggtcgtcgcgagccagcaggcggcggccaagtgcgagtacagaaagcactccggccaccggtacaggcacccggtgggcgtgcggaagatcgtggtggacgcgggcggcgccggcgacttcgtctccatccagcgcgccgtcgactccgtgccggaaggcaacaccgtgcgcgtcatcgtgcagatcaacgccggcacgtacatgtaagctcgctagctacagtactactaatagctacctctaccctcgctctccttcgttcg

SEQ ID NO: 9144 - DNA, 1632 bp, Zea mays
acaaatactactctagccatcgcaaaacctcctgacttcccccagatccagatcgtttccccagatccagatcgcaggcgtgaagggcgactgttaccagattatgatccgttttcgagcttcgaggaatcgacggtcaagcttcggtgaccaagtgacctggttcttcgagttctgcaaggttgaagaccctgagcatctatttggtgaaggatactataccagcctcctaagtgaaggcacaaatccacaagactatgacgatttagttgacttgtatcctgaggaacaaccacaaagggtcgaagtaaacacttatgcaccctctgctagaccgaaccataagaggtcaaagaatttcagtgacgtggaagacgagcttttggtgtctgcatggcttaacataagtttggatccaattattggttataatcaaactcgcagttcatattggactagaatttatgactactttcatgccaataagaccttctcctcaacccgtagccagaactctattatgcaccgttggaccagcatacaagaaggtgtaaacaggtttactggatgccttgctcaggttgagagaagaaggcaaagtggtgctacaatgcaagacaagcttacacaggcgtgtgctttatataagtctgaagataagcaacataaagcttttccatatatgcattgttggaataagttgcggacacagcgtaaatgggagatgaaacttgaagaattggctgttggcaagtcatctaataagaagcaaaagatgaactcaaatgaaacctcacctccacatttaccaagtgccaccgaaacaagcgagcctacaactccaaatgagactgtcacaacaagaccacctggaaagaagaaggccaaagcagcagcatttcaagctgaaaagaaaggctacacagaaactttaaacaaattatttgaaaagaagaaagaaacagatgaatttaaagaaatgaaaaaagacgagaggtttagattagcattagcagttgaacaagagagggctgcgaatgagaaattaaatatgcagttaaggagtaaagagctagaattgaggcagcaagaagttgaacaacataagaagagggaagaagagaggattatgacactagaccttagtgtcatgcctgctgatcagaagcaatattacatgagactacgatctaagatattgtctgaaaatgcctaatgttacatggtacattaggtgttgattagtctttagctaaactgtttgctttttatcactatagatttaggtttctttcttttggtgctatgtaattggataatacacaactagctttgcttattttttagctaaaatgtttgctgtttttatcactgcgattttaggtttctttcttttggcaatatgtaattggatactgcacaactagcttgtcatatataattcaaacatcaggtgtttgtttacatttagaaatactagtcgttcacattttcttatgggaaatcatctcaatactggacaacaaaaacaggtcagtgtactattatctgtaaaacaacgtcttgctctgtggaaagcaggccagtgtacagatgaattcaaacatcaggtgttttttatcacagctattg

SEQ ID NO: 9145 - DNA, 2425 bp, Zea mays
gccggccgggtctcgataactgccctgccctctctcccatcaccaccgcctgcgactgcgagctcaaagacccacccacactgagctgcccaaatccacattcccatcggcgcagacggccgggaggaggatgtccatgccggagacgttcaccctgaaggtgggggaggcgacgccggccgccgccggcaggccgtcggccgggcccgtgtaccggagcatctacgccaaggacggcctcatggacctcccacaggacatccagtccccttgggacttgttcagtggggcagtcaagaagtaccccacgaacaggatggtcgggcagcgtcaggttacagatggcaaggccggtgagtatgtgtggcaaacgtacgaggaagtgtgccagaaggtcatgaggattggatcagcgatcagaagcctgggcgtagagccgggagctcactgtggcatatatggatccaactgcccggaatgggttatggccatgcaggcatgtaacagtcaagggatatgttatgtgccactgtatgacaccctcggagctaaagctgttgaattcatcatgtaccatgctgagatatccattgcctttgtccaggagagcaagatcaaatcaatactagcagttctccctaagtgcacagcgcaccttagagccattgttagtttcggagattttgcaagcgagatgaaagcggaagctgagagattgggcgtctcctgcttttcttgggaagagttttcttcaatgggaaaacaagactaccaacttcccaataaacgtaaggaagatatctgtacaatcatgtataccagcggaacaactggagatcccaaaggtgtgataatcacaaacaaagctatcgttgctggtgttatgaccacagaacacctcctcaaagagaccgataaagtgatcacagaagaggattcctacttttcctaccttccattagcacatatatttgatcaagtaattgagaactactgtatttctaaaggagcctccatcggattctggcaaggggacattaggtacctgatggaggatgtgcaagtgatgaaaccgacaatattctgtggtgttcctcgtgtttatgatcgtatatatacaggtataaacatgaaaattcagtctggagggatgatagccagacacctttttcagtatgcctacaactacaaacttgccaatatgaggaaagggctgaaacagcatgaagcatcaccgtttttcgacaagatagttttcagcaaaataaaggaagggcttggagggcgtatacgtctcatgatagctggagcagcacctttgccagggcaaatcgaagaattcatgcgggtaaccacctgcagcgttgtagtacaaggatatgggctcactgagagttgtgcaggatgcttcacgtcaatcgccaacattttctcaatgattggaacagtcggccctcctgtcacaacaatagaagcacggctggagtcggtccctgaaatgggctacgacgcactgtcagacacgccccggggcgagatctgcttgaggggccacaccatgttctccgggtactacaagcgccctagcctcactgaagaagtgttctcagatggctggttccatacaggtgatatcggggagtggcaatccaatggcacgatgaagatcatcgacagaaagaagaacatcttcaagctgtcccagggggagtatgtggcagttgaggtcctggaaagagcatacctgcagtcaccccttgtggcatcggtctgggtctacgggaacagcttcgagtcgttcctcgttgccgtggctgtccctgagaggcaggctctcgaggaatgggcagcagccaacagcaaggccggcgactttgcagagctgtgcgctgatcccaaggcgaggacctacgttcgggatcagctgaaccaaactgggaagaaacttgggttgagaggcttcgagatgctgaaagcagtctacctggagccggtgcctttcagcatcgagaaggacctcgtcactccaacctttaagctcaagagaccccagctgctcaagtattacaaggatcgggtcgaccaaatgtacaaggatgccaaggaggggagagctgcgccatgagcccatgacggcattgccaatttgccacgagtggctatgatcctgagcattgtgattcctcgaaagcgtgtacatattgattatcacaatttgtaagtttaaggcatgtgtgttctatgccaaaatgtcagcagaaaatgaattggctaagaagctcgtgaatcgtgatagcttacattaataaatttattaagctagtccattaccttcacactcctcacttttttgttttggccccgtttgtggaatagaagatgagtttatccaacaaaaaaaaaaaaaaaaaaggcccctagggcc

SEQ ID NO: 9146 - DNA, 1403 bp, Zea mays
ccggccggcgaaaactaaaaagtaaaaacaacccgacccaccaatcacgtgggcccacccaccgcctcaccaccagcgtccagggaggaggaaagggaaggaggaaccgaggaacccgccgcaccgcaggcacaggcaggcagggcagcagatcgcgagttccgacttccgacgcgtctccgaccaggccgccgccatttctctgtctccacacagcgggatccctccgccgctcgccgcttctcccttggtccaccgtccacccaaccatgtataacaattaccggaatcctcccgggacgcatatgcccccgcagaattctcaacctgtccagtttgacaatccattgtacggtgcaagctcgggtctaatccgatctgggattggagtgtacggggagaagttcttgggctctagttcagagttcatgcaaagcaacatcaatagatacttctccaacccacagtattacttccacgtgaatgatcaatatgtccggaacaagttgaaagtcatactgttcccgttctttcacagggggcactggactcgaataagcgagccggtcggtggacggttgtcctacaagcctccgatatatgacataaatgcgccggatctgtacatccctttcatggcatttggaagcttcatcattctttcagggtttacattgggtttcatgggaaagtttactccagaagctataaacctgcagtttacaagggcgctcatcggatggggcttccagctcacggtcctgaaaggcctgctctactcaatgggtggcggcgaggtgccactgctcgacctggtagcgtacggtggctatttattcgccgggctctcgctcgccgtcgtcgcgaggctcgtgtgggcgtactcgtattacgtgatgatgccgtggatgagcctgtgcatgggggtgttcctggtgaggacgatgaagagggtgctcttcacggagatgaggagcagcgagaggcactcgtcgcggcagcattacttcctcctcttcatggcgatagtgcagttccccctgttcttctggctcggcagcataggcgtgtgatacacagttttgtgcgtgttatgatatttagatgtgttgtagaaaaaaaaacagtcggaggatggtctcaccagcttgtgctcatccatagtatgtgttcttgaggaaccttggatgtggtgctgtatagcttgggagctgttgttgtgaagttctacatgtgatccgtaatcatgttaacttggtccatgatgctattgttatcatttatttacagggagatgggtgctagttagtattgtggacatgttttctattcatcagtaatgaatagttgaggtacccaattttccaaaaataataacttgaaggggagccccgcgcccccgg

SEQ ID NO: 9147 - DNA, 1201 bp, Zea mays
tcgaggccggccgggccgggaccgacaccaggaggcggaaggaaagggggtcccccccgctccgccggcccgtaggctcccgaaaatctccccgagtccgacgcgtctccggcggccgcccccctctccctctcggatctctccctctctccgctcgccgcgcctccatcggtccactcagccatgtatagtaattacgggaatccttcggggatgcagatgcccccgcaaaactctcaacctgtccagtttgataatccattatacggtgcaagctcgggcctaatcagatctgggataggagtatatggggagaagtttttgggttctagttcagaattcatgcaaagcaacatcaatagatacttctccaacccgcagtattacttccatgtgaatgatcaatatgtccgtaacaagttgaaagttatactgttcccgttctttcacagggggcactggactcgaataagtgagccggtcggtggccgcttgtcctacaaacctccaatctatgacataaacgcaccagatctgtacatccctttcatggcatttggaagcttcatcatcctttcagggtttacattgggtttcatgggaaagtttactccagcagctataaatctgcagtttacaagggcgctcatcggctggggcttccagctcatggtcctgaaaggtctgctctactcgatgggtggtggcgaggtgccactgctcgacttggtagcgtacggtggttatttattcgccgggctatcgctcgccgtcgtcgcgaggctcatgtgggcgtactcgtactatgtgatgatgccgtggatgagcctgtgcatgggggtgttcctggtgaggacgatgaagagggtgctcttcacggagatgagaagcagcgagaggcactcgtcgcggcagcactacttccttctcttcatggcaatcgcacagttccccctgttcttctggctcggcagcataggtgcatgatgcagttttgtgtacttttcgcagcattaacgttgcaaaaatgatattgaagtgtttagatgtgttgtaaagaaaaaaacaattggacaatggtctcaacagcttagaggttggcagctctgcttgtgaagttgtatgtgatccacaatcatgttatgctattgactttttttggttggcaaaaaaaaaaaaaaaaaaggcccctagggccctc

SEQ ID NO: 9148 - DNA, 2379 bp, Zea mays
ccggccggtacctattccaaccctctgggctctggcacacagctactccgcctcctcgcccttttctcctcatccctcgctttcgcttcgccgttccaacgcggagcccccacggaaaataaaggccaagaagtgatggtagtggagtaaaaccacgcgttggagggcagagggacaggttggtggaggacgcgcacccagcgtggagagcagcaggagctacgcgaattcgggccgcgagtgcgccggttcaggttgccgccgccggtggaattgtggcagacgaggtggcctgttggtagccgcgggagtttgcgagtaggtcggttccggttggtgtgcgagcgaaggtgctgttggaggcgtggatctggccggcggcgggcgatgggaaggagggactagggctcgattggagggaaaggcgcgatcttggaggttcccatgggcggatgcctctcgcaggaggagcaccggctccagagcaggccagctgaagctgctggagcagatggattgcggaagtctaaatctgattctaaagctgtagcaagtgttcttgctcctccaaaagatgtggtggacctgcaagtagaaggatatggaaatgtgaatattttcacatatgacgaattaagagcagccacaaaaaacttccggccagatcaaattcttggagagggtggatttggagttgtttacaaaggtgtaattgatgaaaatgttagagcaggtttcccatcgagacaggttgctgtgaaagaactaaacccagagggctttcaaggggacaaggagtggcttgcagaagtcaactatcttgggcaacttagtcatccaaatcttgttgaattgattggctattgctgtgagggttcacatagactgcttgtctatgagtacatggcttgtggaagcctcgaaaagcacctttttcgccgggtttgccttaatatgccatggtcaacacgcatgaagattgcattgggtgctgcaagggggctcgagtaccttcacggagctgagagatccatcatttatcgagatttcaagacatcaaacatcttgctagatgcggattacaatgctaagctttcagactttggtctcgcaagaacaggtcctagtggagaccaaacccatgtgtcaactcgggtcatgggaacttatggatacgcagctccagaatatgtcatgactggccatctgacggcacgaagtgatgtttatggcttcggagtggtgcttctagagatgattatcggaagaagggctgtggacaagagccggccaagccgtgagcataacctagttgactgggcacggcccctcctcgtccataacaggaagctgttccgaataatcgatccgagaatggaagggcaatactccaccaaggctgccactgaggtggcaagccttgcataccgctgcctgagccagaaccccaagggacgaccaaccatgagccaagtcgtcgagacctttgaggccgtgcagaacatgcctgaatgccaagacatactcctccagaacagcatcacaggtgccgtgacgctctatgaggtccccaaggagcctgcagacagagttgagctggagaaggccaagcaggaaccggcagtaaagagcgccgcgatgccgcccatgaacggaaagccagtcccccagagcaggcggacgcggcctgggaatggccggagcaagagcgagccatcgttggagtgcaagatgtacatcccgtcaccggactctgatggacaccagctcggcctggaggcagtcgcatccccagatggaagcataagggaccctcctgatgaggatttgtacaagatataacaccagggcagtttttcttcaacaacgaggggcagatctggcgcagtgttgagttgtgggttttcaaaccagcctcttcgcatttagggaggaagatttgcatctgtttatctctttctcatacctcatttacgtgggagcctcgatctgcctttttaacgtgagcccgcgttgctcacctttggcgccgccactcccgttcttaaagatcaatcagctgtaattttttctctgatggccactggccacggtagcgttcatattcttccgattagcaattgtatgtagaggagagttgtgatggaaagcatgtgtgtgtttgccatgacgacgctgtaaaaacctgaaacacttatttctaggggggtttccactccaaaatggaagtggagagatgtgtcctgataattggtgccgttacccgtgtgttgagtttttacccccctccacaatccccttctttcaaacaaggctggtttggatccatgggcaatcaccatgccctgaagaacgttgcaatctggaacagttctgcgg

SEQ ID NO: 9149 - DNA, 2039 bp, Zea mays
gacaaggttggtagaggacgcgcacccggggtggagctgagagcaacaggagctcctgcggcgaattcgggccccgagtacgccggttcaggcggccgccgccggtggaattgtgccagtcgaggtggcctgctggtgcggcgggagtttgcgagtagggcggttccggttttgagtgagcgaaggtgttgttgggggcgtggatctggccggcggcgggcgatgggaaggagggactagggctcgattggagggaaaggcgtgatccatgggcggatgcttctcgcaggaggagcaccggctccagagcaggccagctgaagctgctggaccagacggactgcagaagtcaaaatctgattctaaagctacagcaagtgttcttgctccaccaaaagctgtggtggatctgcaagtggaaggatatggaaatgtgaatattttcacatatgacgaattgagcgcagccacaaaaaacttccgaccagatcaaattcttggagagggtgggtttggagttgtttacaaaggtgtaattgatgaaaatgttagagcaggtttcccatccaggcaggttgctgtgaaagaactaaacccagagggttttcaaggggacaaggagtggctggcagaagtcaactatcttgggcaacttagtcatccaaatcttgttgaactgattggctattgctgtgagggttcacatagactgcttgtgtatgagtacatgggcttgtggaagcctcgaaaagcacctttttcggcgggtttgccttaatatgccatggtcaacacgcatgaagattgcattgggtgctgcaagggggctcgagtaccttcacagagctgagagatccatcatttatcgagatttcaagacatcaaacatcttgctagatgcggattataatgctaagctttcagactttggtctcgcaagaacaggtcctagtggagaccaaacccacgtgtcaactcgtgttatgggaacttatggatacgcggctccagaatatgtcatgactggccatctgacagcacgaagtgatgtttatggctttggagtcgtgcttctagagatgattattggaagaagggctgtggacgatagccggccgagccgtgagcataacctagttgactgggcacggcccctcctcgtccataacaggaagctgttccggataatcgatccaagaatggaagggcagtactccaccaaggctgccaccgaggtggcaagccttgcataccgctgcctgagccagaaccccaaaggacgaccaaccatgagccaagttgttgagacctttgaggccgtgcagaacatgcctgaatgccaggacatactcctccagaacggcatcacaggtgccgtgacgctctacgaggtcccaaaggagcctgcagacagagttgagctggagaaggccaagcaggaaccggcagtaaagaccgccgcaatcccgcccgtgaacggaaagccggccccccagagcaggcgaacgcggcctgggaatggccggagcaagagcgagccatcgttggagtgtaagatgtacatcccatcaccagactctgacgaacagcagctcggcctggaggcactggcgtccccaaatggcagcatgaaggaccatcctgatgaggatttgtacaagatataaaaccagagccctcgttgctcgccttttgcgccgcacaccccagttctcaaagatcggtcagttacaattttttctctgatagccaccggcctcgctagggttcttattcttccgattagcaatagtatgtagagggagagttgtgatggaaagcatgtgtgtgcttgccatgacgatgctgtagagatctgatacacttctttctggggaatttccactccaaaaatggaagttgagagatgtgtcctgacgattggtgcgttttacccgtgtgttgagtttacttgtaaagatgcttcttcgttgtaatcttcagttctgcgggaaatcaacaccagcatagaaattgatagatcaaaaaaaaaaaaaaaa

SEQ ID NO: 9150 - DNA, 2157 bp, Zea mays
ttgagtcactaatgctagccagccaactaagaagtgaaattgcatacagagattctgatatatcaagcttcgtgattttggaagctatgacaacacttagatgctgtgaggacttctctatggagcgattagagttattgggggactctgttcttaagtatgcagtgagtgcccatcttttcatgacatttcttaataagcatgagggacagttatcgtccagaaggcaagaaacaatatgtaatgccacactttataggcttggtattgaacgcaggatacagggttacatacgtgatgctgcatttgatcctcgtcgatggcttgctcctggacagctgtccagacgtccttgtccttgtgaatgcccagtaaattctgaggttgtaactgaggatattcataggattgatgacaagtctataattataggcaaggcgtgtgacaagggacacagatggatatgttcgaaaaccatctctgattgtgttgaggctctaattggggcctattatgtcgaagggggattaaaagcagcttttgctgttctcaaatggttccagattgagactgaaatcgaggaagagttaattatggaagctctgtcgagtgcttcagtgcgaaactatcttccaaaagttgatgtagttgaattgcttgaagcaaaactaggctacacttttcaaatgaaaggtttgttaatagaggctctcacccactcatcacagcaagaatctggagcaacatactgctaccaacgcttggagttccttggtgatgcagtcttggatattttaataactcgccatctgttccttagtcataaagacacagatgagggggagctgacagatttacggtctgcatcagtaaataatgagaattttgcacaagttgcggtaaagcacaatctccatcagtttctacaacattcttcggggttcttacaagaccaaattactgaatatgtgaatagtcttgaaagttcgtccatggacagagccagccttttatccagtggaccatgtagggggccaaaagttttaggtgatattgtagaaagtatagcaggtgctattcttattgacagcaaacttgatttggatttagtttggcgggtttttaaacctcttctttcaccaattgtcacacctgagaatttggagttgccccgattcagagaacttaatgagtggtctgacaagaatgggtactttattggaattaagtgtgaaaatcgaggagacagcacaatggctatccttaacttacaactcaaggatttgcttcttgtgaggcaaggttgtgggaagaataaagtagatgcgaaagcacatgcagcttccttattgcttagggatctagaggaaaaaggacttataattccaaggaatgcaagcagagtggaacaacttgaaaagaattctggtactgtaaaacattgcaacaacgtgcttgatgttatggacacacaaaacgtagcaccacctaggcaaaaggaagtagctgtgttaagtaccaccactcctggctctgttcttgataagccattggttgtgaaggttaagttgagcaaaggaggacctcgtatatcattgtacgagtcgtgtaaaaagcttcagtggccaatgccgacctttgaattcgtgaaggtcgaaccaagcgtgtgctcctcttcctgtggttcgtcacaaaaggttgcgccccaaggattcgcatttgcttcgacaataacgttgcatataccgaacggcgatgtcatcagcctcacaggagatgggcgtgcggataagaagagctcacaggattctgctgcgttgctcatgctctatgagctgcagcggcaacgtagattccaagttcaagaagtatgaggaatcacctcgtggttccatcaccaaagatgcaatgttaccgccaccggcgattattgcttgggcatcttggagtaatgtcaccgccaaatcagtctttagtcgtcagccgcacgggggtgtaagaaaataatgtacttcattctgattctaaattataagacaccccgaattatgtaatctaattatcataatgtcctataatttgaaatggagcggagcaggtcactctcgttcccgtctgatggattcagacatttcatctgtaaaaaaaaaaaaaaaa

SEQ ID NO: 9151 - DNA, 1575 bp, Zea mays
gaggtattggccagacaaagaatgggaccccgaggtacaggctgtgcatagtgaggaacgtggatgcaagcgatccagacggaaattacaaactggaaagctactcgacatgcaaatatctcaatgttgtgtgggatagtgaggctaatgctgcgcggtggcagatgactcaagtatcggattccccacccaacgaagaagagttcaaggaatggctgcaagaggcagagaagcatggtgcacgtataccgacccggcaggaagtgctggacaagaaagaagccatccaggaggcctataattttgtgtattcagctgcaactgtacagcagatgctgcgagagaaatcagctgtgagacgccctatcaatattgctgctgagaaggatcggttgaggagtgagttggagatggccctgagccgtaggaatgaagctgaagcagagaggattcgcgtgaagctgaaaaatctgcaaagcaggccacaaccggtgtcaaaggataataaggctgcaaagttggaggctatgaaccggaagaatcgtgctgataacttcaagaacgcttcggaactgaaacctgtaaatacatctttgaaggctggagaggctggttatgaccctttctcgaggaggtggacaagatcaagaaactattatgcatcaaagccaggaggagataatgctgaagaaactgccaacaagtccagtagtattgtagagcctagcaatggagatataaagagcaaggctcagactggtacatcagccacaactgcagctcaagtggcagcagctgacgccgggaagctcactgatactaatgcaccagtggatctgggaacagaatcgaatgtgatgcatacatttgaacttcctatatcattgtctgctttgcaagaatttggtggagccaagggcctgtttgatggttacatggcaaggaggcagaagatagaagctacaatggggtacaaggtgcctgacaacgatggaaggaggcatgctttaaccttgagtgtgagtgattacaaaaggcggcggggtctcctctgaatggtatctctgattgtgctggacgctcaacggattcaactatattcctggcgtcagcacctatgtgcatttgctgtgacaattgtgcagatcatctgcattttgccttatcttcctaggcgtaacataagacatgcagactacaattcttttgcataaatgttacctgatgtatgaccgattatgttgctgacatcacgtttacatctgtggattttgcttacatcttatccttgctagctgcaaaaaaccggattccataattagatgaattaaattcaatgtatctttcatttttctgattcatgttttacatggtctgatacatgaacatcagaacatacatagtggagcttgcttattaacggcctcatttgtggtccgaagaagtctttcttgctccaactattacttggttgttttttcctgtttttttcttttattgatccctctttgagactgttgtgttcatgctgaaattacagtattctgttgaacaccgcaatttgaaggtactgca

SEQ ID NO: 9152 - DNA, 2525 bp, Zea mays
ccggccgggaaactaatattgtcttctccacttcgaggcggctagggccagcgcatccttctccccttctgtccggcggcgtctctgtcgatcaattgtgcgccgccttcgcccgcatagcccggagagagccgtcatccttacctgcgccgaccgacgcctctgcagcttctccaggggttgcccgttgaggagggttaggcttcgtcatgtcgaagtcggacctggacgatctgcttcttcaggccgccggccggacggggaagaaccagtcccggccgagcaatccgcggtggaactctggggggagcggctccgacggcttcgacgacgacgacgacgaagactctgacgccgcgccgacctactcgaggaagaagccttcgtcgcaggtaccgctcaagaagcggcacaagccggagaagggcggccggcgtggcggtggtgggtggaacgacgaggatgatgaggacgaggatgggcgtcggagtggcggggaggactcggacagcgccccttcagtggggagtgacctatacaaggatgaagacgacaaggagcgtctggagaacatgtctgagttgcaaagggagttgatcctagctgagcggggcacccgcctcgacgactacaagctcaagcagcgggcacgtgcgtcctcctccaagacggacaaggtgggtgcgccaaaggatagcagcccacccccaccgcctagccggatgcggtcttctacccgaactgacaagtctgggtccgccgctaagagcgcgctggacgagctgcgggcaaagcagcggatgcggcaacaagctccggaggcacgcaggatcacggacctactcccacatagtggctcatccattaggcgcagggctgggagcccaccaagtgatgggagcaacgatggcaataacagggggaggctgaatgaccatgggaggatcgctggcgatggcagggatgacgaatttgatgagtcgccgagtaggcttgatccactcaagtttgatgatgtgaagagtattaccctcaggaggtcaaagctggtgaaatggttcatggagccgttctttgatgatctaatttctgggtgttttgtgcggctaggtattggccagacaaagaatgggaccccgaggtacaggctgtgcatagtgaggaacgtggatgcaagcgatccagatcggaattacaaactggaaaactactcgacatgcaaatatctcaatgttgtgtgggatagtgaggctaatgctgctcggtggcagatgactcaggtatcggactccccacccaacgaagaagagttcaaggaatggctgcaagcggcagagaagaatggtgcgcgcataccgactcggcaggaagtgctggataagaaagaagccattcagaatgcctataactttgtgtattcagcagcaactgtacaacagatgctgcaagagaaatcagctgtgagacgacctatcaatattgctgctgagaaggatcggttgaggagtgaattggagatggctcttagccgtaggaacgaacatgaagctgagaggattcgtgcgaagctgaaaaatctgcaaaacagggcacaaccggtgtcaaaggataataaggctgcaaagttggaggctatgaaccggaagaatcgtgctgataacttcaagaacgcttcggaactgaaacctgtaaatacatctttgaaggctggagaggctggttatgaccctttctcgaggaggtggacaagatcaagaaactattatgcatcaaagccaggaggagataatgctgaagaaactgccaacaagtccagtagtattgtagcgcctagcaatggagatacaaagagcaaggctcaacctggtacagcagccacaacagcagctcaagtggcagcagctgatgccgggaagctcattgataccaatgcaccagtggatctgggaacagaatcaaatatgctgcatacatttgagcttcctatatcattgtctgctctgcaagaatttggtggagccaagggcctgtttgatggttacatggcaaggaggcagaagatagaagctacaatggggtacaaagtgcctgacaacgatggaaggaggcatgctttaaccctgagtgtgagtgattacaaacggcgacggggtctcctctgaagtgtatctgtgattgtgctgggtgctcagcggattcaaatatctgcctggcttcagcgcctctgcattgctgtgacaattgtccagatcatctgcattttgccttatcttcctagaagtaacataaaacatgcggagtatacaatttcttttcataaatattacctgatgtatgactgattatgatactgacatcatgtttatatccgtggattgtgtcatcatcatcatcgtatccttgttagctgcaaaaactggattccataattagttcaattaaaataaatgcagctttcatttttcggattcatgttttacatggttggatgtgtgagtgtgaatgttccatcatcttcctctatt

SEQ ID NO: 9153 - DNA, 1856 bp, Zea mays
gcacgagaccattacctagaacatcctaatcgaggaacggcccaccccgatctcataatcgtcgtcttctcccacttcgacgcggctagggccggcgctaccatctcctcttctcttccggcggcttctccgtcccgtcgatcaaccgcgccgccttcgccagtataccccgcattgagccgtcatcgttacctgcgccgaccggcacctctgtagcctcttctccaggggttgcacgaggaggaggaggttcgggcttcgccatgtcgaagtcgaacctagatgatctgcttctgcaggcagccggccggacggggaagaaccactcccggccgagcaacccgcggtggaactctgggggaagcggctccgacggcttcgacgacgacgactcggacgccgcgccgacctactcgaggaagaagccttcgtcgcaggttccgctcaagaagcggcaccagccagagcagggcggccggcgtggcagtggcgggtggaaggacgaggacgacgaggacgaagacgggcgtcgcagtggcggggaggactcggacagcgccccttcggtggggagtgacctatacaaggatgaggacgacaaggagcgtctggagaacatgtctgagctgcaaagggagatgatcctggctgatcggggcacccgcctcgatgattacaagctcaagcagcgggcacgagcgtcctcgtccaagacggacaaggtgggcgcacggaaggatagcagtccacccccgccgcccagccggatgcggtcttcaacccgagctgacaagtctgggtccgcagctaagagcgcgttggacgagctgcgggcaaagcagcggatgcggcaacaggctccggaggcacgcaggttcacggacctgctcccacgtagtggctcaccaactaggcgcagggctgggagccctccaagtgatgggagcaacgatggggatggcagggggaggcctaatgaccatgggaggatcgctgacgatagcagggatgacgaatttgatgagtcgccgagtaggcttgatccactcaagtttgatgacgtgaagagtattaccctcaggaggtcaaagctggtgaaatggttcatggagccgttctttgatgatctaatttctgggtgttttgtgcggctaggtattggccagacaaagaatgggaccccgaggtacaggctgtgcatagtgaggaacgtggatgcaagcgatccagaccggaattacaaactggaaagctactcgacatgcaaatatctcaatgttgtgtgggatagtgaggctaatgctgcgcggtggcagatgactcaagtatcggattccccacccaacgaagaagagttcaaggaatggctgcaagaggcagagaagcatggtgcacgtataccgacccggcaggaagtgctggacaagaaagaagccatccaggaggcctataattttgtgtattcagctgcaactgtacagcagatgctgcgagagaaatcagctgtgagacgccctatcaatattgctgctgagaaggatcggttgaggagtgagttggagatggccctgagccgtaggaatgaagctgaagcagagaggattcgtgtgaagctgaaaaatctgcaaagcaggccacaaccggtgtcaaaggataataaggctgcaaagttggaggctatgaaccggaagaatcgtgctgataacttcaagaacgcttcggaactgaaacctgtaaatacatctttgaaggctggagaggctggttatgaccctttctcgaggaggtggacaagatcaagaaaccatctatgtacacttaaataaattttgcttcaggtaaaaaaaaaaaaaaaa

SEQ ID NO: 9154 - DNA, 3995 bp, Zea mays
acacgcatcaatgcaaaattggtagagctcttttgaagtctcctatctccggtcttctcatcctatacacatttattgctgtgtggtttgtaggaggattgacctcattccacatctatttgatttctacaaatcaggtaagactattcttgagtaactggagtaacatttaatttgctttgcagtttattagcaagctagcagattgaaatctcatgaaaaaaacgtttttcagactacttatgagaacttcagataccgctatgaccggagaacaaatccttacaaccttggagtgggtcagaatttcatcgacgtcttgttttcaaggatacccagctcaaaacacgatttcagcgccgaagttaaggccgattcttcgaccttcgcgtcatccctcagtatgggacgggttctaagcccgcccaagacgagcgtggaccttgagatgggcatgaaaaggcaagcggtggccgcagaggacttggaagacttgcacagccagatcggcagtgctatggggctggagagatgtggcaccgagccgccgcattttgtcggccggaagggctgctctgagatgtcacctgacatagaggcgttcgcagaagagtttggcatggaaggtgggctcagtgagaggaaaaagattgagcggcggacaaatgatgattcgtaggaagtttcccacgtcacaaaccacctcttcggccttcctccaggccccaaacttggtaaaagcttgcaaagaagaaagtgaagtaggacaaaacggacggtagagtgaatcaggcattggttagtttgttttggttgtcatttctagccaagacttgagttagaagtgaaagatgttccttgacgatatagaaatgatgaatccacatctggtttggacttcttagtctatgtgatgtattggatgtgtggtgtggcagtgttgcttctgattttgttgaaggtgtaatctgttgatttaacttggctatgcattcatttaatcgatcaaatttctgcacttttgcgctaaatctttagatattgttcagataagggtggattgaagggaattaaatcatttgttactgaaaattgaataggaagagatttaatctacattaacccctctgattctcatgcaacttaggtaaaatcaattatttagataattttaacagctaactattaacaatagtacattaaaatagggtcttattttatcaataaacagtatcaattgtaggtttgaacttttttttttggcataacactacttcattttcaattcctctttcattttgtgcaaaatgtagaggtctatcgtgttctgaaatctttgtcatgctgcgacgccgtcgtttgaaaggcttcgctatggtctacgagccagccagccaatgcaagctcgccacgacaacgaacaggggtgcccactctcagtcggtctccgcccaccgctgccgcacgcgacgctgtgcccaggagtgcaccgcaccgcacctgcccagccgcccagggttcacgcccgcggcccgcggcccgccgaaccttcaccgtcccccgccccgccttgctgaattccaaagtccaaaccgacgagcgcagcgtggtgacattggtggtcttcgaaagttttgggctggcttatttacttacgggacaagacccagctagctcgtagcccattatctgctagtagcctggcagttccgacgctgcttgcggcggcgcttggcaaggccgacaaacggcgaccaggcaggcgagctcgtcgcctcgggggcagggaggaccggagcccctcgcctcggaggaagggaggacctgaggtaggcacctcctccccctctctctcaacgtctcgctgctagcgttctgttcgattcaccagctcgtctggccctcgctaatctgcgggtcggggcagcgagtgagcggcgccggatttgttgctttctctgtgaggcgtgagcccgtgcagtgcctgccgtctgccgagccgccggccgctgtgagcagctgcgcgtgcgcatgctcactttgtgatagtttgattcctacgctgctctgtttcctgtcgaaaaccagccatccagaaatgctgcttcttcaacgccaaggaactatcgcaagatcactctgagttcctcaaacatgatgtgccatttctggatccccagatggccaaacttgtcatggctgctgctgtggatacttgaatttttccctcagcttcacaaattcctgactacgcggctacgccggtccatttgagtgccggcgtgccgctccaccagtccaccatagagtcacaaactactgctgttaattattgccaagctataaaaacgcagagttcctgtgcattggacctgaagtgtttggccgtgatacgtattgaaaaatagctaactgtctgaaaactcagcaagacatgatgtattggtctctcatgtcgggttcctttgcaatgtaggtttcagtgttgggtgacagttccccatatcctccaagcgcgtgcttgcctgcagcaacagatcgcttgtcaactccattggctttaatgggtgcaccttcacaaatatttgttgggaagtcaaaagccttctgcattgccaaaagctcttttcctgaacacaaatatgccctttcaattttaatcccacgactctcccattgccatattcccctcctcctctcccagtcaattgtttcaggtcttctcctcaagctcccccttgtccactctgtcctccgatctctctctttggggcatttcccatctctatccctcgatttactcgccctgctacgccattctggatgtatgaccctcgatagctactccctcaacattgctttctatgccactgcccgcctcccatctgtttctgttggtgcccagcttcattccctttctgtcaaacttggcttggtttcagatacatttgtccttaattctcttatcaacatgtactcgtcttgtagctatccaacaactgcaagacaagttctcgattctgctccccaaggagcttgtgacacagtttcttggaacacaataatttctggatacctacgatgtgggatgcctaataaggctctgcaggcttttggccagatggtcaaggagccagttagactggatgatgtcacattgctgaacgcactcgttgcttctgccaaggcaggcaaagcgaaggtcgggaggctgtgtcacagtttagttgtggtgaacggggctggaattaattgttatatgggatcctctctgattagtatgtatgccaagtgtggattggttgaggatgcccgcaaggtatttcacggaatgcatgagagaaacgtcgtttgctggacatcaatgatttctgggtacacacagttgggtaagtttaaaaaggctgtcgatcttttcagggatatgcaaattactggaatgaaggctgatgatgggacgattgctactgttgtgtcttcatgtgcccaaatgggagcacttgacttgggacgatatgttcatgcttactgtgatgttcatggtttagggaaggagctttctgttaagaattcactgattgatatgtactcgaaatgtggggatataactaaggctcatgagatattctgtggattgaccaagagagatgtgttttcttggacggcaatgataatgggctttactgttaatggcttatgtaatgaagcacttgatttgtttgctcagatggaaggagagggtaaggttatgccaaatgaggtcacttttttgggtgtccttacttcttgtagccatggagggttagtggaacaagggttccatcacttccagcgtatgtccatggtctacaatcttgcaccgaggattgaacactatggatgcatggttgatctcttgggacgtgcaaagctattgacagaggcagaacaatttattaacgggatgcctattgccccagatgtggtagtatggcggtctttattgtttgcctgca

SEQ ID NO: 9155 - DNA, 4254 bp, Zea mays
gcacgagaccattacctagaacatcctaaatcaaaaattcttcatcaagttattttcttgctccacggattgcctgctctgatgatctggtccttggcaagatcacactcgtgttcataaactcaccaactcactgacacccccgtactctttcttcttcacccacggccaagatagaactcactggcatgctaggcttcctctttttaattcaccaactccctcctccggcgcatccgcatccgaatctcaatccccacgggcacgaatctgacgctgcgaaaacctttccgccatgaagcaggaggggcggaggcggcaacaccaacaccaacaccacaggccgccgccgcgcctcgagctggctatggcgcacgcgcggggcggcgggggccacggccacggccacgaggaggaagcggaggcggccgtctgcctggacggcgactccgaggcgggcgaagcgcgcagcgcggggcgcgcgccgccgtggcgggaccagctgacggcgcgcgggatggtggcgagcctcgccgtcggcgccatgtacagcgtcatcgtcatgaagctgggcctcaccacagggctcgtccccacgctcaacgtctccgccgcgctcatcgccttcgtcatcctccgcgggtggacgcaggcgctcgcccgcttcggcgtcgctacgcgcccgttcacccgccaggagaacaccgtcgtccagacatgcgccgtcgcctgctacagcatcgccgtcggaggtgggtttggctccttcttgcttgctctgaacaagaggacctacgagatggctggggaggacacggaaggcaaccttccgggaagctacaaggagcctggcattggctggatgaccggcttcctcttcgccgtaagcttcgtcgggattgttgcgctaatacctctaaggaagatttttcttcgatttcagtctaacatatgttggcgctgggatgatttgctctcacctcgttaatctatctctccttcttggtgcacttctctcatggggaataatgtggccactggtcagtgatttgaaaggggattggtatcctgcagatatgccagaaagcagcatgagaagccaaggttacaaggccttcatctgcatagcgctcctcttgggcgatggtctttacaattttgttaaggttgttgcattcactgttaagagtctacttggcagatcaagactgaagaatgcaaagaaagaggaagacattccagtgcttgatgaaattcagcgcaatgagatttttacaagagacagtatccccacatggctagcctactctggatatcttgcactatcagctgttgctgtgtttgccattcccttgatgttccatgagatgaaatggtactatgttattatagcatacttattggccccggcattgggtttctgcaatgcctatggtgctggccttactgatatcaacatggcctacaattatggaaaggtcgcgctctttattcttgcggcctgggctgggaaggactctggtgttgtagctggcctagtgggttgtggtttggtgaaatcactggtgtcaatatccgctgatctgatgcatgacttcaagactggacatcttacattaacatcacctagatcaatgattattgctcaggctattggcactgccatgggctgtgtcattggaccactgacatttttactgttctacaaggcttttgacattggaaaccctgatgggtactggaaggcaccatatgctctaatctaccgcaatatggcaattcttggtgtccagggcttctctgctctgcccctgcattgtttgcagctgtgctacggattctttggatttgcagtggcagccaatctgatgagggacctcttgccaccaaagtacggcaaatgggttccattaccaatggcaatgggggttcccttcctagttggtgcgagctttgccatcgacatgtgtgtggggagcttgatggtcttcatctggcacatcattgacagaagtaaagcatctttaatggtgccagcagttgcatctgggttgatatgtggcgatgggctttggatcttccctgaatccttgcttgccttggccaagatcagtccaccattgtgcatggcattcaggtcttcacactagagtaacaaaatgctcgacatctgagaacagttccatgtccaatcggagaagctgttggcatgccaagtttgttattaattagctgggatatgatacatgcaggtaggtaaagatgcagtgcctatctggatgttacctacatataatgacgtaatgtggtacccctgtaaaatttatcatatgcaagatgatacatcacattagagcaatggtaagtttgagaatttcaccccagtggtaatggatggatgcaagagctagcagtagccaaaattttgcaccataggttgtacccccacccctatagtttaatatggaaccacaagctacagtatacaaaccatcttccaaagacagctgaccctattgtcaatcacagctggttttggtaaaagaaaaatgcagtcaaatcttgcatgaatggttagcaaatcatgtatatatttatgtatgtctttgccataacttggattcacaagatgcaatgtagtaagaggcatcttggtcaggcatctgatacaattgtaaaatcatctgctgcgtccttttatcataaacaaaatcatcaggtgatgtatgcctatgaatagttagcaaaaggtacatatatggttatgtatattaaacacgttctgtgaagaagaaatgtaaccattcaacaagaacaatccaatgacacatttgtcagcatccggagaaggctatatcctcagatgcttgccttttcaaaaacctcgatagaagaaattaatagaggcctcgctattgtcagatacatattctcagggcctacattcccaggggcggacgtacataagcctgagtgagggcccaaccgccccactcatttctctgttgcaaatagatttctctgttgcagatagtgagcttagatttttactatacggtttcctaatcaacctaacttaaataccacagctctgatattttagtgctcgttcttttaaatataccctcacttatattttgttttggatctgtccctgtacatttctgaggacctaccttggctctagctaaggtagaggtcattagaccgaaggtctaaatcttttagagccttaaggacatgtaaggttgtctcaactattgtcgtttgtacaggactgctatatcataggctccaatgacccataaggttgtctcaattattgcagtccataagaacggccaaaatttgaggccattattccattcaaaataaggtggtgcatcatgggttatcaaatttggtgggatgatactattcctaatattagtattaactaattaactatgagaaataagatggtgatggatcaactcattccatttcacaaacaagtaaaaaaagtgagcagtaagaagataatagactagttcatttctcaaaccaaacatcctatatatacttactttggacgttcctaaacttagaactctctcggatgtctagggcttctagggctctgtacgagctcccaaatctttgaacccccggcctatgagttattacgaatgattcggtcctgaaaccctcctggactcgacgcctcatgaggacaataaagttttcaattcggtatgggagcacatgtaaagtaaagaatatagatgacctctatccctagagtaggacgcatcctaaaggtataacactatgttcaaacccaacccgtcaacctcgtggtagtggttatcttgataaggctcatttctatcatgtttaatatgatgggcaatgttatggttaaataggtgtattgttgccccgatataggtagcaggcatacgcaagaccactatttgatatgtgtcatcgtccgtatagccatgcttgaacgcgtcagggtactgtaaagtattataaagtatagatgactatattgattatcaattacgtcgtatccaatgacgtggatcggtcacacctgcctctaccgcaaaagggcccctagatgagttgattagatagtctgaatagcactcctaagattctaagttcgacttcccttagatcggtctcggtcttggtcccgattattctcatatgtgatatagtgtcgctatgtatgggtgggacacaggtttaaggggtattatc

SEQ ID NO: 9156 - DNA, 3009 bp, Zea mays
ttctaggtggagttctagattgcaggtttacttttcgttcggtcatctttttagggtcgtaggttggctgcattagcggctgttttttttaccctcaccagtcaccggtcaccatctacatgattggttgcctgcatagagataatccggctctccgcgtgctttgaccaagcacgagattctgattggttgcttggatacgaggatgctggcctgcatgcgggctaggccttttttttttcactaccagcccgcgtgtgaagatggcgctaataaggatcgctttggagccaggctcgcgggaggcctgcgcgcctgcgcgcgggaggcacccaaccaatcagccggcatagtcttcttctcgtcgctgcactgggcccgctccttattaatgaaatacgagcccgacatgcctaaaagaaaccgaggaagacgaagcgtataattcagcatcacacacctctttttgaaaggaaaaaaaatacacagaagctggtggcagccaaacgctgcagtgcacgctggactggagtgcagccgtcccgtcccgtcctcctctggaccgcgcgcgatgcacggcaccggccgccggccgcacttccttcattcgcaggacaaaggacgaagcactacgcatgccaccacaccatgtggcgaccgagatttccccggcgtatcggtttggtaggctcgttgggtttagggtttgttgcggtggagtcgttgagacgtgcagtcgtattagttactactacctcctccggtcctccctagtactagctgtttgcaactgaaagcgtctcttattgtttgcgcttttggttgctccgctgctctgctctaaatcagaaatgcttctgcgtccgtaccggctcggaggctgctgagtgctgactactgatactgatagagagtaccgttgcacagattctggaggcataggatcgggcgagacgagcggaagaatggaagattaaagtaatctcctaggagcagcagggccagctgagctgagactgagagggcagagggaacggtagaaaaatacgtaacggtatgattaggtagggggggcgtcccgaccccgacagcgagccatgtgtgggtggaacggtcgctctcctcccccgcctttataagctcctccgccgagccttcactcgccaccaccaccctccctctctgcctcatcacctactccgcctgcgcctgcgagctgtgctgtgctgtgctgtgctgcgcaacggggagatccaatccacagaacaggatgcagtccaagcaccgggtcttcgcggaggacctgctcctggcggcggcggcggagggcgaggaccacttcgaccgggtgcccgactccctggtgctcctcatcttcaacaagctggccgacgcgcggtcgctgggccgctgctccgcggtgtcgcgccgcttcagcgcgctggtcccgctcgtggacgacgcctgcctgcgcatcgaccgcgtcatccccgccgacgccgccgacgcgggggcgccgcgcccgcgcgccgcgctctcgcacctcctcaagtccgtgctgctcgccgtgctcaagcccttcgcgcactgcgacgccaagtccgcgtcgccgcaaaagcacgcgcagcagcagcagcagcaccactcgcccgcccaggtgctcaggaacttcagcagcatccgcagcctccggatggagctcccggtctccgacgtgggcaccgacgacggcgtcgtgctcaggtggaaggccgtcttcggcagcacgctgcagagctgcgtcatcctcggcggcaccagggtggaccgcgccgcggccgcggccgcgggaccgccgcacgccccctcctccgctccccccgcgggcgacgacgacggcggcagcatcccggagtccctgtacaccaacggcggcctcaagctgcgcgtcgtctggaccatcagctccctcatcgccgcggccaccaggcactacctcctccgcgagatcgtcaaggagcaccccaccctggagcgggtggcgctgacggacgccggcgggcagggcacgctcagcatggggcgcgaccagctcagggagttcagggacaggccgctcgccgccgcgcccgccgccgccgccaaccgcacgcaggtgcccgcctgcaacatgaagctgcgctacgcgccgctgctggagctctcggacggcaccaggatccacggcgccacgctcgtggtcatcaagcccgtcggcgacgccggcgggaaggacctcgacgagctcggcgccggcgccttcgacgggcccctgagggaggccgtggccgcgctcggcaagcgccgcgcctacctgctcgagatgaacggcttctagtctgtgcgcctctctgctccatggcaatgggcattgttaattggccaatgggcaacggcaactagctagattgctcctccgctcgcttcacctcagctgtcagtcagctcctgtcctgacgatatccttgtggaaaaaaaacagtagtatagaatggagtgggcagcgccagccggccagcttcacagtgcattctgatgctatcatgaacggaaatgaagcagtcagtcacattttgaatcaactcttgtctgtaaagggctaaaggctctgagacgacgaaaccacagagttgcagcatggcaattcgaagtctattcatgccttttttttgcgaaacgggaaaatcacacgagatttgcccttatccactcctgctcgaaggcagcagtgacgcttgtttgagcgatcattttagaccgtatctcgcaagagtaacttttaacaatgcgtgcgctcttgtccctcctactgtattgccaagagtggtaaatacatgcagtctcgtcggcctcctcgggtcatttacagatatagatggccaaacagaccgtccgatacggtactgcacgtcaatattaaacactattaataatcgtgttattcggtgctagtgtctaaccagcggctcattacactatagtgtctaatcg

SEQ ID NO: 9157 - DNA, 2156 bp, Zea mays
ctgcagggcacgctggactggagtgcagacgtcccgtcccgtcctcctctggaccgcgcgcgatgcacggcaccggccgacggccgcacttccttcattcgcaggacaaaggacgaagcactacgcatgccaccacaccatgtggcgaccgagatttccccggcgtatcggtttggtaggctcgttgggtttagggtttgttgcggtggagtcgttgagacgtgcagtcgtattagttactactacctcctccggtcctccctagtactagctgtttgcaactgaaagcgtctcttattgtttgcgcttttggttgctccgctgctctgctctaaatcagaaatgcttctgcgtccgtaccggctcggaggctgctgagtgctgactactgatactgatagagagtaccgttgcacagattctggaggcataggatcgggcgagacgagcggaagaatggaagattaaagtaatctcctagcagcagcagggccagctgagctgagactgagagggcagggggaacggtagaaaaatacgtaacggtatgattaggtactagggggggcgtcccgaccccgacagcgagccatgtgtgggtggaacggtcgctctcctcccccgcctttataagcgccccccccgcgccgccaggccggcccccccaccaccctccctctctgcctcaccacctactccgcctgcgcctgcgagctgtgctgtgctgcgcaacggggagatccaatccacagaacaggatgcagtccaagcaccgggtcttcgcggaggacctgctcctggcggcggcggcggagggcgaggaccacttcgaccgggtgcccgactccctggtgctcctcatcttcaacaagctggccgacgcgcggtcgctggggcgctgctccgcggtgtcgcgccgcttcagcgcgctggtcccgctcgtggacgacgcctgcctgcgcatcgaccgcgtcatccccgccgacgccgccgacgcgggggcgccgcgcccgcgcgccgcgctctcgcacctcctcaagtccgtgctgctcgccgtgctcaagcccttcgcgcactgcgacgccaagtccgcgtcgccgcaaaagcacgcgcagcagcagcagcagcagcaccactcgcccgcccaggtgctcaggaacttcagcagcatccgcagcctccggatggagctcccggtctccgacgtgggcaccgacgacggcgtcgtgctcaggtggaaggccgtcttcggcagcacgctgcagagctgcgtcatcctcggcggcaccagggtggaccgcgcgggaccgccgcacgccccctcctccggctccgctccccccgcggtcgacgacgacggcggcagcatcccggagtccctgtacaccaacggcggcctcaagctgcgcgtcgtctggaccatcagctccctcatcgccgcggccaccaggcactacctcctccgcgagatcgtcaaggagcaccccaccctcgagcgggtggcgctgacggacgccggcgggcagggcacgctcagcatgggggcgcgaccagcctcagggagttcagggacaggccgctcgccgccgcgcccgccgccgccgccaaccgcacgcaggtgcccgcctgcaacatgaagctgcgctacgcgccgctgctggagctctcggacggcaccaggatccacggcgccacgctcgtggtcattcaagcccgtcggcgacgccggcgggaaggacctcgacgagctcggcgccggcgccttcgacgggcccctgagggaggccgtggccgcgctcggcaagcgccgcgcatacctgctcgagatgaacggcttctagtctgcgcgcctctctgctccattgcaatgggcattgttaattggccaatgggcaacggcaactagctagctagattgctcctccgctcgcttcacctcagctgtcagtcagctcctgtcctgacgatatccttgtgaaaaaaaaacagtagtatagaatggagtgggcagcgccagccagccggccagcttcacagtgcattctgatgctatcatgaacggaaatgaagcagtcagtcacatttcgaatcaactcttgtatgtaatggcatgagacgacgaaaccagagagttgcagcatggcaattcgaagtct

SEQ ID NO: 9158 - DNA, 2794 bp, Zea mays
cttgcatgcctgcaggaataggatcgggcgagacgaggaggaatggttgattaattaaacctaatctcctaggaccagctgagcagagagagagaaggcaggcaacgccgcaacggtagaaaaatacgtagctgatccgggtaacggtatgattaggggcgtcccgaccccgacagcgagccatggacggacttcaacaaacggtcggtctccgtctcgtccgtcgtcgcctttataagcgcctccgccgcgccttcactcgccaccaccataccaccctcccattcctacctcagctactcccttcgcttcctcatctgcgagctgtgagctgcggcaaggatccaagccacaggcaggacaggatgcagtccaagcaccgggtcttcgcggaggacctgctcctggcggcggagggcgaggaccacttcgaccgggtgcccgactccctggtgctcctcatcttcaacaaggtcgccgacgcgcggtcgctggggcgctgctccgcggtgtcgcgccgcttcaacgcgctggtcccgctcgtggacgacgcctgcctgcgcatcgaccgcgtcatccccgccggcgacggcgacggcgacgcgctcctcggcctcgcgggggcgccgcgcccgcgcgccgtgctctcgcacctcctcaaggccgtgctgctcgccgtgctcaagcccttcgcgcactgcgacgccaagtccgcggcggcggcgcacaagcacgcgcaggcgcaggcgcagcagcagcaccactcgccggcccaggtgctcaagaacttcagcagcatccgcaacctccgcatggagctccccgtgtccgacgtcggcaccgacgacggcgtcgtgctcagggggaaggccgtgttcggcagcacgctgcagagctgcgtcatcctcggcggcaccaaggtggaccgggccgccgcgggtccccgcgcccccaccggcgccgacgccgacgccgaggacgcgggcgacggcggcggcggcggtggcagcatcccggagtccttctacaccaacggcgggctgaagctgcgcgtggtctggaccatcagctcgctcatcgccgcggctaccaggcactacctcctccgcgagatcgtcaaggagcaccccacgctggagcaggtcgcgctgacggacgccaacgggcagggcacgctcagcatggggcgcgagcagctgaaggagttcagggacaagccgctcgccgcggcggccgccgccgccaaccgcacgcaggtgcccgcctgcaacatgaagctccgctacgcgccgctgctggagctgtcggacggcaccaggatccacggcgccacgctcgtggtcatcaggcccgtcggcgaggccaccgcgggcaccggcggcggcggcggcaggaagggtctcgacgagttcgccgccaacgccttcgacgggcctctcagggaggccgtggccgcgctcagcaagcgtcgcacctacctgctcgagatgaacggcttctagtctccttggccaatggccatctctctctcctgcgcacgcgcgtcgtctgctgcagcagcaagaccccccagcgccgccgcctccgttggttttagcctcagctcggtcctgatcgggggaacactgaggtgttccgtccttctcgaatgtcgcagcaaccaacgctgatgtctcctcggaccattgtgaaaatagtagtgtagcgaatggagtgggcggcgccagcagcaaagcttttgctacgttttgaacaggatgaaaacagtcactgttttcaatcaaatgttgtccgagagtactgtacaagtttctgagacgaaatcacggtctcattgatggagaaatcactttttcgatcaggccagtagtgtgaaaaaactttgaacggaattgcagcgttcttgccattgtattgccatgccaagagtgcagcctttgtggaatgcttcttttcttgcacgttatcactttagtcctaatttgaattaggataagctttctttttaggacatacaacccaaaattcttagattttacagtaaaaacataacgtgtatatatatgggaggtactcttgttttttgattttttttcttctcctttaattggattgtacagtaaggcgcatctacgacgacatgatctgggccggctttcttaatccatacagcacattatgtgctgcatctacagcgcatactgtacaacacattcggctctatcattgatcggtgatcattctgagctagactgcatgtgtttgcagcaattaaagaggggggttatcacaacacgaacacacctctcctccgcgcgcggtgaccaactactgctgttgatcgagctaggttggctcacacacgtttccgttagactatctctagcatacttttatctcactcactatttaaaatctcactttataaaaagtgtaatctacggtacaaaacggtatggccgtttgcacggaggtggttaaattgtgcagctacgtacgaccctggacttctgaatattccagtgtgttcagtaggagagacagagagcacaacagggtacggtaaatagaagagagactgcactcttcttcttctttacatataatgaaaaaaaatctgtttaatatgcttgtgcagttttgcccaagcgcggcggccggcggtggcacggccggcagacgagaacgagatggctcttgctcttggacggtggttgggttaacggccactccctcttcattctggatcccagttcccaatcccaacccaaggtggccgagcactcaacggtcg

SEQ ID NO: 9159 - DNA, 653 bp, Zea mays
cctgcagtcgactctatcgatccccctgaagccgagctgcagtattttcacctaactttggagcactatatctcttaatttgttagctttcgaccttaggatgttgcagcgagtttatagagctatattttgtcaacaagttttattaacggaggtcgacttgctatagcatgggttgggagaaaaccttgctttaaatcggtccgtcaagcagatgtgcactgaaccttgtttagatggctgaaacttgctttggtttttggggagaagaaaatatcccacgtctctgttgtgtctcactagtgccagtttgagctgcagtattggatagaggtctaaataggtggtaaatgaaagggtacaaaaatggaagaaggaagaaaaatcctgtttttttcctcccacgttcagtcctccttatctaccatacgctgcaatctcctagcatcttctatccctgcgtgcacgcgtcagtctctggtgatcttcaacgccacctcctacttcctagccaaagcacgatcactcctttggaaacctccagtcctcacgctagctctctggaagtccaaaacgctcggctctcaatactccttcctccgcgtcatctccctctcctcctccccaacgctggagcagcagggggatcctct

SEQ ID NO: 9160 - DNA, 6378 bp, Zea mays
  misc_feature (1432)..(1432): n is a, c, g, or t
tggaagatagccatcaatgctctattttttttttctttcttttctgttttttcgttcaacacacatgtttgttgcgaacctctgaactattacctaactaacaattagtttactaattggtagagataaatcaatatggactaaaaaaaagtacgtacacatgcctctaaattagtccatgtattgaaacagtattgtactgtgctaaactttaacagcgcaaccgcctacgttttagtccattccatctaaacttcagctctctaggcaatccacgtaaccgtctgtttagatctcgcactctaaagttcagccactaataataaactttagctatttccactttaaaagtcgattcagaaacaacattaaagcatataaaaaaagtttttagttaattagttcttaacttcttcatccaactaaactttagacgagtcaacgaatccaacacaaacgctgaaggcatgcatgtttggcttgcttcctttatgctgccaagcaagaggtgtgcacatgcccatactccagcgaacaaatcatccgcaaaaaagatttggtagcgatccaaacacgtcctaagaatcataattcttatacttgactaatgactagtatgggtacagacatggtataagattttacctacttagagcatctccaagaaactctttatctttagctctctctatttgactatctatttatctttttataatacagtctatacatattatctcacttcaacagactatctatctagttcggctagtcaattgactagccaaatttggctagtgagagagaaaatttggagagctcgatagcttagcgagtcacatagctaatacgttggagagttattttgctgttgagtagccaaaatttggtttggcaagtcatttatctagttcttggagatatttttatacatatataccattttatgaattgtactattagctattttgttgtgttgtttttttattttatgacgaaatttaaattatagaagtacagatattgtaagacagactgagtacgagctatctttaaaagaaaaataaaagaaacctactaggtaacctacgacgagtaaccggcccatctagctttgcttccaccgatcccttcgcggaaagcaagaaaaaagttgactgtgggctcttaacgaggtgacgggagagagagctttgtcacgtccaattgattggcgatgtgatttttttacagagatgcacgtatggtaataaaaaattgcaacgttggaacttgtaaggttgctgcagtagtacgttgtacagggctaaaatgattttgtactacccgcgccatcatgatcgcccgagaggcagctttcactatttagatggttagctggcttttaagaccgtttgcagcggttcatctaaaatttatctaaaaatattgntttacactattctgtatattaaaattgtactgtgcacaaagtagaatttgaacataagtatatatatgaataagctgttagagatagtctaagtggtaccgaattcgactgcttctgcagtatttttgtctacctagagtgtaaacagtcgccaaacggcctctgatttcatgatccaacgcgttgtttttcctgatgctggtttttggcagagtattccgttgatcttcttggctatggcgttcacatacatggaactgtacatccattagcgctcctagtaaactgatgagagagggaccagcggaagatcgaggcggccatgtcgttttccagacactaggcgtcgccctcgcccacccagggacccccaaaaactgcgggacaggatcattgcacccgcgaaatgaaaatttacaataaaaaaccgatagtagaaaacgaaagcgaactgacgggccgccgggccggggagcagaaagggaggccattaatactcgacacctccccgtcttcttcctcctcccccctccgccattgctccacgagtccacaagacatctcccgcgcgccagagctctagagagaaactggacaggagcgcgggcttcggactcccatctccgcgggggcacaaaagatgcaggtcctcatgactcccagcctccgcgcagcgcaatcgggtgagatttctgctgcgccacatctcccctccggttctgttttccctggttcctgattcggctgccttccgttatttatatataaataaatgtgcttcggccttcggtcctgttactcctatagatctgtcgcgcctgctgggttccagagctgttcggtttggctcatctctgccgttctgcatttcgcagaaagacgagaaaagcccgtccctacttcctgctttcctcacctttccgcagccaacaccagaagaagaaattggcaaaaaaaaaaaggagcattttggtttcgttgaaatgcggccccgatttcgactcgccagctttgcgcgcctctaactgctaggcagtagtgtgtgttttctctctctctgtgtgtgtgcgcgcgcgcgcgaggaaaggccttcgttctggggcgggcggctctcttttgcaagcggcaatgatgcgcctttggcgagcactctctgctgatcagacgcttgtttattgctaaagaggacgctagatctgtagcgttgcatgattgaggtcagtggggggcggggctggacatagttgatggttttaacaggacctttcctagctctaggccgacaacagatgaacgaacccccccaagtgcggcgggcgcacattgagcacccaatgatgaggcgtccatggcggatgctgaatgtggccgtcattttctcgccttatttatttctttttggcaaagtcttggtttactgtctacttgaatattatgtcgcagcccctcctgcgttttataatcgctatttttgccactcacagttttgccgatttcatcgaagttcttcccccccacaccatttgcagattgtcaatgaatctacaatgcaaatagtccattgcaatgccaaggttgcttcctgactgaccagatcgagcgtgttgaactctctggtcatctcgtctgaaaaaacagacaggtgtttgcagctatggcttcgaaggcaatgccccaaattctcccagaaacgccaggcatcccaggcacgaagcaatgctctaagagtgctccccctttcgagcttccccagacgaacaattcctgtgcttctgcgctgacggtgttaccaggaacaacaactgacctgagcaaatcgagccataaacctgagctgaacgagcagaaaccagaccaccgcctcaaggaacctgtcgacgccgcgtcggtcaagttccccgtagaaccgagcaagaaagcggtagcggagcatgggagcacgaacgggggttccacttcgtttcagacgtgtggagggactagccaggcccaggcaaaggtcagtgcgagtgctaaggccgctgatccacccgagatcggtgacaggggcaacagtggaagatgcaggcctagcacaagcagcgacatcagtgacgagagctcgtgcagcagcatgagcaacagcacgaagcctcacaaggcgaacgattcgcggtgggaggcgatccagacggtcaggaccagagacggggttcttggactgagccatttcaggctgctcaagaggctaggctgcggcgacatcggcagcgtgtacctctctgagctgaatgggaccaagagctatttcgcgatgaaggtcatggataaggcgtcgctagcgagccgtaagaagctgctccgggctcaaacggagaaggagattctgcagtgcctggatcaccccttccttcctacgctttacacccacttcgagaccgataagttctcctgcctggtcatggagttctgccccggaggagacctccacgctcttcggcagaggcagcctggcaaacatttcccggagcaagctgtcaagtacgtatgtcttatccacattttaccatccgcatgtattgcatttcactgtctaaatagtacttaacagagttaaggcttttgagttcattagtttgaaatcatcgtgactgaaaaacaaaacctattgcttgctgcagattctacatagcagaagtcctcctggcgctagaatacctgcacatgctcggtatcatataccgtgatctcaagccagagaacgtccttgtccgggaggacgggcacatcatgctctcggacttcgacctctcccttcgctgcgcagtcagcccgacgctgatcagatcctcgaaccctgacgcagaagcgctcaggaagaacagccatggctactgtgcgcagccagcttgcgtcgagccgtcctgcgtcgtccaaccgtcatgcgcagccccgaccacctgctttggcccgcgcctgttctcctccaagtccaagaaagaacggaagccaagacctgaagctgccaccccggtcaacccttggcctgagctcatagcagagcccagcgacgcacggtcgatgtcgttcgttgggacgcacgagtacctggcccccgagatcatcaaaggcgagggccatggcagcgccgtcgactggtggaccttcggggtattcttgtacgagctgctgttcgggaagacgcctttcaagggatccagcaaccgggccacgctgttcaatgtcattggccagcagctgcgcttcccggagtacccggccgtcagcttctcggcgagggatctgatcaggggtctgcttgtgaaggagccccagcaacggctggcctacaagcgtggagccacggagatcaagcagcatcccttctttgagggcgtgaattgggcgctcataaggtgcgcaagcccaccggaggtaccaaagcctgtcgagatcgagaggccgtcaaatcatccttcatcgccgtctggagctgctgctgacgatgcctccgttggtgcaccccagaaaggtgtcgacggctacttggagtttggtttcttctagcaaacatgtgggctttttttttacactggatgtagggttttctgatgttatgtttttagcagatggttggtgttgtagatttgtgccttcaacctgttttgttttgtattttacacgttcttaaagttcacatctgtaattcagcaagtcttcattgtactgatctcctgcaaggcctttgcaagacatgttctttttttcaaaaaaaaaatggtattccaattataaaactaattatactaaaggacgagataaatttatgaaacttaattaaacttataactaatactcataattgatattcaaatatttgatgtgttacgaattaaactttagctagggaaatcaaataccccttaaatttagatgcttatttccttgttaatgaaaaacaatactccctcagttgtaaattaaaattcgttttgtttttccttgttcataatcatccatataaacgtggacatagagcaaaaatgactactattttgtgatggatgggtataactttccttaggttggtcatattttttgcaatattaaatattttttgtgcctaataaatcttgtttgatgttaaatatgtgtctttttttttataaatctcgttaaaattagaaagtcttggattgggatgaagaaactgactcgcggtttggaaagagaaagtagttattatgaccgattgtacagttgacgcctattctttctgatggcatgtcactggtaaccttgacagtcacatgctcgctcgactagtcttgattcggcgatcgctcaccgacagcgggatgacatcgaaaggttaacaggaaagctccggccgataggcaatagcatcaggtaagatgaccatcagactgatgcatcagcgatcttcagggcgcgattggttgccttctctagcgcgcctgggtcgtttctacttgcgtgtggataaccaggctctggcactcgttcagccatccaattagagatggcaacggggacccgatccccgattccccgcggggaattcatctattagaggatggggatgggggagtttcttctcccacggggatgtaaacggggagaaattctcccccgacgggtaaacggggacggagaatggcccatccccgttccccgcggggacccgttaaacttacatgtgacaatattttcatgtaatagttaatgataaaaataaataattaccttgtcaagagatcacccgttgtacaaatacattgattttaatgcatacataatgatttttacatctaacaatgtgtataagtgacaatgttttacattaataacaaatgaagtacgatttaattataatttaagcggggatggggatacccgatggggatttatccccgtggggaacggggatggggaagaaatgtccc

SEQ ID NO: 9161 - DNA, 1012 bp, Zea mays
cccacgcgtccggcaatgtgtaaaatgtactctgttacccccaactgtattggttgtccaatttctcagcatccagaattggatagaggacttgttatggaaacaacttgatctcgactaccctggcatgcctgaagcaatggttcaccgagggttttattctgcatatcacaacacgacactacgtgatggagtagtcagtggtattcagagaactaggaaagcttacggagacattccaatcatgatcacgggtcattcaatgggtggagctatggcttcattctgtgcgctcgatcttgttgttaactacggactggatggcgtaaacctgatgacgtttgggcagcctcgtattggcaatgctgcatttgcttcttatttcaagacatacttgcctcaagcgatccgagttactcatgcccacgatatcgtgcctcacctgccaccatacttctcattcttcccacagaagacctaccatcacttcccaagagaggtatggatccataatattggactaggaaccctagtgtaccccgtggaaaagatctgtgacgattctggtgaagaccctacatgctgcagatcagtaagtggaagcagcgtgcgagaccatatatactatcttggcgtcagtatgcatgcagaagactggagcagctgcagaatcgtcatggactacagcaaattgcagtatcagatggacctcaacggtaatctcgtattgtcgaaacagcccggtttgtcaaacgccagaggattcagtgcccagtgaaccagtgtatgatttgtataagtacgtatataatagcatcatgaatcagtaatgttccctcacctccattgtgatgctggctgttgtattgttaatgcatcaaaaaggagagggttggaacgattcggagatgcttgttgttgtacatatgattacgcaatgtattatattttcagtttgcaaatgcatataaagacgccgatacttggcaaaaaaaaaaaaaaaaaagcggcc

SEQ ID NO: 9162 - DNA, 1687 bp, Zea mays
cattggggacctcgaggccggccggggcaccaaccttgttgttgttgttcttctatttcttagtatcatagcacagtatttcgtgctctcgcttcgctcccttaatttatcaccattcctaatttattctatttcttagtatcatagcacagtatttcgctcgccccgatttcccgactcttcccgtgcctcagacagcatcggattgcttgatctcgattgtcagaataagattcagcgcaggtttggattcaccgaatccaccgattgcttgcgccccgcggtcgcgcgcggcggaatttcggccgccgccaattcgggcctctccggaagggtgtccccggtgtggttcgcctaatatccgctgccctcgtgcgggactcctcgtgattttcggctgtgcgcttggcttttccagtcccgtgttgtggttccagcctttcaggggatggggcgccgcgggttgctcaaggctgcgcttctgctgtgcttccttgctgcttgctccgggagagaacttacgatcaaacagaacccttccactaccatatacaactcgactcttgccaagatactcgtggaatatgcttctgcaatctatactgccgatttgacgcaattgtttacttggacatgtgccagatgcggtgacttgatcgaggggttcgagatgatagagatcattgtggatgtcgagaactgcttgcaggcatattttggttttgccagtgacataaacgcagtcgttgttgtttttagaggaactcaagagaacagcatccagaattggatagaggacttgttatggaaacaacttgatcttgactaccctggcatgcctgaagcaatggttcaccgagggttttattctgcatatcacaacacgacactacgtgatggagtagtcagtggtattcagaggactaggaaagcttacggagacattccaatcatgatcacgggtcattcaatgggtggagctatggcttcattctgtgcgctcgatcttgttgttaactacggactggatggcgtaaacctgatgacatttgggcagcctcgtattggcaatgctgcatttgcttcttatttcaagacatacttgcctcaagcgatccgagttactcatgcccatgatattgtgcctcacctgccaccatatttctcattcttcccacagaagacctaccatcacttcccaagagaggtatggacccacaatattggactaggaaccctagtgtaccccgtagaaaagatctgtgacgattctggtgaagaccctacatgctgcagatcagtaagtggaagtagcgtgcgagaccatatatactatcttggcgtcagcatgcatgcagaagactggagcagctgcagaatcgtcatggactacagcaaattgcagtatcagatggacctcaacggtaatctcgtattgtcgaagcagcccggtttgtcaaacgccagaggattcagtgctcagtgaaccagtctatgatttgtacagtataatagcttcacgaatcagtaatgttcaattgttaatggatcaaaggagaagggttggaaccagcatgccgattcggagatgcttattgtacatgtgattacgtaatgtattgttcagtttgcaaatatatattcacacacgccgatatttgacaaaaaaaaaaaaaaaaaagcggcc

SEQ ID NO: 9163 - DNA, 3840 bp, Zea mays
  misc_feature (2672)..(2672): n is a, c, g, or t
tgaagtagcagagaagaactgatatggagaatttagtgaacattgtctccccccctgctctgttctccctcctcccctgttcgagcccaagggaaacaggagtacaggactagcttgcacgcatctcgcctcgccatcgccagtcgccacaacagcgcaagatgcagcgccgcgcgccgcgtctccgcgtcctcctccatctcctaatcctcgtcccggccctctccgaggttcctgaccactatgcctccccgcgtgtgggctcgggcaccagaacgggcctcagtaattcgccggcgcaagagtatcttgaccccacctatccggtcccgcggtccccgccgggggcgtcgacctgcgtcttgccggtgctctcctactccttcgccaacacctacggcactccccccgccaaggcggcgtacgcgccgccagccgagtgccctgcgccctggtccctcgtcgttctctccttctccgtcgccatcgccggtgaccagtacgaccgcgtcgcagccgtctggctcgacggcgccgagctcctccggaccaccacggccgagcccaccaccgacggcgttcgctggaccatccacaaggacgtcacccgctactccgcgctgctccggtccccgcgcggcggcgagctttctgtcatgctggagaacctcgtcaacgacgtgtacaccggcgtatacaacgtcagcgtgtccctcgagttccacggcgtccctgcttacctcggcgacgcggggtcctcctcagctgccggctctgcggaacccggcggccaggcgacactaaaactgccggcgtcgtacttccagccggcggatctgatcctgccaatctcggagggcatgggcagcagcaatggcttttggttccgcatccagaattcgtcggacccgcggtccaagcttgtgagaattccatcgaacacctaccgcgcagtcctcgaagtcttcgtgtccccgcactcaaacgacgagttttggtattccaacccgccggacctctacatccgcgagaacaacctcaccacgggacggggcaacgcggcgtaccgcgaggtcgtcgtgagcgtggaccgccatttcgccggctcgttcgtcccgttccccgtgatctacacgggcggcatcaacccgctgttctggcagcccgtggcggcgctgggcgccttcgacctcccgacctacgacgtcgagctcaccccgtttctgggaatcttggtcgacggcaagccgcacgagatcgtcctaagcgtagtggatggcatcgccgagtggcttgttgacgccaacctgcacctgtggctggaccccgcttcgacgaatgtatcggccgcgctcagccggtacaggacgccgcgtctgtccatcaagcgccggtacagcacccggcggccactggacggaaagttcaagatccgtgccaagaggaagtcccagttcagcgggtgggtgaagtcgtcgttcggcaacttcacgacgaacgtggagacggagctggaggtgaccagcctggtggacttcaccagccagggcaggaacaagactgtccggctgcaggtggagcaggacacggaggtcgtcgtccggtcgtcggagacgcggaaggcggtcggcaaggtggagacggaggctaagtacccgctgtggctggagatggtgacggaggacggcgagaacgacacctacgtgatgagggcgaacctgacacactccctcagcgtcgagaccgacgccgaggccgaggggctgtttgatggcgagacgagggtggtcgacgagcaagccgccgcggggtggatgctcgtcagaggccacgacgtgctcgacggctccgcggctacgacgcagacgtacaggtatagcaacgaggcggggaggtatgagcgagccatcgacacactggatggtgcggtgctgagcgacaacgtgaccgagagctactgggcctcgggagacggcttggcttggcttgctgctggacccgcgggaggaggtgccatggaactgtgacggccagcagtttggacattactgctatgtaggagtccgtcgtcagactgggagttgagttgtccagacttcttcaaaatgtgttgattacgtgcgatcgttatgtgtgcatatgtaattctcctgtgcattcttgtttcataagtgaaatcgacctacgggcactatatttgggttttggtgtcataacaacagctacaatcattttcggcggccactgttattttaggggacggttctctagcgatcgaaaatagtcatcagacgtaagatggatttggattaatgttgtttaagtaagaacatgactgtttagattaatgttgtttgctaatatataaaatatagttaaaatagatggatttggatctagagaaagtgaataagtgatggtttaaatgaacaataccttaaataaaacatcagaagcctcattgaaaacctccgaggtggagtataggacacccaaaagtagaagtcaaagacaaacgaaagtgaagttattaaacttggggcaaaggggtggccaaattaaaagtgtcttatgattttagattcgcttaaattgacatggctaaattaaaagtatagatttttattagcttttccaaaaatccaaaatcatcaaaatcagagtttagaacnaaacgttatgcgcgaaatacgaaaataggtcatgctaaacacaacacgagacatggctggtgctcctggtgtcatatttggttcacacataacattatagcgaccacattgaagcaccaaacatgtttggtgttcctatctgatgcaaatatctagtgtcctagaaaaatatcatagcagttatttttagtggtcgaattgtcagaagtacgatgtgatatcgggtgctatcaacggcatgtctggtacataagcagattacagaagcttttgacaatgactatttttagacttggggtctataaataccatcccaaactgccatttaaagtgtgtgtgagtttagaaacataacaaagtagttggtgctctattctagtgttctccacttgcatagagcttagtgatacatatggtgattggaatatgtgatttgcgaaatgtttaccctaattagactactacttatgtgcttcttctaggtttagacctagtgtttagtgaggcttgtatacctcttaccacttgatgcttgcacgcaccattgttatacctggagggcttatattagtcttgtgataccacaccaaccacatttatggcacgaccaccatcgtgtgtcggagaaacaaggcctacaatagtttggtcgtaacctcaacactaaagacaacgggaagtggtccgagagagaccatctcggagacccacttacgcatggggaaagcccagctatccacagagttacctaagtaggaacttggtctcaaatagaaatttgcaatgattcaatttcctgtcttaaatctgagaatgttgacttggttgctaagattgagaaattgaatgtttgtcatgcctctacatcttccattgagcatgtttctatttgcaatagatgtatatatgttgatgctattgatgatcaccttgctttaattaagaaccaaaatgattacatagcaaaactagatgttaagattgttgagtatgcgctaaaaatgaatttttttttgcttgtagcatgcttttataatatgagacgccctgacattaaggatggtgttggcttccaacctgggggcaaggacaacactaaaattaatgcccaaggaaagaaagttcctcaatttgttaagggcaaggctccaattattagtgatgataa

SEQ ID NO: 9164 - DNA, 1569 bp, Zea mays
ctcagctcggtggaggccctcaagtccgacgcgctccgttcccctttccctttccgaagcttctcgaccccccatcccctccctgacatggccgacaacgcgaaggccgcggcggcgcatgcgaggccggagtcgtcgcaggaggaggaggaggactggaaggaggccgagggggacgtcgccgaagtcgaccgcgccgccaccaatggcgccggcgaggggggcgtgcccacagacaggccgatccgggtctacgccgacggcatctacgacctcttccacttcggccacgccaagtcgctggagcaggccaagaagtcgtttccaaacacatatcttcttgttggatgctgcaatgatgagttgacacataaattcaaaggaagaactgttatgactgaggatgagcgatatgagtcacttcgtcattgcaagtgggttgatgaagtcattccagatgctccatgggtggtgacagaagagttcttggataagcataacattgattttgttgctcatgattctctgccgtatgctgatgctagtggagctggtaacgatgtttatgaacatgtaaaaaagcttggtaagtttaaggagactcagcgcactgatgggatatcaacatcggacattataatgcggattgttaaagattataatgagtatgttatgcggaatctggccaggggctacactagaaaggatcttggtgttagttatgtcaaggaaaaacgactgcgagtgaacatgggacttaaaaacctgcgtgacagagtgaaacagcaccaagaaaaagtaggggagaagtggagcacggttgcaaaactccaggaagagtgggtggaaaatgcagaccgctgggtggctggtttcttagagaagtttgaggaagggtgccactcaatggggacagccatcaaggagaggatccaggagaggctcatcaaggcacaatccagcgactttggcagcctcctacagtacgacagctacgattctgatgaagccaaagaaaacgacgaggacgaagacgaagatgaactctttgaagacgtcaaggaatagcacctccgtacatatacaatggttttgtagctgcaaattgtgttgtgagtcagttgcctctctctggttggtgatctttatatatggtctcaaaggtaggtcaggttgcaatgtttgtagctgctcttggtgtttgttcaggcaacgcatggttgtaaaagctgtggaaagactcttgtgcagtcaaggatacagattccgatggttacctttgggttagaacatatacggctgtaaaattggaagtcgaggtggttaaaactctgatatcttgtctgttttccttcccctgacgtgcgtgttgcattcagcatctcagcggagctcctggtgtgtagtctgtggaggtcaccgcttctgccatcgaggttgccgagagcaggattctcagccgtttccagcacgaggaatgttttggaattattcttgtgttgattgttgaatgaagtaatgaacaaataaaagcgtcttggattcaaaaaaaaaaaaaaaaaatcctgc

SEQ ID NO: 9165 - DNA, 1578 bp, Zea mays
gtcacgaaaggggttaaaataaaaaaaattcgggcccaacggccacgctgaacacgaataggcaattaggcatagcgctctctctcccgctcgccccctcgagtcccgactcccgtcctcgatcgaaattccccggatcttccagctattagacagttttcctgctgattttcgcggcttcttttcttttgctcccggggagataggatggagaggatactcagatgcttcaatctagggccaacaggatccgaagatgatgatataagtttcacactgaccgtggaaacgtttagcttcgaagagctctctgctgcaactgataatttcagtagcaccctcaggataggctctggggggcaagccacagtctatgaaggccacataccccacattggacaggttgctgtcaagcggttgagaaccaatgattttccctctaagcaaagggcatttcttatggaggtctatgtgctcaattcaactaaccaccctcacattgtgaaactactcggttgctgttctgagggaacagaacgacttcttgtgtatgaatatgtaaagggggggacattgcgtcatcgattgaaagagttgaactggtatacgagaatgagaattgcacgtgacacagctacagttctggagaaactccatctccaatccgatccaccaatcatccacagggactttaaatcagacaacattttattaagcacaaaccttagtccaaaggtttctgatttcgggatagctaaaattgccccagctggggatgagcttactgcagcaacatcagaaacgttgggaacgtatggatatgcttcaccagggatttttcgtccattaaatgcgacagtcatgacagatatctacagttttggggttgtgctcttggagatcattactggaaagcctgccattgatcatagtaaagaaggagatgaacattatctagttcactgggccgcaagcaagtcgaaagatgggaactttgaggaagtacttgatccaaggttacgtggctctgtatccagaatggtgctcagcgaggctcttgctgtggtggataggtgcactgggacagaacctgttggccgggcctcggattagagaaatcattagagcccttcgccatgtggtgtccatatctcaggatgatactccgggtgcgtcatcgtcagcagcgagctagatacgtgcatggggtctgtcactccatcttcgatgaagcatataagaggcaaatgctgacaagaaagcaaaaactgtcgactgatgcgcatctgctgtttactgattaaaatataattcatgcatgtgactgttagactgtgtgctatatgtaagagactctgccttccatctcgtacatcctgaaagcttctgtcagccacctgcacagcacttaggtgcgtttggttggagagtcaaatggaatagagtggatccattatagtatttgagaatggagccattctattctacgtttggcaagaataacaaagtcgttctattttttgtttggttgaagagttgaatagagcggagccgttccatccaaaaaaaaaaaaaaaa

SEQ ID NO: 9166 - DNA, 2198 bp, Zea mays
ttgtgaccaaaattcttgatgtagttcagatgaactcgatcatgtcggattcaaagcccaagtgtctggtaattgatgaaattgatggagcactcggtgatggaaaaggtgcagtggaggtcatcttgaagaatgatcaatgctgaaaagagtaataattccgacaagagcactaatggtgaggaaactcaagcccgaaagacatctaggaaaagtcatagaacagcaaaactactgaggcctgtaatttgtatatgcaatgacatttatgctccagccctgagacaactgcgccaagtagccaaggttcatgtgtttgtgcagccgacaattagccgtgtggtgaacaggctcaagtatatatgcaaaaatgaaggtttcaaggctagttcaatcgcgctttctgcattagcggagtacactgaatgtgacatccgttcatgcctaaacacacttcagtttttgaacaagaaaagagtggccctaaacattacagcgattgattcacaagtaattggacagaaagataagtcaaaaagcatcctcgatgtttggaagcaggttttgcaaaagaaaagactcaagcgggctggaaaggctgaaagccttttcaatgaagacaaggacatagactttcttttcacgctcatatctaaccgtggcgattatgaagttactatggacgggatccatgaaaatttcttgagattatcgtatcatgacccgatgttgcaaaaaactgtaaaatgtctcgatatacttggagtttcagattccttgacccaatatgtttaccggactcagcagatgccacttcatgcatatcaacctccaattgctatcactataagccgcatggttgctcaagttgagaagcctaatattaattggccaaaagctttgcagaggtctcgagcattgcttttagaaaagaaagacatgttgaaaacctggcaaaaccaaatgtcaccatttgtttcaaggcacctctcagtagaatcattcgttgaagacactgcttctccccttttacatattctctctccactgagtttgagacctgtagcactgaatttgctgtcagagagagaaaaagatgaacttgtgcaattagttgatactatggtctcctattcagttacatacagaaacacaaagtttgtccctcaagaaaaggcaaacctatctgtagtgccgcatgaagtttcatcactctctctttatcctccaattaatgatgtcataaattttgagggctatcaatcagagcacattggactgtctttagccatgaaacaggttttggtgcatgaggtggagaagcaaaagatcattaaagatagcgctggcaaattgttgaaccaatctaatgatggaaatatgaagagcgaagctttatcaactataaggaagaaaacagtagctaattccatccgtccagctttacattcttccaaggatagttccaagtgcaattcatctacacttgaaatgcagtcaaactcagcctctactgtgaatgataaagattctatatctgccaaaaaacactccagccgtgcagcaaatttctttgacagatttaggaaggaaaggccagtagacggaaaaactcatagtgatgtggggctgcaaagagcaacacttcagagggattcacgccctctgatcttcaaatataatgagggtttcacaaatgctgtgaaaagaccagtgagagttagggatcttctgctcagctaggcccgcttggtacctgcacttctgtaaagttatctttgtgtttatgaattttcatttactgtatattgattgtatcatgaatattgtatcatgtggttgtgattggttgcctggccggatccctggctaggtcgaactcagcaacccgccctgctgtttgattgtctgtatcttccgttgccgttgagctaggacgacctcatgcaaatagtggtctggagccaggctcaggagggaagactattttggccgtatgaactcagcctggctggacacagaaaccaagatatagttttaattagttttcttgttacatctcttgattaatgcatcaaattaagaaactgattttacttttgtgtttctgatatttgtatgaacaaaactagatctcacttctctacagcaacaacagctgctatagatcaagagtgagtaaaaaaaaaaaaaaaaaa

SEQ ID NO: 9167 - DNA, 2913 bp, Zea mays
cctgccgggagaaaaccgccgggagctggaaagggcgaggcgagcggtgccggcggaggtcgacaggggggctacaggtagaaaggcgactccgccgctccagctgaaaatggcgaaatgatttgccttccccagaacccagctcagacagacgccgccctccgctgctctgctctgttcctcttcctccttgccccctgagcaggcgagttgtcagcccggaaaccattcgaacaggccgagcccgcccgcctccattgctcgcgtgcgtcagagaaggaaggaaaagaagaactaggagcagagttgaataggtcattatgcgccggtggctttgctgcagtcattttgacacgccgtatgtcgaaaacgaaaatggatttatgagcagtcctgatagaacaagtggtaatggaaacggtttaaatgcaaacagtgatcctgcaaaaccgccttccattgaaatacctgcattgtcatttgatgaattgagggaaaagacggatgattttgggtccaaggctttggttggtgaggggtcatatggaagagtatattatgctgttctggaaaacgaacaacatgtggctgtcaagaagcttgatacttcagcagatcctgagcctgataatgaatttctagcacaggtgtccgctgtttcaagattgaagcatgaacactttgtggacatgcttggttattgtatccaaggagatcaacgtctactggcttatgaattcgctacgatgggctctctacatgatattttgcatggaagaaaaggtgttgcaggtgcacaacctggacctgctcttgattggatgcaaagagtcaaaattgctgttgatgctgcaaaaggtcttgaatatcttcatgagaaggttcaaccttccatagtccatcgagatatacggtccagcaatgttcttttatttgaggattaccaggccaaaattgcagacttcaatctttcaagccaatctccagatatggctgctcgtctacattctactcgtgtccttggaaccttcggatatcatgctccagagtatgctatgactggccaactgactcaaaaaagtgatgtatatagttttggggttgtccttttagagcttcttactggaaggaaacctgtagatcatacaatgccaaggggccagcagagtcttgttacttgggcaacaccaaggcttggtgaggacaaggtgaaacaatgtgttgatccaagattgaatggagagtaccctccaaagggagtagcaaagctagcggcagtggcggctctctgtgtccaatacgaatctgagttcagaccaagcatgagcattgtagtcaaggcgttgtctcctcttcttgtgaatgcaccgtatcagccggctgctgctcctgatgtatcttcagatgcctgacagcatgagcaactgaaaacccatgtaaagaaacaccatttactgtcggtatgccattttttccatgaattattcatctttcgtaaaatcagaattgtgtgtgtgtgtttattggagaggaagggaagaggaaagagtaacgcatttgttttgaacccatgtacttcgtgcttgagagctgctgcagttgaaattaattacttaatctacacacttgtgcatccgttgcccttcccctgtttcagtttcttttttttcttttgaaatggtcatccttgtaatctacccctgctttgctgttgggtggcctcagaaccaaactttttgaatcggagtaattgggtttgaattgtccagtccaatgcaacacggttacacaaagctcttagagagagagagaaaaaaaatccacttttaatcatccactgccccttctataagcataagcagttctggcaacatgttgccatggtgtgtctttgtcagcatggtctattctctaccatcctctgcaaatggcaacactgtcgtcggcgtggacgatcagcctcgtgatgtcctgcccgacggcttcagccgacgtgtagcggttcagacgctcggcgttccgcgggttcctggatggatcatgcatggttcatggatggtacccgtcgaggaaaagcaaccatgcagatcggtttgtatcaaatttcatgcaggatggaagaatcccactgcacgtcattgtttgtttagtttggaattggagcaatgcagcaggttgagaagttactgagagtgcacacaggaacgaaggaagaagcaggacgccggtaggagaaagaaaggaaaaagttaccagtagaggaccttcccgtggagggtcgaggacgtgagcgacctgccccagcgactggatggcgaggactcggtggcggcgtcggcgggctgcgacgacgaggaggagccgccgcggcggtcccggtccggacgccgctggagcttggacacctgtcgcttgagctcggcctggccctcctccagcgcccgtatcttcttcaacaggtcacgctcgtcctccgcgtccatcgccggcggccggcgaacgtacgacggcgccgatcgatcgatcactcacggacggtgatggatggatcggagaagtggcatgcagcagatatagcacagcagcggcaagatagaagctactcaaactagggtgcccaaacgaagaaaacagctgggacagagaagacagtcaaccgaccttcctagctgattcttctagccaaaaggccaaaagcttggctccggccgccgggctcgaacagacagtgcttggctgcttgccgccttggatatccttccatgcagtgaaccaaccaagatagctggcgtagtcctcgttttggggatcgagcccgaacccttgtttgagttgctatacccatattcaaactatattaggagaatattatagtctacagtgcagaaatgcacaacaatttttagtctacag

SEQ ID NO: 9168 - DNA, 729 bp, Zea mays
ctccaccgcggtggcggccgccctttttttttttttttgaatcggagtaattgggtttgaattgtccagtccaatgcaacacggttacacaaagttttttttttttttttgagagaaaacagactcacttaacaagaatgaaatcagaatctgtgaaccccagaccacttttaatcatccactgccccttctataagcataagcagttctggcgacatgttgccatggtgtgtctttgtcagcatggtctattctctaccatcctctgcaaatggcaacactgtcgtcggcgtggaggatcagcctcgtgatgtcctgcccgacggcttcggtcgacgtgtagcggttcagacgctcggcgtttcgcgggttccagtagaggaccttcccgtggaggtcgaggacgtgagcgacctgccccagcgactggatggcgaggactaggtggcggcgtcggcgggctgcgacgacgaggaggagccgccgcggcggtcccggtccggacgccgctggagcttggacacctgtcgcttgagctcggcctggccctcctccagcgcccgtatcttcttcaacaggtcacgctcgtcctccgcgtccatcgccggcggccggcgaacgtacgacggcgccgatcgatcgatcactcacggacggtgatggatggatcggagaagtggcatgcagcagatatagcacagcagcggcaagaagcgagggggggacccg

SEQ ID NO: 9169 - DNA, 1842 bp, Zea mays
  misc_feature (311)..(311): n is a, c, g, or t
gactgggttgctaggcattctacttgaataactccttgtaacgaaataagatggagtttactgtagattgatatggaaatacttgacatgctacatgttttgttttgtttctactgaaagtgatgtgattgaagtgcattctttgtttgctgtctttgatatgctttgctgaatataacatcacattgcaggtacagtgcatcactggcttgtgctgattgtggtttggctttgtggaagccagcatgttgtgtctcagaaatcgacacttgaaccaaaagataaattccttctgtctgatccaccaattngcctctttgatccaatagagatttcaccttctgttcttccacacaatactaaccctgttgagccactgtcacctatgtatccaaattacacatcctatgatccagtcttgactggaaaatgccatgtaaatttttctgcactctcttatatcatggagaagacagcgtatgattgctccattccgttagcaccactagttgctgatgttatatgttgcccccaagttaatagcttgatgaatattttccaagctgcatatggcagtggaaatggtaccctagttctcaaccaggcttcagcaaatgcttgtttctctgacattatgaacatccttgcaagcaaaggggcaaacaccaacatccctgagttatgtactctgaggccatcaaatcttactgatgtttcttgtcctgtgaaggatattagctcttttgagaaaatagtcaacatcagtaaactccaagatgcatgcagcaatgttgacccactgaaagagtgttgtaggccagtttgccaacctgctatagcagaagcagctattcacatatcctctggtggggctaacatgttcggaagttctagcatgccagggagtgctgttgggattgatgttgttagcgactgtaaaggggtagttcattcctggttatctatgaagctttcatcagaggaagctaatagtgctttcagagtattatctggttgcaaggtgaacaaagtttgtccactggagtttgatgaaccttcttcagtcgttaaggcgtgtggcaaggcatcatcttcaacgttatcatgctgcgcagcattgcactcttacattggaactaggcaaaaacagatatttgtcacaaacctgcaagcaattaattgtgcaacaatgtttggatcaatgttacagaaagctggtgtggtggatgacatttatgggctttgcgacattgatttgaaagatttcagcttgcaagattttggacagcaaggctgtctacttcggagcttacctacagatattgtgtttgacaacgctacaggcattagctttacatgcgatttgagtgacaatattgcagcaccatggccatcctcatcttctgtccaatcattgtcactttgtgctccagaaatgtcgctgcctgctttgcctgtctcgccgaaatcagaaagctcaggtccctccagaactgggatcggcgttttgttgctgcttgtattcctcactaccatcactatctgaggaatacttccatctagtgagccagaagcttcttacccctgttgcattttttccccatctgtgcaggcccgcgtgtaaattgtctgaattacattcttgtaaatgagcctcccccttgtgtctctttttggtccagtggatagatcacagtgctgttgtgttagagattactgttgtaccattttgtgtctgagcactggttgaaagtaagctagatctggagcttcaccgcggatgatgatcgaatggcaattaacaaccaggcatgctcttttaaaataaaaaaaaaaaaaaaa

SEQ ID NO: 9170 - DNA, 1431 bp, Zea mays
catggcagccaactcagcagcagggtacctgaacacatacggcattgcacgggtctccatccccttgcttgttttgcaggcctggcatgcaaagttcttcgctggtctcacagtggggagcccaagcatctcgtgcttgactttcttctgggtatcggatttgatcattgtcgcagtcagcaggctcccacagaaggagcacacatctgcgatgtggtaatccgagcaggagtggagcctgtcatgcaagaggtaggacgaaccatgggcgaggagggcatcacgctccatctcaccaaatcggatccctccaccatgcttccttcctcctatgggttgtcttgttatctggtctatacgaccggtagtgcggacctggaatttgtctgagaccatatgacgaagacgttggtaataaacaggtccgatgaaaatctcacagtccatctcagtgccaaaaactccactataaaggacctcgtttccatgataattaaacccataagatgcaagcatgggacccaattcgtccacaatcgaattaggcttgtcggagtccttgtcctttttgagtgagtttgcaaaaggtgttgcatcaatgaactttccatgtagacttccagccttagctgccatagactctaaaagcattgctattgtcattcttgaaggaaatgcatgaggattaatgatcagatctggtctcatgccagtatttgcagagaatggcatgtcaatgtcaggccacaactgagagcaaacacccttctgcccatgtcgactgctgaacttgtcaccgattatagggtttcttacacgacgcagacgaatgttcgccttctgcaggccacattttgaacctgtcccgttgacagcaacatagtcaataaatgctggctctgtgccttttagtttgacaggccttatcacatttgtaaggctattatggacactatagtattgctcgtttggatgtacagcctgtccaagccgaggaaggccatctgaatcaatcacattacttgtatcccttgttaatatactctttgcaaaagtttctggaacattatctctgctttttgttgataagtcaatgcattcagtctggtaaatatgtccacggaacataccacgctcaacagctgatttgttcaaaatcatggcatcctccatgtcataacctgtgtatgatagcactgcaacaatagcattcgttccagatggaaattcatccatacaatatttggtatatgtacctgtccgaacaattggtgtctgaggggtctgtagatggaatgcttttacatcagtacggaattttagggcctgtccgcaaaaacccatggtttgctttgccatctggcattggtacatgttcctaggactttggttgtgtccggcccagggggccggattgggcaactacacccc

SEQ ID NO: 9171 - DNA, 2047 bp, Zea mays
aaatacagcgccggccgggccgttgcgtccgtccatcctcatccccatccgccacccaccccgcgcccctccttctcactccagtgctggctgccggccagctccgcccccggggtccttgagctggaggtggcggtggatgaccagctctcggagttttctgaggcgaggatcggagggcgttgcgttaggtccgcggttggtgagcggcggtcggagcggtctcgcgcgcggcggggtcgttcgatgacgcaggaatcgcgctctgggagggtgggaatacctcgcgctcgcgctcaaggtgctcgattaatttactgcctgaggctgagggggggcgcgcctgtgagctgaaccgttcccgctgcactgactcctgagctcgggaaatggttgggagcgtgcacatcaatggatcggtccacggcggcaatggcacggccacggaggagcggctggacgagctgcgccggctgctcggcaagtcggagggggaccttctcaagatcgtcagcgtcggcgccggcgcgtggggcagcgtcttcgccgcgctcctacaggacgcgtacggccatttccgggacaaggtgcagataaggatctggcgtcgcccgggccggacggtggaccgctccaccgcggagcacctgttcgaggtgatcaactccagggaggacgtgctcaggcgcctcatccgccgctgcgcctacctcaagtacgtcgaggcgcggctcggagaccgcacgctgtatgccgacgagatactcaaggacggcttctgcctgaacatgatcgagacgccgctctgccctctcaaggtcgtcactaacctgcaggaggccgtctgggatgccgacatcgtcgtgaatggggtgccgtccaccgagacgagggaggtgtttgatgagatcagcgagtattggaaggagaggatcagtgtcccggtgataatttccctcgccaagggaattgaggcctcgttggatccaatacctcgtatcattacacctactcaaatgattagctctgcaactggagttccaactgaaaatatactctatcttggaggaccaaacatcgcctcggaaatttataacaaagaatatgcaaacgctcgaatctgtggatccaacaagtggaggaagcctcttgctaagtttttgaggcagccacatttcattgtctgggacaacagtgatcttgtcacccatgaggtgatgggtggcctgaagaatgtctatgcaatcggtgctggaatggtggcagctttaacaaacgagagtgcaacaagcaaatctgtatattttgctcattgcacgtcagagatgatattcattactcatttgctgacagagcaacctgagaaactcgctggtcctctgctggctgacacgtatgtaactctcttaaaaggtcgcaatgcatggtatgggcaaatgcttgccaagggagagttgagtcctgacatgggtgatagtatcaaggggaagggaatgattcagggtatctctgcagttggtgcattttttgagctgcttagtcaacccagcttaagtgtgcagcacccagaagaaaacaagcaggttgctccagctgagctatgcccaatcctgaagaggctttacagaatactgataaaaagggagctcccagcaagggacattcttcaagccctgagggacgaaacgatgaatgatcctcgggaaaggattgagatggcacaaagccatgcattctaccgcccgtctctccttggaaaaccatgatctagttagtcctgtagattagtagaatataaacggacgctgtgctgcaggtttctccactgtgcttgctgtccttgtgtccgagctacatggggatggggctttgtcagttgtcgaattctttgtgcttcctcgttgccatggtgtacaagagattactgaaccaataaatgttctaagtgcatattatatgaacacccaaaaaaaaaaaaaaaaaaaaaaaaataaaaataaaaaaaaaaaaaataaaaaaaaatactaaagaaaaaaaaaaacaaaaa

SEQ ID NO: 9172 - DNA, 3688 bp, Zea mays
atgtatacgtcgtcagtagattcttatcatgaaaatcccccggcctctacggcctcgatcgaccacccggacacctccagctctggccgtcaccacccacctcctgcagctccgaacgagagcttgcggtaatgcccccgaacgcgcggcggcggactcccgcccggcccccaacggcgctgcgtacgaacgacccagataggtgtcagcacctctgtggaggagaaggaggctgtggaagagacggaagtggaacaggcagcactcggcggcaaacgcactcgacgcaccaacgttcgtgtgatgggtccagaatgggctgtgtaatcctaatctcttgtaattcatggccagcccatgtgagggtataatacctagtatgtggtttctggagaggcatgcaaaacttgaacaaactcatacgcaataacatccgccgccttctgcctcctgttcactgttcttctctaatctctgattcttcttccacttctgatctccgagcttaacatttggtatcaaagacttgtcatcctggatctgctgccggaggtgccgcggcgggcgcgatcgtctgcgatggagcaatcggagactatcacccacaagttgcttgaggaaatgcgtctcatggaggcgcgtctatctgagcaaatcagcgggcgctgcgccggcgtcgagcgccgcgtggaggaacactgtgaggagatacgcgtgccttcacccagcgctgcgatgccatccaccaacaagtggatgttgcggcgttgcgcggtgaagaacgcctgatcgccctcgaactcatgaagaccgaggctgatatgtggcgtcccgatctggagaagcgggtcgacgatctggagttggaagttacccgtgtcaacaaattccttgaacgggaacgtcgccagccagccttcgacaagccgggactctttggtccacacgcgtcggcatccgtgcgtcctccagccggatttcctcacgctgatggggcccgtggccaccgcttcgaaccaccaaaccgggagggtgagtttgggttccctgcgacccaacctcacggcctggtcaagggtacgtacaatgcccatccatcgcgcattactggttttatgcctgaacaccaatatccttctgagtttatgcgtgagtctgggctgggtagactgccgaaagtcaatttcccacaatttgatggctcgaaaccacaattatggaagaagtgtgaaaattactttgagatgtatgacactgaatactatatgtgggttaaggtttcatctatgcattttgttggtcgtgctgaacgctggttacaatcggttgagcgacgtttgcgtcagttctcttgggagggattttgtagtttgattcatgaccgatttggtcgcgagcagcatgagacactgatcagacagttatttcatattagtcagtctggatctgtgtcagattacgtcgaacagtttgcgtcgctggtagatgaattgggtgcttatgagtctagaacagatcctttgtattatactatgcgatttgttgatggtcttaagtatgatatcaagtcagttgtcatggtacaacgtccccaaagcctcgatgctgcttgtgcgcttgctctcgtgcaggaagaagcgttggagcccacacgacgccggcgtgctgagcctttcatccaccggaaggcttggccgcaggcgacggcgtctgagatcaccaaggtggagcgtgttggtaaccaggggcaaccaacggagaagcttattgttgactcaacccgtcacacttcgccaatggacagagtagcgactctgaagagctatcgccgtgcccgtgggttatgtgaccgatgcgcagaaaagtggactccaggtcacaaatgtgcaaccacagttcagctccatgctattgaagaggtatgggatcttcttactttggatgaccaggagaatacagaacctgtgagcagtctgaacaagtggttatggcgttatctctatcttcagcagcctgggagggcagtaacagattggtgacgatgcgattatctggaacgattcagcaacaggacctggttattcttattgattcgggatcgtcacactcgttcctctctgatcgtcttcgaccactgctagctggtgtccaggaacttgctcagccggtctcagttcaggtggccaacgggcagactctttcttctcaatattatattcctgcagcacagtggtctatggctggttattggtttacagctgatcttcgttttttgccgttaccagctttggatttagtggtgggcatggactggttgcaacagtttagtcctatgcatgtcgattgggcaaacaagtggttggtaattccataaaatggatcgtcagtgtgcttacaaaacaaaaaataaaattttccttctggttctgtggtgcagttgctgctatcagctgagatacagctcaattcagttcaagaagagtctcagttggaggtacatcccaaggttcaagcggttcttcaacaattttcagatgtgtttgctgatcctgtgggtttacctcccagccgacagtgtgaccatgctattccattggtccctggtgctcaccctttcaatgtcaagccctatcgttatccaccggctctcaaggatgaaatagagacacaagtacgtgacatgctgtcgcagggagtcatccaaaagagccacagtctgtttgcatcgccagtattgctggtcaagaagaaagatcaaacgtggcgcttctgtattgattaccgctatctcaacgctataacagtgaagagctcgtatcctgttccaatctttgatcagctgatggatgaactgtcctctgcacaatggtttagcaagcttgatctgaaagcgggttaccatcaaatctgtctagtaccaggagaagaaccaaagacggccttccaaacacatttgggtcatttcgagtttcgagtaatggcttttggcttgactggagctcccaacacttttctgggtgccatgaatgatacactggcaccagtattgcgtcgtcgtgccctcgtgttcttcgatgacatacttatttacagtcctacatttgagtcccacttgcaacatttatccgaggtcctcactttgttgaagcaagatcactggaagatcaagttgtccaaatgtgcttttgcccagaccactattgcttatctcggtcatataatcagtgctcacggtgtggcgactgacccagctaagttgcaaattattcagcagtggtcagccccaacaaatactaaggagctacgcagttttctcggtttggctggtttttaccgtaaattcgtacgacatttcagcatcatcgccaaacctctgacggacttactcaagaaaaattccctgttcgtttggacatcagatcatcagtcagcatttgagaccctcatgcaggctttaatatctgctccagtgctggctcttccagacttcaaccaaccattctgcatttatacagatgcctgcagtacaggcgtaggtgcggtcctgatgcaaaaggggcacccgttggcgttcttgagcaaggctctgggtcccaaaaaccaaggcttgtcgacatacgagaaggaatatcttgcaattgtgattgctatagcacagtggcgctcataccttcagggggatcctact

SEQ ID NO: 9173 - DNA, 793 bp, Zea mays
gccggccggtccggacactgcagaaacgacgacaagtagtggcagcactcagaccgcgccttatccaactgactgacacctcgctcgctcagccctcacccagtatggtgctccagctccactgcgccacaccgaccatcaccatctctccgcttgccgcccgccctcgtcactacccccaccacctctacggcgccagcggagcgctcccggccccagctcgcggcctcgggcaccttccccgcctcctcctcgtcggcgtcagagacccgcgcgcggacggagcggtctgccacgtgaggaggcaggtgcggtacgacgaggacgacgacgaggaggacggcgaggagtggggccacaacgaggacgtcgcgaggatggaacggtacagcgaggacgcccgcgaccaggcgctcctggtgaaggcccgagtggacgacgaggtcgaagtcgtgctcgtcttcaggggcttctcgtcgagcttgagcgggggaacggccgcggatccggcgaggagcgtcctgccggggagggcgatcatacagtcggtcgacgtggtgaaggggccgtttgaccccaacaacatcgagtacctggagaagggagtgggatgggaggacttcaggagccgcctgcgatagtaacagcactagcacattgtggtgttgttctttaagggggcgtttggatcccttcatttttaaaggaattggaatttcctcaataaagtaacttatttagtttggaatttggcaaaaaaaaaaaggccatagttcagatataagtctatctc

SEQ ID NO: 9174 - DNA, 1193 bp, Zea mays
  misc_feature (53)..(53): n is a, c, g, or t
ccggccacaaacgttatcctcctagattggccagagtttttgcagccaagagngggccggccgaccgccccccaccccccgtattaacaaaacgcctcccgaagcagacagagcctcactccgcgcgcccgcgcagcgaagctggagggagcatggagctgaggccgccgcgcctgcgaccgtgagcacgctctgtagccagccgggtccggctgggcggccatggcagccaccgttctcttcactccggcgcagtgccaccgcgccaccgcgacgacgagcgggcggggagccccctcgcattgcgccctggcccctgggcaccggcgcccggggcggggatcggtgagggcggtgcctcccgagcagagcagcttgcctcaggcggcggcggctgctgtctacgggactgctggcgacgtcaaggccgcgctgtaccgagcgctggacggcgccaacagggggatattcgggatgacgtccgccaagcgctcggagatccatggcctggtggagctgctcgagtccaggaaccccacgccggagcccaccgccaagctgcaggacaaggtggatggatgctggaagctcatctacagcacgatctccatactggggaagaagagaaccaagttagggctgcgagatttcatcagcctaggggacttcctccagataattgacgtcaaacaggaaaaggcggtgaatgtggtagagttcagcgcgagagcactgaagatactgacggggaagctcaccatcgaggcttcgtacagagttaccagccaaacaagagtggatatcaagctcgagagctcaaccatcacccctgagcagctgatgaacatatttcagaagaactacgacatgctcctggaaatattcaatccagagggctggctggagataacatatgttgatgaatcgctacggattggacgagacgacaaagaaaacatattcgtgctggagagagcagacctgccagacgtccgatgacgcgcagttcatgcgcacaggcggtccgtaattttgtgacgaggagcgagtgtaacacgcagaaaacatagcctctgcaaatatataaatatggtatatccgacagctaggactcttgcatggttattggcagttcgatgcagacaatctactacttgaagtaaaaacaaacaaaatgaaaaaaaaaaaaaaaa

SEQ ID NO: 9175 - DNA, 2021 bp, Zea mays
atctctcgctatctgtttcctctcgccagctttgcgggaaaagactccagaaacaaaccccgccgcccctccgcttctctcccgagtcccgactcccgagtcccgtcttctgccccgccccctcctcgcaaaaaccctaacccctcgacctctcaagatggcgtcgccgccgccgcctcccgccgcagccgcagccccagccgccgcggcgtccggaccgccgccgccggcgcaagtggtgggcaacgccttcgtgcatcagtactacaacatcctgcaccagtcgccggagctcgtctaccgcttctaccaggagtccagccgcctcgggcgtccctccggcaccggcgacgacggcatggagacggtcacctccatggacgcgattaacgacaagatcgtgtccatgggcatcgaccgggcggagatcaaggcggtggacgcgcaggaatcactctgtggcggcgtcaccgtgctcgtcatgggccaccttacggggaggaacagcgtcagccgcgagttcgtgcagtccttcttccttgcgccgcaggagaagggctattttgttcttaacgacatattgcgctacgttggagaggagggaggggacgaggggggcgagcagcagccggcaacggaggtcgctgctgatgtggtcgctgctgatgtggaggccgccacccctgcttctatcctggccaacggcactgtcggaggggatacagtgactgtgcctcaggatgcttcgccgcagcccgagtgccaggtggcagagcctgcacttaatccgaaggaggaagttttgaacagggaggtggtttgtaacccaccgaatgacgtgaagcctgttgttgaggaaacaccggttcctgaggtcataaatgaagtgccgaataatgtaggagtggctccaccaatttcatctccctccgcaccaccggaggaggcaccaaagaagtcatatgcttcaattgtaaaagttatgaaagaatatcgaccaccagcacctgcagttccttccaggcctgcacccccgaaaacagagaagcaatcctctcctgcccccgctctggtcgctgatgctccagctttcacccctaatccccagagcggcagctttcaagatccagaagttgatgcacatgccatatatgtgcgaagtctgccattaaatgccacaccacaacaactagaggaagagttcaagagatttggcgccattaaacatgatggcatccaagttagaagcaataagatccaagggttttgttatggctttgtagaatttgaggatgccagtgcagttcaaactgcaatagaggcttctcctgttactattggtgaacgacaatgttatgttgaagagaaaagaactaccggtggttctcgtggtggtagcaggggaggaaggtttccaccagttagaggtggtaacttccgaggtgaaggtattagaggccgtggtacatataatggaggcagaggatacggaaggggcgagttcaattatcgatctgattatggaggccgaggtggtggcaggggtggctcatcgcgtgatgtcggctaccagcgggtcgaccactctagtgcagccagcggtcgtggtgcccgggcaccatcagccgccactgctgttgcaaagtgagttctttggtagggtatggattgtgttttatggccaccatcattgttgaccaaaagagtggtgggtgtggtggattcaagttcatgtgaggaccatcaacaaaagtcgggtcataaatttatgcttccttgttttgtggctaggcaaagcagtggtgatatcggttactaactgtagaatatacgtctgttgagatgtcctagtatgactggcttcggcgggcagctgatttgtgttttgccttttgttacttattgccaaatttatagaggttgatttgaggtgccaacaatttatagtattccctgcgctgctaatataagtaaaaaaatgtctgtttccttccagcaaaaaaaaaaaaaaaaaagcggcc

SEQ ID NO: 9176 - DNA, 2244 bp, Zea mays
ccatggggtccctcgaggccggccgggaacctttccctctcctctctgtttcatctcgccagctttgcgggaaaagagacaccagggacaagccccgcctcctctcccgagtcctgacgtgccccttttgctccggccccacttcctcgcaaaaccctaacccctcgatctcccaagatggcgtcgcagccgccgccccctgccgcagccgcggcatctggagctccgccgccggcacaagtggtgggcaacgccttcgtgcatcagtactacaacatcttgcaccagtcgccggagctcgtctaccgcttctaccaggaggccagctgcctcgggcgccccgccggcaccggtgccgacggcatggacacggtcaccaccatggacgcgattaacgacaagatcgtgtccatgggtatcgaccgggcggagatcaaggcggtggacgcgcaggaatcgctctgtggcggcgtcagcgtgctcgtcatgggtcatcttacggggaggaacagcgtcagccgccagttcgtgcagtccttcttcctcgcgccgcaggagaagggctactttgtgctcaacgacatactgcgctacgttggggaggggggaggggacgagggggctgagaagcagccagcacctgaggttgctgcggacgcggagacgaccacctctgcccctatcctggccaacggcactgtcggaggagacgccacgactgttcctcaggatgcttcgccgcagcctgagtgccaggtggccgagcctgcacttaatccaaaggaggaagttctgaacggggaggtttgtaactcgctaagtgatgtggagaagcctgttgctgaggaaacgccggttcctgatgtcataaatgaagtgccaaataatgttgcagtggctccaccaatttcatcccctcctgtaccattgaaggaggcaccaaagaagtcatatgcttcaattgtaaaagtcatgaaagaacatcggccattagcacctgcagttccttccagacctgcacccccaataacagagaagcaagcctctcctgcccccactccagttactgaggctccagctttctcccctaatcctcagagcggcggctttcaagatccagaagttgatgcacatgccatatatgtgcgaagtctgccattaaatgccacaccacaacaattagaggaagagttcaagagatttggaaccattaaacatgaaggcatccaagttagaagcaacaagatccaagggttttgctatggctttgtagaatttgaggatgccagtgcagttcaagctgcaatagaggcttctcctgttactattggtgagcggcaatgctttgtcgaagagaaaaggactactggttctcgtggcggtggtagcaggggaggaaggtttccaccaggtagaggtggtaatttccgaggtgaaggcattagaggccgtggtacatacaatggaggcagagggtacggaaggggcgagttcagttaccgatccgattatggaggccgaggtggcggcaggggtggctcattacacggaggtgatgttggctatcagcgggtcgactactctggcacatccagtggacgtggtgcccgggcaccatcagcggccgctgctatggcaaagtgagttcttggtagctatgagtcggtagtagtttagttttgtggccaccatcacggttgaccaaaagagtggtgtggtgattcgagttcatgtgaggattatgaacaaaagtcaggtcataaattgatgcttccttgttttgtggcaaggcaaagcagtggtgatatcggttactaattgtagaatatacgtctgttgagatgtcctagtatgtctggcttcggtgagcaggcttacttgttgccaaattatagaggtttttttgagatgccaaaaaaaaaaaaaaaattattgactgtcgttgaataagttttagggtctagcgctgcaaatatgagtatgatatttttcctgtttctggaatatgcatgcccactcatgtctgggaaatgtctgttccttttatgctgcctcttgccagcagctacattccgtgccagtagaatattggaatgtttgctgtcggaatgttttccgtttggctgagctctatttgcttgtaaaaatgagatttttaattgaaatcttgcattcaataggaaatacccctaatctgtgctttgaaacttttttgaggtgaacaaatgtaatacccaaaaagcg

SEQ ID NO: 9177 - DNA, 2188 bp, Zea mays
gcacgagaccattacctagaacatcctgacgggatagagacaaccggcacccgccgatcgctcgctggtgggatgaagaaatgctccggcgtgctcttcatcctcacactcgccgtcgtgctcttcctcctctcgccgtcgccctcccccactccaccccccaacaccgcacccaatggcccgatcaccgacctcctccccaccctccccggcctttcggacctctaccctcccgctcccaactccactgcacatctctcctggggcctcctccgcccgctcctctgccgctccgacgcgctcccgggaacctctgcaggcgtcctcgaggcagccgaagcctggcggaatctcaccctggctgtcaccgccgcggcaagcgaggaggaggcgcgtctccaaggactccgctgctcatcgtccgtgggaggggatctacgcacgggacgtgccacactcccctgcgggctctcggagggcgcggcattgacggtggtcgggattctcagggagggggcggccaagttctgggtggaaatgctgggtgcgaacggtgaggttgtgctgcacgtcaatgtgagcctgggagccgcgggggtgttggtggagcagaattcctggacgccagaggaggggtggggggagtgggagcggtgcccgcctgttggtgatgtgagcagcagcaatagcagcttgcagctaagtccagtggacggccttgttcattgcaatgagaaagtgggtgcaaggatcgtccaggagagtaataatactgtggtaaatattactgggaaccaacctgaagattggcagagtcaaacaggacatggtcagttaagtggacgtttctcaattgttgaaggagagccttttacagtaacactgtgggctggtgtagaggggttccatatgacagtaaatgggcggcatgagacatcatttgcctatagagagaggtcagagccatggttggtagcagaagtcatgttttctggtgatttggagctcttgtcattcttggctaatgagttaccagtatcagaagatatagacatggaaaatgttgcagttttgaaggccccacctctgccaaagaagcaaacttttctgctggttggtgttttctctactggaaacaacttcaagcggcggatggctttgaggcgaacatggatgcaatatgaggctgttcgctcaggcgatgtagtagtccgttttttcactggtcttcacaagaatgagcaagtcaatatggagttatggagagaggctcaattatatggtgatatccaattgatgcccttcgttgactactatactttgatcactttgaagaccatatcaatttgcattttcggaacaaaaattgttcctgcaaagtacatcatgaaaacggatgacgatgcttttgttaggatcgatgaagtgatctcgagcctaaagaagagcaattccaatggccttctttatggtctcatttctttccaatcttccccccacagagacaagggtagcaaatggttcatcagtcggaaggaatggcccttcgacatgtacccgccatgggctcatggccctggatacgtaatctcacgtgacatcgctaagtttgtagtccaaggccaccaggaactgactcttcagcttttcaaacttgaagacgtggcaatgggtatttggatccaacagtacaagaacagtgggcagcaagtaaacattgtgactgatgaccggttctacaatgaaggatgcgaagctgactacgtccttgcccactaccagaccccgaggcttatgatgtgtctgtgggagaagctgaagacggaatatcatgctatatgctgtgaatagcatccgaattgcaagtaggaggcgatagaggaatggatagatagaggaatggataggttagccttggttttgaagaagacatttgctccgattttgacgctgtgtggaaaattgttgggactatgcgcaaaaagcctgtaacattgggttctcacttctgtgctgtggcctgtgggttcatgttctttgtttttgggtagaaaatgttaatccgtgcaacttgatggatgttgtaaaaagagtgttgtaggacatttgagagagtttatctggcacaacctctcaagttattggatccatatacacctgcactcgtcctataaaaaaaaaaaaaaaa

SEQ ID NO: 9178 - DNA, 776 bp, Zea mays
  misc_feature (743)..(743): n is a, c, g, or t
cccacgcgtccgcgcaacatcagtgggcggagcaactgataacattgaggaatcctgtgcagtctttacttcgcgtgcattaggattggaaacgccattgctgacgactcaccagattgacaactgctctgaaggctgtgtggtactatctaaaacgaaagagttctgctctgttttccatggactgataagggagaaacaggttaaaaaactctatcttgcacttactacagcacctgtgtcaacaggaacgattacccattatatgcgcccagttaatcgcgctcctagattagtttctgaagactgtattgaaagatggcatctctgtcaaatggaggtactcgattgtagcaaggtaccatggccaagctcttcgatcaggaaagcttacaatgtaaatggttgtgggtggccacagcaagaagctgcttacgaatgtaaaatcaatctcttgacagggaaaactcaccagataagggcacagcttgctgctataggcgctcctattataggggattctgcatacatgactgcagcaatggcagcgatggccaacccaagcataaacccattcggtagagagaggctgagttacaacagtgaagaggagaaagaagccgccgtcgaagcatggattgcctcccacgggaaggaaccaaaatccgtaattgggctgcaagcgtcagagatctcttgggatcacgagggcaagcaccattcttacaaggctggagttccgnggtggtggcaggatcctgactcctgagtgcgat

SEQ ID NO: 9179 - DNA, 2702 bp, Zea mays
acttggggtacccctcgggccggccggggtagcgtgatagcagagggcggcagcagcagcaaatccctgctccttcctcctccccggccccaaaaccggacaaacccctgctcctcccgccgccgccgccgccgccggggcacgccgggatgcataagccagtggcctccgtcgcctccctatgcccgcagctatggcaccgccacttccgtcgcgctcccctcctcccccgcgcccgcggcctcccctcctcctctcctatcctcacacgccgccgctccgtactcccccgttccacttccactcacctcgccgcggtgtcaaccgccgccgccgccgtcgaggccccatcagccacaccgtacccagtgtacgatcggcttctgccgtgccccttgcaggacgaccctccgagaattgagcacctcgtggctcgggaggacgaggtggcagccgatttcatcgccaggtcgctcggcctgcctcctctgtatgctgcagacctcatcgagttcggtgctgtgtactacgcgctcgtcgccccgcagccgcctccctacgcttctccggagcattttaggctctttcgggaagtcaccgagccttccgtcctgcgccggagggcgtccatcaaggggaagacggtgagggaggctcagaagacgttccgggtgacggaccccaaccagcgcctcgaggccggcacctacctgcgtgttcatgtgcatcctaaacggtttccaaggtgctatcaaattgactggaaatccagggtaatagcagtcgctgatgaatacgttgttcttgataaacctgccgcaacatcagttatctgcacagaataaaattcacatccactaatatgagtatgtacaatgtactaccactgcaacatttgacgcagccagaagcacgagttcttggtgaagcaagttttggtttattggatgttgtaggcagctaagttacaaatgaccagtcagtcgctaggttacggttgaacttttctgagtttcagatgataacaacaggtgaattttgaacctttaggtgggcggagcaactgataacattgaggaatcctgtgcagtctttacttcgcgtgcattaggattggaaacgccattgctgacgactcaccagattgacaactgctctgaaggctgtgtggtactatctaaaacgaaagagttctgctctgttttccatggactgataagggagaaacagggtgtaaaactctatcttgcacttactacagcacctgtgtcaacaggaacgattacccattatatgcgcccagttaatcgcgctcctagattagtttctgaaggaatattattcatttttgggtgccgtgaaactgtgtgctctctttatgaacatatgtgcacactgaccaccttttgttgatgctgtggccgctactgaagatagtgaaatactgtattgaaagatggcatctctgtcaaatggaggtactcgattgtagcaaggtaccatggccaagctcttcgatcaggaaagcttacaatgtaaatggttgtgggtggccacagcaagaagctgcttatgaatgtaaaatcaatctcttgacagggaaaactcaccagataagggcacagcttgctgctataggcgctcctattataggggattctgcatacatgactgcagcaatggcagcgatggtcaacccaagcataaacccattcggtagagagaggctgagttacaacagtgaagaggagaaagaagccgccgtcgaagcatggattgcctcccacgggaaggagccaaaatccgtaattgggctgcaagcgtcagagatctcttgggatcacgagggcaagcaccattcttacaaggctggagttccgtggtggtggcaggatcctgactcctgagtgcgatggtggattggatgggggagttccatatgaacccctggaattctcgcctttttagaggacagatgtttttctacattgttccgagtgctgagcgaccactgtccaacacgaacattggtttggtttggttgctgcgcagaaattgttgggtcaccgaaaactgaatttgggcttgggagatgaaactaagcccgagtctgagctctcgaccaggccaacacgaacaccacaccagagctccttcaactgggaaaagcagatccaggccaacacgaacattgctttgctgttcattctagggcatgcaacgtcattcgttctatggctgtagctgtatggttgtgtgcaaggcctagcttctatttgggacagctctcacaataatattccctggagattgagttggggtgagaccgtctctcataatgtcagtgaccgaaacatcaaattttagaggcaagcatcttaaaatcgataatggggcgtttggatccctcatttaataggaattgaagttcacttaacaaacccccctatttgccttatttgccttaattggtatatgtcaaacgatccaaacgggcgttagagaaattcttatcgtccactttatgttctaattttcttagcttattaacaatgatgttggactcaaaacatcttggtaatattcttcccatcgcagattgtttgatagtgtttatatgagatagttcatgtgataaaaaactgaaggtaaggagtagagatgacaatggggatctgatccccgattccccacgagaaatt

SEQ ID NO: 9180 - DNA, 2846 bp, Zea mays
ggctcgttcctcgaggtacataacgagcagatcaatgatctgttggaaccatctcagcgtgacctacagataagagagaacgctagcaatggtatccatgttgagaacttgactgatgaatacgtgtcaacagcagatgatatcagtcagatcttgatgaagggactgtcaaacagaaaagttggtaccaccagtatgaacttaaaaagttcccgctctcatgtgatattcacctgcgttattgaagcatggagcaagggttcatcaaatgggtttagcagctcaagaactagcagaatcacctttgttgacctcgctggtcctgacactgatgaacttggtgcagcaaagcattccacaaaggaagaaagacatcttaagaagtctctttcaaggcttgggaaactagttaacgttctttcagaaactccagagtcacataaagttgatttaccatatgagcaatcccgtttgacacatgtgctgaaggatacactaggtggcaactccagggttatatttttgtgttcgatttcttcagagcacagatgcagatctggaactttaagtacactaagatttggtgagcgagcaaagctaatgccaaacaaacctgtgataaatgagatatcagaagatgatgttaatggtttgagcgatcagatacgtcagttaaaggatgaactcataaagaacaaatctggagacaccacaacttgcaaggctaggtacttcagtgcacaaagtgcccgtgaaagtttgcatactttgcgagtgagcctcaaccgctctcttatctttcctcacatagaagttgattcagaggaagaaatggatgttgatgaagaagatgtgcaagaactgcgtgatcaaattagcaagattcactcttcatctgaagatacattggatgactttatggatgcagaaagtggagacgaaagcactccttgttctgtgggaagaagtgaagatgatcaagtaatcatagatgattttgaaggtccacaacaggaagagcaaaaagaagtatctaacaatacaaatgctaatgaagacctcggttctgacagaaaatctaatctatcaattattgcctccacacggttatcacctattcaggatccaacattgtgctcttctccaaagatccacaacaaggcaagaatgagcatcacttcactggggctatcaccaagcaagattagagtatcagacagcccaggtgatagaaatgttgaaatgtgtacaaatagtgcatttcgttcctctctacaatcaagcaagcttagccccactgactcactggctgcaagtcttcaacgtggcttgcacattatagagtaccatcaacagaatccagccccaagaaaatcatttattggtctttcatttgaccatttcgctcgtcagtcagtagcaaaaatcagttcagctgttcaggctctaccagaggaccaaggaaacaacctttgttcattctgcaagaagccaatgaacacaaatgataatcagacagaaaacgtaaatttagacaaacagattaaggatggcaacataactaaggaaattgcttccaagagagaaactgagcttgaagctttatgcgaagaacaaagagcaaagatccaggagctgagcagtttgattgaccaatataagaacaggtcagaagaactaactagtgaaggcaaggtttctgtctcactcagtgtgaatgagagggaggtacttcttgctgaaatccagagtctgagggagcaactcaaaaaccagactactgtatcaactactggtagccttcttgaccagttaaggaacggcagcacagaccaggagtatgaacttgacaaagaaaggcagaaatggatggagtctgagagcaagtggatttcacttaccgaagagttgagggtcgatctagaatcaaacaggatgcacgcagagaagaccgagatggagctctgcaacgagaagaagtgcacagcagagctagatgacgctcttcaacgagcgatgtacggccacgccaggatggttgagcattatgttgagctgcaggagctgtataatgatcttctcgagaagcaccgccgagtgatggaggcgatctctgaggtgaagagggcggctgccagagcaggcaggaagggctgtgggacggccttcgctgctgccctcgccgccgagctctccacggtgagaatcgaccgagaaaaggagagggctcagctgaaagaacaaaacagaaggctccgcattcagctgcgagacactgccgaagctgttcatgctgctggagaactgctcgtcagattgagagaaaccgaggaagcatctacactagaaaaggagaggactgccgcgttgttgcaagagaacgagaagctgaagaagcagctggagaagctgaggaagaagcacgagatggagctggagacgatgaaggtgcaccttgcggagagccggctgccggagtcggctttgggtgccttctaccaccacgagaacgagaggacgccggacgacgatctgtcctggcgggccgccttcgcttctgcgtacagtgactgaagttacctgactggggattgcttgggagttgagtctcgtcaactgagacaggttgacaattggggcatgagcatttctacgaccttgtttgattttaagtacatgactcgattggggcatggggcaaagtttttatgtatactgcttgtatgggaactgaatttgaacgagttttatgtagtctttcgagtatttttttggtcgaaaaaaaagttcctgtttaccgtactgccaaagtgcagcctctggtcccacctttaactccttttttt

SEQ ID NO: 9181 - DNA, 1748 bp, Zea mays
aatcacctctcgtcgccaccaactgtccaacagtcgcttcaccgtcggcgccgtcggagggacgctccaggtggctgcccccggcagcggaaagtttcctgcggcccctgccctctttcaccaccgcgggttctcaggcagagaaaccttacctgtgcatcatggagattgcagagctcctccaggagcttgtttcatggtcacgtcacctatgttggggccaattagggtatccttagtatgtagcgcgagccccaaccaccataggccaaggatttcggatatatcgcaactacaaaaggaggggtcctccagagggaaaggaaggtcgtaccaggataaagatgactctgagaacatcgatgaatatgatagcgatatcatgttctccaggaatggaccacctatctctttggcaagcacttcccgtcctcaagacacttcagctcctggggaaagagagatggagattgtggagctctttaaaagggttcaagcactgctgcgagctagggtgaaaggcagggaaaagaagcctgaacctgcaaaagtgcatggcgaaaggggcagtgttgattcacttattaagttgcttaggaagcactctgttgaccagagaaggaagagcggtgacgagaaagagcagaattttgatgtaatgaggagaagcaatgattctggaaatagacgaggttcaaccatctttggcacaaaaagtgacatccaggaagagcagaagaagcaacctccggcacccttcaaaaggccagcttcaaatttcaggcgaaggtctcctgttcctggagtgaagttccagcctgttatcaatgtggatgtagacacagatgccgatcgcaagtctatgcgcaataatgtcgccgatgctgtacagatggctaaagacagctcttgatgagaggactgctacagatgagcctgactacatgtctccatatgaacctgattctgtaatcgagccagaaaatattccgttggacgacctcgatgacatttcagacgatgacgaagaatctgatgctgatgaaccagacaacgagtatccagaactgtctttggaaatcgctgatgttacagatacagatgaattgcacgaaagttcatatctaaactctctgaaggttgcagagctgagggagcttgcaaagtcccgaggaatcaaaggctactgaaagatgaagaaaaacgagctgattgaagtcttgagcagcagcatggcatgatgataagtgggtgatgttgtcgacctgtcagcatggtggatgaagactgtcaattattggcctgcgctgcggtctcgacgccgtgcagaggtagctgcagctttgctcattgggtttgttgcttgcttttgtccagagactagggcaggacaggactgtgttaaggcaggcggccgcgttattgcctgtgcttctattgttaccttgtgctatgctatatgctaatcatttggcaggcgtcaaaaaaaaaaaaaaaacacgcggggatgggaggaaccgcatgagatgctgagtgattggacggttagttggcctcctcacgtggcgcgtctctgcacctttgtctctctggctgactgactggctctgctttcgcctgcgcctgggcatatcgtggaaccctgattggcctagctcgatacggccgcagctatcatgtggtgtttgtttcagcttattttcagcttctggcagctgtggaacctttagctttttaactcgtttttg

SEQ ID NO: 9182 - DNA, 925 bp, Zea mays
ctgtttggaaagcgggccgggacgcccacggcaaataatgtagggtagtctcccccttaggccccccacggctatacccttttttttttccggctctttattttggggggaattggagcggataaccattttcccacagggaaccagtatggcccaggttcccgccaacggcgcaattaccctccaccaaaagggaccaaaagctggaggtccccccgcggtgccggccgttttagaattaggggatccccccgggctgcagggattccgcccgagaccatttccctggaacatcttaatcgaaaaaagaatttgtgcgaacaccttgcacgtcccccctggcacgggcctgctcctacttctctcgctttcgctttatcacctctcgtcgccaccaacactccaacagtcgcttcaccgtcggcgccgtcggagggacgctccagttggctgcccccggcagcggaaagtttcctgcggcccctgctctctttcaccaccgcggtggatgaagactggcaattattggcctgcgctgcggtctcgacgccgtgcagaggcgtcatgtggtttcgtgatccacgcggggatgggaggagccgcatgagatgctgagtgattggacggttagttggcctcctcacgtggcgcgtctctgcacctttgtctctctggctgactgactggctctgctttcgcctgcgcctgggcatatcgtggaaccctgattggcctagctcgatacggccgcagctatcatgtggtgtttgtttcagcttattttcagcttctggcagctgtggaacatttagctttttaactcgtttttgtgagaatcgatttggtaaaaaccgttaaaaatcaatttaaacatataatcggctgattcgtcatccgttaaaaaaaaaaaaaaaaaagcggccaa

SEQ ID NO: 9183 - DNA, 831 bp, Zea mays
cccctatatataatttccatccattccattcccttttaattgcatacccatccattaattccaacagctgattaattactgtgtatagcgtgacagaagggaaaaaaacagacaaagtaacttccatatatacacaataactggatgagatagctaatcacaagaaattaacactggactcgattatgagtctctagctcagtgaggaagcactagcactaaaccacactagctagtagctaacatcttggctacagttacttgttactacacagaagaagcagaatcctcctggagtcgcagctacgcacgagccgtggccgccggagctgacgacgaaatgacgccgtcgtcgaagttctgggagtagctgcgcaggtcgtaggcgaacctcgccgccgccctcgtcctcggccgcgccgcgctccgtctgatgaagctggacctcagcctcctcagcagacgcctcaccggcgccggcgccgtgccgctacctcggctcatcctcctccgaccgccggcggcgtcgccgccgtacaggctgagcagagacgccatcgtccttgcttcccgctttccctatctctccccggccgcgtagcgctacttacactgcagttgtgttcttgttttgtcttgtgaaagctagctcaagcgtgaagactgaagacccggctgcagggtttataggctcaggacggctgggcatatactgcttggccaggtctgccggccacgggccccaggctcacgacgtgggtgacgacgacatccactacgaggcgatcgtgggaatgctccgggcaaatgccgatttcaggtgcctttttt

SEQ ID NO: 9184 - DNA, 1475 bp, Zea mays
ccagattattggtatatgcatgaggattgagtttaacataatgcaaagggtgacaccatctcacgaaagcatgaagtgattttacaaactaaatataacaataatatataaaagactatgtgcgtaaaaatctttaaaatatcttataatttggagcgaatacaataatatattttttgttttatgtaaactaaatcgagggctaaacttcacgtagggtggacatactcatcaatcacttatggcaatagggtctagcattaaaaaaattagaattatttcgattcgaaggacatccgaaacgatttctagccgaatttcttgtatattttatataagatttgattaatgaaaaaaagttgctggctgtaccccgttcgcctccacagacgaaacatgcccttagcctgccgtacatttttcttttcttctttacgcaaatggtaaaacgcttgggaaacacaattcagccctggcctttttccagttgagttcacctcttggctcttgcctcctgcatctctagagaggcacatcccagctccaagcttcgcgccttgttggatcgtggcgtccaagcaacggtggtagcggagcgcgaggcagtggccgcagaaggaagcgcgaagcatccatggaccaacgccaggtggttagcgagaattatgccaatcccataacatgcttcttccatgtgctattcaaggcgggggcgctagccttctacatcctattctcgctctttgtgaagagcttcgtcatcatcttcgtgatcacggtgctcctcgcagcgcttgacttctgggtggtgaagaacgtcagtggcaggatactagtcgggctgcggtggtggaatgagatcgatgatgacggaaacagtgtgtggaagtttgaatgccttgatggggagtctctcgctcggatgaacaagaaggattcatggctgttctggtggactctttacttgactgctgctgcatggatcgttcttggtatattttcactcatcaggcttgaggctgattaccttcttgttgttggagtttgcttgagtctaagcattgcaaacattgttggattcaccaagtgcaacaaagatgccaagaagaacatccagactttcgctcaaaatgcactcgcttcccgtgtcacatcatcgctgcaatcagcattcggtgtcatctgaagtcccacgcggaggccctggtattagtatattactcacagcggtgtacaatttgtcaaaaggatgagcttgcattctacgtttactgcctttcctctgattgcaaggatgtaattctaccagcgtagacagcaagcatattgtactgtcccgttatcattcttttttacctcatacaacaaataggtcgattttgatgtcattaccagaatcctttggtttatctcttgggtgatttatccatgaagcatacacttgtctcatgaaaaaaaaaaaaaaatttgcggcc

SEQ ID NO: 9185 - DNA, 1009 bp, Zea mays
gaaaaatgtcccactgatgacgcgggacgccggagcggaaggcagggcccaccatgtcagcgccgccgccgccgccgccgccgtttctgtcctattctgctcttcctgccgatctgtgcgccgcctcttcttcatcccgtccctagcagccgatcccaactcccgatcttcggttcctttgaggcccgtgagggtctcctaggaccgactgcgcaagagattggagtcaccgtttttttcttttgaggaagtgcaaagcattagagaaacgttgccgttggtctaagatgacgacgagatgattgcgctgctccagaactgcaagcaacctcagaagcctttgactctgggcaaccagactgactgatgaaaggctcaaggcccctggtctcagctgccctatatatgcttgaggttgttgagctgacctttacgttttgttcgagtgtgtatcccactgaaataaggtttcacacagaaaggtatggtatagtcgcactcattcagacctgcctagttcgtgctttcatgctggacggagtgtacatcttttatgactcggggttggagggtatttcgtcagcgccattcctggagaggctcgagcttttggattgcaagaggataacaggtgctggggtgagtttcgttgccccgcgtttgagtagtctcactatctccggagaaggtgttcaggggcctgccactgacagcatgtttgggaacacggtataccgtaatatttgagcataccgtagtattttataccaaaagacgtttgggagcacatacaagaactctatattttaagttatggttttgccaataccacggtatttttaggatcaagaaaactttggtttgcacgcagctacagtcttttctctctcctacactgtaactaaaatactatgtctccaaactgttattggattggaatgatgtaaagtatactataattatgttatgacatactttaaaccatgttattataaactatggttttgtg

SEQ ID NO: 9186 - DNA, 1708 bp, Zea mays
ccaatggctcgcccgatgtgccgctgaaagttatctggtcaggtcagtgagagagaggctcgcaagttggcaacccaatctttactcttatctgcccaaccccgtcactgcaccgtcagccagaacaactgctgctccgactcctatttaacagacggagacgggggcaaacgaagcgaatgaatactggctgctactagtactactggtacgacggcgagcagagcacagcacagcacagcacagcagcgctacacgttgggcgtgcatcgattcaggatcatggacgacggcgactggatcacggcgaggtacctcctctcgtcgatcctcgggcggaacccgctggtggtggactacgtcgacgaggagtccttccccgtcgaccttcctccacctcccgcgccgtccccctcttcctccggcggccgccgcgcggagccgccgccgccggtgcgcgcgcccgcgggggtggccggcacggtgtgcgcggtgtgcacggaggagatcgcggcggcggaccccgtggcgcgcctgccctgcgcgcactggtaccaccacggctgcatcgcgccgtggctcgggatccgccccacctgccccatgtgccgcgccgagctgccgccgagggaagccgccgccggggaggatggccccgcccgcgccaagccgccgcccgcggggaccagcgccggcgcgacggtcgcggccgcacgcgcaaggcgggacgcgccgtacgagctcctcgccggcggcgtgctgtccggctgatccggccgtcgagtagatagagagggagtttggcgcgtggacccggtcctagctgtgagctcagggccggccggctcctttgtttgtacagggcaaattgggtactccgaaaagcaataaaaaaaaagcaaaaacaacatttcgacccgaattctcgccccggcttgggtttcagcgtcactcgtttgctctgttctggaacggtaaccgtgtattccgtattgaagtctgaaagaagttcaatcttaccaagtttcttaaccatctaccattcaaattacatcaatggatatagttaaatccaaaatacccctaaaatggtatgcgctttttagtgggtcaaagtttcgtttcccgtgacattttgctcatcgaaacgcgttcattatatcgagctggatgcagttgttgtccagttgacgctcagatagagatagcgagtgaggaaccaacttctgttcaagtctcactgcaacaagtagagcactgtattttttttatatataaagttagaaggtgttaaaataaactaagcagcaacccgacgaaaccggttggtggtgccgcgtttgcgttgcttcacctcccttcgataatgatatgtaaacacctcctatattgtacactatgaatccataaagaatgtaattctgacggtgtcaggtttaatatctaaagtttggtatcgacgtatgaaataaatactattagattaactacgagatgtgtttctaaaataaattgatttgaaatcacaaatatagataccatttactagagacttaactaaacgtgagtcactttaactaaggtcatgtttggaatctctaagactaatagttagctattaacaattagttgttaggttccacacaacctcaactaataccacagctaattgttagctatctcacaattagttcattaactggctaac

SEQ ID NO: 9187 - DNA, 5636 bp, Zea mays
  misc_feature (4108)..(4108): n is a, c, g, or t
  misc_feature (4991)..(4991): n is a, c, g, or t
cagtagtgcctcagtcgaagaggagcaaaagaaactcagttacgcaatccgaaggagctcgcggcagcagaagcagaggagaagcgatgcatccatgagcatgatccattcgttcttccaagctgccaattacgagggccgacatttatcccacgccaaggggatccgacaaagatgccaacgcttgtccgcctccgccatcaaaatcgcagctgcaaaaatcgcgtccacctcccatcccatcgcactccccgttattatttcccgggaaaaaaatccacgcgaaaattccccacacccgccaccccgcgcacggcctctctcctttctcgagagagcgaagtaaacgggacagcggctgcagccacccagtgtacgagcgctccgacttgtgtgctctcatgccgtgctgctacagagctgcctcataaaagctccctgagcctgctcctgtttgcagcttgcaaggcgccaaggacggacggaggcgacgactcgcaaggtagctctgctcgggcgaggcagcagcagcacgcagcagtactccgttcagaatcaggtactagacggtagacgtcagctcactatcagtattcatcagcagtaccactagtaaaaagatttctctttctttctatccgatattccgatagaaggggtagcttctcttctcgtcccctttctttcttgtctatctttttttcttccctttctcctcctcctcctgttgcggttctgcttcgacggagaagtttcttctcttgggttagttagttcgttgacgcctgctgttcttgccacgggcctgctctccttttgcaggagagaagacgttgttctccgggcactcgagtcgaagtcctgacgagatggacggcaatgcgaggtcggcggcaacgaatcagaagaagcccgtcgtgtaaggattctgtttcgccagtctcccccagccccaccaaaagaactctcctttcatttccactgatcgattgcgcctgctccctccaatggcgcccgcactgcagcgcggacgacgacctcgtggagctgctgtggcacaacgggagcgtcgtcgcgcagccccaggcgcaccagaggccggcgcccacctacgaccccgaccgcccgggcaccagcggcctcaccggcgaagagaccgccgcgtggttcccggacaccctcgacgacgcgctggagaaggacctgtacacgcagctctggtacagcaccatcgccgacgccgccccgcagcacgagggcacgctcccgggccctacctcgcagccttcgccttcgccgcccgttgggagcagcggcgtcgagtcgagctgggctggcgacatctgctcgaccttctgcggaagcaaccaggtgctcaggacgccggcaaggatcagggggaaggacgcggcattgcagtcggagttgccgagcaataccggcgcgcacgacggcacatcgtcatccggcgggtctggaagcaactatgggggattcgggctgcccagtgacagcgtccatgtacagaagaggaaggggaggtgtagagacgactcagatagtccgagtgaggtgtttcttggtctactctgttcatcatttttggaaatagggatgctagagtggaatataattgacgaggaaattgcaggatgccgagtgtgaggaggcaagtgaggaaacgaaaccatcaaggcgatatgggacgaaacgccggactcgtgcagctgaagttcacaatctttcagagagggtgagatcagaatcagattgtgctagcaaccaaagcctgttttcaggaaggcagctcgttggtaaattgttcttacagcaatattgactggtgactgctgctgatgtagagaagaagggaccggatcaatgaaaagatgcgcgcattgcaagagctcatcccgcattgcaacaaggtatattattaatacatattatgcatcttttcttgtcaggtgcaagtcccttgaataatgacattctgttgggtgagtgttaacatgctgtgtcctttatcattgtcagtatgtttattttgtttttcgccgacctttttcttactttatcagctccaattgttttcagactgacaaagcgtcgatattagacgagacgattgagtatctgaagtccctccaaatgcaagttcaggttagcagctactcctacctgaagtcctgaacttacatgatcccatacaagatcatttgctggtaccgaatgaaactaagtaatagatatgtttcagatcatgtggatgacttctgggatggcgccaatgatgtttcctggtgttcaccaattcattccacagatggctctaggaatgaatccaggttgcatccctgcagcacagggcctaagtcagatgccaagattaccatacatgaaccacaccctgccaaaccatatccatctgaactcgtctccagctatgaatctaatgaatccactgaacgccgcgaaccaggtgcaaatcggtcacctcagggatgcaagtagccacttgcttcacctagatggcgggcgagcagcagtggtacctcaggtacgaccatagtatgatgacccagatgctgtggacttcagggacatttcaacctttttatttctagctgattaactaaataagctgtcaattgttctgcaggtaccaggaccaggaccccatgttcatggacatcaaatagcacaagccgaagaacacaataagatactggaagtggcagctagtactgttataccaacttctaaggcagggcaaccaccaactttacatagagtttagagtgaccaaaatcatgccttgagctgtatatctgtacagaagtgtcagaagcatattctttgacatgtaagcttagttctagagttattatcaggagtcttgtataggttacaagataacagcctgtctaccgccgtattctatctacggaagaactcccctgcatactgctgtgcagactgcagtacagcgttcaagagagaattgaatgggtgagtattatacgaaacaaagcacaacctgtgagttttttttaacgggtggatccattccttgagattgaactgacagttttgtacatatcaggaaaggagtagataatgccaaggccagtcggtttaaccatccttttcttgacacttacaggatcaagaaagggtctttctttttctgggaaccgctgaaaatactgacgtgatgaggagcggatggcatctctgtagctgcgctgcgctgcagtgtatctacatcaatatggcaatgcttgtctggacacgaatgctacatctacatgtaaatgcagagttgcaggtagatagcaacccctctcccctgagatgccaactccgactcctgtcctactgtatgtactgatctgtacagcaagcaatattcaatcagcagtcaattcctaggatgtcgtaaggtactgtggaaacatttttccttcgaatactgttatactaatgaaaaaagggagtgtcgaaatgtttgttgtcaacggacgaaaatccagccagcaggcccgtcctacctgcagacagaatggataacaagcttatgaatccgaagtgcatatttatatctgcatatcatatattaatcaatcctgtctttctgcctgctcctatttgtaggtcacgacaatgatcctatctaagtacataagtcgctaacaccatttcctgcttgtggaaaggtttggtcttgcaggagatgagctcgccagacagtccatcacactgccggcttgattgcatcttcacaggacgtggacttgtgggcacatgctccacgggcaacggttcggcatcctcctggcgttcttgtggctggcagcagccgcgagaatctgtgtggagccctgggctgggctcgttgcaagatatgccagcctctcatcttcagactggaggaggaggggggggttccctctccaggctttttccatgatgttacaggcttacagcattcagagtgcatgttacactcacggccctatcagcacatgctgtgggcagccggtgatgataggatcagatgctcatatctcctgcggttttctgtctaccgcatttggattggatnccccccccccccccccccctgtactgtacttcctccttgctcccctgctgcttggcgctttgtccatgtgcctggttggaattgctactatacatttttggagggtaatagtttcaccggaacatgtagcgtggacgtgtggtaataacaattgaattgatgcctttaaaaaaaaaaaaaataacaaagggaagcgatgagcagcacatggtaagcttccggtgccggttggaggcttcgatgtcgatgtctgcattgagtttatttgatgctgtgtgttctatagctagactaggctagagtttggatagagttcatgggacaatgttgtctgcatcttcatctcccctttagtttaggacttatctgagaggtacggttctttgcatgacagaacaaaactagcagcagcaaaaaaaaaaaaaaaaggaaacaacgacaaaatataaaaaattggcttcgcccgggttcgaaccggagaccttcagtgtgttagactgacgtgataaccaactacaccacgaaaccaatcttggtgttcgtaaatcctaagcatttatgaacataactatcgtcttccagcaaatgctcggcaccgttagacgggccggcctaaccctcggtgacaaggagactcttgcgcgagcacgtgccgaagcgcaggcggcccaccacggccttgccccggattcaaggtccatgggtttttatagctagtaatctactatacgtactgatttggtttgttcatttgttggcagctcgcagctgctgccgcgggagttgatgccgcgcgcgtcgacggtccacgagctagaacagctcaccgccgccggcgagcgagttgcccaggtcctggactgttgaagtgtataagtaatangttggctaccttccattagcttaagttttggttgatttgtttagtgtctctataacatgatatcaaagttagaggttttatttatgactttattttcacgtttacatctttgtctctgacccatttatttttatgtttgcgtttttctctcgggcatgagtgagggtgttgacgtggattggttatcttctttagttagcgcgtccactctgacatgcacgagtagatagaccttcttgtgcgtcgcatgcatgatctcgtagagccacatctgcaccacgaggcgttgccggaggcgctaaaaggaagtctacctcctgcatagggctgaacgaaatgctcgtagcttgttggctcgctcgattcgtggtcagttcggctcgactcggatcggctcgtttgaatttttcatgagctgaggtgacatcctagctcgatttgttaacgagtcagctcggtttaccaacgagccagctcacgacctaaacgagctaccacatttcagcaaaacgaaactatatgcatatcatttacgtaataattgatgaacatgttatatgtatgtgtggtgttatatgagttaaactaacgattgataaactatgtctatgtgttaagttggtatgtgagaatataaccgtggtc

SEQ ID NO: 9188 - DNA, 3843 bp, Zea mays
  misc_feature (1977)..(1977): n is a, c, g, or t
gactaaagtttagtcctaggactaaagtttagtcctagaactaattgaaaccaaacatgccctaagtttcgtgattgcggctgtgagcatttcacacatagtaatgtatatgtgcaaagtctgtaagtatggatacgtcacaccaacggcgtaatcagtacagcaattacgataagataggagtattagatctttgctggaggacaggccccacactatctatacagggatgagggatacatatctcttacctcttgtgctatgaaaaagatatataaagcaatatacaaaatgctcttgattgacgtcacaaggggtaggtagggtagggttgttctcacctgctacattatacatcgtgtcattatgtaagctatgtccacgattatatatataatcatatatcgtctagaacatgtagagtaatatatatgcttaagcggccgaacctctccacactgtatgcatgtgtgtatactgctatattagttcaattacaaagtcctaaatctatggtgctgtttggttcacatgtttgtaacataaacgataacccataacattaaaccatatttgtttaaatccaaccgtaataagataccaaactagaaacttaaaccgtctcatttaaatttattaccactgttaattagttgtaaatcattagcattatcatttacattacattttatgaacttaacacttagtctcctggtgccttattagcgccgcatcgtgacaataacaatgtttgttttggctccgaaattttccaaggagtattgctaaagaagaaccacccggaaattgggtgtgttgctgcttgcctgctgcatttgtgcagcccatttgccaattattcggcccatatcacatgacggcccatcccagaacccagttcaactattgatgaggacgacaaagaagatattttccttcgccccgaaaatcagctacgtaggcagacaaacctcccactgatgacgcgggacgccggagcggaaggcagggcccaccatgtcagcgccgccgccgccgccgccgtttctgtcctattctgctcttcctgccgatctgtgcgccgcctcttcttcatcccgtccctagcagccgatcccaactcccgatcttcggttcctttgaggtatgactctgtattcgcctgttggggtataatcaatttgggggctggctcctttttttaagcgtttctgattgagatgacggaggtgaaaaaatactccagcataattggttccttgcttatggagtatttgttaatgctgtagtactatctgaacatcgaattccaggctgtaacttttgctgcatcgggcaaatggttttgatttgctcgatagaactgtcagtttaggaaccactaggcgtcgttacatactgtacgctcgcaagtttcatggtattatttgcaaagtgctccttacaaatttatttttaaaaaagaaaaaaaaaaacttctaattcgttgatttgttctaggttaatttgctatttgtttcagaatttcctactcatccgtagtgttttagtttaatttggttgcgcttctacattagcttatttgcatgctcagcgatttagaagaaaataaactcggacacctctctcttcggtgagatcttagtctaacttaacatggaagttaagatttaataaggtgtttggtttgaggaaagggctagtccattatctacttacttctcactttttgtttggtttgtagaatggaatgatttgatccatcatcatcttattcctcagagttagtactgatataaagaatgagttcatttcatcaaatttgaggaatggaatcataatgcaccacctcattttggatgaattgatccatcaaaccaaacacctcctaactgtcagcattggttactgcgatcagggtaatcctaaggttatttttaagctaatcctaaggttatttttaagctggtctcggtnccatagggtgtatataaataaaaaagatgatttcgagaataaggctaattattcaacatataaatctatctaactgattaattaagtgttgaaagagtttaagggactctcaaaccggctccggctcctgtaggagccctcccagatggtctaaaaaaagatctctcaacaaagagcactgagtaatcagagctattattttatagagaggatgagccaaaggggggggggggctcctatcctagtgcctcctaccccactctcccatcttgcatttctctcacgccaaaatgagccgttttactagacgatttgttaagaaaacactacctcctatataggaattgctcttcaagagaagtcaaagcgaagtcatttttagtagagccggagccgtgtcaaacagtccctaaatacatcaagttcttcatcaagagaggcgtcgagtggctagagtaccttggcaggaccggatcattggtggaacttgtggtgaatgattgcaagggaatccttcaccacaagtttgacctcctaaaattttgtccaggtctccaggatagataaagtttgagaagtttgagatcaatggcaattattggttactagggtctctcggtgatgatggtttgaacatgtttaatggagatctctatgggcaccaatgcttaatgagattataatgtgcgatagtgatggaaagagatgtacggggagatcaaagttgatgtgggaagagacggtaaaagaagacttacaaagatgaaatataataaaagatttaaccttaaatagggtgaatagaaaatagttatccacatgactgaaccttgatctgtgggctctgttgggttttaactttagcctatccaacttacttgggactaaaagatattgttgttttgttgtagtagtagtagtagtaggccctccctctgatcccgcgtatgatgcctgctacccgtaaaaatatgatatcttctgtgagaatttgaggttggcacatatattaactttgcaggcccgtgagggtctcctaggaccgactgctcaagggattggagtcaccgttttttttttcttttgagaaagtgcaaagcattagagaaacgttgccgttggtctagatgacgacgagatgattgcgctgctccagaactgcaagcaacctcagaagcctttgactctgcgccaaccagactgactgatgaaaggctcaaggcccctggtctcaactgccctatgcttgaggttgttgagctgacctttacgttttgttcgagtgtgtatcccactgaaataaggtttcacacagaaaggtatggtatagtcgcactcattcagacctgcctagtccgtgctttcatgctggacggagtgtacatcttttatgactcggggttggagggtatttcgtcagcgccattcctggagaggctcgagcttttggatcgcaagaggataacaggtgctggggtgagtttcgttgccccgcgcttgagtagtctcactatctccggggaaggtgttcaggggcctgccactgacagcatgtttgggaacacggtataccgtaatatttgagcataccgccgtattttataccaaaagacgtttgggagcacatacaagaactctatattttaagttatggttttgccaataccacggtatttttaggatcaagaaaactttggtttgcacgcagctacagtcttttctctctcctacactgtaactaaaatactatgtctccaaactgttattggattggaatgatgtaaagtatactataattatgttatgacatactttaaaccatgttattataaactatggttttgtgaaacaaaaaaaaaaaagaaa

SEQ ID NO: 9189 - DNA, 1425 bp, Zea mays
  misc_feature (1408)..(1408): n is a, c, g, or t
ctggccgggaacgagaaatcgaaccacacgcacgagaccattacctagaacatcctaatcgaaaaagaatccagatccagcgcccgcatctctctctctcgcgcgcgcgcgcgagcgcgatgagctgccgcgacgggcgatcgtgctagcggtaacagcgagcggtgcgcgagggcggagtgggagtgtggatccgaggggcggcaaatctggcaggcgccgcggtggggctgcgggcgcgggggagggcggggggctgggcggacggcggggagggaggggaggactgcggtaggctcaggccctggcgcaggaggctgctcgcgtccatggcgctctcgtggtcctcggccctccgcctcgccgtcgccgccgtcctgctcgtcgccgtcgtcgtcgcgctcttcactctccccatcgagaagattttgaaggactttctggtttggatcaaggagaatttgggtccatggggtcctttggtgttggccctcgcttacatccctctgacagtcttagctgttccagcatcaattcttacacttggagggggctatctatttggcttgccagtggggtttgttgctgattccattggagcagcaattggtgcgactgctgcatttctgcttggcaggacgattgggaggtcttatgttctctccaaatgcaaagattaccctaagtttcaagcagtagctattgccatccaaagatctggcttcaagatcgtgttgctactaaggcttgtacctttacttccgttcaacatgttgaactacctgttatctgtcactcctgttggtgttggagaatacatgctggcttcttggttgggaatgatgccaatcactcttgctctggtgtacgttggaacaacactaaaagatctatcagatgtgacacatgggtggagtgagatctcgactactcgacggattctgataatatctggttttgtattatctgtggtcttgattatctgcgtcacaaaaattgcaaaatcatctctggagaaggcattggctgagaatggagagctccatgtaggaacatcgcagcttccaggtgtaacctctcccttggatctgcaacaacctcttgtaatcaagattgacacatcaaatgaagaccacgagaagtaaaagtgttgtgtttacaatctcagatctaaattctttggttgttgagtcggtagactgtatatacacccatactctggtgaggcccgtaaatgggtaaaaaagacatcatccccccttccaaaaaagggaatgaagtttagtttactgataggttatagtaatacgatatgcgctttgtttcactccacgtgctaccttatctttggtgaaaatactcgcacttaactggaaaaaaaaaaaaaaaaaaaaaaaaaaaaaaaaangaaaaaaaaaaaaaaaa

SEQ ID NO: 9190 - DNA, 1973 bp, Zea mays
  misc_feature (262)..(262): n is a, c, g, or t
ttttttttttttttttatcggtgccaatcctggcagcaaccggttcgattaaacctttctcgactctcgaccgcccacagtcagactcagagcagaggcgaccggatcatgcgcgtccacatctgtcggtgctgggcgctccccgccgaggacggacacggacggtaggtgggactggaactggaactggaagcaaggcgaggcgaggcgtgcgagcaaggcgaagcgaaccctccccctgctgtttcctcccgtgctcggngctccccagcgggaaaaggggcaacgagagtagagaaatcgaacccacacgcaacgcgtcgcgacgggacggctccacctccacccactcgcctgcctccagatccagcgcccgaatctctctctctgtcgctcgcgcgagataagccgccgcgccgggcgggcgtgctagcggtagcagcgagcggtgcgcgagggcggcggaggcgggagggcggatccggtgggcggcaaatctggcaggcgccgcggtggggctgcgggcgcgggggagggcggggggctgggcggacggcgcggagggcggggagggaggggaggactgcggcaggctcaggccctggcgcaggaggctgctcgcgtccatggcgctctcgtggccctcggccgtccgcctcgccgtcgccgccgtcctgctcgccgccgtcgtcgtcgcgctcttcacgctccccgtcgagaagattttaaaggactttctgctttggatcaaggagaacttgggtgcatggggtcctttggtgctggccctagcttacattcctctgacagtcttagctgttccagcatcaattcttacacttggagggggctatttatttggactgccagtagggttcgttgctgattccattggagcaacaattggtgcaactgctgcatttctgcttggcaggacgattgggaggccttatgttctttcgaaatgcaaagattaccctaagtttcaagcagtagctattgccatccaaagatctggcttcaagatcgtgttgctactaaggcttgtacctttacttccgttcaacatgttgaactacctgttatctgtcactcctgttggtgttggagaatacatgctggcttcttggtttggaatgatgccaatcactcttgctttggtgtacgttggaacaacactgaaagatctatcagatgtgacacatgggtggagtgagatctcgactactcgatggattctgataatatctggctttgtattatctgtggtcttgatcatctgcgtcacaaaaattgcaaaatcatctctggagaaagcattggccgagaatggagagctggatgtaggaacatcgcagcttcctgtggtagcctctccctccgatctgcaacaacctcttgtaatcaagattgacacgtcaaatgaagatcacgagaagtaaaagtgttgtgttcacaatctcggatgtacattctttgtctgttgagtctgtagactatatatacccatagctcttgtgaggccggtaaaagggtaaaaaagcgcaaaaagagagaaaaatgacggtggagtttgactgataggtaatatctttggtgaaaatgcaattgtagtatttcagttgggcctagccgctagggatgaaacgagcggaaaaataactcctgtttgtgtttttttttggtgaaaatggcgccagattcggaaaaaatgggaatcgccgaatcggagacggggttgtgatatgtggggtgtacccgaagtccgaacgaatcaatacgaacggaattcaccgaaaacagatcgtcaaatatggaaaataggacaggtcgggaaaggattacaacggacgtgtactatggggtgtatgtaactcatgtcagatttaataaaattatctaagatataatttatttatggtgttgcccattgtcctagcaaaactgtgtcttagaatacccagccagagata

SEQ ID NO: 9191 - DNA, 1652 bp, Zea mays
aaagaataaagagagagcagtatcagtactggactcttctacgaggagatcagctattctagatgcccatgctgaaaaaataaagcttcagatagatgagttctcggcagagcttgaagtgatccaatcttccatagaaactcttcgccagaagaaactaaatatgcaaaggctagaaagcaaacatattgacctggataaggggtgcacatacagccatgccacactgtcaaattgcgcctcaaatgcttttggagatgatttatacggcttcagagaatttacagtgttggatatgcaatctgctacgtgtaaattctcagagagcttcaggatgtggtcgcaaggtcgtgggtgccctgcctccgcccagcgtcccgacagaactgtgatgatctataagctgcactgccatagcattgagagcgtgaggcagttccagcaagaggtttatatcctcagcaatgtgaggcaccctcatctagtgacactggttggggcgtgcccggaagcgctgtgcctcgtttatgaatacctgccaaacgggagccttcacgaccgcctcttcagcagacgcagcagccgtcacttgccgtggagaattcgtgcacgcatcgtcgccgagatctcagacgcgctgctgttcttgcattcctgtaagcctcagacgatcgtacacggcaacttgaaactcgagaacatccttctagataccgaatgccattgcaagatagccgatttcggtatctctcggctattcacaggcgacgtgaaggattacccgtcggggggttctgagccgccgaaagggtcttttccctacgcagatccggagtacaagagaagcaaagtgttgacacccaagtctgacgtatactgcttcggaaccgtgatactccagctactgaccggaagacaggagcctgcacggcggcttgctggtgaagtaaggtgtgccatggcttgtggcaagctatcgtcaattctcgaccctgctgctgggcattggcctatggaggtggccggaaggctagcggaactgggcctgaggtgcagtgaggacagaagccgggatcgcccagacctgactgctgagactgtacgagagctggaacagctacacttgacgagggaggaggaacaagcaccctcctctttcctgtgcccgattatgcaggagataatgcatgatcctcaggtgtgcgctgctgatggggtgacctacgaagggcgggcgatccgtgagcggatggagttggagactgggcaggggacagcgcctctgaacaacctgaaactggagcatctcagtctcacacctaaccacgcccttcggttcgctatccaggattggcttcgtcgctctcgccgatgaaactttttgcctggcgtttcttttgggttttcgacctgtacagatttcacgtgtaaaggggtatagcatatctgcatatgaataatttgaatagctgttctaaggttttgtctgtacttcatgaaatgtatcaggatgcatgtacgcggcaatgcagcttcaggatcgatcgcataaatcttaaaataatactgtctatgctatgtccaaccatcaaaaaaaaaaaaaaagggcggctgctcgcgatctagaacccacgcgtccgcggacgcgtggg

SEQ ID NO: 9192 - DNA, 1219 bp, Zea mays
atttggggcaggcagcagagtgcgctgaacaccggcatggacaccatcgtctctctctcgcctcagatgcttcgccagcgccagggccaccagtctactgcatcatcatcatcatcagcttgggctattaccacagctaggatcggtcgccacctgtctactgcatcatcctgttccagcccgcggctgctcatcaagcagagggcgacggcggcatcggcaccggcaccggcaccggcaccggcacagaaagagaaagaggtcgtcttcgtggctggcgccaccggcagagttgggtcccgggccgtaagggagctcatgaagcttggcttccgtgtgcgcgctgccgtcaggaacgcacagagggccacgtcgctggtgcagaaagagaaagagcagcagctgcttgagcttgtggagtgtgacctggagaaggagccgcaggaaggcatcgtttcagccatcggcaatgcttccttggtggtgtgctccaccggtgcaagcgagaaggagatcctggatgtcaccggcccataccgcatcgactacatggccaccagcaaacttgtacaagctgcgactgctgccaagcaggcttgttctggggagttctgttctggaaaagacgagctgaagaagcactcatcgcaagcggcattccctacacgatcataaggcccggaggcatggagaggccgacggatgcttacaaggagacgcacaacctggtgttggcaccggaggacacctacgtgggtggccaggtatccaacctgcaggtggcggagctcatcggatgcatggccaccaacaggagcgcggcctactgcaagacggtggaagcggtggccgagatcaccgcgccgttgctgcccatggagcagctcctctccgcaattccctccaagagggaacaacgccctgcagatcgatgagctagacggcctcaaagcattgcatatgcttctaggttttgttttgtatgcaatgttgtgatatcagagagatatctaagtttttatattttatatgatgacgatgagaactaagtacaagtgcttttattttttattattcctaaagacaacttttgtatatgtaacatcatgaatgtttgaggtgtctcatgtgtaactttaattaatatcaatttatgcatgaaatattatggatggttcaaaaaaaccaccaaaaaaaaaaaaaaaactcgagagggggc

SEQ ID NO: 9193 - DNA, 1352 bp, Zea mays
gggggagaggcacttgaggcaggcagcagagtgcgctgaacaccggcatggacaccatcgtctctctctcgcctcagatgcttcgccagcgccagggccaccagtctactgcatcatcatcatcatcagcttgggctattaccacagctaggatcggtcgccacctgtctactgcatcatcctgttccagcccgcggctgctcatcaagcagagggcgacggcggcatcggcaccggcacagaaagagaaagaggtcgtcttcgtggctggcgccaccggcagagttgggtcccgggccgtaagggagctcatgaagcttggcttccgtgtgcgcgctgccgtcaggaacgcacagagggccacgtcgctggtgcagaaagagaaagagcagcagctgcttgagcttgtggagtgtgacctggagaaggagccgcaggaaggcatcgtttcagccatcggcaatgcttccttggtggtgtgctccatcggtgcaagcgagaaggagatcctggatgtcaccggcccataccgcatcgactacatggccaccagcaaacttgtacaagctgcgactgctgccaagcaggtggagcacttcatcctggttacatccctggggaccaacaagatcggcttccctgcattcctcttgaagtaatttaaatgcttattgtgctccgatccgatcctgctctctaaatatatatagattttatttatttatttatttattggtaattaataatacgatgaaatgcaaagcttgttctggggagttctgttctggaaaagacgagctgaagaagcactcatcgcaagcggcattccctacacgatcataaggcccggaggcatggagaggccgacggatgcttacaaggagacgcacaacctggtgttggcaccggaggacacctacgtgggtggccaggtatccaacctgcaggtggcggagctcatcggatgcatggccaccaacaggagcgcggcctactgcaagacggtggaagcggtggccgagatcaccgcgccgttgctgcccatggagcagctcctctccgcaattccctccaagagggaacaacgccctgcagcagatcgatgagctagacggcctcaaagcattgcatatgcttctaggttttgttttgtatgcaatgttgtgatatcagagagatatctaagtttttaccccccccatcatgacgatgagaactaagtacaagtgcttttattttttattattcctaaagacaacttttgtatatgtaacatcatgaatgtttgaggtgtctcatgtgtaactttaattaatatcaatttatgcatttaatattaccccccccccccc

SEQ ID NO: 9194 - DNA, 1199 bp, Zea mays
gccggcccggtcatcggaaggacgagcaaagtctgtttctttccccctctcttcgcctttttctgtttcttcccccttctttatactcgctggcagcggcgggcgacggtcgtggtgcactgctgccgcggccccacgcgtccggggcccctgatcgcccgcttcttctacaactatattctgtcgccagcgcacaagcggcagggggcacggggtagattcggagcggctcttggcttgcagtccagacgcccttcacccctgatctggaccggagggagcggctccttccgtcagttgttcttgctttgcctgggcctcttccgcctgcttcgtgttcttcacaggagccggtgacctcggacgatatcttggaggacaagatgtcgggggctgttcttgtcgccatcgtcgcctccatcggcaatctgttgcaggggtgggacaatgccaccatcgcagctgctgttctgtatataaagaaggaatttcaattgcaaaatgagcccactgtggagggactaattgtgtcaatgtcacttatcggcgccaccatcgttactacattctccgggccattatcagactcgattggccgacgccctatgcttattctctcctccattctggacttcttcagcggcctcatcatgctatggtctcctaatgtctatgtcctgctgttggcacgcttcgtagatggatttggtattggcttggctgtcacgctttgtgcctttgtacatttcagaaatagccccttcggagattagaggttttgctgaatacactaccacaattcagtggatcaggaggaatgttcttgtcatactgcatggtgtttgggatgtccctgtcgccatcacccgattggagaattatgcttggaagtgtgctttctcttgcatctcgtcatgggagcatggtgaaccagagtgtaccccttatggatccgattgtgacactttttggtagtgtccatgagaatatgcctcaagctggaggaagtatgaggagcacattgtttccaaactttggaagtatgttcagtgtcacagatcaagatgcccaaaatgagcagtgggatgaagagaatctttatgggatgacgaggagtccgcatttgatggtgcaggaggtgactatgaggacaatcttcatagttcattggtatccaggcaggcaacaagtgcggaagg

SEQ ID NO: 9195 - DNA, 3641 bp, Zea mays
  misc_feature (20)..(21): n is a, c, g, or t
  misc_feature (42)..(42): n is a, c, g, or t
tatgggtcaccctttgtggnnccggcacgggaagtccagggntccagcggctgacagatcggttccggctggttgctggcagatcgtttcatcgcttgtcacgacgctggcagcggggccttcaaatcctgtgtgtgccggggccggccgggtccggcggcgcgcaagtcgcaacggtggtggctgcagctgcggcgtgctccttcgctggaaagtggggcagtatcttttcgcatctcctcgactccgcctctctcggatctcgccgaaggacgagcaaaggcccctgatcgcccgcttctactacaactatattctgtcgccagcgcacaagcggcgggggcacggggtagattcggagcggctcttggcttgcagtccagacgcccttcacccctgatctggaccggagggagcggctccttccgtcagttgttcttgctttgcctgggcctcttccgcctgcttcgtgttcttcacaggagccggtgacctcggacgatatcttggaggacaagatgtcgggggctgttcttgtcgccatagtcgcctccatcggcaatctattgcaggggtgggacaatgccaccatcgcagctgctgttctgtatataaagaaggaatttcaattgcaaaatgagcccactgtggagggactaattgtgtcaatgtcacttatcggcgccaccatcgttactacattctccgggccattatcagactcgattggccgacgccctatgcttattctctcttcaattctgtacttcttcagcggcctcatcatgctatggtctcctaatgtctatgtcctgctgttggcacgcttcgtagatggatttggtattggcttggctgtcacgcttgtgcctttgtacatttcagaaatagccccttcggagattagaggtttgctgaatacactaccacaattcagtggatcaggaggaatgttcttgtcatactgcatggtgtttgggatgtccctgtcgccatcacccgattggagaattatgcttggtgtgctcgcgataccttcattgttcttctttggtttgacaatattttatcttcctgaatctccaagatggctcgttagcaaaggtcggatggcagaggcaaaaaaggtgttgcaaaagttacgggggaaagacgatgtctcaggtgaattgtcccttcttctcgaagggttggaggttggaggagacacttccattgaagagtacatcattggacctgccaccgaggcagccgatgatcttgttactgacggtgataaggaacaaatcacactttatgggcctgaagaaggccagtcatggattgctcgaccttctaagggacccagcatgcttggaagtgtgctttctcttgcatctcgtcatgggagcatggtgaaccagagtgtaccccttatggatccgattgtgacactttttggtagtgtccatgagaatatgcctcaagctggaggaagtatgaggagcacattgtttccaaactttggaagtatgttcagtgtcacagatcagcatgccaaaaatgagcagtgggatgaagagaatcttcatagggatgacgaggagtatgcatctgatggtgcaggaggtgactatgaggacaatctccatagtccattgctatccaggcaggcaacaggtgcggaagggaaggacattgtgcaccatggtcaccgtggaagtgctttgagcatgagaaggcaaagcctcttaggggagggtggagatggtgtgagcagcactgatatcggtgggggatggcagcttgcttggaaatggtcagagaaggaaggtgagaatggtaggaaggaaggtggtttcaaaagagtctacttgcaccaagagggagttcctggctcaagaaggggctcaattgtttcacttcccggtggtggcgatgttcttgagggtagtgagtttgtacatgctgctgctttagtaagtcagtcagcacttttctcaaagggtcttgctgaaccacgcatgtcagatgctgccatggttcacccatctgaggtagctgccaaaggttcacgttggaaagatttgtttgaacctggagtgaggcgtgccctgttagtcggtgttggaattcagatccttcaacagtttgctggaataaacggtgttctgtactataccccacaaattcttgagcaagctggtgtggcagttattctttccaaatttggtctcagctcggcatcagcatccatcttgatcagttctctcactaccttactaatgcttccttgcattggctttgccatgctgcttatggatctttccggaagaaggtttttgctgctaggcacaattccaatcttgatagcatctctagttatcctggttgtgtccaatctaattgatttgggtacactagcccatgctttgctctccacagtcagtgttatcgtctacttctgctgcttcgttatgggatttggtcccatccccaacattttatgtgcagagatctttccaaccagggttcgtggcctctgtattgccatttgtgcctttacattctggatcggagatatcatcgtcacctacagccttcctgtgatgctgaatgctattggactggcgggtgttttcagcatatatgcagtcgtatgcttgatttcctttgtgttcgtcttccttaaggtccctgagacaaaggggatgccccttgaggtcattaccgaattctttgcagttggtgcgaagcaagcggctgcaaaagcctaatttctttggtacctttgcgtgcaactattgcactgtaagttagaaacttgaaggggtttcaccaagaagctcggagaattactttggatttgtgtaaatgttaagggaacgaacatctgctcatgctcctcaaacggtaaaaaagagtccctcaatggcaaataggagtcgttaagttgtcaatgtcatttaccatatgttttacctatttgtactgtattataagtcaagctattcaacgctggttgttgctagaaatctttagaacaaagatgataatgatctgatctgatgttataatattcaaatctcaaataaagaaaatatcgtttctcatgttgtctttgcaagcttttgcactgttcaatatgatattaccacgctcggttcacagagaatcaattgcaagctcatattgtaaactttcttcatttggacgagttaccttgaacgcatttgatagaaggtgaattcctatcatatgaaatattatgcttaacttattgtattctagcttatatctccaaaataacaaaatgccactacaaaagcacttgccagaccgaggggattattgatgagaaatttgacgcctcgccaatccacttagaactgaaaccagccttgttcagttgttctagaaatcaaagaaattgcaagggattgaggaggatttgatttatagaggatttattaatccctcaatcccttctaacctatatagttctgtgatcaaatgaacaagacataaagggtgtttggattttatagactaatttttagtccctttattttattctattttagtctctaaattgtcaaatacagaaactaaaatagagttttagtttccgtatttaggcattatggattaagttggataaa

SEQ ID NO: 9196 - DNA, 2572 bp, Zea mays
cactgtgattttttatattaaattaaaactaaaattgtttattttttatcaacctaaagtcctaaagaggcaagccagagaaagtatgtagccgaacctccgcccgcccgcgacccaccacccgtccgcccgaaaccagaggcgggtagggttctagctgcaggcgacggccatggccgcctccgccgccgccccggcgctgcttcgacgcctcttctgcagctctattccagcctcctcctccgtactgcgcgctaccttttgctcctccgccggcttcggctcgtcttctccgtcctccatattcggcgacgccaccgaggtcgccaacgtgccaccgctcaccacgcccaacctcttcgtcagtggtaacgtctctccgcttcgccccgtcccaccaaactcgtcgcactaatacaaaacaggtgtgtgcgtgaatttaaagctgcgggcacttggataccttaatgctatgtttgtgagcaatccatttggggaactagggataaccagtaagctttatcgatgaagcacagcatttaaacctgttacagactcctagtttgcatcccatcctgcagctcttgtgccgtcaaatcctattgcacctgtgcgttttgcttgattttctttttaccagtgcataaaaatggccgtgttccatgtccatcggttgtagtttgccgctatgctcagtaataaacacttctctcagtaagaagcagctcccagttcattttcacctgtaggttttccataaaaataaactgctttgagggtcctgatttacattaacttgggcgcaggcctttcaaggttaacgacagatgagaagctccagggtgcatttgctcctttcgggaggctccttgaaggtacacgggaagctttcttcgagtagttatgttcaggcctctgttcatcctgttcctcactcttaattgtagtgtgcttttgtgttactgtgtgcagcaaaagtggtgacggatagagtttctgggaggtcaaagggtttcggtttcgtgagatatgccaccatagaagaggccgagagagcgcggcaggagatgaacgccaagttcctggatggatgggtcatcttcgttgaccctgccaagccaaggcagccaaagcccgctcctcagcaggacactggttcatcgcatgctggcttcacgacgaacaagactgtaggatggtgcggctaggctcattgatctgtcgcgatatttcacggcacaaaacttggattgcaggggtggatctaggggtgttcgtcacccggataaaatttataaattctttagaaaaacacagttaaagttcaagaaaatttgtatcatgtagcaaacctgaccttgctacccgataatattttgggttagattcgccatttattggatggtgggcagccgaaccgagagttcactttggcatggcatggccgggcaatgcagatagctgggacacagctctgctatgtttggcctcgttgtttttttttcattcggagatagcgcatgatgaccggtgcactgcaaagttgattatgctatttctaactctcttcgcatggttgcccgtcgtcctgttaccggtcttttgcaatttatgagacgctaccccacagatttggccgatatattccagaccagaacaacatatgagacacttcagataattggttggcgtgtgatggcacaacgtcgagacaatccaatttttttttagctaggtgaagctagtttcttggtttttaagaaactgagaatctaatttctataaacttagtcataaacggatatgtttgaaatcactttaatttctataacccagtattttaaaaatggggtgcttccaaacagtacatcagttgatgcatatagacgtagaaacgttactaactgcaaacttcgtgcccatagtaaacgaccaggcataaaaatggatcataatggatttagagtctgtttatgcatcatatcatttgagtgtgttttgaaggctgctatcatatggatttttaatgtattacattcacctcgaacggttagcactaaacgggtgagaaaatgaaataactgcacgatagcggatcgacaagtgaattacacggaatcaaacaacaatagtgtgcatcttacgaaacataaaaaaacaatagtatgaaacatcaagcaacagataatgaaacatgccaaaatttgagtcaaccttcaaataacgagtgttgtttagtattactctggatttatggtgggagtgtgcgtgtaacggggcacggcggaaagatatataggtgtccaaccgccttaaaacttgttcggttaaaagtgaattaaagacttgttccgttagagatagattgagagagattgaaaggaatttaattcccttcgatcgtcctcaaaccactttaaaccaaacagactcttagagtttgttcggttaggggtggattgagtgggattggaaaatattaaattccctcaatccatatcaaacagaacaaggccttacatatcacaataagcacgtggcaatcacatatacaagtgagcacctactgcag

SEQ ID NO: 9197 - DNA, 853 bp, Zea mays
aacctaaagtcctaaagccgcaagccagagaaagtatgtagccgaacctccgcccgcccgcgacccaaaagccgaaagcccgaaaccagaggcgggtagggttctagctgcaggcgacggccatggccgcctccgccgccgccccggcgctgcttcgacgcctcttctgcagctctattccagcctcctcctccgtactgcgcgctaccttttgctcctccgccggcttcggctcgtcttctccgtcctccatattcggcgacgccaccgaggtcgccaacgtgccaccgctcaccacgcccaacctcttcgtcagtggcctttcaaggttaacgacagatgagaagctccagggtgcatttgctcctttcgggaggctccttgaagcaaaagtggtgacggatagagtttctgggaggtcaaagggtttcggtttcgtgagatatgccaccatagaagaggccgagagagcgcggcaggagatgaacgccaagttcctggatggatgggtcatcttcgttgaccctgccaagccaaggcagccaaagcccgctcctcagcaggacactggttcatcgcatgctggcttcacgacgaacaagactgtaggatggtgcggctaggctcattgatctgtcgcgatatttcacggcacaaaacttggattgcaggggtggatctaggggtgttcgtcacccggataaaatttataaattctttagaaaaacacagttaaagttcaagaaaatttgtatcatgtagcaaacctgaccttgctacccgataatattttgggttagattcgccatttattgaaaaaaaaaaaaaagaagcggccgttcactttggcatg

SEQ ID NO: 9198 - DNA, 764 bp, Zea mays
ctgtgcggcgctcgcgcgccgtgttccaatcccgatactctactccaaccactccgcgggatcgtaccttacccagccttcttcctcgtcgccggctcgccatgtcggcggcgttcaaggcgttcctgaatagcccagtgggccccaagacgacccacttctggggacccgtctcgaactggggcatcatcctcgcgagcgtggctgacacgaaaaagcctcctgagatgatatccggcaacatgacaggagtgttgtgcgtgtactctgcgctcttcgtcaggttcgcgtggatggtgcgacctcggaactatttcctcatggtaacccacagctgcaacgagtgcgttcagctctaccagctgtcgcgctgggctagggcgcaggggttccttgagaagaaagaagaggagaggcccaagagcgaagattgaccgacggcccggccctaaaccatagtctgaccgaacaagcatgctcctgcttcggccgtacaatactacaatgtactcggttgtaccacaaaggcaatatttgatgcatgtacgtaacgtgaaaaaagcctcggttatacatgttgtaggttcatctgcggatactgaactatgaatttccgagcataaagcatcaatttccactgcaaaaaaaaaaaaaaaaagcccccacgaccccgaagcacatcccgtcgcatcccatcccactaccacccatctcgtcgtccgccgaattcgatccggttcttccaacccaagggcagtgatggc

SEQ ID NO: 9199 - DNA, 2195 bp, Zea mays
caaaaaacccaatcgtgcgcaatcaaattattctaaatgcaaataaatgacacacaattaattgaaaacttataccccttattcccatataaactaaaattattaatatacatatttcccaaaaaccttattttagcaattcattattgttttgtaaaatgagattttcttcacaagatcaaatccccgagattggatttgcaaatcaattcaaacaaaatatatgcttcggcatgagtgcaacaaacacttggaaaaattttatttattcaagaattgttcaaattatttatattaccattttactattagaaatcataagtatttttcctttctattgaaaaataataatataaactaagttatcttcaattgatggttttagggtgttacaaatggccccttacatctcggcaaagcgtaaaggtactcatattacaaatcttgctagaacagctcgttgtttatcagaagcttgtgatttagtttttgatgcagcaagtcagggaaaaagcttcttaattgttggtaccaaaaaaagagcagcggatttagtagcatcagctgcaataaggtctcgttgtcattatgttaataaaaagtggttcagcggtatgttaacgaattggtcgattaccaaaactagactttctcaatttagagacttaagagcagaagaaaaaatgggaaaattccaccatctcccaaaaagagatgcggcaatcttaaagagaaaattatctaccttgcaaagatatctcggcgggatcaaatatatgacgaggttgcctgacattgtgatcgtccttgatcagcaaaaagagtatatagctcttcaggaatgtgccattttggggattcctactatttctttagtcgatacaaattgtgacccagatcttgcgaatatatcgattcctgccaacgatgacactatgacttcaattcgattaattcttaacaaattagtatttgcaatttctgagggccgttctctctatataagaaatcgttgattaagaagaatagtgaattcttgagcaactgcgtagatttataggattaattactattcttttttgttttgcatagataaaagaagggaaatattgatatatattagagggtattgatatatattatgatctgatgtgatttcttggtatattaaatataagattaatacttcaagttgctgagttgagaaagagatgcttgaatcaaaagaattccttttttgaagttcaatttttatcagaggacaatatgaatattacaccatgttccattaaaacactcaaggggttatatgatatatcgggtgtagaagtagggcaacacttctattggcaaataggaggtttccaaattcatgcccaagtactcatcacttcttgggtcgtaattactattttgctaggttcagttatcatagctgttcggaatccacaaaccatcccgaccgatggtcagaatttcttcgaatatgtccttgagtttattcgagacttgagcaaaactcagattggagaagaatatggtccctgggttccctttattggaactatgttcctttttatttttgtttcgaattggtcaggtgctcttttaccttggaaaattatagagttaccccatggggaattagcagcgcccacgaatgatataaatactactgttgctttagctttactaacatcagcggcatatttttatgcgggtcttagcaaaaaaggattgagttatttcgaaaaatatattaaaccaaccccaatccttttacctattaacatcctagaagatttcacaaaaccattatcacttagttttcgacttttcggaaatatattggcggatgaattagtcgttgttgttcttgtttctttagtccccttagtagtccctataccggtcatgtttcttggattatttacaagcggtattcaagctcttatttttgcaacgttagccgcagcctatataggtgaatccatggaaggtcatcattgaattaactagtttttgaaatagtctttctttttttagcttagcccaattcatgcatgattccggataatcctcttagttggaaaactaaatagttcgaaaggcgtatgaatatacaacctagagttgtaggagagagaaagacttattatggaagaggtaaagtatatatgcattcaggcgggcca

SEQ ID NO: 9200 - DNA, 3254 bp, Zea mays
  misc_feature (2881)..(2881): n is a, c, g, or t
cttctagataagcagcgcaaacccctagtccggcgccgctccctatccatccccaaataatccccacctcccgctcatcctccgcctccgccgcccgccatggcctccctcacctcggcctccacctcactcctcttcccgcaggcctcctcatccaggagccgcgtccggctctccacctccctgggcttctccgcgcagccggcgcggctgcggagccgggcggcggcaggagggcagcggcgcgggagcctgctggtggtgcgcgcggcgaggggaaagttcgagcgcaccaagccgcacgtaaacatcggcaccatcggtcacgtcgaccacggcaagaccaccctcaccgccgcgctcaccatggtgctcgcctccgtcggcggcagcgcgcccaagaagtacgacgagatcgatgccgcccccgaggagcgtgcccgcggtatcaccatcaacaccgccaccgtcgagtacgagaccgagacccgccactacgcgcacgtcgactgccccggccacgccgactatgtcaagaacatgatcaccggcgctgcgcagatggacggcgccatcctcgtcgtctctggcgccgacggtcccatgccgcagaccaaagagcacattctcctcgccaagcaggtcggcgttcccaagatcgttgtcttcctcaacaagaaggacatggtcgacgacgaggagctgctcgagctcgtcgagctggaagtccgcgagctgctcagcaactatgagtacgacggcgacgaggtgccaatcgtcgctggctccgccctcaaggcgctcgaggccctcatgggcaaccctaccctgaagcgcggcgacgatgagtgggtggactgcatcttcaagctggttgattctgtggattcctacattccagtgccacagcggcagaccgacctcccgttcttactcgctgttgaagatgtcttctccatcaccggtcgtggtacagttgccactggccgtatcgagcgtggcaccgtcaagattggtgacacagtcgatatcgttggaatccgggacacccggaactgcaccgtgactggcgttgagatgttccagaagaccatggacgatgccatggctggagacaatgtcggactgctgctccgtggtatgcagaaggatgacattgagagaggcatggtgctggcaaagcccggctctatcacaccgcacaccaagtttgaggctgttgtgtatgtgcttaagaaggaagagggtggccggcactcacctttcttccctggttaccgcccgcagttctacatgaggacaaccgatgtgacagggaatgtgactgtgattatgaatgacaaagatgaggaggcgaagatgtgcatgcctggtgaccgtatcaagatggttgttcagctcatccagcctgttgcttgtgagcagggtatgaggtttgctatccgtgagggtggtaagactgttggtgctggtgtcatcaacaaaatcattgagtaaactggatatatcacatccaccacgagaattttccttgtttactcaaagcgaaatgctctgtagttgttattatgtgttgagttttaggggttgttcatgtgaaattgtagtatgacactctttcgccaagtgaatttgcataatttatgacattcacgacaaagatacacttatctggttgcaaatgatttggctaaaaagcaccatctactgttacatgtccaaaaaaaaattggttctgttaccctataatagtgttgatacgcttaaaatgaagcttgatgatgccacagacacatgaatgtagtctatctgcaccttttagactttagagtatataagcagcactataacatatacaatcttgcttgctggactttcttagcaaacctatcttgattcatttatattgcttttgtgatacgaatcaatttgttgcaaattagttactatgcaagcagccatcatgtcttttcttattcttccattatttttcacctgattgttttcgtggtctcgtggaatgtttgcttttatgttggagtagtagttttcttagagatctaaggtggttatcccagttctgtctgtgtatagcaaccacatctattgattgtgtttcttgtgtcggagcagtagcagatattctgttttttttctcaaactatgcaggagagctgtgtcattccgttaagatagagagtaaaaagtagaacggttcaagagcagaggctaaagacgagtacaaaaacccactcacactcaaaacaacctagaccagataacaaattcgctgcaaacaggaaagagaacctgaccagcagagcctgttgggatccatgatctgaagagggctggtgcccctgccaaacaccacaggccacactcataatggtttgatggagctcagcaatgttgggctgagccctgtcaaaaacacaagggtttttatgcttcgaaacatcccatcccacaagaatgatcagggaattcagtcccttgcgcaactctttgggagtaacctgatggtgtgcccccaccaggtagagaagcacttcgcctttgctgaaggtgctacagcagccaggtccaaactctacaggatcagggaccaaatttcctctacttgtttgttatgtttgatgatgctactttgcctcttctggcattcgcatcatgagcatgaactctattctgcgtgtccaatgtttattacattgtttgtggctctaaagctggggcagcactatggagatgaccacttggttctttctttagagagtagctgcgtttttctttcagaaatggtcctgttagcagcagcacagtacgaagatgggctggtctgacattcttgtttgtataactgttaatgtttgtgaantcacctctcatctttcaatattaaaatagaaattaaagggctcaagtttagtctattctattgttgtgtctgaagcaattcaccagaaactgaaaaattagcgtggaagtcgatcaaaaccttgcctccatgctagtcttcacttcttgttcaatcatacagattacagaccaggtctgatcttggcaggtctacttaacttacacctaatgctagactttcttggtgaaccgtgaatctatcttgattcgtctgttaatgcttcacgatttaaatcaaattgctgcaaattaattactatacatgtggccttcaggacaccgcttattcttttccttggtaccttttatggggcacttgatgtttttcatgg

SEQ ID NO: 9201 - DNA, 2027 bp, Zea mays
cgcagttttgaaactgaggtccagagctaagtttagaatgccttaaaacaactatagtatttgcaatatttcagttttgaaaacagagattttagctagcttgccaaacactattctatatataatactgcagtattttctcccaaaactgtgaaaaaacttcactcccaagcacccccttaactgtcgagcccgaccggagaggccgcccccattggacaactgtaccccacgccctctcgctgcgtttcccagtttcccttcttttagataagcagcgcagacccctaccctcgctcgcgtctccctatccattcccaaataatccccacctcccgctgctgctccgccgcccgccatggcctccctcacctcggcgtccacttcactcctcttcccgcaggcctcctcatccaggagccgcatccgtctctccacccccctgggcttctccgcgcagcctgcgcggctgcggagccagggggcggcagtgggcgcgcggcggcgcgggcgcctgctggtggtgcgcgcggcgaggggcaagttcgagcgcaccaaaccacacgtcaacataggcaccatcggccatgtcgaccacggaaagaccactctcaccgccgcgctcaccatggtgctcgcctccgtcggcggcagcgcgcctaagaagtacgacgagatcgacgccgcccccgaggagcgcgcccgcggtatcaccatcaacaccgccaccgtcgagtacgagaccgagacccgccactacgcacacgtcgactgccccggccacgccgactatgtcaagaatatgatcaccggcgctgcgcagatggacggtgccatcctcgtcgtatccggtgccgacgggcccatgccgcagaccaaagagcacatcctcctcgccaagcaagtcggtgttcccaagatcgttgtcttcctcaacaagaaggacatggtcgacgacgaggagctgctcgagctcgtcgagctcgaggtccgcgagctgctcagcaactacgagtacgacggcgacgacgtaccaatcgtcgctggctccgccctcaaggcgctcgaggctctcatggtcaaccctgccctgaagcgcggcgacgatgagtgggtcgactacatcttctcgttggttgataaagtggattcctatattccagtcccgcagaggcagactgacctcccgttcttgctcgctgttgaagatgtcttctccatcaccggtcgtggtacagttgccactggccgtatagagcgtggcaccgtcaagattggtgacacagtcgatatcgtcggaatccgggacacccggaactgcacggtcactggtgttgagatgttccagaagaccatggatgatgccatggccggagacaatgttgggctgctgctccgtggtatgcagaaggatgacattgaaagaggcatggtgctggcaaagcctggctctatcacaccgcacaccaagtttgaggctgttgtgtatgtgcttaagaaggaagagggtggccgacactcacctttcttccctggttaccgcccacagttctacatgcggacaactgatgtgacagggagtgtgactacgattatgaatgacaaggatgaggaggcgaagatgtgcatgcctggtgaccgtatcaaaatgattgttcagctcatccagcctgttgcttgtgagcagggtatgaggtttgctatccgtgagggtggtaagaccgttggtgccggtgtcatcaacaaaatcattgagtaaactggatataacatatccaccatgagaattttccttgtttactcaaagcgacatgctccgtagttgttattatgtggtgagttttaggggttgctcatgtgcaattgtagtatgacactttttttttgtcaagtgaatttgcataatttatgacattcacgacaaagattcacatatctggttgcaactcatttggctaagaggtgccatctactgttacatggccagttgcttcttggttgtgttgcattatattgttcatatgctt

SEQ ID NO: 9202 - DNA, 1269 bp, Zea mays
ctcgaggcccgccccggcggcacccccggaaattagttaggcccataagcgtgcccgttcttttcgcgtttcacggcggcgcggacagagagccatcggcggcgcactgaccgccggcgaagggtacagagatgaagacggttagcctcggcgcctctaggccttccactgtcaacttccgcatgccgacgagggacaacctcgtgcctatacgcgtcgacgtcgaggtggacggccagcgctacagggacgccttcacctggaacccgcgagatcccgactcggagataatcagcttcgctaagcggacggccaaggacctcaagctgccggccaatttcgtcccccagatgctccagtccatccaggggcaacttgcggagttccgctcctacgaggggcaagagatgcaaatcaaagagaagattgtgcctctgaagattgacctccgagtgaacaacactgtaattagggaccagttcttatgggatatcggcaaccttgatagtgaccctgaagaatttgcgaggacgctgtgtgatgatttgaacattacagaccctgaagttgggcctgcaatagctgtttccatccgtgagcagctttatgagattgctagtcagagcgtctctgttatgagagagaagcaaatgtcaaagaagggaaggcgagcaccagaattttcttcaaatagtaaagccgtgaacaatgcagtggatttgttcaagtattttggcagcaaagggagcgtcatccggaaaaggaaggaatggtacctgtatgagcctgttgttgatgtggtagctaatgacgaagacgggaaagaggaggctaataattctagcaggccgaagaaaagagccgacgaagagaaagctgcaagccttcagtccctttgaacacaagctgctgatagttctaaccaaggagggtttctcttgccaatcccagcagatgcctgcctttgacattcgtcgtaggatggcttcatcatagctacatatttgtatgtaagcggtgtgagaggtgttattcctgatgagggtcgggtgctgccctgtcacctagtctgacgacacccgtccagtactccagttgttgtatttgtatattcagttggctttgctgctcttgtttttacgatgcatgtccaaagctaaaggaagcctttgaactgaatgcccttggaagaacagtggcacatgtaatctcaggtagcattgcaagcgtccgctgccgcctgctggtcagcaatagaaacaataatat

SEQ ID NO: 9203 - DNA, 5650 bp, Zea mays
  misc_feature (1787)..(1787): n is a, c, g, or t
cgatcccgtgtgacgacgacgcgaggcgcggggggacaggaggtgccgtgccgcgccgagcggaaagagagagagagaggtggcgtccagtcagtcagtccagcagccagcgcttaccctcggcgggtggtccacgtgcctgtgcgcgcgcacgcgggcggcgacgggggatggttggcgccgcgcagacagcggctcggtacgcacggatcgtgatgcgtcctcgagcggggccccacgccgcccgtgacgtgctccctcccacaacaggccaggccctacgcgcccgcggtgggcccacccagcggcggctttgatgccttttgtttttgtttacggaatgggatcatgctcctttttttattaccctgctctcaagccctacgagcgcaatgccgcctagccgcccacgccttggacgtgaagcatttttttttcttgatcgaagccgccggtcccctctccccaggttgagcaattttccactccaccgtgggggagcggaagcgaaagcagtcctcctgccgaatcgtaacgcagccacgctaaaagacgagggacggcggcggcgcggtcagtcaaaccgctccctggcagcgccttgccgctccgcaaggcccggcccgctctccccattgttgccgccctttttaaccaccagtacaccacctcctcctcccaccgctattaaagtcccgtccgcggctccgccctcctcggtgtcttccttccacctgaaaacccaacccacacgctcgcgcctccgcgaagaaaaacaccgaggcccatggcgccgagaacgtcagagagagcgatgacatcggcggccgcggggctcgcgcgtggcgccggcccgcactacagaggcgtcaggaagcggccgtggggccggtacgccgcggagatccgcgacccggccaagaagagccgcgtgtggctcggcacgttcgacacgcccgaggacgccgcgcgggcctacgacgccgccgcgcgcgagtaccgcggcgccaaggccaagaccaacttctccttccctgcgtgcctgccgctcgccgccgcggacgtggccggcgcctgccggagcggcaacagcagcagcaccaccaccaccaccaccgtcgactccttcggcggcgacgtgcaggcgccgcccatgcaggccatgccgctcccaccgtccttctgcgccagcggcgccgtacgcttccctttcagcagctaccccgtgacgcacccgtattacttcttcgggcaggcggcagcagggtgccatatgctgaagctgccaccgacgacggtgactgtggctcagagcgactcagactcctcgtcggtcgaggatctgtcgccgtcgccgtcgccgtcgccgccggccgccgtgtcagcgacgagatccgccacgtttgatctcgacctcaactgcccaccgccggccgaggcggaggcatagtcgcggagttttgctgaatgactgcctgtagtttcttcctttctttcgtcttttatccgtagagagaatcggtaggcttaggacccctttgtattcacacggtgtcacggccacacctccgaactctggtactctgatatttagagtgaaactacgaacacgtggttcaaagttatcaaaagttaactctatatggtttatagtcatgagaaacggctaaaaaattctgcagctaacagaaactatttatttcctgttctcataaactgaagtgagatctaggagctgcaaagatcggtaaggcgtttcatttagcttgcttgcgatctatgcaacntcgcctttattggtcggttaaagatgtacttaccaaacggagtcgacgagtcgtctcatcccgcgtagacaggctcggtcatgtacgttgtccatttcagaacaaccgccgctacagtcgccgtgccgacggagaatataatttcgcgcaccgccaccgcgtgccttctcgagtcgttttcccggcgcagcgagcgctatggaactgtaccgcgtctgacacaacagggggcagaaaataataatgctggcctcctgcagcctgcaggccaggctgttggtgccgccgctaatccaaggtgacgcatgcatgtgtggataaggaacgagtaaacacaggagctgggtcagcttaatcgacggattaaactaatccggagcggcggcggccggcagggcagggcagcggggtggtggtggggcggcggatggacccgtcggtgcgcgcgtacggcgcgatcgtcctgcctgtgcgctgggctggcaggtcgtggttgccccctttccgctcgtgaccccgggagtaacgtgagcgtgtggtgtgggcgacgctccccccacgggccacgtgtgcgcgtcgctgccggcccgctgccggcctccgcgcccgggaccacgaaccaaccccgcgccgcgcgtgggaggcggcggccaattggctggcgtcagtggtgcgtggacgcggtgggaggaccagacgtgcgtggtccgcggcggacaggcgcgggcgggccccggcacgcggggcgcgcggaggccgtttcgccctcgccctcgccctcgggggcggggcccgcggccggccactatcggaaggtcgtcgcgcactgcgccaccctgcctcggctcggctcggctgtgcgcgttttctattgctttgccggcgcgcgtctgctgttccttgccacagttgcctcccgggattccgttgcgctgcagctacctacctacacgcagtgctccttctggcaccacccccctgtcgttacagatcaacgaattcgcttgctgtcatgaagaaataagtatacgtactgacaaatattactgcgcggctagaaaattatatttctttctcgaaggaacggagtctggaggagcaattcgagctgtggtctgttgcgacgctaagctctcgagcctgcatgctgaggcacggggcctgcccatcgggctactcgagttgggggttggatcttggatctggttacgctagacggctcgagccagcaacacgtcaaactgcttgtcacaccacgcactctccaaccaaaagttcgggggtgctctactttgtgaactcgtcccgtagtaggtaggccttaacccaaaaaaaaaatagctgggccgtgcatcccaaggagaacaaaaaggcccacacaggcgggcaaagcggcatcgggcaagtttgtgaactcgtcctattctgttaaaaatgtaggactggctaacacacgctggtttgtcaaacatcgatacgatgatatatatacacacaattttgatagtattctcaaagttgtacatcatccaaaatatataggttcaaatgagtaaatactgcattaagtaatatgaaatataggagatattacattgttgcaatatgaaatatatgagatattaccattctagttgtagtcatgcagtacggaagcaataggaagtcattgcatagtacaaatttgaaagaataaactataagttgctattaccgatttagggcatatttgtcttatgtaacaatcatgtttactttgttacattatgtgtctttttcccccattgtattgatattgtatgatagaaattttatgtagagattagatatgtacaaacgcatttgtaaaggattatgaaaaaaaacttgggaaaatgaaagaggaaccaataatgtaatcggaggctgctgaactttgttaaaaaagtgtttccctctattgcaagtagtatttcagcggtgatctttaatagtgtgtaactgttacaaatatagattgcagcacacatcagaagaactgtaagtttaaatacacgtgaatgaatgaaggtgtctgtatctagacatggtataaataacttgtgcaaaacagcgctgattaatccttccaagagtccacatagctcaaattattataaaagtgttcaagctaagggaatttcatttcatttcattttcagttgtagagatgaacatctgaggtcacaagaacaggaggcaaattggaagtttatggaaaatccgtctgaaatagaaggaagggaatgcagaggagtaattatgcataattaggggggggggggggggggggcagacaacaatgagtaacacaacaaaaatgtaaccacttcatgaaactaaatgcaggaggaatgtatatgttctcgtaatgtcgttactttgtacagagcttaaatgctatttagcaaaaaagaacaagttgcttcaaattccaatttcttgtcctgtcaatgaaagagcatataatctaaagaaaaggtcaggacagagtcgtcgacgtttttgttctataaaaattatgtctactgcatctaacccaccaaaccaaacagctgtggctcttttttgtgtggtctggtcgtttcatgttagacgtgacgaacatcgtatctgctgtttcctttcctctgcagcctgccctgccccgctcaagtctctccatcccggcgctgctgtttcctctgccctgaccctgacccgtcgtatccgcgttcgtcacatcgtcgcctaggctcatggtggcagcggcgccgcgccctgctgccctggcctgggcctggggttgcagttgcacaccgtcggcgactcggcgtggccgcacacggcaacaaatctggaagctaggggggatcaaagatgcggtagcaatagccctagcaggtagcagctactcctaattgtttttaaaaaaatagaacatatataatattttgttaccagtctcagtgcaaaattatataaattttaaatgctactacattatagaactgaaatagataaaacgcgtgtcacttgtatcaacgtcagtaccccacggagagtgaggctgtgagcagcgaaccccacggaggccccgaacctgcaacagcagtaccaccgccgccgtcctaccgccgcggaccaaggtcaaaaaagcacggtgacgtgacgccatcttttccgctgcaggcacccaggccaggcagccgctcggaccacgtgtgcgccggcccgacctgcccccatcaccgcgacacgctcccacgtaacgtaaagtcgcgcggcgcccacgggccacggcgactggccaccacatcggtcgatcgcctatgcccacggcgcccccgacgacggtcttcacgcccggagtcgccggccgctgcctcgacagggctgcctacgccatcgctgtagcgccactgtagcattcgccgcgtaggactaggggctccctgaaagcccatgctttttttttttccattcatcgcggcgggtgagtggtgacgactgaagatccgttttttcctcttgctttgcttgcgatgcatgtgccggatgattagtgttcccctctctcgctgcacgctgctgctccaaagcccaaaggagtcgcatggcggcgctcggcgcggaatacggcaaagcggctttggtgccttgattgcggcgaacgcggcccgatccgggctattcgagtagcgtgcagcaagcctaaacaatagcgtgacatcagcctgcactgcactgcactgcactgcactggagccctgcccaggaacaggaatccaggatcacgtgaggtagcgtagcggcgacctgaaggaccacgggcgggccacccggcacgggcacggcacggcgcc

SEQ ID NO: 9204 - DNA, 2127 bp, Zea mays
aaatcctacctcgcctcgctttcccatcccatccctccccttccagccttcctccacggtccacgccaccagtcgagtccaccgctccataactccattcctccggcctccgcacgccctacttctccattccgcaaagaggggccaggcgtcaagggcgcggccgctctctgctggacgcgcgtcatgggcgccgccgagaaccccccggcgccgccgcggcaggagtctgcaccagtcaggggagcggctccgacgccggcgacagaggcggtggagaaggtggtcgtcgtggaccaggcgccgcccccgcaagcggcgtcgaggctgcaggcgcagcggccgctggcgccgctgcaggtcaccacgcaggcgccgccgccgcccatgacggtggcctccggcgccgtcgagccgccgccgcagttggcagcgtaccagcctgtcatgcagcctccgcagcaggggccgcttccgtcgctcaactcaagcaagtacaccaacggcataacgctgtgcctcttcctgctccaccttgccgccgcggcagccgccatggggttcttcgtgttcaagaccgtccaggagatcagccagcacccaaggtcgcacgacgcgcagcgagagcgcagcctgctgcgggactggctgctgcccgtggagggcgcggtggcgctcagcatcgtgctggccttcgcgtggcagaaggccgtgcgcgcgtggccgcgcgctatggtgcgcgtcatcctctggtccagcttcggtgtgaccctggccgtgggcgcgctgctcatgtgcttctcgatgctggccactgtagggctgggcgtggcgatggtggtgttctccatcggcaccgggctgtacgcgtgctgggtgacgcggcgtgtgggcttcacggcgcgggtgttcgagcgcgcggtgcagccggtggataagttccacggtttgaatggccccgcgtacctgatggtggcggcgggcttcgcgtggatctccgtgtggtgcgtggcggtgatcggagctgtgaacttccgcttccccgggctcaccatcctggggctggtggtcagcctggcgtggaccgccgaggtgatgcggaacgtggcgaacctgacggcgagccgggtgatcgcgctctactacctgcgcggcatgcagtcgagcgtgcagttcagcttccaccgcgcgctgtcgcacaacctcggcagcgcctgcctgggctcgctcttcgtgcccaccatcgaggcgctccgcatcctggcgcgcgggctcaacctgctggagggcgaggacgagttcatgttctcctgcgcgcactgctgcctccacgtcatgaacgccatcttcagcttcggcaacagctgggccttcgtccacatcgcggcgtacgggcgcgggttcgtgcaggcgtcgcggagcacgtggagccagttcgaggcgctgccggggatggcggcgttggtggactcggacatcaccagctccgtgtgcttcctgacgggcgtgacgagcggcgcgctgtgcgtggcgctggcggggtcctgggcgttcgcgacgcaccggcactacacggccaccgtgtcgctgctggccttctacgtcgggtacctgatgacccgcatcggcatggcgctgccccaggcgtgcgtcggctgctactacgtctgctacgccgagaaccccacgtcacggctcttcgacggtaacataccgaaccagctgagcaagatgcaggaaagccgcggcccgtccgtgccgacgccgcggttcccgcaccgccagcacgtcggcgcgtgagtgagacgacggagcttctttttcctcgtgtgccaccgccgctcgtcggtgtggcttgatccggatgagggcggcggctcgtacggcggtctggagatcaaattttctttttctagttttgtaaatttatttatccattttttagctgacagaaatggtgaatccccaatattttgggtgtatgtagacagagtactattcttgcataggatttatgtgaatattttaactaactgaatcagaatcaggctttgtcctaaaaaaaaaaaaaaaaataaagccataaacaatagctgtagctcacactttgaggctttgtattgtcag

SEQ ID NO: 9205 - DNA, 2245 bp, Zea mays
  misc_feature (145)..(145): n is a, c, g, or t
  misc_feature (2090)..(2090): n is a, c, g, or t
tgatatttactttccagcattgatttattttagagggcgcatctatcgtgcaggaatactacactttcacgagcgggactttgctaaatgtctaatatcttttcctattggtagtggtgatgttaagttcacaggaaaagaaganaaggaagaagctactacttatatgattgagcaagctgtgggtttccatcatcatttggctttgcccttcctcctcgtttttctttgagattggcaatcttatccacttttttactttgctccacacagatgaaggcaagcttgtcttcgctctatcttaccaggaaagtaggaaatacacacccctgttggttaaagcagactcgtatgcctattctgatgcggagggatcagccacctctttctgttcgaaagattccagacctgacttaaagccctctttcacaagacatttggttgatcaggatttggtaaacctagagatctgattctgggatagggtaaatctgttctttctgcttctgcctatgcttgtcttttagcattcgcctatgcggattgagatagatattgatatctatctgggcgaaagagcacaaaagggagtggtttggccgctaagaacttaactcctaggcgatggaaatatagaatctatgtatggctcagccatctcttcttgaacttgctgtggaacttctctatctttgtcattaaaggctatgtatccctttccctcattagtactcaagcactagaaccgcttactgattcaacgacggttactgatatgccatgttgatcgtcatttctcgttgaatggttctccctcctgtagctctgtgggcattcaaaccagagtttatgcggttggctatgtcccttctagaactgctgtttttagcaattgacagaaaaagttccgtaatcgtcctattttttcgtccttgtggaagcgagaaatgccgcggggataaatatagtgatgcgatgattccatgaatctcagaaaaggtaggggtcaaggaccttatgggactgcaatcgtgcctgccaattggggaaggacgcgggcctggcaaccgctcggctctagtaagggaaacaggtatgtctcacatcattgctcgaagactggaaaaacagcaagttagctcagttgggtagagtgctggtctgtcacgccagaagtcgcgggttcgaaccccgttttccccgcacgatctgaaactaatagaatagaaggggccataaacaggagagtcttgaccaattcatttggtgtagttgaaataacggaattggaagttgttcggtcaagtataggaaattaatataagaatgaataactttctcaatggtttattttttgtcttttatttatcttaatattcattccattcaggccattcgcaagcaagcacgaaaaagcttctatttctaaacggaaacgcccagcccaatacatcgaaactcattacccatgggcaaagaaagccagtcgagaaaaaaaaaaaaaaaaaacaccgtcccgcggattcggaattgtaaccaagcatcctgggttctatacccgattcaacactagagcatgcagccgatcctggatacagaactatagaaagtgtgcagtgagggatctttattggtagccagtctttcacttccgcctctccactcccatgcctttcttggtcggaccaacccaaccggcgatttccgacaagtctttctgcttagagcaagaagcggaacaaaaatcaagctttctttattttcatttatggataaccaatccattttcaaatatagttgggagattttacccaagaaatgggtacataaaatgaaaagatcggaacatgggaatagatcttataccaatactgactacccatttccattgttgtgctttctaaaatggcatacctatacaagggttcaagtttcgatcgatatttgcggagtggatcatccctctcgaaaacgcagatttgaagttgtccataatttactgagtactcggtataactcacgcattcgtgtacaaacaagtgcggacgaagtaacacgaatatctccggtagtcagtccatttccatcanccggccggtgggagcgagaagtatgggatatgtctggtgtttcttccatcaatcatccggatttacgccgtatatcaactgattatggtttcgagggtcatccattacgaaaagactttcctctgagtggatatgtggaagtacgctatgatgat

SEQ ID NO: 9206 - DNA, 2762 bp, Zea mays
cctgcaggctctagtggataggatagaaactaaataagtttgtttgcatgcctagaattaaggatagaaactagataagtttgtttgcaagcctagaattaagggttgtttgcatgcctagaattaagggttgtttgtatgcctagaattagggagcagttagctccatgcggttaggcctaggagcctatatattcctataaccagacctgagttgggaattaagaaagatcattatcctaatctctctctctctcaactaagccgacggcagaggggcataacctcgccggagaagacgatggaccgcggctacgatctccatagccgagggccacctaccctagacactaaggcccttgacaacctgatatcacggtcacgccgatcctactcatccacctccgccaacgccgagtccactgtcaccactccactcagccttaccgcgccaccagaaagcccaccaccctccccaccttcagctgcatcctccagttcacccatggccgaaccatccaatgccgacctcgccaagatgatcgagcaactcacgggtttcgtcgccacgctgcagtccgaggtcaccgcgctgaaacgcgacaaggagaagtcgtcgtcgacggtcgggggcgatgttcctgacggccagcaccaccacgatcggccacccaaattttagaagatcgattttccccgcttcgacggcaagaccgatcccttgatcttcgttaattgttgtgaatcctacttccatcagcagcgcgtcatggaggagaaggtctggatggcttcataccatcttgaagacatggcacagctctggtatatccagctgcaggaggacgagggcactcctcgatggagtcgattcaaagatctcctccacctgcgtttcgggccgcctatccgctccgctccactcttcgagctcgccgagtgccgacgcacaaggtccgttgaggagtaccaaaaccgcttccgagcgttgctgacccgcgccggtccattggaggaggggcagcgcgtccagctcttcacgggcagcctcctaccgccactcagccacgcgtttttgaaaggacagcctgtgttgggggcttgctgcagaaccaatattgttggatttcacattactgattttctgaggcagtgtctaaaatatccctatcacatgacaagtattgcatgggaaaaggctgaagagctgaagaaggagcattgttatatagctcttgattatatggcagagttgcagatatttaaaaacaataaggaagaagctgatgacaaaatgaggtattggcaactaccatgggtgcccccaccaaaggaagaaccaccatctgaggaagaacttgcaaggaaagcagctttgaaggaaaaggctggtcagcgtttgcgagacatggctgctgcaaagagatctcagaagatagtggaactagaaaaacaactttcctatctggaggaactaatggaacaacttgatgaagctgaggaagaagaagcaacaactattctaggtagctctggatatctttcccagcaggaaatcagatctgccattttaaaagcatcacaatctttaaggaaagcaaaaggggagtccaatggcaatgatgagaaaacagatgcctcagcagttgataagtatccacttgtatctgttcctgatgagacactgacgccagaacagttaaaggaaaagaagaaacagatattacttaaaaccacaacagagggcaaattgcgcgcaaagcagaaacgtgctgaagaggaggctttgcgggagaaacaagaagaaaagaggcgtgcggagaacccagagttataccttgaagagcttcgggcccgatattcagaactttctgataaatttgagcagaggaagcgacagaaagttaatggtagtcagacaaatgggaaccatagttcatctgcaggtgtaggccgtggagaaagactaaatgcagctcagaaagaaaggatgcggctgcttgcctcagctgcttttgatcggggcaaaggtgaggacacttttggaatgagagacgaggattggttagtgtacaacaagatgagcaaagacaatgatgatgacagcaatgatgatgatgaatcggaacttgttcgaatttcatcgaagctccaggagattgatcctacatttgtgtccaacataatccgaagctgttcaactgactccggagccacccaaagtccggccactaaccgctgaggattacagaattgccattgggatcgagcggttccgttgccctgaagtcctcttccagccaggcatgattggaatcgaccaggccggcatcgatgagatggtcagcatctcactcaggagattaatggaggacgagtctgtgaaggagcgcctctgccagtcgatccttgtcactggcgggagctccctgttccctggcatgatccctcggctggagtctgggatacggcaatatcggccctaccttgctcccctgaagcttgtcggagcagctgaccccattttagacgcgtggaggggtgctgccgcctttgcggcatcaagcaagttcggcaaacaaacgttcagcctagctgattacggagagcatggagagaacctgtttcatcggtacaacatgtgtttactcactataacctgtcacacaggaaatgacatagtgatcgtcgaaccatctcagcaggctatttatttgacagctgatacaaattgatttagcaacaaagtttttcaaaactgc

SEQ ID NO: 9207 - DNA, 1374 bp, Zea mays
cgggtgttcaactgggactccggagccacccaaagtccggccactaaccgctgaggattacagaattgccattgggatcgagcggttccgttgccctgaagtcctcttccagccaggcatgattggaatcgaccaggccggcatcgatgagatggtcagcatctcactcaggagattaatggaggacgagtctgtgaaggagcgcctctgccagtcgatccttgtcactggcgggagctccctgttccctggcatgatccctcggctggagtctgggatacggcaatatcggccctaccttgctcccctgaagcttgtcagagcagctgaccccattttagacgcgtggaggggtgctgccgcctttgcggcatcaagcaagttcggcaaacaaacgttcagcctagctgattacggagagcatggagagaacctgtttcatcggtacaacattgtttactcactataaccggaaaatgacatagtgatcgaaccatctcagtcaggctatttatttaacagctgatacaaattgatgtagcaacaaagtttttcaaaactgcaattgatatttttatgtgattggaattggagggttcaaatggtgaaggaatttcataaccctataatatgtgtgcctttttttagtcttcccagggcacaacttgtttaagaacaggtgagctgaatcctctataaagctaaggtcactatcgactatatggatggataaaaagaacaaagttgtccatggttacttgcataggggcatttctttttcattttcttttttagtctctattttgttatatctaccattaattaaaaaaaggaacacagtcttatatagggggtatgcctttttattttatttttaaatcttctgtttcttcagggttcctaaatctattttttgttttctttaacacacatgcggtactatctatagtccctaaaaaagcacaaaatcaacccgtgattactttatataagggaaattgatggtgaacaatggcattgttcgtaaaagaaacgatttttagcccctagactctatatcaagtatcatgcatgctgtggaaacgcggaacgcatttttaggagatctcgtccccgtccctacttctactgttctacatcgggtgggcgcgcacgagggatggtcctacagctctccatagctcctcccaagccaagcttttcggagtttgatttggatcgggtgtggttcctgcataatcatgagcgagatcagaaagctaagggcctgttcgcttctttcggaacgacgggccgaaataattttctatcaaaactattcactaatttatataatttttgataagccggaacagtttcatgtgcatttcaaac

SEQ ID NO: 9208 - DNA, 2195 bp, Zea mays
cattgggtacctcgaggccggccgggttgcaagccacaaatatttgcaagccacaagccaagccaagcaaaaccctaagaaacccaccctccctccagtctcctcgacccccgccgccgccgccgccatcacaacccagagcaccccctccccaccccaccctgtcccgatggctgcggacgccgccgctgcggcgatgtccgcgacttccctctgcgacgatctcgagcccgccaccgtgcgcacccgcatccgcgatgtcctggccgcaggtgccgcgcgtgccggggaccgcgtcgtggtcggtgggtgggtccggacgggccgggagcaggggaagggctctttcgccttcctggagctcagcgacgggtcctgcgctgccacgcttcaggccatcgttgacgccgccgtgcacccgctagcgcgcctcaccgccaccggcacctccgtcctcgtcgagggcgtgatcaaggagccgcccgaggggaccaagcagaacgtcgagctgaaggtcagccgcgtgcttgaggtcggcgaggtcgatgccgccgtctacccgctgcccaagggcaaggtcaaactcacgctcgagaagctcagggacgtcgttcatctccgttcgcgcaccaacacgattggagcggttgctaggattaggcaccagttagcctatgcatcacacaggttctttgatgagaatggatttctctatgtacatacaccaataataactacgagtgactgtgaaggtgctggtgagatgtttcaagtgacaactttatttagccaggctgagaaaactgagaaggaattgagagagaacccaaaaccttctgattctgaaattgaggcagctaaagttcttgtcaaggaaaaaggtgatgtggtcgcacagcttaaagctgcaaaagccagcaaacaagagatatcaactgctgtcgatgagcttaatagggcaaaggaaattgtttcaaaactggaggagaggttcaagttaaagcctgggattccacgcaaggatgatggttcaatagcttttgaaaatgacttcttcaaacgtcaagcttttttgacagtgtctggacagcttcaggttgagacatatgcatgtgctcttagtagcgtttatacctttggaccaacattccgggcagagaactcacatacgtcacgacatttggcagagttttggatggttgaaccggaaatcgcatttgcaaacttgcaggatgacatgaactgtgcagaaaaatatgtacagtacctttgcaagtggctgcttgaccattgccaggaagatatggagtttatggtgaaaaattatgataagagtgcaattgaacgcctggagcttgtttcgtcaactccttttgtgcggatttcatacacaaaggctgtggagctcttgaaaaatgttaccgacaagaagtttgacaacaaagttgaatggggaattgatttagcctctgagcatgaaaggtatttaacagaggatatatttaagaagccagttattgtctataactatccgaaaggaataaaggcattttatatgagactcaatgatgatgacaagacggtggctgcaatggatgttcttgtgcctaaggttggtgaattgattggtggaagccaaagggaggaacggttagatgttctgaaacagaggatacttgatgctggcctgcctttggaaccctatgaatggtacttggacctccgtcgctttggatctgtaaagcacagtggttttgggttgggttttgaaaggatgattctatttgcaaccggaatggagaacatcagagatgttatacccttcccaaggtacccaggaagggctgatctgtgatctttggagacattggttaaacagatgcgagttgaattcaacacgcgactagtgattttgatatgttttcaccgttaagtttctacttcctaatttgcacattttaattataaattgtggaactggtacggttgtcaaaaatcatgtaattttctggttgtattttattatatttgtatctctgatcaaacttctgtctttgctagttgtgctcaacaggcaatgtttttttctaaatgaaaaaaacaggtcaaaactgaattgtttaattaattgacatttcagtgtaaacaaaaaaagttctcgctatttaggataaagttaatattttttactgcct

SEQ ID NO: 9209 - DNA, 2934 bp, Zea mays
  misc_feature (1667)..(1667): n is a, c, g, or t
tatctaccaaagttaaaaccacctattatgatttaaaagtgagagtgtagacgatttctacacaataacgaacgctactagacctaaccatgggctaccctccgcgccccgtccgaaaaaacccgatccgatccaatttaatccaatcaatacgacgggtaggtacgagccatagtttttgacatgtaacaatccacgagtcaaatacagactatgaaaatacctgacctacgcaaaaaaaaaaacagttaacttgaggctgccgagtgaggaaatggggaaagatagaatcatcctcctaaggatgatgtataggagaaaggttatcgaagaagactttcccacactggtgtgggtgctagaaagttatggagattgaccgttgatcaagttaatgatgatttgaaagatcggactttatctttgattcatatttaatagagtgagatactacaatatgaaggaaggcgaacgaaacagagaatgaaggttgtgaatgaacccaaacattcgctttatttatagattgaattttagtttttttggatttttagaatttaaactgtttaaaacggtgtggactaattagaacgtgtcacatggctaaatgcagttggtactaatcaatttaaattggtaccaattaaaccatcaacacatcggtccgccaacggggccacataatcgattgaccgaaccaaccaacttagagcccgatcagtcgatatcgactgctatacatattggcaccagacttgactagctgttttttttgcgtggcgagagacagagtaaagttcatgttgacatcttgatctaggaaatacgtgacccagcaatttgttttcttcgaaaaaggagaaggggttagggaaggtcgcttttagagaggatcggcccactaaactgacaaaaaaagaactgagttgcctctccggtgcgctaatctgacaaaaaaagagagattgagttgccttttatttaaagtataggttgtgagtcatttgaatttgtcaaaacaaaatgatcatatccttccgaataaaaccaatcgagctttgtgttataataattttaaaataccagttaaattattaataaaaagtataaaattcgaattttgatatatatgtatgtatcttataaaagagaacggaggaagtatgacttttcgtcgggtcaaatataagtattttactagtatgaaatcccaccaaataacagaggttagaggacattattacttaggtcatatatatttggaccctcctagctaattgtttgttagtgactaacaattagtcaacaaataactagtaactaggaacaatttagttagggtatgtttagagtcttgattaatagatgttttttctttatacgatctattagcacctattactaaagtcaaatgactaatgagtaaccaatttgtcagttattcggctaacaattagacaatttattagttattctgtttggaagccaaagtgctaaaattagctggcaaatcgtttgccacacggatccaaatagactctaaattgacttgttaacaactaaaacctagagtcgaattccacaactcaattagaattagctatggaaaaagtaaaattagtaaagggaaaggacttctagaatgaaaatctgccgtggctgatatntcaccacacaattggtcggaatggataaggggagaaaccctcataaaacggatcccagatctcaacgcaagaaaaacattttatcttctctatcgctactccaagagtacccaatcaccgagccatggccatctcagtcactgccgtggccgccttgcccgctttctcggctcaaagaagcctcccgcagccgtcccgccagagggtcgtagcgttcatcgtcgtccggccggtgcgcgcgcaccgccggtttgtgggcgtggcggccagctcgccgcccacgccgccggatctcgcaaagaaggtgtccgagagcatcaagcaggcccaggagacgtgcgcagatgacccggtgagcggcgagtgcgtggcggcgtgggacgaggtggaggagctcagcgcggccgccagccacttgcgcgaccggcagaagggcgccgacccgctcgaggagtactgcaaggacaaccccgagaccgacgagtgccgcacgtacgaggactgaaccacgcgcgcgcgaggttggatcgctgtcacttgatctagctagcagcttagctcggcatgatggcgacatgtgtagacatgcaatggatcgggtatgatccttcgttgattcagtctggcttggtgtggaataaaacgaggtttgctgtttattataagtaacatttaggagctcctactgtagttccaaggcaggtgtaatccttagaaacatttgatggtgtgcttctagccttgtagtactcgatatgtgcaattctgtaaagtatcgcagatttttcacctgagcatgatattgctgcaaataaaaaaaaaaaactaaactggctaatgtgtggccaattttcaactgtttgaacgagatgaacctgtggtcctctaaattggcttttaagggagaaacacttgctagatcgacgcaccttcattcttgaaccaagagatctcatcgctaatatagaagctacttcacccaggataatttccatgtccaagctctcttcttgcttgcagcatttgagcttgagcaatacacttgctatagatgcaacaaacaaattccctttacaaacaggctctgaatataacaaagaaacaagtctatttatttatttatttatctgttccacttatggtacttataaccaaaacgaattttgaaagaaaattaaccaacacagaatgaccactgtatagacaactccaaggtatcacaatttaccttgtaattatcaacaatcaaaatgcttcaactaaggag

SEQ ID NO: 9210 - DNA, 1231 bp, Zea mays
gacccactcacccacccacccgcgcgccgtcggcgtcgccatcaccgtcgcaccgcgcgctgctcccagcctgcacgagaccattacctagaacatcctaatcgaaaagattgactcccagtaaaacgggcagcactgcacggcacgacagaacccactcggccactcccgcctctctctactatacccagctactcgcacgcagatccacccacccacccatcgttccttccgttccgtccgtccacttgccgttgccgaccataacccgctcccggaggacggcgggatgagggggcaagccaacggagtggaggaccgccggcagcggggcgacgaccacgaggcggacaacgacggcgaggaggcggaggaagaggagggcgacgacgagggccgccaccggggccagggcccgccgcagcagcggcgccaccaggcccagaggccgtactccggcccgcagcagcagccgcgcccgccgccgccgctcgccaggaacgtcggctacgtcggcaagcaccgcctctccgccgccatcgcccgcttcgaccaggagctccagtccctccaggacgagctggacgagcttgagaccatggaatctgcgtccgcggcgtgccaggaagtggtcacgagtacggaagggaagcctgacccgcttcttcctgtcaccagtggcccggagaactcgtcttgggacaggtggttccagcgggtgcgctcccgcagcaacaaatggtgggcatcgaaaggccctgacttctcgtagctcctgcaaacaaagcggagaccatcctcaccagtcgtgtgcagattagaatgaaacacgttgagatgtatcgtccattggtgtcctggggaaacagaacaggcggcggcggcggcgagtgcggtgtggctctcgcaacgcctgatagtttttttttttttttggagagaatcattgtgtatgtagtaatccctaacgaggccgaacatcgatgcatccacatcaaggcctgggtgttgtgtttcctagagattctgactcactaggtcggattcctgatggtcatgcgatctcgctgttctttcttcaaacgtgaagaatcacattgtctttgaaaagtttcagaaaaaaaggagaatcagatcgaacgttgttaaaaataaaaaaaataaaataaaaaaaaaaataaaaaaaaaacaattagaaaataattataataaaaattaaaattaaaaatgg

SEQ ID NO: 9211 - DNA, 2318 bp, Zea mays
gcacgagtccagctccaacatctctctcctagctacatctctccactgtctgtttgcctgtcgaggccgggcgccagcagcaacaatggcattgggtacctcgaggccggccgtcctcctctcccccctggccatgatcgtcgtggccgccgccgtcatggcgctggcaccggcgccggtggccgcgaccaagtacaacatcaccaagattctggcgccctacaaggagtactccaagttcaacgacatgctgtccaagacgcgcctcgcgtacgacatcaaccggcgccagaccatcaccgtgctggccgtcgacaactccgccatgtcggcgctcgaccactactcgctgcagaccatccgccacatcctcgagctgcacgttctcgtcgactactacggcgacaagaagctcaagaagctcgcccatggctccaccgcttcctcctccatgttccaggctaccgggtcggcgtctggcatgtcggggtacgtgaacatcacccggaaggacggcaaggttagcttcatgacggaggacgccgacgacaccgcgaagccgtcccggtacgtcaagtccgtcaaggagttcccctacgacatcgccgtgctccaggtgagctccatcatctcgtccgccgaggccgaggcgccggtgccgcccccggcgcccgtggacctcgaggagctcctatccaagaggtactgcaagtccttcgcgtccctgctctccgccaacgccgaggtgttccgcgccgtgaacgagaccaaggacaacgggctgacgctcttctgccccgtcgactcggccgtcgcggccttcgcggccacgtacaagaacctcacggccaaggccaaggcggccatcctcctctaccacgccgtgccggactacttctcgctgcagctgctcaagtccaacaacggcatggtcaccacgctggccaccgccagcgacaagaagatggactacagctacgacgtcaagaacaaaggcgagacggtcacgctgcagaccagggtcgtcacgtccagcgtcaccgccaccgttggcgacatggagccgttggccgtgtatgccgtgaacaagttcctgcagcccaaggagctcttcaaggtcgtcgaggcgcccgcgcccgcgccggagccgtccaagaagaagaaggctggtcgcggcgggagtgacgacgattcctcggacgattcgggagattcgaccgccgatgctgagaagggcgacgcagcaccggctctgctcgtgcgatggctagtcaccgcggtcgcgacagcgggagttgcatatgccctgatgggataaacttctatcagtcacctgaattatattcggactttcatttgatttgagtattctttttctttcagtgttaaatttgttttcacttattataatggtgctctcgatcggttaaggtatataaactataagagtttattataagctttttatccaggccaatcatgcagaaacagatatatagttcaaacacattgcttccaacgcaaagacctgcttgtactttctgacctatgacttagagcgcgatgctccaaccgtgtccaaattatgaacctttattttgacgtcaagagcctgttctttttttaatgtaaatggcagaagcaaaatgagtttcaaacactaaagccctgtctaatgctaatttctttgccgagagcaaatcctctagcactaggtaaagaataatactcgataaagaggtggtaggcaaagaaaaacacttgacaaaagagatggccaaataaaaacactcagcaaatcgccgtcaacaactaacgccatctaccaccgttaactgtgtcgagtgtcgtacctcgacacttagcaaaggaggcctctttgactagtgctggatcagacactaggcaaacatgcattttgcgagtgtcaaactaggacactacgcaaaggaggaattttgcctattttttttacgctcggcaattttttttctttgtgctcccaaactttttatgttgtgtttctatagcacctagaactacttgttcaattttggcacatttctcaaaatatttgctatatttactaaatttatttcatttaattggatttctttggataattcaaatttgaactacaagtcattcacataatggaaaaaatgaatgaaaaaacgataatcatgttactcagtataagttgagatcgtatacagtaacatattagaaattttaaacattacgttcacgaaaaatgaccacgaagctatgcaccacatgttttaaaattatatagaaattaaatgaagtcaaaaaat

SEQ ID NO: 9212 - DNA, 1611 bp, Zea mays
ctgcagcagcttccctggtagcggtgaatatctatctgttcgtggccgcctcatctccggtctgtacagccattcgaatgaggtgcactcgttcggcggatttttggaagcaagtttgtgcaatatttcaaataaatactaattcccagtcagagatggaatggctccgtcccaaggaccaaatgcattgcatctctgttaaattgtgtgggcactgggcagcggtggattaaatttaaattgacgtcgctataaattgtgcgcaacgtgtgcttcggaaacaaccgtaccggctgagtgtttagaccggccgacgccgatctaacaacgaccgaccgagcgttaggtccctagctttccgaaacacgcgtacgactatagtatatatagagttatagactgactccaaaaaacacaagaccgagttagcagcagcagacgacagcccaatttctctaagcggcgccagctcagcaaacaaaccatatatatatatgcatgatgatggcttgatgccgcaacgaatgatgacggcgttttttttttgtttaaatttgcgtcccccaacgaacgccgagactcaaaaaactcgacgaaccgatgaacagaagagcgtggatgtgaccgtccaccggattggcagcaccttatgtagatcactccaacgtctttcccgctcgctggatgtacgcgtctacacagcgacccgccaaccttctctgctcgcccaccatgcatacttacaatactacagtggatcgagtatataagcacgcagcacagctcccaggccgcgatcgtatcccctctcattaattccagctccaacatctctctcctagctacatctctccactgtctgtttgcctgtcgaggccgggcgccagcagcaacaatggcgaggatgatcagccggccggccgtcctcctctcccccctggccatgatcgtcgtggccgccgccgtcatggcgctggcaccggcgccggtggccgcgaccaagtacaacatcaccaagattctggcgccctacaaggagtactccaagttcaacgacatgctgtccaagacgcgcctcgcgtacgacatcaaccggcgccagaccatcaccgtgctggccgtcgacaactccgccatgtcggcgctcgaccactactcgctgcagaccatccgccacatcctcgagctgcacgttctcgtcgactactacggcgacaagaagctcaagaagctcgcccatggctccaccgcttcctcctccatgttccaggctaccgggtcggcgtctggcatgtcggggtacgtgaacatcacccggaaggacggcaaggttagcttcatgacggaggacgccgacgacaccgcgaagccgtcccggtacgtcaagtccgtcaaggagttcccctacgacatcgccgtgctccaggtgagctccatcatctcgtccgccgaggccgaggcgccggtgccgcccccggcgcccgtggacctcgaggagctcctatccaagaggtactgcaagtccttcgcgtccctgctctccgccaacgccgaggtggtccgcgccgtgaacgagaccaaggacaacgggctgacgctcttctgcccgtc

SEQ ID NO: 9213 - DNA, 3356 bp, Zea mays
gtaccgccctggcaggtacccaggtccggaacattccacgggtacgaccccacgccgtcacgccaacccctctctctcggcttctccgcctcaagcctcttcccaattccgctagctgctgcccatcggccgccgcgaaccgaccgaccggtgctgctccggctccgccatggccggcgccggcgccgagctgggccgccgagccgctgcgaacgctgccaacaccgcgggggcccgcatctaggctcgatggtgtaggggggactgggaactgcggagaggagaagtggaggtgagaggggcgacgacaaagagagagagagagatgggagcgattggaggcgacgcgccggtgcagtgggacaaggtggatggggccgaggtggccaatggcggcggtggaggtgctgcgggaaggctggagaagatactcgtctcggtgaggctgagaccgctcagcgacaaggagatttcaaggggggacccggcggagtgggagtgcatcaacgacactaccatcatctcccggagcaccttcccggaccggcccactgctccgactgcgtattcgttcgatagggtatttcgttctgactgtactaccaaagaagtatatgaggaagggaccaaagcagttgccctctctgtagttagtggcattaactcaagtgtttttgcatatggtcaaacaagtagtggaaaaacatacaccatgactggaataacggaatatacagcagcagatatctatgattacattgccaagcatgaagagagagcgtttgtattgaaattttcagcaatcgaaatatataacgaagttgtaagggatcttcttagtgcagaaaacacatcgcttagactttgggatgatgcagagaagggaacatgtgtagagaaccttacagaggtgaccttgagggattcagaccacctgaaagaacttatttctacgtgtgaagctcaaaaggaggaccggagagacatacttaaatgaaaacagctccagatcacaccaaatacttaaactgactattgaaagttctgctcatgagttcttgggtaaggacaagtcaacaacacttgttgctagtgtgaacttcgttgatttggctggaagtgaacgtgcatcccaggcattatcagctgggactaggctgaaggaaggttgtcatattaatagaagtctacttaccctaggaactgggattcggaaactaagcaaggtaagaaatgggcacataccataccgagattcaaagctcacgcgcatattacaaccttctctaggaggcaatgcaagaacagcaattatttgtacaatgagcccagcccggagccatatggaacagtcaaggaataccttgttgtttgcaagttgtgcaaaggaagtggtgacaaatgcccaggttaatgtcgttatgtctgataaggcactggttaagcaattacaaaaagaacttgcaaggttggagagtgaattgcgatgcccagcttcatattctggtcttgaagcattagtgagagaaaaagataatcaaatccggaagatggataaagaaattaaggaactgaagttacatcgtgatcttgctcagtctagactgcaagatttgctcaaggttgttggagataaccacggttcgaagcaccccctggcttcttctgcaagaaattttacttttgatgttcctcagccatgtgaggatgagcaatcgacgacatcagaagctatcagcagtggccaaaattttaggcttcaaggacgcctgacaacacaaagagattataggtcacagcaatctgaaaatgatgtgcagtttgctacccctcttagctattcaatcagcagtcccccattcagtgggatgcctccaactaatggcagaaatgataactctcatatatctgatgaagattcagaggatctttgcaaagaagtacggtgcatagagaccaatgaaacagaagaaaatgaatgcttagagtcgtcagctgtgggaagcaatagtctgcaagattcaaatttagcttccagcatgcatgggaacgacaatacaaatcgatctgtgaattctggacggaatgatgcatcttctattaccctggaacaacatctggagaatgtcaaaaaaccgtttgccaatcctggcatggatctgggatcctctacacgtaactcgtcaagctcaaaagtaattggcagaagcaggagctgtaggtctctgatgggttctactctgttggaagacttggagaaagaagtttgcacccctccaagcagaagtttcatggactacccagggaggcccgaaacatgtcaaagaagggtacccgcactgaactacgatgcagagagtgaagctttatccagggcaggatcaatgctatctgaaattaccaccacgaggggtggactgaaggaaaacagctctgctgctggtgatacagaatttgttgctggcataggtgaatttgtcgcggagctaaaagaaatggcccagggtcataatggagaattggctgaagggaccataaggagcgtggggctggatcccattatggatatcttgcaatcaccttctcgctggcctttggaattcgagaagaaacagcaggagatcattgacctgtggcatggatgcaacgtttccttggtccacaggacttactttttcctgctgttcaaaggggacccagccgacgccatttacatggaagtggagcttaggaggttatcatttctcaagaacacatactccaacggaagcatggggtatgatatggtggcaggcagcttgagcacttctttggtttcaagtgcaaagaaactgcaacgcgagagggagatgctctgcaggcagatgcagaagcggctgacgatccaggaacgggagagcctgtacaccaagtggggagtctcgctgtcctccaagaggaggcggctgcaggtcgctcggcgcctttggacggagaccagggacctggagcatgtgagggagagcgcgtccctcgtggccagactgatcgggctcctggagcctgggaaggcgctgagggagatgtttggtctgagcttcgcgccgcagcagtccacccggaggtcgcacagtagttggcggtatggccgttcttctctagactgactgagctcgaaagacgcagctgacaaaaaaacaacaacagttattccgttgttttcgttttgtgtagtgcctgatttttttgctgtcctctcggaaaatagaaattcctgaacattttgtgaccagtctgcgagaaaatttggtagcattttcaagatttattgatgtttacaatttggaaaccgtcaacgagcaaaaaaaaaaaaaaaa

SEQ ID NO: 9214 - DNA, 2827 bp, Zea mays
  misc_feature (2637)..(2637): n is a, c, g, or t
aaccattgtgaactaactacatgttgcatatgccatttagcatgtcagttgtcttcgtcgtgaaaatatgacgacttccatgacatgatgtaaaatttcacttgttctttgcagatggagaaagaaattaaggaactgaagttacaacgtgatgtcgctgaatctagactgcaagatctgctcaaggttgttggagataaccatggttcaaagcaccccctggtagacacacttcactactttctagttgatcagcttgactgttccttcataacaaaaaaataataatctctcttcaatgtaggcttcttctggaagaaactttgatgttcctcagccatgtgaggatgagcaatcgacgacatcagaagttgtcagcagtggccaaaattttaggcttcaaggacgccagacaacacaaagagattataggttacagcaatctgaaaatgatgtgcagtttgctacctctcttagctgttcagtcagcagtcccccgttcagtgggatgcccccaactaatggcagagatgataactctcaaatatctaatgaagattcgggggatctttgcaaagaagtacggtgcatagagaccaatgaaacagaggaaaacaaatgtttagagtcgtcagctgtgggaagcactagtctgcaagattcaaatgtagcttccagcatgcatgggaacaacaatacaaatcgatctgtgaattctagacagcatgatgagtctcctattaccctggagcaacatttggagaatgccaataattcgttagccaatcttgggatggatctgggatcctctacaggtaattcaccaagctcaaaagtaattggcagaagcaggagctgtaggtctctgatgggttctaccttgttggaagacttggagaaacaagattgcacccctccaagcagaagttttgtggactacccagggagacccgaaacatgtcaaagaagggtacctccaccgcgccctcgcgtagagagtgaaactttatccagaacaggatcaatgctatctgaaattattaccgcgagggacggactgaaggaaaacagctctattgctggtgatacagaatctgttgctggcataggtgaatttgttgcggagctaaaagaaatggtccaggcacagtatcagaagcaacgtggtaatcaggtgcgaaactggaaatgttctggttctcctgctggcatggctcatttcattattattctaatgagataaaatttaacgcatagctatgtcctacaatttttattagctcattataagattgtacatgcagaatttcagtgaaacgccttttttatgttatcattgtcagggtgatgatggagaattggctgaagggaccataaggagcgtggggctagatcccattatggatgacttgcaatcaccatctcgctggccattggatttcgagaagaaacaacaagagatcattgacctgtggcatggatgcaacgtttccttggtccacaggacttactttttcctgctgttcaaaggggacccagccgacgccatttacatggaagtggagcttaggaggttgccatttctcaaaaatacatactccaacggaagcatggggcgtaatgtggtagcaggcagcgtgagcgcttctctggttttaaggtaagtcatcttcaatttttttcacagtttggctgtggcgcgtcactcaaactcagtgacatgctgcgcagtgcaaagaaactgcgacgtgagagggagatgttctgtaggcagatgcagaagcggctgacgatccaggaacgggagagtttgtacaccaagtggggagtctcactgtcctccaagaggaggcggctgcaggtcgctcggcgcctttggacggagaccaaggatctggagcatgttagggagagcgcgtccctcgtggccagactgatcgtgctcctggagcctgggaaggcgctgagggagatgtttggtctgagcttcgcgccgcagcagttcacccggagatcgcacaatagttggcgatatggccgttcttctctagactgactgaactcgaaaaactcagctgagggggaaaaaacgttccgtccttttgtttttgtgtaatagattgttgccctcttggaaatagaaatccctgattccgagtccgttgcaacgccgtaatgtgactaactatcagatggatatacatttgatcgatgtgtgatgatgtgtccagggcgcacaaatcggaaaacaaacagagcaattgtacatactatgggggtctttaaaactgtttcttttcacgaaaatcaacttagcttcacaaatctacggctaaacactttcaacttcaacaaatttcatctttttcataaagcagcaaaaatagtgcttcacaaactctgttttctaataaattcgtgaagttagaggtaattactcatcattgacaccgataacaaccacatgttcaggtacatagtccatccacaacaaagaaccttcaacacgggtgatttttcctgatcaagcctaaaatgcttgtctactccatgttgtggtgtctctagagctggatatcttgcctactccatgttgtggtgtccctagagctggatatcgagacagctcggctagtncgagttcgagttggctcagctcgttaagctaacgagacacatagtcgcctccgctcgactcgtttagcttgcgagccacggtacaaaaacaaatacatataataatcaatttctagttaatttcaaactaatttaacattatagaacagtaactatactcatagttttgcagactacatcaatgaacacc

SEQ ID NO: 9215 - DNA, 3702 bp, Zea mays
  misc_feature (537)..(537): n is a, c, g, or t
attcgtctccactataaccttcttctcctgaaaatttatcagcactattcgtaacaacgcttaactagatgtggaagacatctcggtaggttgacagagaagatgtgcggctcactcaccgagtcccacacaggcctgtgcgtgctgcaagaaaagagaaaaaaagttcacatattcgaatcgaaaagtggtacgtatttactagatatagagtggtgataaatgcatgcaattcaaaattagatggagagtacaggcaaaggcgattcacgatatggtggctcataactggctgaggtacttatcagcaatcccgcgtgcggcgtggaagttaaaatttactagatcggagggcacagccagagggacatttgagagttaccaagtcgagggacacacagcacgcagacatgagagcgagacagggatattcttgcacagaggaatggaaatggaacagacataggacgagtattcgagcagtaaataaaagcaagggcgacgcacttgtcggacgtctcggtgcggtacgtgcgntcgccgagagagaggcacgcgaagaacttgtccttgaactgcatatccgcctgcgcccggaaaccgaacaggaggatcaaccatggcgagtcaaagtcagagtcagagaggcagagacagtgatgcgatacgaatcgaaacccacggattccgcctcggctggccgcgtcgaagcggggagcgagactcggtgctaaggaacatgcgcgtagcagcggagttcgcagcgcgcggcccacgtaccttggctatccggacgcgtgcgatgccggcgaactcgtcggcggcgagggccttggaggagaccgagtcgtcgccggcgccgcggcgcaggcggttgcgcaggcggcggcggaaccgcgcgaagcgcgagggcagcgcctcgccggcgccggcgcaggcagtgggccgcgacgccgagtggcccatccggacaggttggtggggactggggacgaagacggacgggacggcgcggcgcggcgcggcgcgccttttgcgggacggtggtgggcgcggcgtcagacagacagacagacgcctaggcagatggtggttggaaatgggccaaaagtagagtcccttttgaatccaggccaaccgcctgcctgcctgcctgcccgcgcacgccggttcgtcgcccggccgcgggccccatcgccactttgataactcggtggacccacacgtcagaggggttttggaaggtgtgtaaggatggaagtcaaacctgtgttgatggcgctggtgggaccggacaaggaagatccacctgcgtgcgctgcgcactgggggggcgcctgcctggctcttggatccacccatttcccatcgtcgtcttctttttctgaatgggaatctccacttcttggtggtggcaggtcatgacagcagccaaagtagatgatgattcccccccccctagaacatcctaatcgaaaagcaatgggaagcaaatggccaaccaatagcaaaaaggcagccgtgtatcgatcgccttatccgggtcctgtggcactggcacaccgcgcgtccggatttggctgagtagctgactagctgagcgagcaatccatcccttcgcccgccgcaccatggaagccctcgcctcggcgcctcgggcgctcttcccgcgcgcgtgcccagtggcgacgccggccggcccagcccggcgccgctccgccgctcctcacatctgcagggcctccgcggcggccggggaggagacgacgccgccgccgccgccggcggccgctcccaagaagatcctcaagaagaagcccgtctactcgatgaagaaagggcagattgtgcgcgtggacaaggagaagtacctgaacagcatcaattatctgtcagtgggacacccgcccttctacaaggggctggactacatataccaagaccgcggcgaggtcttggatatcaggaacttcgaaacaggagaatacgccctgatcgcttgggtggggatcccgacgccaccggcatggctaccaacctacatgctcatcaagtcggacaagctcgactacgagaggatatgatggccggccggcggcctcgcagggcaccgtagcgccgccgccgaattcatgcttcatttcgcatcaggagtcggccaagcaggacacacctcttgttgttgacttgttgtaggtatatacgtacatgccagtattgccagaacagtcgacagaggcaatctgagacctcagctgctggaataatcaggaagtagatcgagagcgacgtacgatgacgagattcataattgctgctgcacatcacctgaggccggggctgaagcacggcatgttctcccgagaggaagaggagaccgtcatgagcctccacgccaagctcggcaacaagtggtcccagatcgcacggcatctgccgggacggacggacaacgaggtgaagaactactggaactcctacctcaagaagcgtgtcgagggcggcgcgcaggcgaagggctcggcggacccggcgacacccgcccgctccgacgacgtgcacgggagcccggaccccagcgagaacggccagaggtccgtcagccggccggcgaactctggctcgtccgagccggcgggggagtcgtcctcggcggacgactctagctgcctcaccgtcaccgagcctgcgcccgcggtgcgaccgcacgcgcccgtgctccccaaggtcatgttcgcggactggctggacatggactacggaaccagcctgctggcgctgggtccggacgccggtttcttcgacgtggccggccgcagcccgggccagggcctgagccaccaggggtctgcgcaggttgacgggccgtgcggcgtcgtggattccctgcacggcctcggcgtcggcgtcggcgtcggcggcatgtgctgggagttcgacggcgcggcggcggagcagctggacgtgcagggaggagagttctgcgatttgctctccatgagcgagttcctcgggatcaactaggcgtcgggccgttctcttcttcccaacgattcatcttgaagcatccttgtcaaatctgtttcttccgtaggcgagagtgtaaaaaactgtgtgttataccaatgtgcagttactaaagtgtatagtatatgcagaggagctgagtaaagatgtgtgaggattgtcctttccggtccaagaaaaaaaaaaaaaaaagggaattgcatggtttttccacttccaagaccagatttcacctgatgattcgaacgagtaggcaaaacaagatataatctcttgctttttctacggcgatgtcacagactaatgtacctaacaaaattaaattttcacttacggaaacacaactataataagtacaaaaattgctactataccagcaactaagtaatgccatctatgcttactccatctgtttcaataaaatttgtccattccatctatgttgagaggagaagcttgtaagcctcgaaaagaacctgcgtgtctgaccgagaccacgttttggcgggtccacttccattacaggtctgttcgaatgtctcctgttggccctataatagaggcccatttaagtgtatcaggaggagcccacgaaaagtccagaactcagcgcattggttggttcgtcctgaccatttagtaccaccgcggcagttcaagtaggacgtgcgacaa

SEQ ID NO: 9216 - DNA, 2248 bp, Zea mays
  misc_feature (745)..(745): n is a, c, g, or t
gcgacacgggacggtacggcggggcaggacggcgacgcgccggccagagctgcgacgagtggtgtgggcggcgtggcgagagaaagagagaagagaagaatgaataaggttggctgctgcggtttaaaacggcttattttcggtggctgtgtcagtgaccgtcgaaaataaagctatttgcggcggcttttgacatggccgtcgaaaatagcgttattttcgacggccaccgaacgccgatgaaaataaacgtttatttttggcggtcaagccctgatagcagaaaatgatgtctcttgtgttgttttggcacagtggctgctgcataccggctgtttggttcgtgcacgccggcatgcaactacatgcatggagtattagagcagtccatgtttggttcagatctctgcccatacaggtttgtcacacatgcaaaaagtgttgttcggccaggttctcgagagacatgggcgagggacgtatccgcgcgtgcaggccgcatgtacgccgggcgtatacagcggcgtcaaatacgaaatgtcattttaattttaaattttgttatattttctaattaaaatttttcatactataaagatttatttatatatcattctgaaatatacgtctaagtacactcaaccaaacaaagtttatgttagtatgcgtgagtctgtgcaaataatcaaacaaatatgtgctgcacaatgcctatgtgcgcctaattaatcctacatatactacntcttgcagagctaactggccgtcacctgtcggcaagcttcggcggcgccgggtccggtgaggaagcgaatggccacagttcgttccatgccagcttccaccagcagcagcaccctatcatagttcaacatggccataaaaaactgaaacgcttggattataaatggacgccgcggccccccccgcgccggcatcatctccgcattccactattagcagcacacttctcatcagccatgaagctcgtcctgtgcttctgcatctgtgtcgttctcgtcatcgcctcgtcgccggtcacgctctctgatagccgccctgcgatggggcgacgctggctgagagacgaagttgtcattgccaggggccctgaagggaacacgacctctgcctcagcctctgcctggtcggaggaggcgccggggataccgtacgacaggtcgaagaggctcagccccggtggtcccaacccgcagcatcactaatcgtcgtccgatcttgttggcaagtgccactgcggacatcttgctacgggaatctgtggttgattactacactttggttctgatcagcttttcttttctgtcctttctgatcagcttttcttttctgtcaaggccgtgtgatcaaggagtaaacgtaacaaattattgccacgatttttctgaatgtatccaagtcatgtgagtgataataatgatatgctgtcattaactaaactaaagagtcattgcgcccctcgcgccttatctgtaacttttatttttggtatcagtgtttcgtgctaatatgtagtcgcctccaattatctctaagtttaaactttaaacacattcaaatgtagtaaaagtgatgcctacatttatctggatggaacatcttgagatcgagagacgatgtggatgtttgtacttcggaccaccgattttgcatcctttgttatggatgtcatctaatatttgctgatggtaaagcaaaaaaaggcataccatccaacaaagttacactacactactggacatttccggcgttacagtcccgttctgagaaatagaatccaaatgaattatacagcaactgaaccaaaaatactccatccgagacaacagaaaagtgcttaattagaaattccttggttcttctgcttcgggcaagctaagcattatgagatccaatacccacaattattttgttataaaattgttacatctccttcattatctaggtatatcaatacaccataggaaacttaataacaatgaccggcaaggagttctgtttttgtgcagttgtaaagaataaaatgccttttctagcagggagactagtgttgactaaccgattctgcccaatttacctatatatatgttgccttttttcaatacctagagatagttctcaagaaaaatggttactatcaaccgaggttcttctagcagtatgatcaacataaaagatacaggttagcaaaacgatatgatgttatctgccaatccaaagaacaggg

SEQ ID NO: 9217 - DNA, 811 bp, Zea mays
cacattcttcattcatcgttaaccatctgttttgacgatgaatgaagaatgtgcttgtgtaaccctgctttaacagctgcatgtgcatagcaacagttgttcacagaagcttttcgtagatttgtcaaaacagatggttaacgatcttgagaattcagggcggtcattttcaggcccatcacatggttgggaagctggcattagtctcccggaggatctcgcagatttgtttgaagcaatagctggcgcaatttacgtggacagcgggaacgacaaagaggttgtctggagtgccatcaggcggctactggaacctcttgccacccccgggaccatggagcctgaccccgtgtcggaactgaaggaattatgcgagcacaaacactaccctaagccatcgtactctccaactcgtgacagtgtagctggagtgacaagggtggttgcacaggtgacggctgcgcggactgtgtactccgggactggaacaggccgcaaccaggatgtggcagaggttctcgctgcaaaggctctgctcaaaaagataaaggccgcagcaagaggatgaagcttggacttggcttggaccgggcgggcatttgatatttgggagtttgcgcacatgatagctgttctcgcagaggtatcaaaacaaactactgtagtatataaatgttgtgtatatgaatcaaggacagttgaactacccttggtttcgatagctgcaaaaaacaaaacaaaaaactcgaatctactatgcacagtggcttcatgtggtggacccttaatgaaatgatgaattctacgtggc

SEQ ID NO: 9218 - DNA, 1267 bp, Zea mays
taccctagcaggccttccggggcattaccacctgtctttttccttcctcttcacgtctcgaacaagcaggaggaggtagaccgaacaactccaggtcgcgggagcggccatttctctggggcgggaccgcgggagagctctagctcttgcagcagtagaactctactgcagccagagttaagagaaatggataaggatggcagctccgagagaagtcgcccagatcatggtgatgtgaagatgctcaagttcagaccaaaggtgcctcgacagaagcaaaagccaaagcaacaagaccctaagccaattgatgaagatgtgatgaagatattgaggactcgccaagtggctgcaaaaagtgcaccaaacacagaagatgagtgctcaccacagaagaccctctcgacgccaccttctgcagatgttgtttgcttgtcaccagcgcaactcggagtgcaaaaacaaaatcaattgccactccaaattcctagatccttccctgttcctgttaattcaggattggtttatgaagaagagagtagtgatgacgacgacgataatgatagtgacaatgttgggttgctggagactcagccagattcaattgaaagtgaagctttaacatgtccggctgaggagcttgatttgcttcaagaaggtagcaaagaaagaatgttcttcttccagttcccaaactctcttcctttacccaaaaggtcgtccagtgccggcaaggaggtgatggaaggatccaacctgcagcagctgcctcagggttatttgggcaaaatgctagtatacaagagcggcaagatcaaaatgaagttaggagacatcatctttgatgtgaacccaggagtagaaagtaggatgctgcagcgtgcagtagctctcaacactcgagacaacactgttgcttgcttggagagattgagaatcgtcatgttattgtgactcccaatgttgattctttgttgaacgacaagtagggaccaactgtagcagctttgtcacagattgtgtgtagacctgtagatatgcagggttagtgacatctgtagaaattatatcagctctgtcaaatgatgtataggattttagttgtgtagtgttgtgaacgttttattgtgattgcagtgctatgttagttttagaactgcatgcagctccctgtggatgaatgtttgtaaggatcggtatttgaccttgattgtattggaaggcaaatataataaaaatcacgtcgttcttgtgggcaaaaaaaaaa

SEQ ID NO: 9219 - DNA, 1416 bp, Zea mays
aatagagttgttctacttctattctactggagtgcattaccacctgtctttttccttcctcttcaacgtctcgaacaagcaggaggaggtagaccgaacaactccaggtcgcgggagcggccatttctctggggcgggaccgcgggagagctctagctcttgcagcagtagaactctactgcagccagttgtgctaggtggcatccaaaataccggctaaactttagtacgggatccaaacacccccccttaactgggctcttagctatttatgacagagttaagagaaatggataaggatggcagctccgagagaagtcgcccagatcatggtgatgtgaagatgctcaagttcagaccaaaggtgcctcgacagaagcaaaagccaaagcaacaagaccctaagccaattgatgaagatgtgatgaagatattgaggactcgccaagtggctacaaaaagtgcaccaaacacagaagatgagtgctcaccacagaagaccctctcgacgccaccttctgcagatgttgtttgcttgtcaccagcgcaactcggagtgcaaaaacaaaatcaattgccactccaaattcctagatccttccctgttcctgttaattcaggattggtttatgaagaagagagtagtgatgacgacgacgataatgatagtgacaatgttgggttgctggagactcaaccagattcaattgaaagtgaagctttaacatgtccggccgaggagcttgatttgcttcagcaagaaggtagcaaagaaagaatgttcttcttccagttcccaaactctcttcctttacccaaaaggtcgtccagtgccggcaaggaggtgatggaaggatccaacctgcagcagctgcctcagggttatttgggcaaaatgctagtatacaagagcggcaagatcaaaatgaagttaggagacatcatctttgatgtgaacccaggagtagaaagtaggatgctgcagcgtgcagtagctctcaacactcgagacaaacactgttgcttgcttggagagattgagaatcgtcatgttattgtgactcccaatgttgattctttgttgaacgacaagtagggaccaactgtagcagctttgtcacagattgtgtgtagacctgtagatatgcagggttagtgacatctgtagaaattatatcagctctgtcaaatgatgtataggattttagttgtgtagtgttgtgaacgttttattgtgattgcagtgctatgttagttttagaactgcatgcagctccctgtggatgaatgtttgtaaggatcggtatttgaccttgattgtattggaaggcaaatataataaaaatcacgtcgttcttgtgggcaaaaaaaaaaaaaaaaaaaaaaaaaaaagggcggccaccgaaaagtgagctc

SEQ ID NO: 9220 - DNA, 5375 bp, Zea mays
catttttctggtagagtgatagtgattatctgaagagaaatctaatagaaatgcagttctttggttctagataattttgatggccttaaatatatcaatcaagattcttccttctgcggcaaaatgtgttactgtagatatggtgcataatattggtgattttatctcagagttgctaagtcttatggaaagctcaatagttgacaatgacaaggtaaatttttatcctgtacagtgttagaattagcttgttcatctgacaaagccagtgctaatatatctgtataagtcaaagataaatttactgagaaataattcattttaattctttttattaaccagttccttagccgcctttttggggtttttaatttcagtcagacttggcttaaccatattattaggtaattatgtgttaccttttcatatctgttctgcctttcctgaaagtagtttaatttttaaatattaaatgaaacagaaagttatagtaattgacacactgataattaaattaaatttgttgcctctcatattatgctcagattacttacatatcttttagcaatttcaaatgggatgctgtacggaatattggaaatccatcattgaaacgagcttcctactattgtatcttcatatattttttcagcacactcttatcatatcagtatgaggtagtggtgttcgttttaaactcttgcaaccttagtcctgcagaaatgatgtcactgactcactgtataatttctctgatggatatatgattacagaaaattcatggagctgctctggatatcactaaggctgcacctgtttttctagatgaaacaactaagctgtgccgggcatactctgaggccgcaaaagtagacaactgcacaatgagtataactgatgaagatgctactgtgaaacacaacaaacaaggtcttgctagtgatgtcatcaggattacatcatccactattcagactatgtgtagattgggaacctatgcagcatccagtggtggaagccaggtgattttactgaatgtatcatggaagggtgtagtctcattactccaaagcggtaaagggatgattgaaggaaaagtaaatgtcagagaaataattgtaacccttctatctctgtccatagaatctctaagagttgctgctgaaacatggtgtgcaccgttactagaaaccattggtgctactgaagccagaagggcgttcctaccaatcaagtttttcttaataaatgctgtaaggatttgttcaacatatccatctgaagcaatgattatatacaagaacataatcaattgtgcattagtgatcacatcctcaagcattctatttagcaagaagccacagttgaaggcagcaaatgagacccttgttgaattgttggagcctactttatttgttttactagatacacttatgaaatcatctgacttaacaccagaatccaaatgccagcttgcacatcatttttttgaaaacgaagaagataagagtccagatcttatgggacaagctaatcagagagagataaatttggcctcactggattgcattttctctatggattcagatgtggatcatagaaatagagcacttttacctgctgagttgcttgtgtttttgcactttctcaatgcttcatcatggttgacagaaatggtggtcatcacattatctaaaaagctacagactcttcttaatatattgacatcagaagacatctactcctatgtccttggcttccaaatccctgccttaaatggcgcagaccagtctcctgcagttgtttggcaacctgtgtatacttctatcatacaagcattgaaggcttttatgatttctactgttgcttcaagtgctgcttggaacgagttagaggctttcttacttgaaaatattttccatccccatttcctttgcttggaaattattacagagctgtggtgtttcttcattcgttatgctgaaactgagacttcaattaatctagttaatcaagtctcccttctactaaagactgttgcatcaccagaggatgttctttcacctctcagtgctttgcggaaagttgcacgatcattgtgcatcatcttgagctatgcatcttctgcaactgttgatcaaatatatacttgtgtgctgaatggtgaaaactcttccaagtcttcaatcttacacttagcattgctgatggaaggatttcctttggattcattgtctgatggtacaaaggaacttgctatgaagaaaatgtttacctcttttgctggctatctggagagctactccaagaaccaccgagtaatcaatgtgccaacttgtaaattgggtgttgtaggacttcctatacatgctctagcctctgcattgcagcataggtaagtctgttctctaattaccagtattgttcactctgatgatgatgatggctgtcttatacacagtactttttttggcagtgtaataaaggttgatagtattgtagatgagaatagcatcactgctatgtttaagttcaccatctctctcataaagatgtttagaattgcgccagatagtagtaaggataaccttgccaagcacattagttccatgttggttattatctcaaacacgaggcatctttgtgcattcagtgagatggagaagttgactctgcagttgcgcacgctgttcgtttccacttctgataaatcaaatgcagtgctgtcccagtgcaaaccgtcaatggcttcctttatgtcaactctcggtcacttgaacgttactgaagacgatgctaacgaactttgttctgcaatatgggatctatatcatctcctgctgaaggaacggcactgggctctcattcacctcgcaatggattcctttggctacttcgccgcccgcacatcctttacgcagctctggagatttgttcccggagatgctgccctttcgtacaatgcaagcacagggacgagcatagatgaaaacggattcatgctggagttgagggcttatcttcagaaagaggtcgccttgcacaccgataaatggtctgaagagcagattcggctcctggtttctgaggggagagcgctgaagaagctggctgaagtttgttgtgaaattccggttgtcgctgagcctgagaaggcgccggttgccaaggatgccagcacgaagaagaggaagatgccagatgggatctgtgaagggatggcgatgctgcagaacggtctcaaggtcatgcgaggcgcctttggtgaaggggactttgctgatctgaaggataggtttgctgcacacttgtctcgcctcgaggatgcagtttcccagatcgctagtttatccgacgaaatttgatatagtgcactgtatgtcgcgctgttacctttaactgcaaaagagcattcattctagtacagttcacgatcatagcacagctgatctcgtggcaagcaagctccagagtcatcgggttgacagatcgttcaacatggccagcacaacttcaaggtttgcaggtcatctccgcgccggcgcttgcgtggcgacggcccttgtggcttgttggcttgtggggcgaaaatgcaagaaaatggatgtgaattatcttttgtataataaccacacgtgacaccaaaaaaaaaaaaaaaaacaattggtagtacaccctgcagacgaggcgaatacaatttttgacccatgcaaacactacattgcaattgcatgcatgcatgcatccaccgacgaggcgacgacctcgacacgtccgaaacaacacagcccaggcttcactgcagccacgacagccgacaagcgctggcttactttacggtcacaacttaagcaagatggacggtgatcctcagcagcgtctctgcgccatcggtgacgtgctggccggaagcgatgagcgggcgtacctcggcgaacccgcaggcacccttgaacttgccggtgcctccggtgatggacagccggcacagcggggtgcccaccttgtacaccccgaagaagttgatcgtgtcgccgtactcgccgccctccatcatggccgtgaacgccatcatctgcgacgacccatcggcggagctcgccacgtacacgccctgcgcgcgcccgagcggctgcgcgccgaggtcgggcccgctcgtcagcacgtcgtcgatgaccgtgatggtgccgaacccgaggctgaggccgtcggggcccagctgcacctgcgccggtgccgccgccgccgcgccgccgccgttcccagtccctggctgcaagaacccggcgccggacaagccggtgtccagcgggatgccggtgttgccgttgtacgtgggcacctgcccgttggcgttggggatcgccacgccgttcctgggcgcgctgaagccgatgggccgcgcgaaggggacctgcccgttgtagatgttgcccagcaaaccggtgatgggccgcgccgtcgggctcgacccgcccaggatgtcgtgcatgtagagttccagaggcgcgtccggcccgcccgcgcccactacgccgccgccagtgccactgcctcctggctgcgggtttgtggcggccaccgcggcgccggtcgttgccgaggcaggtatctgcgcatggatggcggaggcgtggagcgtgacgatgagaagaacggcgagaggggcggacggaaatgggaagaagctcgacatcttgggttttggttggttggacgtgcaggtttctgctgctcgatcgatcagctgtgtatatttttccgggcgcgtcggggtaagttaaacgattggcgagacaatggttttatatatgcatcccaaggcattaatgaatgagtgcagtagttgtgtcatatgtgttcctgatttgtgaccaaggacgtccggaggaagagtgaagcagttgagctgtgaggaactgaagtgggtctacctgaaccaacgagcctgaaatatgaagtgaaatgttagctggtctcatctcaacgaaaggaacacttgaaaacaaaagctgaaacaaatgctgatcccagtgtcttgatttaacgctgaatgctgaagcttgacttggcccagagctaacttgtcggtgaccgttctcgagacgatttcattccccggacgactggaagtctggaactgaaatgcagggcaagattgcggatgcaaccggagtacgtgtctgatcttttagcctgaatccagttaactgtttaatacttctctcaataaataatttattcttagagctagtttggtaaacccattttcctaacgtggcgtttggatcccttcattttagaagaattggaattcactcaataaagtaacttatttagtttggaatttgacattccaccactttcccaagttc

SEQ ID NO: 9221 - DNA, 2895 bp, Zea mays
gtaccctcgggctcggccgggctctctcgctgctttgcttgcttcccccacccccagccccatcagctgagcctccgccgacctcgacgaagtggcggcagaacacgcgcagttgctgagttacggcacacaccgcagcagtgcacaccacatccacacacgcgcctggcggtggagtgacaactgacaggcatcgggttgcttccggcggtggccattgccaaccccgccccatctccttcgtcatgcgtacaagacatccccacatcgccgctcctccacctcctcctcgcctgacgtcatccccgcaccggcactgcaccacaaatccatcccccctcccctcccggcccctgcattgcatccattcttcttgcttccccgaaacctcgctcgcgcttggtctgacctgacgcaacgcgtcctcgatccctgagataaagctcgcggcattcgcttgttccgccaaattcagtcccttgaatttcctgagctgtcgaagtttttcttctggttcgattcttcggagaccccctggcatttgtgggttcagccattgctcgctggtttgatccgtcctagttgccgaagcgcctgttgatttggttctaaaatacatcgttcgtccttccaagttcaaaaggggggaaaaggctcttctttttttggatcctgatttgagtgtgtcacctttgcttccggcaatggggaacaacagcagcagcggcggcggcaacaggcgtccggagcactcggagacggcgctgccgcccgaggcgtcgccggcggaagagctgagctcttatgaggcagctgccggtcggacccggagctgcgcacgttcgacacgacgctgcagcggcgcaccagccgcgccatctcgacgctggcggtgggcgtcgaggtgcggtccatgtcgctggactcgctccgcgaggtcaccggctgcctcctcgacatgaaccaggaggtggtgcgcgtcatcctcgactgcaagaaggacatctggaagagccccgagctgttcgacctcgtcgaggactacttcgagagcagcctccagaccctcgatttctgcaccgcactcgacaagtgcctcaagcgcgcccgcgactcccagctcctcctccacgtcgcgctccagcgcttcgacgacgaggaaggcagcgacgccgccgccaccgccgctccctccgcccggtacgcgcgcacgctgcacgagctgcgccagttcaaggcggccggggatcccttcacggacgagttcttcgccgccttccaggccgtttaccggcagcagctggccatgctggagaagctgcagcagcgcaagcaccggctcgacaagaaggtcaagaccatcaaagcgtggcgccgggtgtcaagcatcatcttcgcgaccacgttcgcggccgtgctcatctgctcggtggttgccgcggccatcgctgccccgcctgtcgctgcggcattggccgcggccgctgcagtcccgctgggatctatggggaagtggatagattctttgctgaaagggtatcaggacgcgctccgtggacagaaggaggtggtgagcgcaatgcaggttggcacgttcattgccatcaaggatttggacagtatcagagtcctcatcaaccgggtggaggtggagatcagctcaatggtagactgtgtagagtttgcggagcgggatgaggaggcggtgaaatttggggtggaggagatcaagaagaagctggaaaactttatgaagagtgtcgaagatcttggggaacaagcagaccggtgtagccgggatatccgtcgggcaaggacggtcgtgctgcaaaggatcatccggcatccaaactgaaaaataaggggaaatgtaaggtatgcatgtcttaagatataaccatgtactcttgataatgttgtgatggaatgtatataagagatggacctttaggaaagtgtgaatgagtcaaatcgatttcattatcatttgattcatggtatctgtatttccatacttgattatctctttccctcccttgttactgtgcaagattattcttggcgttactgcaatttcacctcacctgttttgttttcatgaataattcagttctagctataaataaacatattataaaactctactgctagtattagatgcaagatactactcgtgatcatgatccacggaggtcatctaacttagcacttaacgatcatgctattaaacttaaccttcactttacttggagtgttcaaatgtccaaatttctggagtcaaaaacaaaatgtccttatctaggcttcatggttgttgtcgtgttccagacgtgtatatgttgtctctgttgttttctcaagtcatctgtgcttctaagtgaagcgaaacatttaattcagatgtttgattgtaaaaaagaacatctcagtattgactttttttctttatttaatgcataacacgtagtaagatcctcaatcatccaacctgtaatgactatcttcaacaatgcaaccctaactctggatgctgccaaatccaatttgagaagtaccttttcccaaattagtgaatagcttcaatgatatatgttttattttttttctttctttttgtacataactttttgctgccgtaatatataatcagtaggggcgcaagtgcctcctgttccattaaaaaagtgttatacgaaagcagcaaaatgttagcaattcatcttctgaactttttattaaagacccaattttttatgttcatggaatatttgcacattttgcctgcattattttggatcaactaaacttctaatttctcgtagttcacctgtatacttgtttgtttagaaaatgctgtcactatttgtagagcagtacaagtatctcactattttc

SEQ ID NO: 9222 - DNA, 2853 bp, Zea mays
  misc_feature (18)..(18): n is a, c, g, or t
gaccaagctaaggatggncccgcatgtcagccacgtataccggagaagaagcattagtcatgtcatgtctgtagactgcagtcggcgcaacgcccttctctctagatccttgggaaaccacgtcggccggggccggctttcatcctctgttttttttttcctcacagcttcagactggtccggcttactctgtcatgagtcatgatgccgcttggtgcttctaaagcttcacagagaggagaaatggataaaaaaggctcttgagacttggctatcacacaaagaaaactgaaaggaaataacggccacgtctcggttgtggcgaccataaaatctgggattcaggatcgacgagtgaccaatgactttggccacaggacttcctccggatatacatgtgtatatatgacgatgtacgagttggatcagtgtaagctactcttactgctgatctcacgtcgcacgtcttgtgattagccagccacatgcttaatgcggctaatttgtgggagtgacgagcatggaccgggtacatctggccagaagaattcagacactccactcatcagtttcagcttagaagaggtttcatcgcgatcacgagctcatcatgtgggctagatgccacggaacctgaccagaagctcaccggagaaagcacaagattccatataacagaattcagtttgcgaattgccaatttctctccgatgcgccgattagcattcgccgttgagcctttttggcttttgctgtggcccccgacaaggcaccatgccaagcccctcgttgctttgcttcccccaggctgcaagatcctcctccgccgacctcgaggagaggaggggaacatgaaacacgcgcaattgctgctgagctacttactacacacaccgcagcggtgcacaccacgtccacagtccacacgcgcgcgcctaggcctagcgatggagtgacaagcatcgggttgcttccggcgatggccattgccaaccccgccccccgtctccttcgtcatgcgtacaagacatccccacatcaccccctcctccaccacctcctcgccgcaccgcaaaatccacctccccttcccggccctgcattgcatccgttcttcttgcttgcttccccggaacctcgcgcttggtctgacgcaacgcaacgcgccttcgggccctgagataaaatctcccagcgctcgcttgctccgccaaaatccactccttggaatttcctgagctgtgggaaattttctcttttgttttggttcttctttgaccccttaggtcgctagcatttgtgcgttccgccgaagctcgcttgtttgatccgtcctagttgcggaagcgcctcttgatttggttctaaaatacatcgtttcttgttttcatccttccgaaggggggaaaatcatcttttttgggccctgatttgagtgtgtcacctttgcttccggcaatggggaacagcagcagcagcaacaggcgtccgccggggccctcggagccggcgctgcaagagctgagctcatacgaggccgcgtgccggtcggacccggagctgcgcaccttcgacacgacgctgcagcggcgcaccagccgcgccatctcgacgctggccgtgggcgtcgaggtgcggtcgatgtcgctggactcgctccgcgaggtcaccggctgcctcctcgacatgaaccaggaggtggtgcgcgtcatcctcgactgcaagaaggacatctggaagagccccgagctgttcgacctcgtcgaggactacttcgagagcagcctgcagaccctcgatttctgtaccgcactcgacaagtgcctcaagcgcgcccgcgactcccagctcctcctccacgtcgcgctccagcgcttcgacgacgaggaagacatcgacgccgccgccgctgctccctccgcccggtacgcgcgcacgctgcacgagctgcgccagttcaagacggccggggaccccttcacggacgagttcttcgccgcgttccaggccgtttaccggcagcagctggcaatgctggagaagctgcagcagcgcaagcaccggctcgacaagaaggtcaagaccatcaaggcgtggcgccgggtgtcaagcatcatcttcgcgaccacgttcgcggccgtgctcatctgctccgttgttgccgcggccatcgccgccccgcctgtggccgcggcattggccgcggctgctgcagtccctctggggtctatggggaagtggatcgattcgttgctgaaagggtatcaggacgcgctccgcggacagaaggaggtggtgagcacaatgcaggttggcacattcattgccatcaaggatttggacagtatcagagtcctcatcaaccgggtggagctggagatcagctcaatggtagactgcgtagagtttgcagagcgggatgaggaggcggtgaaatttggggtggaggagatcaagaagaagctggagaacttcatgaagagtgtcgaagatctaggagagcaagcagaccggtgtagccgggatatccgtcgtgcaaggaccgttgttctgcaaagaatcatccgacatccaaactgaaaaataaagggaaatgtaaggtatggatgtcttaatatatagccatgttactcttaataatgttgtgatggaatgtacataagagatgcacctttaggaaagtgtgaatgagtcaaatcgatttcattatcatttgattcatggaatctgtacttccatacttgattatctctttggttgtctatctggggacatatctggtgcacatagaagactgatgcacatggtgcacatattaaatcatcaccactcattttagatactaacgtctta

SEQ ID NO: 9223 - DNA, 1273 bp, Zea mays
agtgctgggcccacacgcagtgacacactgacactcaaagtcggcgaataggagaaaacaagtacgcggctttcttcacagatcacagatcatccagcatcgggtcaaaacgaaacgaagcatccacgttcgtcgctcccacgctggcaatggccgccgccgcatctcccgccaccgccgccgccgttcgcgaagcggcgccggcccacagacaaattggaatccgtccgggtcatggtccggccccattccgtatcggcttcctcgccaaaccgtcctcccggtgggccgcgatctctgtgccgcctgggcctcgccgcgcggctccggcggcgtccgcggccagggagagggtcgcggaggaggaggagaggcccgtgtcggtggacctggaacccatcgccagcgagcagcagctggactgggtccttggggaggcgcagcagctccagctccccatcgtcctgctctggatggcgagttggtgcaggaaatgtatatatctgaagcctaagcttgagaagttggcagcagaatatcatccaagaatccggttctactgcatcgatgtgaattgcgttccacaaaagcttgtgaaccgcgctggagtaacaaagatgccttgtatacagctgtggagcgactcccggaaacaggcggaggtgatcggcggcgggcacaagtcttggctggtgatcgatgacgtccggaggatcgagcaggaggaatgatccggcgtgtccttttagcgcagcgacctcagtattgccgcttgctcatagtcctagactgggcgtctgggccaggtgtttggtcgtcttgcatatattaggaaccatccatgatcagaggttttgaaaaatcgccggttcgtcttccatatatgaactctctccctggtgtcgcgatcaggaaaatgaaggaattgggctaccagtcatctgcgatgtccttgatgtatccatgtgtgtgtattaaaactggaacttgctgctgtatgagcaataatccagcacagcacggcaggacttattgccggtgtactgactggccttgccattagccactggatctggatggtagcactgttcatggatatgaagattagcatagcgagtacaatctctgctttagggttgtcaaaataacactggtcttgtttacaaacactagcttgtcttgtagcttgcttcttgaattctcaagagacaaattgtagccagctgggaaagtggcagcaggttcccctgtttttcttggtttgctcctgcat

SEQ ID NO: 9224 - DNA, 1726 bp, Zea mays
  misc_feature (1685)..(1685): n is a, c, g, or t
  misc_feature (1690)..(1690): n is a, c, g, or t
  misc_feature (1694)..(1695): n is a, c, g, or t
  misc_feature (1699)..(1700): n is a, c, g, or t
  misc_feature (1706)..(1708): n is a, c, g, or t
  misc_feature (1711)..(1712): n is a, c, g, or t
gcacgagaccattacctagcacatcggcggcccgcacttctcgtccccgctccagtggatgccccatccctccattcaaggttggtggcgggtgcgccggtgtctctctcagcccctcgtcaaccggatggtcacactgccacgccatcgctacacgcagtagtaactgcactggcatagcgacacggcaggcacacgcttcttccccgtgcttgcagtcgcagtgcagctgttcccacactacaccccgtcagtctcggccactgcatagtctcaagaagcagaaatggagttgccaagatccatggccgttcttgtgctcgtgttcgtcgtcttgtgccgagtgggggaggcggcgacgttcacgttcgtgaaccggtgcacggacacggtgtggccgggcgtcctgtccaacgccgggagcccaaggctggagcccacggggttcgagctcccgccgggcgcggcgcgcgcggtgccggcgccggcgggctggtcaggccgaatgtgggcgcgcacgggctgctcccaggatggcggcacggggcggctcgtctgtgccacgggcgactgcggctccggctcagccgagtgctcgggcgcgggcgcggcgccgccggccacactggccgagttcacgctcgacggcagtggcgggctggacttctacgacgtcagcctcgtggacggctacaacctccccgtgctggtggagacctccggcggcggaggctccacggggccagcctcgtgcgccgcggccgggtgcgcggcggacctgaacgcgatgtgccccgccgagctccgagccgggggcggcggcgcgtgccggagcgcgtgcgacgcgtttgcgcggcccgagtactgctgcagcggcgccttcgcgtccccggcggcgtgccggccgacggcctactcgcaggtgttcaagaccgcgtgcccgcgctcttacagctacgcattcgacgatcccacctccacattcacctgcggcggcggcccggactacaccgtgacattctgccccggcgccaccccaagccagaagtcgacgaccatgccgagcgcgacgccgacgatggtgccgggggggacaacgacgacagtgccaggggcgacgcccacgacggtgccggggacgatgccaatgccgggcgcgaccccagcgttgccgacagggaccatgatgccgggcactacgttcacggacgccaccccggacagcgggatgccgatgggtggtggtggtggcctgggcatcgagggcggggaacaaggcagcgtgctactcggagccagcagcggcgaaggcggcgtctcttggctcgccaacatggccaccggcgacgcgtccgccgcgggcgccccgctggtggcttcggctcggttcgtggtggcgacattgctctgcggcctccatttgcggcggcttctgctgtagtggtgatggagagggtagaggaaacccactcgtacgtagtagcactgtactgtaccttaccttacattgtagcagtgtctgtagatgattactatcaattgatgatgttgagttagtcgcaggattagacacttgtgtctgctagtactggttctggttctagttctagttctagagaagaaattaatgcatgcttgcgggtgggcattgattgattaagttaatcgccgtcgtgctaaaaaanaaaanaaannaaannaaaaannnttnnaaaaaaaaaaaaaa

SEQ ID NO: 9225 - DNA, 3761 bp, Zea mays
gagttcaaaaaatttgtaaaactccaacgcaatgcttaaacaaagcaggttaagtctaactagaattcagtccaccaaagaggagcaaacagtgccttcaagcaggtgtatgagttgtgcgtctcgctcctagccaacgacggattggaggcgcaatgtatcagtcgtcctcccctggcatcaccattgatcatcaagctcaagcaaattaaatccctcttgagcatttgatcaaaaacctcacgcgcatggaccacaccagcaccgcttgagctgagcacgcagaggagaaaaaaaagagccgacgagccgtccgtaagcaagtcagagcaaaagaagcgattacagatgagaaaagaaagaagccggacaagtccataagccgagccagttccgtttccttaagatttgtgggcggacgcgtgtcgtcgatccaaaggcagctacatagatgttttctacagtgacagtagtcaattttttttcctcctccagtggagatggtctatcaaaggtaaaaagcgaggtaaagtaatttgctgctataagtacagccttagcgcctcccaaaagattccttctcgtccccgctccagtggatgccccatccctccattcaaggttggtggcgggtgcgccggtgtctctctcagcccctcgtcaaccggatggtcacactgccacgccatcgctacacgcagtagtaactgcactggcatagcgacacggcaggcacacgcttcttccccgtgcttgcagtcgcagtgcagctgttcccacactacaccccgtcagtctcggccactgcatagtctcaagaagcagaaatggagttgccaagatccatggccgttcttgtgctcgtgttcgtcgtcttgtgccgaggtaatgatctctcggcaaatcgaccgaatgtttccttctttaacgagatcttgcgtggtcaccagcaatggcgggtgaccaagctgaagcattctcgtttgtcgcagtgggggaagggcggcgacgttcacgttcgtgaaccggtgcacggacacggtgtggccgggcgtcctgtccaacgccggcagcccaaggctggagcccacggggttcgagctcccgccgggcgcggcgcgcgcggtgccggcgccggcgggctggtccggccgcatgtgggcgcgcacgggctgctcccaggatggcggcacggggcggctcgtctgtgccacgggcgactgcggctccggctcagccgagtgctcgggcgcgggcgcggcgccgccggccacactggccgagttcacgctcgacggcagtggcgggctggacttctacgacgtcagcctcgtggacggctacaacctccccgtgctggtggagacctccggcggcggaggctccacggggccagcctcgtgcgccgcggccgggtgcgcggcggacctgaacgcgatgtgccccgccgagctccgagccgggggcggcggcgcgtgccggagcgcgtgcgacgcgtttgcgcggcccgagtactgctgcagcggcgccttcgcgtccccggcggcgtgccggccgacggcctactcgcaggtgttcaagaccgcgtgcccgcgctcttacagctacgcattcgacgatcccacctccacattcacctgcggcggcggcccggactacaccgtgacattctgccccggcgccaccccaaggtccggcctttgatttcactcgcccttcttttctcgcaccattgcctgatttattggtcactcccatcgtacacttgcaatttctcgctctctctagagagagggagagaaagagactatgaaacaagatttggcactgcgtttctgccaagtttgtctggatctgtggatgggttcttggcttgtgaatgtggggttgatctgccgcagctcttttttaccgtgcctgccagctagtctacactatactacacagccttctgtcgtcctttagctcctcttgtcactaaaacagtcagaggtttctgactcaccgcaagatttccagctattaattacctactaaaccagtacttagctaattgttgttaacaagattgacattgtcagagatttctggcttctctgcgagaagttgaagacttgaaatagtttaaggcattatctagtaatgcaatctactactaatcttatttgtattcctagaaagccgaaagacaaggaagtaggaacatgcatggtttacttgcaagatctggcatactatttgtttttatttttttggggctattttccatttgcgtgaattgcttttgtccgtactactgagcatgtgaacactgatcggttggcgctgctattgtgtgtatccgtaacgtgagcgcagccagaagtcgacgaccatgccgagcgcgacgccgacgatggtgccgggggggacaacgacgacagtgccaggggcgacgcccacgacggtgccggggacgatgccaatgccgggcgcgaccccagcgttgccgacagggaccatgatgccgggcactacgttcacggacgccaccccggacagcgggatgccgatgggtggtggtggtggcctgggcatcgagggcggggaacaaggcagcgtgctactcggagccagcagcggcgaaggcggcgtctcttggctcgccaacatggccaccggcgacgcgtccgccgcgggcgccccgctggtggcttcggctcggttcgtggtggcgacattgctctgcggcctccatttgcggcggcttctgctgtagtggtgatggagagggtagaggaaacccactcgtacgtagtagcactgtactgtaccttaccttacattgtagcagtgtctgtagatgattactatcaattgatgatgttgagttagtcgcaggattagacacttgtgtctgctagtactggttctggttctagttctagttctagagaagaaattaatgcatgcttgcgggtgggcattgattgattaagttaatcgccgtcgtgctatgttgtttgttgccactgtttgttcatgcgtggctcgaggttggcggggaacacgggcctggcatggtctcagagaagactgcctggaataaaaaacatactggggtcctgtgttcactctaccacacaagtagtgtacccaactacccgttgttttatacgtataacgtactgagtacgtacttgtataccacattgcgtgtatagtgtgctgtactattgtgtagtagtggcagcgccagctgccagaggagggcgcgtaccgccgtaccggtgtactagtgaaggtgtggtccgcaacatgcgcgggcgcgggtgccgaggccgcaaacacgtaggcccgcccacccgcctactgctgctttcgagtgaggcgaaaggagatttgttgtgacctgctacgatgtggtgcaccggtggtgcctgctgggcatccccgcatggcatgggcctctcctctgccaggctggtcccttttcccagtccccctcccttttcccaggctttatctcctcctacggtctcgccctcgggcataggcgcatagcccgtgtgttccagtgtaagctagctacccgtatactcttaaaagatctaagaaataattaaaaatatataagaacatgactctctatatatattgtcttttaattataattatatatattatctgtaattatgattcaaaagtttaaaattttataatacagtttcttagccgtttcttgtatttagaaaaccggatttagggtctctagtttgtat

SEQ ID NO: 9226 - DNA, 626 bp, Zea mays
  misc_feature (619)..(619): n is a, c, g, or t
ccggccgggggaggctcctcgcccgcccgcaccccccctctctctcccctggctgacgccgcgaccgccccaacccaactgcccttttcggagatctcgccgcctccgccgtcgacttccgtcgcccccctatcccgcgtccgggcttacccgatggcacggctgcactggcttgaggccgtcctgccgctggggatcatcggcggcatgctctgcatcatgggcaacgcccagtatttcatccacaaggccgcgcacggcaggccgaagcacatcgggaacgatatgtgggacgtcgccatggagcgccgcgacaagaagctcgtggaacaatcctccggcaactagggtattgatcaacctcaaacttttctggatgttgacgaacctcgttcaaaagcacagaagtactgctcttttgtttcctgtacaattggaaccaagacttgtttgttttgctttgaaatatcaacagttcggagaataatctgtatctgacatctgtttaattgaacaaagccaaatactttgtcaaaaaaaaaaaaaaaaaaaaaaaaaaaaaaaaaaaaacaaaaaaaagcaaaaaacaaaaaaaaaaggccccttgggcccctaatanccacggg

SEQ ID NO: 9227 - DNA, 1936 bp, Zea mays
tcgggaagttgcgccttgtgctggacccgggattcggccgccggcccggccagatccacccggaggccccgcccgcacacacactctctctctctccactggctgacgccgcgaccgccccaacccaactgcccttttcggagatctcgccgcctccgccgtcgacttccgtcgcccccctatcccgcgtccgggcttacccgatggcacggctgcactggcttgaggccgtcctgccgctggggatcatcggcggcatgctctgcatcatgggcaacgcccagtatttcatccacaaggccgcgcacggcaggccgaagcacatcgggaacgatatgtgggacgtcgccatggagcgccgcgacaagaagctcgtggaacaatcctccggcaactagggtattgatcaacctcaaacttttctggatgttgacgaacctcgttcaaaagcacagaagtactgctcttttgtttcctgtacaattggaaccaagacttgtttgttttgctttgaaatatcaacagttcggagaataatctgtatctgacatctgtttaattgaacaaagccaaatactttgtcaattgtgtatgcacaattatttccgccaccggggcagatccatgaacaccaaaaaaaaaacgtttcacagaaaaaaaaaaaaaaaaaaggcccaaaaattgatctgtccatggtggatccaaaaaaaaaaaaaaaaaagcatataaggatacccattctaattaaacaaggtgctggttgccgatcctatttgttctctaggaaatgccagtgaatcagatgttgtgctgaagagcacaatagtcaagaaaaccacaatgggactgaatcgcagcaatcagtcatctggaaaggaagaatatctggtcattgatcaggaatcttaacatctgaaagaaaaatacctgatcaataatggttctttattttcacgctgatcaggtgaatcaggttttacattcaacaaaatccaaatggcaaatcagagatgaaccgtcaaccgtccctcgtcgtttctggcgaagaaccatcatccttgtagccccggggcgactcatttgtgttgccgccggtgtttgtgctcagcatcctgggggattcactagcaatttcgacgccgctgtttgtgttcagcatccgcggcggttcgtggtcaggggtgccgccgctgtttgtgttcagcatccgcggcgattcgtggtcagaggtgacgccgctgttcgtgttcagcatccgtggcgattcgcggtcaggggtgccgccgccgccgctgttcgtgttcaggatccgcggcgattcgtggtcaggggtgacgccgccgccgctgttcgtgttcagcattcgcggcgactccgtctgctcagtgggcgactgcggttcggcgcctggatcggccgcctggtgctcctcttcctccagcacaagccgggacggcaggcacttgcggcgatcttggtactgttcagcctccaactccacgtcgtcggcgtcgacgtcgtaatcgtcgtcttcttcctcgatgtcgtcgtcgtcgtcgtcaaggttgacgacgtcctgcatgttgagctggtagtagtcgacgatctcccgcaggaaccggttctcccgggcgtacaccgtgttctcgtgcgccagccgcgtcttctccgcgagcagcgtctccagctgccgccgtatctgatagtaacacgagcaacggcaggagtgacatacggtatgcgtacttgacctcacctcaccatcatattcgccactggttgcagagcgaggccggtcggtcgatcgggcacgtaccaggtcctcgtcggcgtcgtggttgccgtcccggagcagccggttctcctcctccagctgcgcgcaccgctccttggagaaggccaggtcggccttcagcgtcttgagctcccgctgcag

SEQ ID NO: 9228 - DNA, 1253 bp, Zea mays
gggtacctcgaggccggccgggaaaaaaatacaaaaagaggaaaaaaaaaaaaaaaaaatttaccaaaaaaaaaaattggggaccggccggcccgccgctctctctctctccactggctgacgccgcgaccgccccaacccaactgcccttttcggagatctcgccgcctccgccgtcgacttccgtcgcccccctatcccgcgtccgggcttacccgatggcacggctgcactggcttgaggccgtcctgccgctggggatcatcggcggcatgctctgcatcatgggcaacgcccagtatttcatccacaaggccgcgcacggcaggccgaagcacatcgggaacgatatgtgggacgtcgccatggagcgccgcgacaagaagctcgtggaacaatcctccggcaactagggtattgatcaacctcaaacttttctggatgttgacgaacctcgttcaaaagcacagaagtactgctcttttgtttcctgtacaattggaaccaagacttgtttgttttgctttgaaatatcaacagttcggagaataatctgtatctgacatctgtttaattgaacaaagccaaatactttgtcaattgtgtatgcacaattatttccgccaccggggcagatccatgaacacaaaaaaaaacacgtgtcacagttgttttggcttttgttgaaaaaaaaaaaaaaaaaaaccaaaatggtggaggcccctcggggtacatctggatgatataaggatacccattctaattaaacaaggtgcagattgccaatcctatttgtcctttaggaaatgccagtgaatcagatgttttgctgaagagcacaatagtcgagaaaaccacaatgggactgaatcgcagcaatcagtcatctggaaaggaagaatatctggtcattgatcaggaatcttaacatctgaaagaaaaatacctgatcaataatggttctttattttcacgctgatcaggtgaatcaggttttacattcaacaaaatccaagtgacaaatcagagatgaagaaccgtcaaccgtccctcgtcgtttctggcgaagaaccatcatgagacctgttaggtgtaacttggttgtggccgtcaccacgacgatcattgcgacattgctcccataccaatgcaccctgaaaccatcagctttattatgaccgtatccttacattggtcttgttatcattgtggctatattataaatgtgcacactgtattttacccttccactg

SEQ ID NO: 9229 - DNA, 1426 bp, Zea mays
ccggcctccattgccaaggaaatttcagaggcggaattgagatagacgagggagtgggaagggagacagggaggggtcagtcgtcttcctttgtccccgtgctgctcctttgcttcggagtcttgccaagcctagattcgaggagagggctccctctctttccttgcttggcctgcatcggaaggtgcgattggcgctctctgtcctacagtgcagaccgaaaattattttacgcaggattctgatttttctgttggaggaatgtcctcaaccacatctattcagccctcagcatcttcaggtggtgcatctacttcagctgatgagaatgcaaggcctcctgattcaggcactaattcttctggaccagcacgaagcatattgtctctacagttggaccagcggtcattacatttttctgttagtgcttgggttcttattgttgccttgattggcatctttccattggcaccacattcccttcagtataagggatatcggttgtcacttcttggcacaacatgtactacaggctatgctttgtttgctttgtacaggctaccccgagcagggaacatgcaggctgttcaggtgtggtgtcaccatgtaactgcatcaaaggattttataccattcatgtactgccttatgttttctacatccaaactgcacttgaagcttgttttggtacctgtaatttgttgggcacttgaacatgtcgctcgatttctacgtcgccattttactagctcatctttgtacaggacatacttggagcaaccttgtacatgggttgagacaaacacaaatgcagtccagtttctacgttcaaatgcagagattttgacgggctttcttttgatcctatccctgttctcgcgacagcgaaatcttatgcaaacattcatgtattggcagttgctgaagctcatgtaccattctcccttcactgccgcttatcatagagctatctggctaaaaattgggcggacaattaacccttatatccaccgttacaccccttttcttcatgacccgataaatgctggcatgagatggtggtttaggtaggttgaatgcagcactgtcagtcatgtaaagagatgcaagtatgtttatggtattattttactccaaagagaatctttgagaaaactgctgcttgggagtggtgtgattagtcccttgtgtggctttgagctgatgacaatttagtagttagcatgatcagtaactcttaactcttgtaggcttgtagctagagctagtcgagatcttagcctgtttggcatgaactgaagttaggtggggaggttattattgtgaccgaattgttttgatttttctgactattggctattgctgaccacatatcagtgttatcaaagggacgttactattctacgtgttaaaaaaaaaaaaaaaa

SEQ ID NO: 9230 - DNA, 783 bp, Zea mays
aaacgtcgtgggtcgtgctcgtgcagctctaggctttttttgaggaagcggtaagcgcggagggaggacgggagagagagataggcgtgccttcgtcgtccgtgccggtgcgtggcgtggtggccgtgccgaccgtccgtccaccccctctcctcttcccggcgccggcgacagcgggagggactccctgggaggaatggccgtggtgagggctccgctcggcgcggtggcggtggccgctctcgtcgtcgccatcttcatgccggccgccgcagcggcgcaggcaccggcgcccgcgcccaccagcgacggcacatcaatcgacctggggatcgcgtacatccttatgctggtggccctggtgctcacctacctgatccacccgctggacgcgtcctccccctacaagctcttttaatctctgctccttttcgtttggtcatgcggttatgggtgctataggaattttaggtgcgcgagatgtttaggtgaggttgggaggtttagaatgatgatgattgcaatcatttgatcttggtatgtatccatcgagatgtatacgtgcaggtcgcgccgtgtcggcttcacattacgcagcttgaatgacagtcgacgaatgtggagtcgtattcctagccaaatgacccgcgcatgtatatttgtcgaagatttccattgcatggcattcgttgaacggaacctcccgctattacatcgagatcttggggaggcagcccctgttgtatgaaccatagacagacactaaaggatctgtgatacgat

SEQ ID NO: 9231 - DNA, 834 bp, Zea mays
ccggccgggagcccctcattgtggtcctccctccgtgcaggaggtcctgccggcgggtccgccaaacacagcgttacggtggacccacatgtcatccatggtgcgtagcttgcaggcgggttctaatttctaaattacagtcagacgcgcagcaacgtcgtgggtcgtgctcgtgcagctctaggctttttttgaggaagcggtaagcgcggagggaggacgggagagagagataggcgtgccttcgtcgtccgtgccggtgcgtggcgtggtggccgtgccgaccgtccgtccaccccctctcctcttcccggcgccggcgacagcgggagggactccctgggaggaatggccgtggtgagggctccgctcggcgcggtggcggtggccgctctcgtcgtcgccatcttcatgccggccgccgcagcggcgcaggcaccggcgcccgcgcccaccagcgacggcacatcaatcgacctggggatcgcgtacatccttatgctggtggccctggtgctcacctacctgatccacccgctggacgcgtcctccccctacaagctcttttaatctctgctccttttcgtttggtcatgcggttatgggtgctataggaattttaggtgcgcgagatgtttaggtgaggttgggaggtttagaatgatgatgattgcaatcatttgatcttggtatgtatccaaggctccaagccgttggtgttctgattggtttgtaattgtatcggattccattatctttgtgctcagtccctgatttgctcctgctgaaaaaaaaaaaaaaaaaaaaaaaaaaaaaaaaaaaaaaaaaaaactc

SEQ ID NO: 9232 - DNA, 861 bp, Zea mays
attcagttgcgcacccccggcccggcaggcctaggcttttttgaggagcgcggactagggagtagggaggacgggacgggagagagagagagaggcgcgtgcgttcgtggtcggtgccggtgcgtgcgtggcgtggtggccgctgccgtacgtgatccgtccaccccctctcctcttccgacgccggcgacagcgggaggtactcccggggaggaatggccgtggcaagggctccgctcggcgcggttgctgcgatggcggtggccgctctcgtcttcgccatactcatgaccgccgccgctgcggcgcaggcaccggcgcccgcgcccaccagcgacggcacatcaatcgacctggggattgcgtacatccttatgctggttgccctagtgctcacctacctgatccacccgcttgacgcgtcctccccctacaagctcttctgatccctgcgcctttccgtttggtcatgcggttaagggcgcgataggattttgagttaggcaacgtgcttaggtgaggctgggaggtttaggatgatgattgcggtcatctggtcttgcttggtatgatgtattggaggctcgaagctgttggtgttctgattggttttgtatcggacggactccatgatctttgtgctcagtccctcagttctgctctgttttggctggtgccgctcggtgtatgagctctgctctgcttgccgttgcaagttgcggcagcaggcacgtgaagagtggatgtgcctggcacagctgcctgacacgcatgcttgtccttcctgtcacgcatgcaacttttgatattcaatggacttcgaaacatttagattgtaaaaaaaaaaaaaaaaaagcggcc

SEQ ID NO: 9233 - DNA, 1011 bp, Zea mays
gggtacctcgaggccgggccccccggccgggccgggccccccgcgtcttcacacagcagcctttttgttctccccgcgagcgctctctttctctatcgactggcgacgactccgccaccgccgccgctctacgcgagacgcccaggtcttcgccaacgacgagcatccgggttagagaggaagaaattgcaaccgaaacaatggcggcagattccggcgctcgcagacaaccaagcttcaccaaggtcgaccagctgcgccctggaacccacggccacaacctcatcctcaaggttgttgactccaagatggtcgtccagagaggccgcgagggagggccccagggaagacagatgaggattgcggagtgcttggttggtgatgaaaccggcatcattgtcttcactgcaagaaacgatcaagtggatgtaattaggcctggaacaactgttgaactgaggaacgcaaagatcgacatgttcaagggttcgatgcggcttgcagtggacaagtggggaattgtcaaagctgctgaaagctcagctgagtggacagtcaaggaggacaacaacctgtccttaattgagtttgagctggtgaccgtgacggagtgaaaaccgccattgcttaggagtattgttggtttgctgtgttgttgaacctaatcatcatcgccaatcaataaggactcgtggttgatgttctcggcatcggagttgcgtattgctgtaccgttgcttgcttactgtgcgttgtggctacttttgactgctatcgaataataataaattggtgtcatgaagtggaaaaaaaaaaagcgatgatggctactttctgcagcagcgcctgttgttccatggggcctgatctctttaaaaaaaaaaaaaaaaaaaaaaaaaaaaaaaaaaaaaaaaaaaataaaaaaaaaaaaaaaaaaaaaataaataacaatcaaaaatattaatattcttaataaaaaaaaaaaaaaaagggcgacacactctacggggg

SEQ ID NO: 9234 - DNA, 925 bp, Zea mays
ctcgaggcccgccgcgacacctctgctcagacctttccaaactcgcgacccagcgtccatacacacaccagcctttttgttctccccgcgagcgctctctttctctatcgactggcgacgactccgccaccgccgccgctctacgcgagacgcccaggtcttcgccaacgacgagcatccgggttagagaggaagaaattgcaaccgaaacaatggcggcagattccggcgctcgcagacaaccaagcttcaccaaggtcgaccagctgcgccctggaacccacggccacaacctcatcctcaaggttgttgactccaagatggtcgtccagagaggccgcgagggagggccccagggaagacagatgaggattgcggagtgcttggttggtgatgaaaccggcatcattgtcttcactgcaagaaacgatcaagtggatgtaattaggcctggaacaactgttgaactgaggaacgcaaagatcgacatgttcaagggttcgatgcggcttgcagtggacaagtggggaattgtcaaagctgctgaaagctcagctgagtggacagtcaaggaggacaacaacctgtccttaattgagtttgagctggtgaccgtgacggagtgaaaaccgccattgcttaggagtattgttggttttctgtgttgttgaacctaatcatcatcgccaatcaataaggactcgtggttgatgttctcggcatcggagttgcgtattgctgtaccgttgcttgcttactgtgcgttgtggctacttttgactgctatcgaataataataaattggtgtcatgaagtggaaaatgccatgcgatgatggctactttctgcagcagccgcctgttgttccatgggaaatgatctaattacaaaaaaaaaaaaaaagggcgagccgccgcactagtga

SEQ ID NO: 9235 - DNA, 972 bp, Zea mays
gaattcggcctctaggcccggcggcgacccaggcacccagcgtccatacacacaccagcctttttcttctccccgcgagcgctctctttctctatcgactggcgacgactccgccaccgccgccgctctacgcgagacgcccaggtcttcgccaacgacgagcatccgggttagagaggaagaaattgcatccgaaacaatggcggcagattccggcgctcgcagacaaccaagcttcaccaaggtcgaccagctgcgccctggaacccacggccacaacctcatcctcaaggttgttgactccaagatggtcgtccagagaggccgcgagggagggcctcagggaagacagatgaggattgcggagtgcttggttggtgatgaaaccggcatcattgtcttcactgcaagaaacgatcaagtggatgtaattaggcctggaacaactgttgaactgaggaacgcaaagatcgacatgttcaagggttcgatgcggcttgcagtggacaagtggggaattgtcaaagctgctgaaagctcagctgagtggacagtcaaggaggacaacaacctgtccttaattgagtttgagctggtgaccgtgacggagtgaaaaccgccattgcttaggagtgttgttggtatgctgtgttgttgaacctaatcatcatcgccaatcaataaggactcgtggttgatgttctcggcaccggagttgcgttttgctgtaccgttgcttgcttgctgtgcgttgtggctagttttgactgctatcgaataataataaattggtgtcatgaagtggaaaatgccatgcgatggtggctactttctgcagcagcgcctgttgttccaggtgacgtgatctctttaatcttgcgtctttggatcattggaattgaattccattctaataataataatttagtcataaaaaaagaaaaaaaaaactagagggggggcccggtaccc

SEQ ID NO: 9236 - DNA, 4246 bp, Zea mays
  misc_feature (722)..(722): n is a, c, g, or t
  misc_feature (760)..(760): n is a, c, g, or t
tgaattttttttggatagtttacgtgagtattgttgtgagccgtcgcaacggatggacaaccgactagtattttttttagaaacagataattgaattttcaaattaaaaaatataaatggaaaaatttcatatgaaaaaaaggcccaacagcagcagccttttactactgctcagctcagacctttccaaactcgcgacccagcgtccatacacacagcagcctttttgttctccccgcgagcgctctctttctctatcgactggcgacgactccgccaccgccgccgctctacgcgagacgcccaggtcttcgccaacgacgagcatccggtacgctcacccaatctcttcccttacttactgctatgcggaaacaagcgcccaaaccctaaacttggttatttgtaatcggatctgatgtgatctacaagtttatatacaatcgcccaccccagattacgagctacaggtgctaaacccggtcaaactcagtatatccgtccgatccatacacatctgacgcttaattaatgatattatcgtcgtatccatagtcatgtcatggtttagggttagagaggaagaaattgcaaccgaaacaatggcggcagattccggcgctcgcagacaaccaagcttcaccaaggtcgaccagctgcgccctggaacccacggccacaacctcatcctcaaggttgttgactccaagatggtcgtccanagaggccgcgagggagggccccagggaagacagatgangattgcggagtgcttggttggtgatgaaaccggcatcattgtcttcactgcaagaaacgatcaaggttctcccaactctttccccatcccctcacaatatcttacactcaatctaacagcatatcactctttgtgtatacgcctagtactaatccagtcaatttaacaacatattactgttttgtatgtgcgactagtactaaattttctagtcttgtggttcattcatctcagcgtcacctattctgtctgatgtggttgcgttgtgtataaccttaattttccatgccttcggttatattctccttagttaagttataaagtccataattctccttagttaacttataatgttcataatctttatttgctggtacagatctagcgtaagttgaattcatcatctgttgcatgttctgttctgttttcctatgctgatagcagtaaccatatcaacccaaccttgcttctaatctgatcaaacattattggttcctattataggaaggaatcatatgaaatgctaagatatatgtcatgttctttaccattaccattcaatagttgcatttgttcagttctaggcatgtattccgcttttctttaacaactatttagtttatacctttggtggtcatcttcagtgtcgacatacctacttgatatagctgtggttgcataaatccaaagaactgatcgtgtcactttcccgacaaccgagtataatgtgtggctttgcatcaggggacaagtgtcatgtacacgattcactctttactgaagcactcagttttcttaagcttgtgtttggttccttgccgcttctgggtcgttcctgtgaggccgcgagggagggccccagggaagacagatgaggattgcggagtgcttggttggtgatgaaaccggcatcattgtcttcactgcaagaaacgatcaagtggatgtaattaggcctggaacaactgttgaactgaggaacgcaaagatcgacatgttcaagggttcgatgcggcttgcagtggacaagtggggaattgtcaaagctgctgaaagctcagctgagtggacagtcaaggaggacaacaacctgtccttaattgagtttgagctggtgaccgtgacggagtgaaaaccgccattgcttaggagtattgttggtttgctgtgttgttgaacctaatcatcatcgccaatcaataaggactcgtggttgatgttctcggcatcggagttgcgtattgctgtaccgttgcttgcttactgtgcgttgtggctacttttgactgctatcgaataataataaattggtgtcatgaagtggaaaatgccaatgcgatgatggctactttctgcagcagcgcctgttgttccatgggacgtgatctctttaatcttgcgtcccgtttggatcattggaattgaattccattctaataataataatttagacatatatcgattgaactaattcgactttatgcaaaatatatcagtatattattattagcaatatattgaatttatttatgtactatatttttactacagagaagtgagttaaaaagtgtcttataagttacacagtagaaacaaattttagtaattattagcaagacgtcgaagatatttatgtgctatatttttactagaggagtgatttgaaaagtgtcttataagttacacattagaaacaaattttagtaatatataaaattatttttcatcctctcctccacaccataaatttgagataagcttatatcagaactttaaaagtggtggaatatcaaattccagactaaatatgttactttattaagtgaattctaattcctataaaatgaaggcatccaaacgctagtaatataaaaaatcatttcccatcctctcctccacattatgattttgagataagcttatatcagaactttgaaaagtggtagaatattaaattccaaactaaataggttactttattaagtgaattccaattcctataaaatgaagtcatccaaacgccttatggtaattaagcctttgtacaaaactactggagaagtgagcatgaccatggatccacaaatgcagaagacaagagaatgcaagcagcaacacccaacattaacctgattactgcaagtcggcgtcaaagcaggagcagggttctgcagctgcattgcatggttgtcgaactaatatttatgtggagcgggattctgcaactaaaataaaacggaaggagtatatagtcaatagcatagatcacagtactactataacttcacccaacccctaccccaccccatgccccctcgcgcgcgcaacaaccgtcccgtgacctctgccacgcgtcgtcatccaaccaggtagccctcaccttagggtggacgtgtcgtcatccaaccaagctgcccccaccctagggtggacggggctgagcgtcgtcgtcgcgggccgcttgtttgtcgtctctaagtacaagaggatgaaggtcaaggtgtacgccccagagacgaactcatggctcatgggacacggtcggtggcgcctcgatgccccaacgcatcatgatgcccttctcggtcagctgcaccaagagcaggatcgttgtcgtcgggcgaggccggatccatgttgcgattggccttgtgtgggaggagcccgctttcggtcctggtagcagggggccagcctacttcgtccgctagcaggatgtggatgctccataggagttcagcgtcctgacgccttcgagctgccagattctgcatgcttgaaatggctcgttgagcggtcgactgttggaactgcctcctgcccctgctttgatgagatgcgcgattgctgtgtcctgcatagtaggattttttccagtccctgataatccggagagagctggagatgtaaagaaataagtcgacacatttcaaaccggagagacgaactaaggctcttcaaaaatggttgtaaagtaagtagatgcttgtcagtttctcgaacatgtatattgcgagctatcttttgtttttctccatgtgaagcaaaacacttttgtcatgctatccatactaacatggcccacgatggcatcggcgtcggagacatggagtcagtgtagtcatccaagaaccggagactccaatccagatggactgtttgctgaggaaacaaacacagctgctctcgggcccactgctcgactttgcgcttgatttgtgcaaattagttgctaaatttaggtccctctgccgcggaagcaacgtgtgttcctttccttccataggagacaaggaggaagagtgggtcgaatcccttgtaggtatcgccgctccacaggccccgtagtcagtcgatacccaccgttcaagtaaccccacttcgttttgtttctttttttaaaaatcagtctggaactaatataaacacaaatttacatggtaaagaactgaaataatatacactcacaaattcacaccatctaag

SEQ ID NO: 9237 - DNA, 2492 bp, Zea mays
  misc_feature (2411)..(2415): n is a, c, g, or t
aaaatcaactcgagcaaagcagctagctagctagcgctagtaccatcgtgcgagtgtgagcaagctactgagagatctcggaacgttgcttgacagcttgagtaggtaaataatctatggcgcgccgacagtggagcagcggcggcctcgcggtcgcggtgctcgccgtgctgtcgtccgtgctcatctgctcatcgggccacccggtgccgggcgggcacggcggcgggctccccctgcagccgcacttctacggccacgcgtgcccgcagatggaggccatcgtggggtccctcgtggcgaaggcgcacgcggaggacccgcgcatggcggcgtccctgctgcggatgcacttccacgactgcttcgtgcagggctgcgacgcctccgtgctgctggacgccgacggcagcggcaggttcgtcaccgagaagcggtccaaccccaacaaggactcgctccgggggttcgaggtcatcgacgagatcaaggccgcgctggagcacgcctgcccgcacaccgtctcctgcgccgacatcgtcgccgtcgccgccagggactccgtcgtcctgaccggcggacctggctgggaggtgccactggggaggagggactcgctgacggccagcctgagcggctccaacaacctcatccctgctcccaacgactccctccccaccatcatcggcaagttcgccaaccaaggcctcgacatcgtcgacctcgtcgcactctcaggggggcacaccatcggcgactcgcggtgcgtgagcttccggcagcggctgtacggccagaacaacaacgggcaggtggaccggacgctgaacccggcgtacgcggcggagctgcggggccggtgcccgcggtcgggcggcgaccagaacctgttcgcgctggacctggtgacccagttccggttcgacaaccagtactaccacaacatcctggccatgaacgggctgctcagctccgacgagatcctgctcacgcagagccgcgagaccatggacctcgtccaccgctacgccgccgaccagggcctcttcttcgaccacttcgccaagtccatggtcaagatgggcaacatctcgccgctcaccgggagcgccggcgagatcaggcacaactgcaggagggtcaaccacttctagcttccatggagtggccatccgtgcagtggtgttcttgctttggtttcatttctggatgcatgcgtcatctttcatacttggatttaagtgtgcagtagtcgtaaatgattggaatttctgttttagtttggtgcccattcgatctcgagtcgattttcactcatgtaatttgcaaatcttgtacgaagaaatgatccaataaaattcagcatttgtgtcaaaaaaaaaaaaaaaaaaagtaaggatggtatgcatgggtaccgcggctttttccctttggattttacactcagtcaaaggcagactcagcccaagatctgggggggggggggcacgtctaaatgggggcataaatagaggtctacttatcaatgtatctataagtaaataagataggggtccacaaaaccagaaaaacgagtggagtttgtgcccccactcgccacaacgtaggtccgcttctccttctcccctagtatgtacactttgctaagttctacctttgtctcattggactgttcagttttcgcctcaaccgacaaacgacgcttgaccctgtgctatacccctaccaccctcttgtgaccataccttattacccgatcgaccagccaacgctctagcctctagaaggccctgaccggccatcgtctctcaggtctctgctcattgagagcacctagaggggggtgttgaataggtgatcctgcaaaattaactctaaccaacacaaacttggtttataataggtgttagtgagaactaaaaccaagcaagtagagttggaaaggagaagagaactcttcacttgattgctcctttaagatgagtattaaacttaggagcaataatgcaagtgaaatatgataactctttggaagacaataattgcaataaaaataaatgcacaatagacacgacgattttatcctgtggttcggcaaaatgtgtactccacgttgtggtgacctcctttggtcaagggttgcactcaacccctctcaaatgatccaaagatcaaacttgagtatcatggttttcttccttatatcaaatccctttgtgaggaatctctataagttggagccgctcatgtcttacacaaatgatctcaatcaaagcacaagagtaaggagggagtagagacacaaacaagagtacaagaacatcaacaccacacacacaagcaaaggagaaaccacaagaatcaaaacgacatagtttctcccaagaaaacgctcagttctcgctagaatnnnnngaaagcgtggttgcattgaattgaagtttcggtgtgctcttggtatgcttgggttacagctccatgtgcctaggggg

SEQ ID NO: 9238 - DNA, 2681 bp, Zea mays
gtcagaaataaccaaatttcaacagtagcagttggaaatagccttatttccgaatgtttataaccaacagccaggtgctgtcggaaatgatccctaagctctcgaaggtagcttatttctgacggttattagcttattgctgacggcttatgttgttggattttatttggtttactgttgtgatggggaaatagggccaagcaacagtaacgtcgtcgaatggctagaggttgaagtagacttctgcagctttgttggatttccatccaatccaatggactgaaagtgggggtgccccacactacccgagagcaaccccgagagaataaaaatgctgcttttacaaaacgtgggttgatcatatcatatgtacaccgacgatggatttgtgtcggccggtgctcacgacaaacggcaaactccatacagcctctctgcaaaatgagcgtgcatgttctagagattattttagcacaaggcttttaggtgacaaagccaagctgaaggagggcagatgcgagcattatacaaagcgccgcgtcactttacctagtgttatatatatgcgttctgtgagctcaacatgcatgcatagtgtttaggttgtacttacccctgcggaaagctaattggaggaggtgagaggtcagagcgagctggaaagagcagccatgcattacccgctctcataactactcagtatgaaaatatagtttaccggatcatgtgtatcattctgtttcaagcttgttgcgcggcttggtcctatataattataaatacgtgctccatccacacgtcgttaaaacagcttcatcgtcgtcgagcaaagcagctagctagctacagagccagagagatacggaacgttagttgttttgagcagctagctatctagttagctaggtaagtaatggcacggcgacaacagtggagcaggggcggcctcgcggccgtggcggtgctcgccgtgctgtgcgtgctctgctcgggccacccggtgccgggcgggcatggcagcggcggcggcgggttcgtcaacacgctgcagccgcacttctacgaccacgcgtgcccgcagatgcaggccatcgtgggctccgtcgttgcgaaggcgcacgcggaggacccgcgcatggcggcgtcgctgctgcggatgcacttccacgactgcttcgtgcaggggtgcgacgcctccgtgctgctggacgccgacggcagcggcaggttcgtcaccgagaagcgctccaaccccaacaaggactcgctccgcgggttcgaggtcatcgacgagatcaaggccgcgctggagcacgcctgcccgcgcaccgtctcctgcgccgacatcgtcgccgtcgccgcgagggactccgtcgtcctggtacgtaccaagcagctaatgcagagcaataatggtttatttatgtatgtatgtatggaacatagctaattgcatgcgctgcaccacagaccggcggacccggctgggaggtgccactggggaggagggactcgctgacggccagcctgagcggctcgaacaacctcatccctgctcccaacgactctctccccaccatcatcggcaagttcgccaaccaaggcctcgacatcgtcgacctcgtcgcactttcaggtacgtacgtatacacagtagacatgcacgtgcgtgcgtgcgtgcatgcgcgttccatcagttgcagttccttcaacgatcgaacaactgagtgcaggagggcacaccatcggcgactcgcgctgcgtgagcttccggcagcggctgtacgggcagaacaacaacgggcaggtggaccggacgctgaacccggcgtacgcggcggagctgcgggggcggtgcccgcggtcgggcggcgaccagaacctgttcgcgctggacccggcgagccagttccggttcgacaaccagtactaccacaacatcctggccatggacgggctgctcagctccgacgagatcctgctcacgcagagccgccagaccatgggcctcgtccaccgctacgccgccgaccaggggctcttcttcgaccacttcgccaagtccatggtcaagatgggcaacatctcgccgctcaccgggagcgccggcgagatcaggcacaactgcaggagggtcaaccactagtaattctaaggagggatgcatatatacggcaatccgtgtggtgcacatcctttgatgattttcatatgtggatgcttcgtatttcatgcttggatttaagtgtgcagtagtatttaaatggctggaatttctgctttattttggttggatttaagtgcgcagtagtaaatggtcgcaatttctgttttaatttggctacgttctcgagtggatttttcactatgtaattcgccattcatgtaccaagaaacgattcaataaaattcatctttcgtgtcgttgccgaaccactcaaacatttctcatctcaccatcattattatctttgatgggaagccgacgagcaacagccatggcgcagggggatgtgaataactgatgacttcactaaagattatcaacacaaggttgatacatgctcttatagtttgggttgcgataaatcagtggcgtagctacgatttaatgatggatggcccagcttaattttttaacaatttaaatacataacatcagtataataataaaaaattac

SEQ ID NO: 9239 - DNA, 793 bp, Zea mays
  misc_feature (739)..(740): n is a, c, g, or t
  misc_feature (746)..(746): n is a, c, g, or t
  misc_feature (758)..(758): n is a, c, g, or t
  misc_feature (760)..(766): n is a, c, g, or t
cgggagatatcgcaccaagcccacgtggtagcagacgcgtttctacgtcgggccggcccaccacctgtgtcctttcccctcccgcaagcgaaagcccccaaacaaatcccccgcacgcctccgcagccgacgatgaccaccgccgcggacgccgacgtcgacgactaccaccactccgacggattcgtcatgtccgacgtcctcgccaagggccgggaggcctgctacaaggcacgggatgccttctacgcgtgcatagagaagcacgcggacaaaaagcccaccgagatcgccaccatgggtctcctctaccccgccgactgcaaaaagtcccgcgccgacttcgtcagcaactgccgccccacctgggtcaagcacttcgaccggcagtactgcgccaagaagcgggtgcagaggttgctcgacggcgatggggaccgccggggccccatgtcgctgccccagccctacaccttcaagcaataggtagtcttcctgtggttcagatcttggtattgagctcaattggatcagtgctacgttggtgtctagatgctatagtattggtttcaggctttgtgtcatttagctggatgcatatgtgatgtgtaccagtacattgctctgaatgctaatggatgagcgaatctgtatgtggatttatcaatatcaggatatccctcattggcaattgagttgcattacttataaacaaaaaacaaccacagggccggaaaannaaaaanaaaaaaaaaaanannnnnnnccgaaaaaaaaaaaaaaaaaagcggcc

SEQ ID NO: 9240 - DNA, 724 bp, Zea mays
cattgggtacaaacaaatccccccgcacgcctccgcagccgacgatgaccaccgccgcagacgactaccaccactccgacggattcgtcatgcccgacgtcctcgccaagggccgggaggcctgctacaaggcacgggatgccttctacgcgtgcatagagaagcacgcggacaaaaagcccaccgagatcgccaccatgggtctcctctaccccgccgactgcaaaaagtcccgcgccgacttcgtcagcaactgccgccccacctgggtcaagcacttcgaccggcagtactccgccaagaagcgggtgcagaggctgctcgacggcgatggggaccgccggggccccatgtcgctgccccagccctacaccttcaagcaataggtagtcttcctgtggttcagatcttggtattgagctcaattggatcagtgctacgctggtgtctagatgctatagtattggtttcaggctttgtgtcatttagctggatgcatatgtgatgtgtaccagtacattgctctgaatgctaatggatgagcgaatctgtatgtggatttatcaatatcaggatatccctcattggcaattgagttgcattacttttcttctgatggcatgcagattgccagaatccttatcgaaatctttcgtccttatttcaactttcaattgatcgatgcagggggtaaaaggatattgttgtgtcattgaaatttttt

SEQ ID NO: 9241 - DNA, 2414 bp, Zea mays
ctgcaggatgccttaacgtttcaaatacttggatgtctgggcgtcccgcgtcccgtatatgtgcggaagtaaaggcaaacccctcgagtccttgtcatgcccgtccacgatgtatcgtcccgtattttattattaatgatgcattaataatgacttgtttattttattgtttttaaaaatatgtaggataggtaattacatgtaatatctaaaagttaaaagcatcatctatttagaaactaaggtaggtagcagcagccaaaaaaaaaaactgaggcgctgctgatctttccgcagtgatctgcgcgtacctggaaggggatctagcgaggatctggctgtcgatcctcgtgttcgtgggcagccagctcgttctgccgctggtgtcctcgctagagaagaacaggctcagctacgctactaccggaatcgtgatggttgtcccgaccacgttcgtcgcaactacgtcccgaactcgtcctccatggctactgatgacatcgtggtaagtgcacacattaacacgcgtggcatggcttcccactcttcgttgacctgacgcattactcaggtgccgttctcgtgggcgaagacctccataaagacgacgacagggtgaaagaggacttgactaagcgcatatggtctttgagcatatagactagtggaatagccaggagataagtgacactccatccctgaaggactggagaatgataatgatacccaaatttcaagaactgagcttctaatgtttccaaagtttctgtacgcttactaacctgacagatatactaacgagtgactgttggtaagcgtacaacaacatcggaatttggttaacctgctgacagctgtagcgggaatacaccagacgttcccatagagttggaaaatggcaagcgcttacaaaagcaaactatgccatctgaatgccaacgccatcataaatagcatgcattggatagcagcacagcacagcaactgagtaaactacaacttcagtcacattactttgacaatgtcaaaccgggtttcgtgaactcttcaaaacatccctagttgtacaacagcgtagaataataaaacctagagtctatgcatttcctctctctctctctctctacacaaacaaggatatctctggtggttggacaaaggagaagatggcttccccgaagacctcgtacagagaccccaagagatgaccggtgtcctggtcctccttccaggcttgcctaagcactgcagaaactctctgcgcgagatcactgccctgatccctccggaccgcagctgatgggatgctctccaccgtctgcccagaggacgaggcctgcatcatgccagggttgcctaactggttgggaaagccatccatggcaccttgcatgtttcctcccatggaagctgaggccatggagttggctgttgcgtccgttgccatcttcttcagaggtggctgagttgcagagagatctgtgctagattttcgcttatctgggatttgctgcgctacataatctttactttcaaactcgactaatccaactgctgacagtaagaaccactttgcacttaattgccagtcaacacgtgtctagtggcatatattcaactgatactgtgcttatattcaacactcacttgggttgttggttaagacccttttgttgctctgtaaaagaggccgcatcgacggagaaagcaaaccaggaaatagtttcaaccgatcatacaagcatttgcctgcagcacactaaaaaaatgcattccactggtaagaaacttggcctggcattagttggtgaaccaaaatacgataaatattatattgactgagaactctgaactgaccagcaaggcaccataaacacgccaagcttccttccttttcatctcgtttttctgcttctcaagctgcagttccggctccagaagttgcatatatgtcacaaggttgggcaaaagaaggagtctaatctggtaagcagaaaaaacaatcagccagtgcataggacagacccagtgttggcggctcccacataagtgggatctgaggaaggaataactaatacaaaaaaaaaagagtttcaaatgggatctaccgcgctgggccccagtgcccctctcccttgggctgcaccataatgttgtgtcagtgatttggcaggatcaagaaatgcatggatcaatgttttagttaaccgattttgaaggttgtgatagacatgaccaaacctctgacataccatggcatcttcagattggtcaacaatgtcatgagaaaattattaaggcaattagccaaatactacatacagaaaatatcaattagcaaagagagctagagatcatcattcagaaaatacacacactccatgagcagagcatgcaaaaggctataaatcaat

SEQ ID NO: 9242 - DNA, 1006 bp, Zea mays
ggagtaaactacaacttcagtcacattactttgacaatgtcaaaccgggtttcgtgaactctgcaaaacatccctagttgtacaacagcgtagaataataaaacctagagtctatgcatttcctctctctctctctctctacacaaacaaggatatctctggtggttggacaaaggagaagatggcttccccgaagacctcgtacagagaccccaagagatgaccggtgtcctggtcctccttccaggcttgcctaagcactgcagaaactctctgcgcgagatcactgccctgatccctccggaccgcagctgatgggatgctctccaccgtctgcccagaggacgaggcctgcatcatgccagggttgcctaactggttgggaaagccatccatggcaccttgcatgtttcctcccatggaagctgaggccatggagttggctgttgcgtccgttgccatcttcttcagaggtggctgagttgcagagagatctgtgctagattttcgcttatttgggttgttggttaagacccttttgttgctctgtaaaagaggccgcatcgacggagaaagcaaaccaggaaatagtttcaaccgatcatacaagcatttgcctgcagcacacagcaaggcaccataaacacgccaagcttccttccttttcatctcgtttttctgcttctcaagctgcagttccggctccagaagttgcatatatgtcacaaggttgggcaaaagaaggagtctaatcgcgctgggccccagtgcagatatcccttggacagcaccataatgttgtgtcagtgatttggcaggatcaagaaatgcatggatcaatgttttagttaaccgattttgaaggttgtgatagacatgaccaaacctctgacataccaaggcaaccaaattggcggggggggccctcggtgcccactcgttatctgagagcctatgccctagccttttcgcaacaatgcaagtgatcattgatggcatcagctgg

SEQ ID NO: 9243 - DNA, 1299 bp, Zea mays
ttaaaggtgtgatagacatgaccaagcgtttgacataccaaggcatccaaattgtcagagaagtcctaaagttcccagtggttatctgagagcttatgccgtagccttttcgcaacaatgcaagtgatcattgatggcatcagctggtgcaaataaggtgcaatatgaatatgtggattacggagaaagactttggacgactctcattagagcaagtaaaacaggaagatcacccaaactccgggtaccctcgtctgcaatgaagtaggaaaagtaaggaactaaaggatgagccccagaatcttttgccaagctcactaaagcttctttaaaaagggacgtatcagatctactcatagtaagttcagctattttatcaaagtacatctgtagttctctagataatacatgcttaacaggaagcttgacatcagctggaagtccatcatctttcccatgctcagaccttttattttcagttggtggtacaattgcatcaatagcaggattctccggtattgcaggctgtaccccctcaatcgctagccaatgggctacaactgatgtgtccagtggggctttaggcagaggacagtcaataatctctttgaagtctacctcccgatcatcaagatagaagagatccttatgtccaacagctctcttaaaacgcaatggatcaccagaggcaaatccatatacgggctcaacattcctgagacccagggcactgtcaacatcatccgccgtcagaacagtccgctttgcatgccgcatacatttaatggattcctgcatgatctcgcggaggcggtattcgacgtcaggggcgagcgcgacggcgacatcggcaccgaggctggggatgccgacgctctgagcgatgacctcgatcgtctccttgggcacgatgctcattgcgctcctctcggcccctaattcccttaaccctagtttagctatctccctctcgattcttctccccaaacaaagggtctgtttgggacttctctaaaccaccacttggaatcaaatatggcctccaccacagcaatttttgcggacgcgcggagtgagtacaagcgtggcgtttgggagaccgcttacaggagacgctccgcatccactactcttctcccggatgtgtgtgtgtgtgtgtgtggggggggggggggcggaggcgcgggaggccgcaaggaggaggaggagacgctcgcgcactggcgacgacgaggataccgcgctggcgtcggaaaggaagaagagctcgcgcgggcgccggagacagtaccggccggc

SEQ ID NO: 9244 - DNA, 784 bp, Zea mays
  misc_feature (696)..(696): n is a, c, g, or t
cctgtgcggcgcgccggccgcggcggggccaacggcatacgtgcggttcggcaacagagcaataagagaaccagtgtgctagtgctacagctacggcctagctacctactacggcgcagctagcagcagcggcggacatgagcgacgggcgcgaggagagcaccagcagcaggtggccagagctggccgccctgcgcgcgctggcgcgcgacgcggcggcccgggccgggagggagacggcggggtggcgcgggcgggagcgagaggaccaccgccacggccacggcaagacggccaaggtgatgcacctgctgctctggggacccaagcgaggtgaagtgaagcgctgctgctgctgcacctgcctctgcctcgtggcccgcgcgcggcgtcctcgcttccttctccgcccgctgcccgcacgggttgtacttgtacatgtaccactgctagactagtactgctgctgtgcctgtaccatagtactgtgtattgtattgtacgtgctagtagtaaaccgctgccttcttcctcctcttctcttctcttccccaccactctgctgttttgctcgtcgtcgtcgtcgtcggcggcggcggcggcggcggcggcggctgtgagttgtgacctgtatgtaattaagccattatccaacacgtctaatccccccctcccctttctgccgaaggttattcnatggtaaccagatcatcacgagatcgaaaactaaagattaaagcccagggaaggttttatacaagttcaggttctctctttctgagat

SEQ ID NO: 9245 - DNA, 752 bp, Zea mays
gccggccggcccgtagcaacggcatacgtgcggttcggcagcagagcaagaagagaaccagtgtgctagtgctacagctacggcctagctacctactacggcgcagctagcagcggcggacatgagcggcgggcgcgaggagagcaccagcagcaggtggccagagctgtccgccctgcgcgcgctggcgcgcgacgcggcggcccgggccgggagggagacggcggggtggcgcgggcgggagcgggaggaccaccgccacggccacggccacggcaagacggccaaggtcatgcacctgctgctctggggacccaagtgaggtgaagtgaagcgctgctgcacctgcctctgcctcgtggcccgcgcgcggcgtcctcgcttccttctccgcccgctgcccgcacgggttgtacttgtacatgtaccactgctagactagtacttctgctgtgcctgtaccatagtactgtgtattgtattgtacgtgctagtagtaaactgctgccttcttccttctcttctctcccccaccactctgctgttttgctccttctcatcgtcatcgccgtcgtcgcgtcggctgtgagttgtgacctgtatgtaattaagccatcatccaacacgtctaatccccctccgctttctgtcgaaggttattcgatgagtcgatgttaactagatcaagatcgaaaactaaagataaaagcacatgaaagtttttatacaagttcagtttctctctttctgag

SEQ ID NO: 9246 - DNA, 872 bp, Zea mays
cattgggaccctcgaggccccccggggccgcgcattcgcccacacgagcctacccaaagagcccagagcccgggaggttacttcgctgcctgaggagtccccggcaccggaggtcttgctaccggctggcggcttcttcttccgttcctccccaagtcctcttcccggaggaatcatgatcgtctgcgtcgccgttgtcggccaccagaacaatccgctgtacctgcagagcttcacggaggcggacgacgccctcaagctccaccacatcgtccactgctctctcgacgtcatcgacgagcgagtgagcaatcctaagaggagtgcacctacattgaatgagacatttttgggtcttctatacccaactgagaactacaaagtgtatggctatttgacaaacacaaaggtcaaatttatcatggtcacgactgatcttgatgtcaaagatgcagatgccagaaattttttcaggaagttccatgctgcatatgtagatgccgtctcgaacccgttccatgtcccagggaagaagattgcttcaagaagctttggtgcaagagtaagcaccatcgttaaatccttcggttcagggaccagttgatcgaatgctacttttgtcagactttctgtaatcaaacatatgtgttctctccctgtttgacaaaattactccctaccgtgctgcttgtctgctgaacgagatgctattggtactgattgctgaacaaagaaaaatagtggtttattcattcaaaaaaaaaaaaaaaaaaaagaccaaagggcccacaagggagagtgggagactagcgccacaggacagcgcacggaaagcgaggggaggggagaccgagaaggcgcatcggacggcg

SEQ ID NO: 9247 - DNA, 6950 bp, Zea mays
ccaaacctagaattacccgggggcgcggggtgggagggtgtttgttacgtttggacgtgtaccacaaaggaataagcaactgatcccgcgtttcaacagtgtaatacatcagataggacacctggctagtaagcaactacatgtatatatgctgtgccctgatgatggttagctagctaaccactttgtgtcctgtactgtacgtaactacatgtatgcgtttgtatcgagccccggcccgtggactgcgacagaaggccgacggaccacttctgttcaggtcgcgtgagagagtgtccagccccgtcggcccggcaaggaaagcctatctatctgccaagttagttccggaatcgtatcgtatgctgggccccgttaccgatgagctactatttggacagctggtgggccggcggtcgttttaaacggccagcatcgtcacgctgtgctaggttgcgttgcgtgccatcgacagcagcatatccgctgaacgccgccgatggagccaaagaagccaatttgagtgccgtgtggctgcgcgtggtcacgggcgcctggcacgcacattccccgttcctgtaggcactagacaacgagttgagttccggccgtcactgcgttcagagaggtcgccgcctgactgtggatggacggaagggcaggcagatgatttccagagcgcgacgacggacggacacggccgttcctgtgggtttggccgccgcggcagggagcaaggagctggatttgctggagaaggagtggcgtacacggacccgaaatcatcatcagaagatagaggcgatgacagcagcagatgcatgggcctaaactaaactaaaagaacgccgacgaccgaagctcgcatagcaggccaagcagtgcgcccgtgctgctgcaacagccaacagctgccttgtcccgacaccatcgagtgcgcaaatctcggcaaagataagaatgtgggcgcgcgcgaatccagcaaagcgtgacagatacggccatcggcaaggtagaaggcacctgcggcgcgaaggaatccgctcccgcgcatcagccgaatcgttcgccgccgccttcctcctcctcctctgcatccgggcgccgttgtggaccggccgaggtcagatacgtcagtcggtcaggacgtggcgcggcgcgcgtaacctaacatacctcgtgcgggagccgaaaccttgggccgtggcgtgcgtgccagtgctgcgccggctggccacgccttgtcttttactggcctggcctggctaatctttgcgtgcaccactgctcaagctcgagctcgccgccgggtggcataggctaggcgtacgcgcacgcaggcgccagccggacccacgttacgtggagagcacctacctccgtcctaaataaaataaaaaatataagcagatcaatattatcagcgaaaaaattatgcactccctctatttttatttttgtggtaattgcacttttagaatttaaaattcattctaaaatagatacatctctagttgtattttttctaattacaatcatattcgtctcgatcatgccggtcccgagccccgccctcagttgctcctgagtagcgtgatggtgtaattcaagtaattttggtcggctacggatagatagatagataaccgatttagctaaaatcctatgtaaattgtttttggcatacgaatgcttttagttttccatgcctgctatggtttagttttccatccgtcggcaggcacaggcggccttttcttttctcgccacatggctggatggagcggaaggatggatcagtcggacggccctgcactgatgatgggtctcgggcgcggagagggagagtggagaggagtcacagccgatgagccgacgccgggtcgccatccgccaaagccgttgtggcggcgctgggagcgtaatcatcttcgtcgtcgccgtcgtccaccggctcggtcactattatcaatcatcatgatggctccgccggccggactttgccgttgaagctacgtcagtgcggattaattaggatttaccatcacggggcgccttttttttgtaatctatctatcttttgtactgccacacacgcttataccgataaagatgaccgcggcccgaaccagaaccaccaccgggatcgagttcctgctgggcgacgccgctcttgggcgtccccgtgtcctgggactaggagttccggttccagacgcgggcgggcgggcggcaatccagagcacgcgtaggacaggacggcaggcggcgaccagcctaaaattcaaagccgacgccgtaggacacacacacacatacacagcatgtggaagggcattccagtccagcacgcgtagggtaggaccaattaattctcccacgcccgactacgatctggactcagaaacgtgaaagaataggaagatcgatctgtgcggacattcggctaccaaggacaccgaacggcgaccaaaaccgaacccgaaaccaaagctgccgagtttggcagcggccggtacgggcgttcctgccataatcgtgcgggattccccaacggaacaccgatacgcatccagcatccatcctatactgaggaacggaaacctcagaccggttggataacaatgccagtctcggacatcgccgccgctccacgctcccccgctttcggcagcgccacggacaccgatgccttgtgtgcggctttcctttccgttgccttcgcccaggcctggaagccatcagagtcagagaacggcggcggaaaggagcggaaaaaagggggaaaaaagaaaaaaaaaggcaaaaaaaacccgtcgctttgcttcgtcttgagttgagccacgacgagcgcttttctggtagtggtaccatgaaagaaacccgggcaatcttctccccagtcgccatccgtgaccttgggcgctggccccctaccacgagacgagactcttcctctcccggcgcggcgcctctcgtcgcgccgcgccgtacttagcagacgcacgcgcgcgatgcggcgtgggtctctgtggagtgtggacgactgactactgtaggcttgcccgcgcatgcagcaagccagcagcatggcagcgggggaggtgccgagcccacatgccatgccatgtccttgtcctgggggtttcgaacacggcgcgcgcggcctgcccgccggatgtacagtactgtactcccgagtcccgtctcggacggcgctccgaggaacagagcgtggcgagcgcctagacgggctggacgaggtgagctggatggcggagggccgaggacgacgcttgctgggacagtctacacactgcagaccgtgcaagctgccgagacaggagtcaagattttaacgctttcgaggctggccagtgcgagcgtgtatactacctcacctcaccctctgaacgctgtaaaatctactcgcataaacaaacaacgactctaactctatcctcacccctgaagcagagcattgcaagagaaagggccagcaggacacgcgtcgtccgcctacgcagcgggagcggcgtgcggcgccgttggcccgttgcatagaaggatttctttttcccgaaggtgttagtcaggcccggccctgctcggcccagcccatctatataagcgcccgcctctctccccacttaaagcaaggcagccagtgttagagcttagcatagtagctccacacgcgcacggaggtagtatagccgggagggggcacagagagaggagcgaacgagaggaaggagcagcggcaactacacgccagagagagggaaggggaggttggccagagagccgagagcagccctgcagtcgagagcatccgactgctagctactagcaatagcataggcagataagctcgggccgggccggggcacgcgcacaatgaggtcgcggcggtggcacagcgtggtcgccgtagcgctggcagcggcggcgtggtggtggtgcgcggcggcgcaggcgcaggcgcaggcgcagcctgagccagagctactacgcgtcgacgtgccccgacgtggagacgctggtccgcggcgccgtcacccagaagctgcaggagaccttcaacgcggcgccgggcacgctccgcctcttcttccatgactgcttcgtcagggtacgtaccccgtccgtcgtcgtgctccacgctcgcccgactcttgagagatggtcctgagtcagctgaccgatcgacctactcccctcccctcacagggctgcgacgcgtccgtgctgctgtcgggccccgacgacgagcacagcgcgggcgccgacaccacgctgtccccggacgcgctcgacctggtcacccgcgccaaggccgccgtggacgccgacccgcgctgcgccaacagggtgtcctgcgccgacatcctcgccctcgccgcccgcgacgtcgtctcccaggtactgtgctgtgctgtgtgtttcctaggctaggccggccaggcggcgtggcttattacgcttaaaccttacgccatcagcgcaccgtcgtgataataataatcacccatgcttgctactagtgctttggagtggtttacggggcatgtcaggcgaggcccggacgacagctatgatgaggctgcccatggctgtctgtcccctcccgcatgggcgaacgagtgccgcagctggagcgcccgatccacgctgccaggcgcagtcgctgaccctgaggcctgagctgtgccgcaagtccgcaaccatgcatcctagtcccgtcatgtccagcaaccaaccaggcctctgaccgcagaggaggggggagggaagggaaaaacaggggattgggtttttgtgtgtgtgtgtgtgtgtgtgtgggcggggtgtgtggtcgtggtccttgcttgctgcccgtcctgtcgtaattctgctgtccccggctcattcactcggagcaacaaacaacacatcacagattcacagcaaagcacagcacgcgggccagagccagacttcagagctgggtgtgggtgctggccggccgacgacgcccgccgtttgtcactgctgcctgcgtcccccccccccccccccctttgaattcttctctgacgcccacgcgtccgcccacgcgtccgcggacgcgtgggtgagccggtacggcgacggggatggtccggcacctaatccgccgggctggtgcggtaccgcgctgccattgcctgtgctgtgcggctacctccgtgctcgtagaagattactgagctagacatacgggccaccatacggatacgggctctcatcagttattgtgctgagcaagcaagagcaactccgccggagttttcttctctgactgctctgcgtgtaaaaaagaagaagaaaagaaaagaggatttcactgcatgaacgcaactacttattaccgatgatgatgatgatgatgacgatgatgtgatggttgggattggtggtgcagacgggcgggccgtactaccaggtggagctggggcggctggacggcaaggtaggcacgcgtgccgcggtgaagcacagcctcccgggcgccggcttcgacctggaccagctcaacaagctcttcgccgccaacgggctcacgcagaccgacatgatcgcgctctcaggtacggccggcctgccatgcggttgcggtcgcggaacgccggacggacgcgcgcgcgcggctcatctcatcattccgcgcctcgcctctcctctctgtcgctgacgcgctgccgcttgcacctgacatgacatgacacgacacaggtgggcacacgatcggggtgacgcactgcgacaagttcgtgcggcggctgtacccgttcaagggcgccgccgccggcccgccgatgaacctctacttcctgcggcagatgcggcggacgtgcccgctgaactacggcccgtcggcgttcgcgatgctggacgccgtgacgccccgcgcgttcgacaacggctactaccggacgctgcagcagatgaagggcctgctggcctccgaccaggtgctcttcgctgaccgccgctcccgcgccaccgtcaaccgcttcgccgccaaccagaccgccttcttcgacgccttcgccaacgccatggccaagctcggccgcgtgggcgtcaagaccgccgccgacggcgaggtccgccgggtatgcaccagggtcaactagccctgcccagctccagatgcaatgcatgcgagccacgtccacgtgcacatgaaatgaagctagctagctgctagcctagctttagctagctcgttattactaggggcgccgggggttgggaaagaatgcttcatgagtcatgtccgtccattcatccatccatccatccatcacacggttcacagtcagtcacagtgtactattgattcgttggtccgccgattcttttctttccttggtgattgttgtgtatgtagcagaagtaataattaaaaaaaccatgtaacaagaagagggatgagctttgagctccacacttgtactgcatccaatccaatgtaaatgaatgccacggttcgtcgtcgtccttgcttgctctttgacagttgccggtcagtcagtcagtcacgagaaacatgaatggcggctccaggctgatgacagaacgaacatgtatggtccaaagtcctccgtcatcataaatacagccccggcatgagagctgtgtgcgtgtgtgctatggcaggtcggagagaccatgtgatgtgacgctttcagtggacgaacagtcccgtctctggcgctgatgatgacgatgcctgcctgcctctgtgttcagaatcagagagtcttttcacccccattgacagtctctgtcatgagaaagaaagaaacggggagcgagaaaggtggccgaggaaaaacgtgattccgtggcacggaatgtgcagaaactctgcttttcccacgcgtagtagcttggtgcgttggaatggcacggtcgcgagg

SEQ ID NO: 9248 - DNA, 1976 bp, Zea mays
tgcagaccgtgcaagctgccgagacaggagtcaagattttaacgccttcgaggctggccagtgcgagcgtgtatactacctcacccccctgaacgctgtaaaacggacctactcgcataaacaaacgactctaactctatcctcttaattaattaattaaaattacctcacccctgaagcagagcattgcaagtaacctccccccggcaagagaaagggccagcaggacacgcgtcgtccgcctacgcagcgggagcggcgtgcggcgccgttggcccgttgcatagaagaatttctttttcccgaaggtgttagtcaggcccggccctgctcggcccagcccatctatataagcgcccgcctctctccccacttaaagcaaccggcccgtcccaacccgtgtagctccacacgcgcggaggtagtatagccgggaggggcacagagagaggagcgaacgagaggaaggagcagcggcaactacacgccagagagagggaaggggaggttggccagagagccgagagcagccctgcagtcgagagcatccgactgctagctactagcaatagcataggcagataagctcgggccgggccggggcacgcgcacaatgaggtcgcggcggtggcacagcgtggtcgccgtagcgctggcagcggcggcgtggtggtggtgcgcggcggcgcaggcgcaggcgcaggcgcagctgagccagagctactacgcgtcgacgtgccccgacgtggagacgctggtccgcggcgccgtcacccagaagctgcaggagaccttcaacgcggcgccgggcacgctccgcctcttcttccacgactgcttcgtcaggggctgcgacgcgtccgtgctgctgtcgggccccgacgacgagcacagcgcgggcgccgacaccacgctgtccccggacgcgctcgacctggtcacccgcgccaaggccgccgtggacgccgacccgcgctgcgccaacagggtgtcctgcgccgacatcctcgccctcgccgcccgcgacgtcgtctcccagacgggcgggccgtactaccaggtggagctggggcggctggacggcaaggtaggcacgcgtgccgcggtgaagcacagcctcccgggcgccggcttcgacctggaccagctcaacaagctcttcgccgccaacgggctcacgcagaccgacatgatcgcgctctcaggtgggcacacgatcggggtgacgcactgcgacaagttcgtgcggcggctgtacccgttcaagggcgccgccgccggcccgccgatgaacctctacttcctgcggcagatgcggcggacgtgcccgctgaactacggcccgtcggcgttcgcgatgctggacgccgtgacgccccgcgcgttcgacaacggctactaccggacgctgcagcagatgaagggcctgctggcctccgaccaggtgctcttcgctgaccgccgctcccgcgccaccgtcaaccgcttcgccgccaaccagaccgccttcttcgacgccttcgccaacgccatggccaagctcggccgcgtgggcgtcaagaccgccgccgacggcgaggtccgccgggtatgcaccagggtcaactagccctgcccagctccagatgcaatgcatgcgagccacgtccacgtgcacatgaaatgaagctagctagctgctagcctagctttagctagctcgttattactaggggcgccgggggttgggaaagaatgcttcatgagtcatgtccgtccattcatccatccatccatccatcacacggttcacagtcagtcacagtgtactattgattcgttggtccgccgattcttttctttccttggtgattgttgtgtatgtagcagaagtaataattaaaaaaaccatgtaacaagaagagggatgagctttgagctccacacttgtactgcatccaatccaatgtaaatgaatgccacggttcgtcgtcgtc

SEQ ID NO: 9249 - DNA, 697 bp, Zea mays
attggacggcagacgataaagcacggcgcgccaccacggataagaatccagaagcttgcgctccgctgtcccgtctcctctccggcctccacccatggctcatccactcctctcgtccgcgcttgtttgttcgcgtcttctccctgtagggaactccgttacccggccccggctgtgcgtggcgtcagcacgccccgcgggcaggagggtgaggctgctgagcgtgaggtgcgagcagggagccaagggcggtggcgggctggacgtgtggctgagccgcggggcgatgctgggcttcgtcggagcggtggccgtggagctgaccaccgggaaaggcgtgcttcagaatgtgggattgaccgcgccggtgccgacgctggcgctggcgctcaccggcgcggtcggcgtcctcacggccttcctcatcttccagtccgggacgcgggactgatgggtgaattgtcaaagctcccaaaaggacatgcataaagtctgtcagagtcttgtgctgtgtatgtctatgctgttgtagttgccttgccttcacaggaagctgaggagtaacacagtgcgaaaaggataattattattttttacaaaatgtgtttacagtactcttccttgaaggactaaactgcatttatgttgaagttgtcaataatcctattctcactacaccaaaaaaaaaaaagcggcc

SEQ ID NO: 9250 - DNA, 772 bp, Zea mays
  misc_feature (717)..(717): n is a, c, g, or t
  misc_feature (750)..(750): n is a, c, g, or t
cattgggtacctcccggccggccgccagaagcttccgcgccgctgtcccgtctcctctccggcctccacccatggctcatcccctcctctcgtccgcgcttgtttgttcgcgtcttctccctgtagggaactccgttccccggccccggctgtgcgcggcgtcagcacgccccgcgggcaggggggtgaggctgctgagcgtgaggtgcgagcagggagccaagggcggtggcgggctggacgtgtggctgagccgcggggcgatgctgggcttcgtcggagcggtggccgtggagctgaccaccgggaaaggcgtgcttcagaatgtgggattgaccgcgccggtgccgacgctggcgctggcgctcaccggcgtggtcggcgtcctcacggccttcctcatcttccagtccgggacgcgggactgatgggtgaattgtcaaagctcccaaaaagacatgcataagtctgtcagagtcttgtgctgtgtatgtctatgctgttgtagttgccttgccttcacaggaagctgaggagtaacacagtgcgaaaaggataattattattattttttaccaattgtgtttacagtactcttccttgaaggtcttctcagtctcttccaaacaagttggtttcttcatttataatctcaagtattatgaatgcaaaaaaaaaaaaaaaaggtgcgcccttatctggagctctggtggtctnaattggaggaagaatatgacttattcctttttngaaaaaaaaaaaaaaagcggcc

SEQ ID NO: 9251 - DNA, 1582 bp, Zea mays
ttcaagtttaacaaagtttttaatacacgtgcttctcaagctgaggtattctctgatatccagcctctgatcagatcagttcttgatgggtttaatgtgtgcatttttgcctatggtcaaactggatccggaaagacttacacaatgagtgggccaggcacatcaaaagaagattggggtgttaactatcgagctttaaatgacttgttcgacatctctctaagtagaaggaatgctttctcatatgaggtgggagtgcagatggttgagatttataacgagcaagtgcgggatcttctctcaaatgatattgcacaaaaaagacttggaatttggagtacatctcagcctaatggacttgttgtccctgatgcaagtttacatccagtcaaatcaacattggatgtgctagagttgatggaaattgggcaaacaaatagagcagttggatcaacagctctgaatgaaaggagcagtcgatctcacagcattctgactgtgcatgttagaggggtggatctgaagaatggatctacttccagaggatgtctacatctgattgatcttgctgggagtgaaagagttgagcgatctgaagcaattggagatagattaaaagaagcacagtatattaacaaatccctctctgctcttggtgatgtgattttttctttggcacagaaaaatgcccatgttccttatcgaaacagcaagctgactcaagttctacagagctctttaggtgggcaagcaaagacactgatgtttgttcaaattaatccggatactggatcatattcagaaacaataagcactttgaagtttgctgaaagggtttctggagttgagttaggtgctgcaagaagtaacaaagagggtaaagatataaaagagctgctagaacaggtttcatctctgaaagacacaatatcacggaaagatatggaaatcgatcaactcctgaagaacaaagccaaatctccaggttcatcaatagatagaaatgacagtcgccaacagatccggcgactatcagggactggatcaagtgaagccgaatgtgaagataacatgtctgatgatggctgctcagtagcaggaaccgagtattcagtaggtggtgcttcagaggcgacagcagaacggatgcagaaggccccatcaaggatagccaggctattccacacaaagaatggacagcctgcaaactccaaaccaaaaccaagggagtctgctctgaaaccaccaggtcgcacgacatctacaggaggaagccaggcgacaggaggatctttagtgaaaccccctaagaggcggtagagaaataaagattccatcatctaggatttgccatgttgatgggggtatgtgacgatgtcactgtaacgggttcacttgtcatcaccatgatgagcagccgactgtaggctggatgttgtatgagctggacgccatgaggttggtttctcagccctgctgaccatcacgttagttatcgactatgttactgaccatcatcaactttttatctatactatacttaaaacaccagtttcaacggtcgtacctgcccgggcggcca

SEQ ID NO: 9252 - DNA, 1280 bp, Zea mays
  misc_feature (411)..(411): n is a, c, g, or t
cccacgcgtccgcccacgcgtccgcccacgcgtccgcccagcgtccgaaaaagacttggaatttggagtacatctcagcctaacggacttgttgtccctgatgcaagtttacatccagtcaaatcaacattggatgtgctagagttgatggaaattgggcaaacaaatagagcagttggatcgacagctctgaatgaaaggagcagtcgatctcacagcattctaactgtgcatgttagaggggtggatttgaagaatggatctacttccagaggatgtctacatctgattgatcttgctgggagtgaaagagttgagcgatctgaagcaattggagatagattaaaagaagcacagtatattaacaaatccctctctgctctgggtgatgtgatttttgctttggcacangaaaaatgctcatgttccttatcgaaacagcaagctgactcaagttctacagagctctttaggcggacaagcacagtcggtcctcgtgccgccgggttatccggatactgaatcatattcagaaacaataagcactttgaagtttgctgaaagggtttctggagttgagttaggtgctgcaagaagtaacaaagagggtaaagatataaaagagctgctagaacaggtttcatatctgaaagacacaatatcacggaaagatatggaaatcgatcaactcctgaaggacaaagccaagtcaccaagttcatcaacagatataaatgacagtagccaacagatccgacgactatcaggggctgctggatcaggcgaggccgaatgcgaagataacatgtctgatgatggctgctcagtggcaggaaccgagtgttctgtaggtggtgcttcagaggcgacagcagaacgaatgcagaaggccccatcaaggataggcaggctgtttctcacaaagaatgggcagcctgcaaattcgaagccaaaaccaagggagtctgccctgaaaccgtcaggtcgcacgacatctacaggaagccaggcgacaggaggaggatcttcagtgaaacccccgaagaggcggtagagaaataaagagcatctggggtttgccatgttgatggctgatgcaatgcgtgggcgtttgtaaaccgactcggagattgcgctgctgaaacactacggtcaacgggttggtgcgatgcaagggtatgtcactgtaacggtttcacttgtaaacggtctgttgagtatgatggtgagcagccggcttttggtgggaaatgttgttgcgacggcgcaaaaaaaaaaaa

SEQ ID NO: 9253 - DNA, 4106 bp, Zea mays
  misc_feature (210)..(210): n is a, c, g, or t
cctgccatgcctcatctagacatccaatcataccatgcataatatgtcgtaatgggaatctacacacacagcaacaacacatatcttgatttttttcaaataactttagtgcttttataagaccacacatgtagaatgaaaccaaatttcagactcgaaatttcttttataacacatttgcctcatatctactgagactgtgatgtatangaaggcatgaattagtcaacttaaaatgtcatttctaactatggcctctatttgttatatataaaatatatgcaataaagaaactatctagatgtgcaactaaattactgccataaaagatttatggaatctatatttcaaacctattgctagcttatcaaattatggtagaaagttaaagcacacaacaaggtacctaacatgaacacaggagataaaaagtggttcttgtttgagcctctcgtagggatgatctcgcaagggtaaagctctcggtcggataactctatagatagcccatgagacttttccacaagtaagagggtctccgagatgacctcttctaggctgctctctgttgccttcctctacaccgacgtgctgggaggacggaggtggagaaaaggaaggggctaatggtggtgaggctgacacacctttcgtcgccggtgaggttagcgagaaagaggtcgcaggtggcggcgatgtcaatagatgagatatacgatatgagcgacacagatgtgattctaagaatatgtaattccgtgcacacctaataaggggacgcaagcaggggtggtagaggaaggggaagggtcctcacaggggaagcatttcttaacgtttggccactttcgtgcagggtcaggcctaagccggcccctcacgtgtggtaacatcaaggatattactgcagagattgcgacaacaacctatcttatatctcatatatgcaataaggcaaacaaatttgatttatgaaaaagtgctactccaacgcatgagatattcttctattatatattgtataatatatacacaaaaccacttgtaagttcaacatcccctttggatcaacaaagcccacagccacccaatgtgacaatattccactagagcaacactggaacagcaaccagtggcgcgccgcggagacgcacgaagtgccacacgtgtgcctgtccacacgccatccgctgaagcccttttggcatcccctccctccaccatgggtgcgggtggccccccggaggcgataagccccggcgcatcctggccgcccgtttcgaattcacgcttcccaacggtcgcgccaccctctccgactcccgcacccgccgtcgcttgcccttccgccactgaccgctcggcctcccgcttccgggacccacgcgtcggtcactccatcacgaacttcttatgtggcagccatgccgcgcggacgggggcccgaaccctagtggcggacgagggtgctagataggggggacacgtgacccggcaaccatgggcacgggcaggaggaagggcaagcgcagcgccgccgtggcttccgtcgacgacgctaacgaggccatggcttcagcggaggcgctctctgtggagcatcaggacccaccgctggcttcagcggagggaaccgatgaggccaaggcggccaacggggaggtgacggcggtggtggagccggacgagccgaggcgggactcgtcgccggagcggggcgacggggatgccgcgcggctgaagctcctcaacggcattctcatccgcacggcctccgagtagcgggagcgggtggcggcgctcgaggcgcggctcgctgaactctccgccgacgccgccgtgctcgcggacggggagagcgcggtactgctcgcggccttctctgcccagctcagggccgtggaggaggagcaggctgcgctgctggaccgcattgcggtggcgcaggagtcccttgagcgcgcccaggcggaggcggccagcgaggccagggccagcgcagacgccacggcgcggctccaggaggcgatcgtggagaacggctcgctctcagagcagctccgtgcgaaggcggatgaggcggacgcggcggccgagcgggtggccggactggaggctgcggttgcgggattggagtcccagatctcggacctgcgcgcgaagaggagtgaattcgagagccagttggaggccatgcgggcgtcagctcgtgctgtccagtccgagaaggatgtgttggaatcaagcttcaacgagctcaagaaggaaaacgaggcgtacaaacaggagatggaggctacgcttcaggatcaattgaaggagtcggaggctctgcaatccaggaaggtggaattagaggcgaaggtgggttctttggaggcagagctctcagaggccgtcgctaggaaccatggattggagttggaagggcacaaattggatgtagagatggccgctaccaaggcggaggtggagaagctccacgccttgcttgcggagatggaccagaagcagattgttgtggctgctgaagtggctaggctccaaagtgagcttgaccaagtggcgatggcgaatgaagctgctgctggggcacatgaggctgagaagaagatgatggagggtgaattggagatgctgaaggtgaacgtggacatggttcaggctgagaaagatagtgccttagtcttggtagatgctaaaaatgctgaggttggaaagttgagggatgaactgaagaagctcaacagttccatggctgcgctccgtgctctctatgatgatcttgatggaaagtcttctttcctccacgatgagaaagtttcggttctcaaagaacttgagcaggagaaagctgaagcagaaaagctgaagtccaaaatccaggagcttgaatcctgtaacagagacaatgttcatgagattggggtgctgaaggcagaagttggtggcagggacaaacaaatcaatgacttgaacagtgagcttgagcaggtgcagcttgcagtagccgatgcagagcgcagtgggaagaatgtggtctggacatggctgtgcccagctaccacaaccgtgttagcagctgcgtcctttgtctacgccgcacgtagtcggtgaacagctagctctttcactcgctttttcgagtatgtactgctcgaaataacctggtctcttactcatgagtcgtgcatcattatacttggtatatgcctatatggtgaactgcttcttatactatgaaataaagctatggtccaacaattttgttttcgtgtccttgaaagaactgctttagcattagtagaatgtaatgacatatagttgcatagcattgggttggtaacacgaatctcatttagtattgtgactggtgaaaggagtcggggatttaacatcagatattcacattgtgggtagtttgtaaacaaattataaagaatattctaaaatatttaatgtatgcttagtagcttagagttatgtctgttggctgctccacaggcccctgttggtctggttaaagtggttgccattccattgcacattaaacggacaaaacatttttcatcgttgagaatagaggcttttgtttttcaagacaggtacaaccttcagaaccttgtcaaaccatccaacatcaacaaagcagggtgtagagtctacggtaaaaaccaacaagagctacatgaataaaaacacagtaatagtataaactgacagtatatcattgctactaatcggaagttttgtagttccttgaagtataaccatttctattctcacttcatttgcatagagtttagagtagttggcaatttgtatttgtcagttttagcacaattcaaaaaactctttttttttcatagattctgtgtttttttggccttgtcagactgctgtagtacattgactggtaatgttaggtcacaaatgattggattacccttcgctgtaatgtcagaactagcagtatatcttttcacctccctgtagttttcaacaaatgtcatttggagcttgtgctattctgaagtttgaagttgaggggcattgaacagataaaaaactgtcagtatatgaatttagcgttagcttgcttcttt

SEQ ID NO: 9254 - DNA, 913 bp, Zea mays
cattgggacctcgagccggccgggaaacagactaacagagtgaggacacaaggacggtgaccaagcagagtgacgacgacgcgacaatcaagtccgtagctccggcggtagactttgatatggctttagctcgtctgtgcctcaacagggccatcgctggccgcgcgcaggcgctggcgaggccggcgctcgccgcagccccggcgacagatccgaaacttcactcgcttctctcaacctcggcagccgactctgccgcctcaggcgaggcaaaccgccgagatgtcgccgtgtcggagcgctccgcccccaatcgccgctgggcatggcgagacctccgcgacttcaccccgttcagcctcgtggacggtctcgggagcgcgctgtcgcaggtggcggagaccctgggccgcccgctggagcgcctggcgccgtcgcggctgctgtccgggaaggtgcgcgaggacgaggcgcggtaccggctgcgtttcgaggtgccgggcctcggcaagggcgacgtgcgcgtggccgtggaggacggggtgctggtcatcgagggcgagaagcgtgagcacggggaggagggcgacggcggcgagtggtggtcgaccagcgggtaccacgccagcctgctgctcccggacgacgcgcgcgccgaggggatcaccgccgaggtgaaggacggcgtgctgtacgtcaccgtgccgcgcaccggggagcgcaagcggaacgtcaccgaggtgaaggtgcagtgatgcgtgtcgtgtcactcaactcttgtgagtgcttcttgtttgtgagcccgtgactgttgtgtattttctccggaaataaaatacgtatcgtgtacagaaaaaaaaaaaaaaaaaaaaaaaaagctgggggaaaaactcgaggggggggcccgtgtacc

SEQ ID NO: 9255 - DNA, 1050 bp, Zea mays
cattggggccccgggcggggccgggcatttgcatctgagaaattagttactcgatcactgtagtgatattattactgaactccaaataagcaatgtcgacaatttcgacatccctcggcctgctaatccgtccgccaagatcatcagctggtacgccgtcctttgggtctctcaaaccagtagtggtgactctcccttgcgctcctgctgagaagaagcggcctcgatccatctgttactctgtggatgccaaggctaacgaccatgccttcaacatctctcccgttgcccttgtgcatcccaacatgccgccaacgtcgacgccgcgatgggagatcaaggaagatggcaaggaagtcaggctgacattcttcaacttgtcggagggtgctacaacgggcgacttccaggttgccgtggaggacgatgtgctcatcatcaagagcacgaagcccaagccccctgcagctgaggaacagaggcaaaaggaagcccccgtcgacagcgtctcgttccacgtccggctactggtgcccaagggatacgacaaagagaacgtgcgtgcccaactgcagctccgggcgctggttgtcaccatccccaaggttaatccttcattcaccaaggaggttgacatcgacgacggaaaataggaacgaacacttcagtttctgtattttgtgtttaccatgggtcatatcgttgtatcccagctgtggtagtaattatgtggacgcatttttgcgtcaaaataaccatggcttagcagcgaaatatctattgcgggcaccacagcaaaataaaaacttttcgtgagtcaaaatatataatttctgtacttttttttgaaaaaaaaaaatactttaggaggtccctatagtatttttttttatttcagacagagttcacagaatttacgggccccccaatgcgggggaaaggggggagagatttacaatgtttgtatgcattgtgtgacattctcggcttaagtctctcatatcttgtatgtgttgaggagcaactcttttataaacatggccttacatg

SEQ ID NO: 9256 - DNA, 2641 bp, Zea mays
tactaaactaggggctaaactagaactagactagaactactcctaatgcataaggtaaaaacgagtaatagacttgatttgatcgattgttgggggttcaatcgggcgtagctctttatctatataaaggggaggcctggatccgcttcgaactaatttccaagtcaatcacacgattttagataacaaatcccgcgataaactagaaaccctaactgactctgcgcacatgcggattgtccacgccaccaccgcggacagtccgaaccgcggactgtccggcctccgggccggaccgtccgcacagttttttttttttttggcttctaacactcatcaaacaagcgcctttactgctcggttactcctcatcaccaggctgtcggactgacgcggagtgtgtctatacgtatacactgaaggacgggacgagtattgtatgtagacggcgaattcgttgagtagactggttagtggaaaattcgttcagtagacgggacgaattcgtacaagcagagagcgctcgcgctcggatgtgacctctcgctctcgacgagaaaaatccgtggcacgccctagtcgaaactagtcttcgcccgatcgtgaaccgcaggacgccactggacacgcttgaaccggtcttcggtgtcggtcttccggcgcgcgaccgcgaccccttgggcagcacgcgggtgcgcgaggcggcgaatctggccgcccatgcccccacggcaaccggccacacgatgccaggcacccggcggatcagggatgatcacgcccgcccaccaccgtgcggagcggaaaagcgcaggaaatcgcgcggagaccttactggtggctctgcccatcatccatgcgggggtgcatcggcaattcggcacggcaggcatgctgccaactggtctctactgtccacccaccaacaagtgggcggggaagccttcatggtgactcgcctccgctccgttttgcccctctatagttccgggagacgcagcagcgaagcgagacaaaatcgcgctgcttgtggtctcaaatcggtcatctgagctggacggctaactgttcaacgaatggtcagagtggcgctgtagccggaggagcccatgtggggcacgtggacccggcgctgctgttgccaaacgcttgcattgcagcaggcggacacgatcccacctgctggtgcatgctggagaagaagaacatctcggaaatataggactgactgacgtatagacagacagacagacgcagagcttgtcaggagagcctgaagctttttcaggaccaaatgcaatcacccttcttgtctgcgtctcacagagtcacaggacgtgatgtcgagatgtgagcttctcttgcaagctttgctggtctgctagtggtagcacaccgaattttgaccacaaaaacaggcacaccgcacgtaaatcttaagattaggcttcattaattatatctaattcatccatccatccatcatttcatcccgcccggaggctcccgcgagcgagcctggatcgtcagatcgctcgcgtgtcgccactccgaaacgaagcaaaaaaaaaaaaaaacagagagagagaactcccttcctcgcccgttccaagaaaagcaagaagggggcaaaaattacagcggcgtcgatcaaggagaacagcaaagcaagcacctcacgaaacaaggacggacggtacggcgacggcgacggttgttgtagtagtagtagtactgatggtggtggcggcggcggcggcggctacggtagagcaggcgcgcgcccgcgacgggggatcttcactcggacgacggcgccgccgcggagccggccatccggggcgagacgacggggaagagcgggagcaggcgcgggggctcggcgcccctcggggacgggtggaggaagaagcccctctcggcgatggccgcgcgctcggcctcctcggaggacgacgccgacgccggcgagcggttaaaggggtcgccggcgagcggcgtcaccgggctgagcgtgagggacgggaagtccagcacgctcggcgacaggatctccggcgccgccctccgcggcgacggcgacggcggcgagcccatcgccagcggcgcgatcatcttcaggttcttcaggctgctccgccgctcgtacagcttgaacgacggcttcttgggccggcagcacggtccgccgctggccgcctgggcgccggcgccaccgccgttggcggcagcggcagcggctgcgcccgccgtcgtcgcgtcgttgttggccggctgctcggcgccggtgagcatctggacgacctgcttgaacgaggtggtgtcggcctggacgaaggtggtggggaacggggtggtgtcgatggtgcgcgggacgggtctgggggactgggggaggttgtggggctggggttgcgcacggtggtgagggcgagatgggggcgtggaggaggacgacgacgaggaggaagaggtggaagaggaagggtagttggggtcccgctggtgaggcatggggaggagttgcttggtgaaaacatccatcggagtgttggttttggtggcgttggtggggaagagtaagaggagaggagagaagaggagggagatgatttgagtggaggaagagggtggggaggtt

SEQ ID NO: 9257 - DNA, 3608 bp, Zea mays
atattactttctttatagcgccttcaacgatgtgctctagcaatcaacgatattctctaaagtctcttctgaatatagaggacagtagccaacagtaaactgttttaggtttctaaagttatctccaatgcacagagacggttttgaatctatttatactcgcatttttttaaaaccgttagtgccaagggctagtagaaattattattttgtacaggcgggtaaataagaaccgccacggtcgagataataaaaccgcaagtgaaaatctttttcaggaaacataaaatgtgtttttaaaatagcaaaaaattatttattagggatgcctcaccctttcccggcccgcctatgttcatcgaagtcgcaagtcacaaatcgaacacctcgacttcacccttgtgtgtagtccatttaccactccacctatcacttattttatgtgtatattgcagttttgttgcctacatattagaacaaaccgaatataaattgactatttgaggttgtaaacaaattcgaacaaaaacgttatcaactaaaaagtttcttaactttcaaagttctacaacttttattttggacttttcctatccgaggacttttgcaaaatttgtattttaaattttacaaatttggatgcaatttttaagagccgaaatgatttcaaataaaaagttgtcaagtacatagtttcataacttttagatatctccaacttttatgttggtggttttttcattcgaggtaattttaaaacaaaaaaatcagcataaaaataaattttagtggcggtttcctaagaaaaccacttgtagaaatcgtttttagacccggtttcttaagaaagctgcttgtaaaaatcatagaaaatcgtctgtagatttctagagtcggttttcttaagaaaccgtcattaaaaataccacttgcgcttgataacctaaatctaccacatatttagagctgttttctactagtgatagaaaactctagacaattttcctaggctctaaatatagagagaaactctcatatcctctaaatatagggcgacaactacagtacaatcatgtcttatatgtgcaaccttataaataacgagcatcttggtccgttagtttataatccaacctatatatcacatttagcacacagaatacgtctctaatataaatttttgacgtgtagaggacacccaggagacaggctacctaaacctcgctatataagctgaggtacacagagataagagacggttgcattgcatctgagaaattagctactcgatcactgtagtggtattattaccgaactccaaataagcaatgtcgacaacttcgacatccctcggcctgctaatccgtccgccaagatcagctggtacgccgtcctttgggtctctcaaaccagtagtggtgactctcccttgcgctcctgctgagaagaagcggcctcgatccatctgttactctgtggatgccaaggctaccgaccatgccttcaacatctctcccgttggtatgacagctccttaactacatatatatatattggtgtatgactgtatgagatgaaatagcaagcaaattttactagtaacttctctctgcatgatgagtattctacgtgttcgagttgcatataaactatgtagagtaatgttttcgctgatctccaccacctgtgtcttggcgatggcggaagcccttgtgcatcccaacatgccgccaacgtcgacgccgcgatgggagatcaaggaagatggcaaggaagtcaggctgacattcttcaacttgtcggagggtgctacaacgggcgacttccaggttgccgtggaggacgatgtgctcatcatcaagagcacgaagcccaagccccctgcagccgaggaacagaggcaaaaggaagccccagccgacagcgtctcgttccacgtccggctactggtgcccaagggatacgacaaagagaacgtgcgtgcccaactgcagctccgggctctggttgtcaccatccccaaggttaatccttcattcaccaaggaggttgacatcgacgacggaaaataggaacgaacacttcagtttctgtattttgtgtttaccatgggtcatatcgttgtatcccagctgtggtagtaattatgtggacgcattttgcgtcaaaataaccatggcttagcagcgaaatatctattgcgggcaccacagcaaaataaaaacttttcgtgagtcaaaaaaaataatttctgtaattttttttgaaggtaaggcttactttaggaggtccatatagtattttttgtatttcagatagagttgacagaattcacaggttacacaatgcgggggaaagggggggaagagatttacaatgtttgtatgcattgtgtgacattctcggcttaagtctctcgtatcttgtatgtgttgaggagcaactcttttataaacatggctgttgacgctttttcggagcgccaaatactcaagaaaaacaggcggcggtgctctttgcacaggcgtggacggtccgcgacctggcgcaggggctagggttccctgcctgacggccggacggtccgcgcgtgcgcaggggcggcggaggatcgccggtggcgcctggatctcgctcccgggagggaccctgtcggggagtagatatcctaggtggtgtctaggctcggctgggccgacctagactcctctaatcgacgtagagtcgaagagaggcggagaatttggggattggaaggctaaactagggctaaactagaactagactagaactactcctaatgcataaggtaaaaacgagtaatagacttgatttgagcgttccttgggggttcaatcggccgtagcccttcatctatataaaggggaggtctgaatccgcttccaactgatttccgagttaatcctgtggttttaggtaaccaatcccgcgaaaaactaggaaccctaactgattctgcgcacgcgcgaaccgtccgcgccaccaccgcggaccgtccggcctcatgaccggaccgtccgcgagacacatttggtgtccaacacggtgaccacgagtttgatgggggtatacctcggttgcttatatagggtgagtacgagtccagatcgttcgttccgtcagtgtctcccaacaaaccatggcttcaaatctaggtcggtatcagggtgggacaaggatccgaacaatagggtccacacgacagcggcacaatgaaacgtgagcgcgcacaagaccactggccgacggtccctcctgcagcatatgacgatggcataggtgatcgcatccctgatgtgggctgctgcctccacggacccacgcgtctaggtgcttttgggctggccgcgctgaaacaggggagtgggctggggtgtgggattcgggccaggtaggtttagggtaactttcttttattttctgttttcttttatttccgaatccatttttcaaattcctaattcaaatcctagtttcaagtttcaatttaaatgctcaataaaaaaacaaaacatgtatgcaaagtttcatatatcaactatttattcatgtatttaggtacatgtttcataatgcaatacagaata

SEQ ID NO: 9258 - DNA, 789 bp, Zea mays
tcgcccacagaccaccaactctcagagacaagaatcagtttacttgccaaacagtttttaaaatgattctgatttctaggagaatcaggaggatcagctcctcacgaggatcaggatctagagctaaagaagcggcgcctcgggctcttccctccgcgcccttaatgtcgataattgattcctttcggaatacaaaaaatggtttcacgggtcagcagagatggcgccgtcgccaagcaaactcagcagccagcatgtcgcccaagcattaagaccaggcctcgaaactaccgttctgcccctgtaccctcttcacgggaccggcgcttggcgagtctggtgccgagggtggaaggggaatttatgtggctgttttcgttattaattttcactcggccaccgaggcagcgaacggctcaagaaaagaaaagtagcggcagcaacccgcggcggcgacgagtaaccaaccaggccacgccattgccaatcgcccgagccgccgagcaccaaggagccctgccttgcccagccacagagccctcctccttccccgtctcccgctgcgggctctctgaattcggcggtggttcatttgtccgcttcttctgagctccttctcggcgccgcgctatggaggagatgggaaagcgggcggtgcggacggtgcgggtgcgggcgtttactagttctcttgtcaggcgacgtcagcggcttgtgctggggatttgggagggtcgtgtcggtgatggacctgacgcgtttccgcggttggagaactttcgcctgcag

SEQ ID NO: 9259 - DNA, 828 bp, Zea mays
atttaaatttgctggacaaacggatatatccgcggatgcgaatagtgttgggtatccataacgggtaacgggggcgcctccagccggggaagaaaagaaaagtagcggcagcaacccgcggcggcgacgagtaaccaaccaggccacgccattgccaatcgcccgagccgccgagcaccaaggagccctgccttgcccagccacagagccctcctccttccccgtctcccgctgcgggctctctgaattcggcggtggttcatttgtccgcttcttctgagctccttctcggcgccgcgctatggaggagatgggaaagcgggcggtgcggacggtgcgggtgcggaacatctcagatctggcgacggagcgggaggtgcgcgagttcttctccttttccggcgaaatcgagcacgtcgacatcagatttgatacagtgtcgtcggggaggacggcctacgtcacattcaaagatcccaaggcgctcgagattgcgcttctcctgtcgggagcaacaattgtggaccaaattgtgaacataacccctgctgaagattacatctacatccctgttactgaacaacaacttatggtccatgaggtgacaagtagaagttcagcttctaatgcagaattggagtactcctcagaggccaatgtcagtcccaatagccgtgtctatgtgagcaaggcccatgatgtcatgacaaatgtgattgcaaagggttcagcaatgagacaagacgcagtgaacaaggctaaagcatttgatgagaagcatcaattttagggctaatgcatcagcgaggatcaattccctttgataac

SEQ ID NO: 9260 - DNA, 1225 bp, Zea mays
cagcgagtgctagctttgttctgattcttagtaaccaagccatgcatatgcctcctcttaccgttctgctaagctaatacatattgaatcgtctgcaaagtaactgcatgcaagagaaatgtttgaaggacctcgtcggtaaatttatctgctcatgtaaattaaatgaacatgttacatttcttttggaatgtttctttagctagtttgtaaaaaaattcactgaaatcttgcagacaaccaaccaaggcatggcgtatgtgttgtgctgaaacgtcgaccggtaccgcggcccaaaaggcaccagcaccacaggcatgctagctatatatatactacaagggcaagtctactggatgcctaatagtacgtgacagctccttcagaaacatcgaaaaccaccgaaccagtcaccaccacgcctcggcctcgcgcaacatgctgcctcatgtcgagatgccggtaccgggcagcgcggcggccgcgtgcaccggcgcggcgggcatcaagctgttcggcaaggtcatcaccacgccgccgcaccacgcgggcgccgcgcctccgaggctgcagcaggcggcagcggcgtcggggcgcgggagcgccgacctactggaggaggtggcgcgggcgcgcgcggcggcggccgaggtgcggctgccgtgcccgcgctgcctgagccgggacaccaagttctgctacttcaacaactacaacgtcaaccagccgcgccacttctgccgggcctgccaccgctactgcacggccggcggcgccatccgcaacgtgcccatcggctccggccgccgcaagaaccgcccggtgctgctcacaccgccggcgccgcacgctgtcaccgccaccgataacagccgccggtcgggcgcggggtctcctcctgtgttcggctctgtgttcaccgcgccctaccagcagctcggcgcgcccacccagttcaccacgtcgccggcttacgccgccaccgcccccctggggacgacggggcagtgcttgtggctggtggcgacagcagatcatcgttctgttgcatcgggccgcgcttttgatctgatatgatgtgaaaaataaataaatgacgtgatttaatttgcttgtcaccggcggtttgagtgtggtggttacggtagggtttgacattgtaacaatttttgagtgcatgcatgctccggtccaggcgcctgttctaacaaaaaaaaaaaaaaaa

SEQ ID NO: 9261 - DNA, 7292 bp, Zea mays
  misc_feature (7242)..(7242): n is a, c, g, or t
cgtaatccactcaccggtgtccttgggtgggggcttttcaccggtctgctaccgactcacgcccggcgaactctagccgcggccacgggtcatcacacatggtctcctggcggcgcagcgcgtcctggctgtcgtcggcgtcgcgctcctcgctcggcgccgccgtcggcggggaggccaaggtcacgccggaggcggatccggcggcgcagcacgacgaggccgacgaggagcgctggtcgcgcctgctgccggagctgctcacggagatcatgcgccgcgtcgacgccggcgccgagcgctggccgccgcgccgggacgtcgtggtctgcgcctgcgtgtgccgccggtggcgcgacgccgcggtctcggtcgtccgcccgccgctcgagtgcggcaggatcaccttcccgtcgtcgctcaagcagcctggaccaagggatgcgccgatgcactgttttatccggagggacaaaaaaatttcaaccttttctctctatctcagcttaacgcaggccctaacggataaagggaagttccttttggctgctcgaaggttcagacagggagcacatacagaatatatcatctcttatgactatgatgatctgcacccaagaagcagttcatatgttggaaagttgaggtatggtccaatcattccagaaccttattttcaaatgtgattacctggtttggttgttgtgcatgcccacaaggctaaacattcatgttttgactatgtgtaagttgagctctatgttatgggcataaacccatataatttgtgtcacatgccttatttccattgttggtacttttatcattattcaaaccccttcagtaaattaacccataatctctttatttctggtacttatattgtcaatatacatcgtccatgttcatatgcatagcactggctgaaattgtgtttattcaaaggttgagggttatggctcagttgcactgatgaattttggcagcttttccttgtttttcaatcagccagtcacctgttacatgaagctatttgtatgaaaacaaagaacttagttgatctattagataatctactccaaatgttgtcttgtttattgccaagttcactataggtgcatagtaaacactgttgcgttacctctgaacttcattaatggagattgcatggacattgatgttttctttgttcgtgctgcccatacccggctttcttcgctaaaaattggctaaagcctacagcacttccataactcaatgcgcctgaatattgatgacccagcacacagcctcaaacatgataataccctgtaacacactcttctcttagatattaagctgccatgatggaacaattgattcagttttctaagaaaaatgctttctttttataatgtttgccaataatactaatttgatcatgtgaaatctgcttgtagatctgacttcttggggacaaagttcatcatctatggtagccaggcgccatatgacggtgccaaaccttcgaggacccgatccactcgccgctttgcaagcaagcagataagcccacaggtttcaggcggcaatttcgaagttggacaagtgacctacaggttcaacttcatgaaatcaagagggccgagacggatgcagtgcaatatccagtgccctgtaggccagggcagcgcttcggatccgtccaaggagaaaacaccctcgccgagttccttggacctgaagaacaaggctccaagatggcacgaccatcttcagtgttggtgcttaaatttccacggccgggtgaccgtcgcctccgtgaagaacttccagctcgtcgccacagctggctccggcggtccatggggcgtcggagacgaggagacggtgatcctgcagttcgggaagatcgaggacgatgcgtttacgatggactaccggcagcctctgtccgccttccaggcgttcgccatctgcctgaccagctttggcacgaagctggcctgtgaataaatggttgccggtttaccaactatgttggggatcagattgtagggggtagtctgaactagttgccctgagcacctcagatgggagaaaactggcgataagaaacagggcggacgttgtccctataagctttgactccttgtaatcgcctaaatgattgatttatatatatatgatgtgcgcctatgttgttgaagagatgacgatgacttatcgttgtaaatggcactcccttccgtttggtgacattccattcttaaaaaaaaagaaaacatacaattaaaatgtgctgttgaacttccccttctctgcattttgtcaatcatgatcgaccatgtctgagcatatctagttgtggttgctgctgatctggaccaaggttaggaagcaagcatgggtaaattacgctgtcatttacttaccccgggctccagtatatagctatacagctctattagtagtaatacgaatacaatcatgctacatgctaacatatgcccttggagattactaacccatcaatacagcatatccattcctacatatacccatcactagaacaaaacaaccaggagccgctcgctagcacttaacacgatcaggatagcttcgtgtccatcatttctgtagatcgtgcacgcgaatttgccgttgcctgtcatgatggacgtccctgctggaatcaatggagcagcacggcaacggagcatgcttcctgggctgcacatggaggcccagaaaagacgtggtcgggggtcgagtggacacggacggcagcgcgcgcgcgagccacgactccgtaggcgacttgggcaacggcaacgggagcagcggctgcggcgatgacagcgccatctctcgtccggcactaccgccctccttgtcgtccagaagcagcgggaaaccgtaccccccgccgccggcggcagcatcggcggcggccgcgtcgtcgtcacgtcccagccgcttctcgccgccgttgggcaagcgcaagctgcccttggtagcagcgccgcccctcagaagcaacgcggtgtcgccgccgccggttatagagaacttccgcgccggcggtgaggcggcgtggccgcaagcctcgtttgacctgtcgaggaccaggagcagacccagatggctcgccttggggcggacggcggcctgcccgtgtcggcgtctgctgtacagttcgcacacggttctgtccagctccgaggccacggcggccgccggtcccatcaggctgccgcggcctgaccggagcagcgacttgatgtacacttcctcccagcattgctgcgagagatttatgcgcgagagaagacgtgagttgtttgttccgcatgaggcagtattgatttcgttaatttagcatgcgagtgaagttcatgcatgcacatgcacgaggatatatatatgtacaacagggagtaccagtaccatgccgtgatcgtctccggtatgcggcagcagtggcttcttttctcttcggcttctggcgccgccgttggaccggaacggtctgcccgcacgtcgccgcaaggcgctcctgacgcaccggacggagagcaggccgcacctcctagtcctggacacgaagcccggcgtgctgcgcgcgtcagaactggcgccgtcgtagtcgtcgttcttgccacgggggctgctcatgggagcgggagggacgggcggcggcaggtggcacgccgcaatgtggtggaggggcacccgcctctgcggctgcgctggcaacaagtacaacctcctgtcggcggcggccggcgccgtccgggcggccttgcggcggaaggcgttctgcggggacccggcggcggccacggcgtgcgcggccggcaggaaccggtccatcatggcgccgccgcgggcgcgggcgcgcggctccgacgaccccgtcccggcccccgcggacgcggcgtcgctgaggcccgtggtggcgctgcagttggcggtgacccccctggcagcgtcgtcgcgggagagcgtgtcgtccgaggggcgcgtcgcgggagaggggtcgtcgacgatcgtcgtgaggggcggcggcggcggctggcggcgggtgcggacgctcttggggtgaccggggcggcgctcccacccgaatggcacggccacggccacggcgctggtagtggtgcggcccgggggctccgacgacgtggcggctcccgcctgcttgtaggctggcaaccgcgtccccgtgggcgctgtctcggcaccaccgtggcgccggacggagaggagcggcgcggcgagattgatgcgcctgttggcgtcgggcatgcccatgactggcaaccacttagcttgcgtctcgtgagtgcactcactgagctaatccgcggggttaaataatgggagacgcttggatcgttctgttgtggctaatgattccttgtacagtagcgttggcgcatggcgccggtagagccgtacacgacgtggcgggaagcgaccaaagtcagctgacaagttgctaccgctgcagtgcagtctgtgcatgcacgagctctgattcctgtagagaagctcgtaaaaacgggatactgtggcaggtgcctgtcggctccctgcccctgttggttaaaggatcttttactacatatacatgctcggtacgactaggacatctttgtcctctcattggttgtattattattggaacgtactagcagtagcaggtgacaaaacggctgtgtggcccctcgcgggagattagcatgtaacaaactaacaaccggttggtgaaccatgtctctgatcggatcggatggacggcattgtcagcagcggatggggagtcgccgtacgtcctgttcaattcaattcgtaaccgacatgcagactgcagcagcggaggcagacaggtcgttttctcgtcgctccagaggtgggaagaagatcgagcagcaccgagccaccgacagaaccatgctaatcgttttggttggttcagcaagcgtaattcgcttcagtaatccaagtactacgtacgtgtgctaagtgcatgcagcaagcagcatctatctccgatagtgcgtttggtgccccccaccccaactctgcatgcatcatatatatctggggtggttaagctagctgtatgcgtcctaaaaagtccctaacaactctaccatcgtcgggcatggcgtgtctgtttgttgttttgcattcaagagccgctctacaaagtctctcgctgaaacgcccctttctaccttttttttttttgccctacgaagggactgtccattccattgtcacctagagagcgtgtccagcgaccagcatcagctggtctttctccaggcggatgtcgcaggatctatcgacgaatccaagggtccaacgcttttttcacgcacatcagtgtgtcatcagtgtggcaggttctctgccctttcatttcatttagttattattactgatattcatgttggaagtccgtcacgaccttttccttgagatcaaaatctttattcgggttttattggctgccaaactatatatctaattgttttttccccgtatttttgtagagtttccatagtctttttgggggatcaaaaccccccattttttgaattattagatcaagttttttttcttcacgaaaatgttattgctccaagatttttaacgactcgtttcgggctaaataccggtgcgttcaaggagggaaaaaaacgcggagtgtttttttagcagcagagacgacgagctaaaagcaatgcccgtttgtagcaagtagcaactggcgagcaaggtcgcgtacgggccacctaattaggcctcaaggcccaagatatggcccatctactatagatcatcagcctttttttgccagcccaatagcaactaaaagctccctcggacgatacatgcagcatgcctgaccgtggacatcgatgacgtcgagagactcccgccgatgcatggcacgacgacgacgaagtgtgcttctgctttttcttcagaaaacagctcgtatgtagctcatgaggttaaaatcaagggcctgcaggttcctgggcaaatttggctttgcgaccaaagcgcaaagcttagagaggcgctttcgtttggactggcaggaaaaggaggacatgcatgggccggtctttccaaccgaaaagactcgcgcttttgattccgcgcgcgcgcatcaaaagctacagattagggcttctgccgtatggtatggacgataaagaccgtgcatgaacacccaaagcacgcgctttaccgagataaagcaaagcaaaggcgagaatcttgtttcgggtagttttttttttggtgaacttttatgtcacagagacgcatgtggcgacgatgggaaaaagattaggaaggtgcagctggtgctgctttgttcacattcttagtaaccaagtcatatgcctgcctcttgctcttataggttgactccgatcctggagcttttacctcttaccgttctgctagtgctagctaaaacatactgaactgtctgcactgcaggttgcaggagaaatatttgatgaagctctgttcttgcattcacttggaaagtttctttctttaatttgtaaaacctctctactagcatgactttgcagacaaccaacgaaggcacggcgcatgacggaaaatcatggtgtctgtccaccgcgcacgcacccaagcactgagactgagctactgactcccacagtctcccccacatgtgctatatatatacgagggccaggtctactggatgcctgataccgatagctagtacgtgatagctccttcagtaaccaccgaaccagccacgagccaccgccgctggcctcgcgcaacatgctgccgcctcacgtcgagatgccgaccaccagcagggcggcgggcatcaagctgttcggcaaggtcatcgccacgcattatcagcagcagcagcagccgccgcagcccgtgcgccacgcgggcgccgcgccggcgccggcgtcggggcgcgggagcggcggcggccccggccccggccccctcttgctggaggaggtggcgcgggcgcgcgcggcggcggccgaggcgcggctgccgtgcccgcgctgcttgagccgggacaccaagttctgctacttcaacaactacaacgtgaaccagccgcgccacttctgccgggcctgccaccgctactggacggccggcggcgccatccgcaacgtgccggtcggctccggccgccgcaagaaccgcccggtgctgctnccgccgccgccgccgccgccgcacgctaccaccgccactactaccggcag

SEQ ID NO: 9262 - DNA, 7736 bp, Zea mays
  misc_feature (495)..(495): n is a, c, g, or t
  misc_feature (646)..(646): n is a, c, g, or t
tctgtgcaggaaaatgtatttcatagatttccttagttttttttgttaatattctttctgcaatccaaaatgttttgcgatagtagttttgtgctaataccaatttatcaaatttttagttgttaaagtttaaaattatcgccattttactatagcagtatgaaatctataactctgatgttattggccatgtaactgtgctacaattatgtacattcagcttgtccaaatgtcatctgtaattttttttgaagaaggaacattggccttggtgtgtacaaaagactaaagagtgtaactttaagctataactcaaatgttatgacgcatgtaactgtgctacaattatgtacttcatcttgtacaaaaatgtcatctgagaagaaggaatattggtcttggtgtgtacaaatgtacttcatcttgtacaattatgtacttcatcttgtaatttttttttcatatattcagtctttttttttgggtgggttcatnaactctggaatcacagtattagaactaaaatggtcattggttccctgctgttcagcttcactactttattaattgaaaaacattctattagatccaactgaaataaaacggcaggcggttaaaagtgttaattatcaaattcagtgtgttncttccttactcatacttatactatggtgtgtaactctgtacaagattaaattgtgtagctggtatatccggtggtcttttcaggcttgtggaacaagagtaccagtagaattagattagccattgttgagcttaaccagttcagatgctgatgagaacattctgtttgatccaaatttaatatgagatggctaattgtagaaataactcaaacatgtagcctgtaggacaagtaattgatggtcgaaaagcggcggggggtgcccagacacaatcgtgtaccatatttctaatcaaacattgtttactgattctgattgaatgcaaaattgtgctgttttttcttctcatataagcttatgttgttctaatttctaagcgaagttcaaatagaaaacaatgtttccagatggttgagtttcttttcttgcatgggctcccttgcatttgtgatttgattcgcagaggaaagaagaatcatggcaagtggtctagcaaaacctttttttccacttttggtggaagattggttgtgctaaattaagtactccctccattccttcatttgaaattgtataattgttttctagatacatagctattatgtatctagatatatagtatatctagatacacctcaaaaaactataataacctatgatttagaatgaagtagctagttttagttttagtgttgtcatgcacccatttgcactgtacaccctattgtacactttgggaatcctgcattcttactgtttgtagatagaattaggggctgacatgttttgctaatcttaactaaacaaaatgggatgaccaaatgggtgccccagattcttttttggtgacgaggcgaaatcgataaacagtagctgatattttgcagtgctcttcttcagaattgttctttgcaactcaaactacatatgccagtcaccagagtaattgtggaggataaatattgtggccactcatgtcatgtagtgaaaaaaataggtggtatactttatttgtagctgtcaggctatggatttgatttcacctcatttgaagagtcatccatgacttgatgtatgctcacggagtttcttctatttacagtatgacagtgtatgtaaagggcaaattagtaaagcgacttcactcgggcaaaatatttgggtatcgcttttgtaggatagtcttcctctcattgattcatggcattgctatgtaatgcacaacaagaagtgaagctatcggttggttttaggcacttgcaaaggacttgatactgctgtctggaactacatgcacgagcaaatgaataaaccatgagcatgtgcaaagcataaactatgatataaaatatcataaactaatttaagtaacatgtttgcaattagaaaataaaaataaaaataacttcatagagtaatctctaaaataaatagactaatcatttatctggcactaatacttgatgctaattggtgggccttgtgctatggccaacattgggtccgcccacgccccacgctggatagcccagcccacacgtaggctgaagcgtcaagaagcagttgatttggtcttgtcacagcagcttgattggttgcaggttttgaacagttggaaggttcactagtcagttttcttgatcactgaagctgttgctggagcagtatcccttttatttgtttccctctccgtaaaattgtagatgtcagtctgtcacacacacatacaccccttatcggccctcctgcttttcaaagtttccagtccctgacaacgattttactcacctgttcgtgcattcagcaggaacagctcgtggattgcagttgcagggaggggggctgatcgtggggacgaggaagtcggcaccttcacactacagtccgtgcaagctggtgcgagctggtgcgagcgggccgtggcacagcacagcacagttgaggtcgtcgtcagctgggcgtcaagaaaaatctggcttcctcagagaggagaatcacaatcgcatcaacagacgacgtggggccccactatcgacaaggcatataccacacgcatctctaatggcgatctcatctcgaagctgtttacaaaaaaaaaaaaaaaaagaatcagctagtggcgtacaggcgtggcgatcaatcatgcacgcacgccgcgcagctgatgaagatacgggcggggtgagtagtcgtcaggtcaggacgttttccgagcgtgcgtgcgggtgcggcgtccaccgccacccttccaagaccagacccaccacgaggacaaatcagtcaaacagcggctggcgcgcgtgccgcatgccgggtcccgctcccgccccagcgccacggaaatggccggcccgagtcacaagtcacggcggacggcaccacgcgccaggagcaccagacacccccgcacggtgaccaccacgcgcgcacgtccaaagcggacgcagcaaccccgctcccttgtccctccctcccgctacgtgctgtcggggtcgggggatggcggaagggtcgggtcgggccggggggcggtggttggtttcgcgggcccggcgacttttctcacccctacttgcgctagtatccttcggctctcactgctcggtactagggggcttgacgctgaacctgagcctgaggctgagctaatcgcgtcgtcgcggatggtcgtcactactcacttgtcgggtggttggatggtaacgttgacgccaccgctaccacgagattacacacacggagtgtttctacacacggttcacctaatcgcggtttaattaatgaccctaccatctcctttcagtgctaggtccatttcagagcagagaaaaccggatccaccgcgaactcgtcaaagatgtcggacttcaatgcaggttgacaaaacccggaaaaccgcaaggttttctctacaaaaaataactggcggtaagttgttgtacacggtgctagagggccgtgcgactactatttttctgttattttttttaaagtaaaggagtacaggttcgaaaggacgaggagaaaaaaaaaaagaaaatagagacacccgagtttttttttcttctcttggcgctaaaagcagcacgacgactacgagcaatgcagcggcagctccgaggcctgcgatcccgcctcagtacgcgtgggacccgcccgcttaatggcccccacgtgtcgtgtcacggcggatgggccgcataattaggcgcagcagatccggaattattaaattaggcgagccgaggtgccgctttttcaattttcgggggccgtttcttggtttttcctctttctcctccctcctcctcctcctccttcctccttcctctcgctcgctcgctcccctcccttcccccgctccctctcctcctcctcccttcattcctacctccgctcgcgccactctcctccgaccgaggggcagggaacggtgcccacccgcccgcccgtccgaccgccatggtctcctggcggcgcagcgcgtcctggctgtcgtcggcgtcgcgctcctcgctcggcaccgccgtcggcggggaggccaaggtcacgccggaggcggatccggcggcgcagcacgacgaggccgacgaggagcgctggtcgcgcctgctgccggagctgctcacggagatcatgcgccgcgtcgacgccggcgccgagcgctggccgccgcgccgggacgtcgtggtctgcgcctgcgtgtgccgccggtggcgcgacgccgcggtctcggtcgtccgcccgccgctcgagtgcggcaggatcaccttcccgtcgtcgctcaagcaggtcagtgagacagaaatcaccttcccgtcgtcgtcgctcatggtaaaaaaataaaataaaaaataccggctctttcgatctgtttcgtctaaatcgcctgaaatctacgtggctccaaattgctgaggtttttgggggcacatggttactatgtggctgtgcgttttcttattatccatttctatgcttgattgcttctgacaaacaaaaccagtagctacacatcctatcggtatctttgatttgaagctctaggaatgcaagagatgtcttgtgcgcccttttcttatgcggtttgactccatctcaggtgatctctcgatcaattgctggatttcatcttcttcgaattcattttccgtttctgaataggcttctacgcctattcaattttatttgcacgcagaaatgcgaaaaaaatgtatatctaattcttatgtcttatccttataacgatcagcagatccatgtatgtactctaaccatttgtatatttaaattctgattattgttcgtctggcgctgctgtaatgttccttgtgcgttaggatttagaacgaagccgcatatattcaacttaatctctatcctctctctttttggctacatagcactatatttttggtggctagtgctaataaagtatgacagtagtggagaagttggcaccacacggactttctttatttatgtttacatgtgatagcttgattttgtttggtatgtcaatagcgatatgataaatacctataaaagcctgcttctccgtttgggtttattaaatattgatttaatggactcttatattgtttcttttgcacagcctggaccaagggatgcgccgatgcactgttttatccggagggacaaaaaaaattcaaccttttctctctatctcagcttaacgcagggtgagtaggcatggatatcttcttattctgccgtgcttttgatctgtggttcacttggtcagatctcttttaattcgaataagtagtaccaagtaagcaactaaaatgccaacttacttttttgaggttcctgatccacctacgatatttgaaatggaatcctataattctgtcaaatcatgtttttttataaaattgaaagcgtagccattgcctattggggccaaataaacagcaaatacagctggcacctctgctgaggttactttgcatatgacttgtgatgttgcaatctgtacctagtcttgtttagaaaataggaaagcaaatatatagtttgtttattcatataatcatttacggctttcttataccatttgacaaggactcgtacacctacgttgctgtctcacctacaacatttagggggttcttctgcctaaatgtaatcctattcattcggtaggaagatttgacttgtgttattgattgttgaaaaattattcaattgagtacgtttgcatcgattcttacttggcatctatttgatttgatcttaatggccaatataaatcttggaaatctaccttgctggcataatagtatacagtagagcttgtgaagtactccctctactccaaattataagacacgttttttcgagatacattacttttactatgtatccagagtctagacatattgtatatctaagtacatagcaaaagctacatatataaaaaaagtcaaaatgtcttataatttggaacaggtggagtacatgattttgcaaacttaatggaattctggaaactctgtgtgatccatttccactcacataatcggttcaacttataatctgtgaaagcaagaaaatgttgaaagatcgggtcctgtcaagtgtatgattcactatttcgctgcataaataatgttacagtttctcacaagtttggtattagaggcattacgacttgggagcttgaaacaacgaagcagtgcagagtattggtccagttgctctcttaaaaactcgagcggcatcgtaggccatgtgagaacgacctttggcgtgggacaaatgagatgagttttttaaccacaacctaaaattcgcttcacatggggagtcgaactcaggacctaaggagtggtactcagaccatctaaccaactcagctagatgccttccgctgtccagttgctctcttattccctgctttcgatctgaataagcttgttctagagattatagcaataaagttgcactttgcctggaactcttttataaatatcagactgcaagtgcatgtgatatttaatttatcgcggcttaacgcaggccctaacggataaagggaagtttcttttggctgctcgaaggttcagacaaggagcacatacagaatatatcatctcttatgactatgatgatctgcacccaagaagcagttcatatgttggaaagttgagatctgacttcttggggacaaagttcatcatctatgatagccaggcgccatatgacggtgccaaaccttcgaggacccgatccactcgccgctttgcaagcaagcagataagcccacaggtttcaggcggcaatttcgaagttggacaagtgacctacaggttcaacttcatgaaatcaagagggccgagacggatgcagtgcaatatccagtgccctgtaggccagggcagcgcttcggatccgtccaaggagaaaacaccctcgccgagttccttggacctgaagaacaaggctccaagatggcacgaccatcttcagtgttggtgcttaaatttccacggccgggtgaccgtcgcctccgtgaagaacttccagctcgtcgccacagctggctccggtggtccatggggcgtcggagacgaggagacggtgatcctgcagttcgggaagatcgaggacgatgcgtttacgatggactaccggcagcctctgtccgccttccaggcgttcgccatctgcctcaccagctttggcacgaagctggcctgtgaataaatggttgccggtttaccaactatgttggggatcagattgtagggggtagtctgaactagttgccctgagcacctcagatgggagaaaactggcgataagaaacagggcggacgttgtccctataagctttgactccttgtaatcgcctaaatgaatgatttatatatatatgatgtgcgcctatgttgttgaagagatgacgatgacttatcgttgtaaatggcactccacttcgtttggtgaaaaaaaaaaaaaaaaaaaaaaaaaaaaataaaaaaaaaaaaataaaaaaaaaaaaaaaaaaaaaacctcaaaaaaaaaaaaaaaaaggggcgggccggttttagaaggaatcca

SEQ ID NO: 9263 - DNA, 1470 bp, Zea mays
cgaaatccaactcaccggtgtccttggcttcgttcttttcaccggtctgctaccgactcacgcccggcgaactctagccgcggccacgggtcatcacacatggtctcctggcggcgcagcgcgtcctggctgtcgtcggcgtcgcgctcctcgctcggcgccgccgtcggcggggaggccaaggtcacgccggaggcggatccggcggcgcagcacgacgaggccgacgaggagcgctggtcgcgcctgctgccggagctgctcacggagatcatgcggcgcgtcgacgccggcgccgagcgctggccgccgcgccgggacgtcgtggtctgcgcctgcgtgtgccgccggtggcgcgacgccgcggtctcggtcgtccgcccgccgctcgagtgcggcaggatcaccttcccgtcgtcgctcaagcagcctggaccaagggatgcgccgatgcactgttttatccggagggacaaaaaaatttcaaccttttctctctatctcagcttaacgcaggccctaacggataaagggaagttccttttggctgctcgaaggttcagacaaggagcacatacagaatatatcatctcttatgactatgatgatctgcacccaagaagcagttcatatgttggaaagttgagatctgacttcttggggacaaagttcatcatctatgatacccaggcgccatatgacggtgccaaaccttctaggacccgatccactcgccgctttgcaagcaagcagataagcccacaggtttcaggcggcaatttcgaagttggacaagtgacctacaggttcaacttcatgaaatcaagagggccgagacggatgcagtgcaatatccagtgccctgtaggccagggcagcgcttcggatccatccaaggagaaaacaccctcgccgagttccttggacctgaagaacaaggctccaagatggcacgaccatcttcagtgttggtgcttaaatttccacggccgggtgaccgtcgcctccgtgaagaacttccagctcgtcgccacagctggctccggtggtccatggggcgtcggagacgaggagacggtgatcctgcagttcgggaagatcgaggacgatgcgtttacgatggactaccggcagcctctgtctgccttccaggcgttcgccatctgcctcaccagctttggcacgaagctggcctgtgaataaatggttgccggtttaccaactatgttggggatcagattgtagggggtagtctgaactagttgccctgagcacctcagatgggagaaaactggcgataagaaacagggcggacgttgtccctataagctttgactccttgtaatcgcctaaatgattgatttatatatttatgatgtgcgcctatgttgtggtgtgcgcctatgttgttgaagagatgacgatgacttatcgttgtaaatggcactccacttcgtttggtgacaaaaa

SEQ ID NO: 9264 - DNA, 1879 bp, Zea mays
ctgttctcttcctttgaagacatgccgtaatatattagtataagagttcaatctgtcaggcaggctgtcactaggtcacgtcgccgataataagtcaagtcggtgcacatcatcatacacggcatttacttccttagacttcttccgatggggaaaaaaagaagtagtagttggaggtccataaatcctctctctctctctcgctataaggcaccaaagcatcagatttgtgcttgaaactcctcctcctcctcctcctcctccaccaccacctcgccttctcttctttttgtcttgcgtcgcagcatggtgaggaaccccctaaaagccaggccgacgctggtgctcatcagccttcttctaatggcggacctggcaaccgttggctatagccgaagagttgcagaactgggtgcgttagccgtgagcgacagcggcggcggtggcggtggctcgccgccgggcaaaggctgctgcttgcccaaccagtcatcttcttcagcgtcagggcgacacctcggtgacgattgttgcaagcaaatgcgtattgtgtccaagaggctggtgccccaggggccaaaccctctgcacaactgaccagctccgggctccaggtctgcacttgcatgcatcgagagataggcagaggctttttcctttttgtaacgcagccatgcagagtgattagtggagctgcaggtcttcctcttccatgaggtcatgtaaattataggcctacagcttagtttgccgctagctcatacgctctctctgtcacacacttttgtcacttttgattgagagccgctcttcatcggtgacggtgagagactgaaactttgtaataatggatggtcgagggcaaaactcttgcataggctggaattctattttcctttatctaaaaaaaaaaaaaaaatgatgagaatttttactgggacctgtggttctgacattgtgtttttttctctacgtgcttaactacctaactgttgtagtcttctcaatagattttccctcacaattcttagccgatttgtttctctaatttatataagttttgatcagctggaatgattctcacaattcttagccgatttgtttctctaatttatataagttttgatcagctggaatgattcttgattcattcctgaacaaacgaacaaggaaacaatagaagatggttctttttttttgtcccttccgctcctcgtctttgagtaggagacgatgatatttcatcagaacacgccacaagcgaagataagacattctctattattcagctggacaacataaaacgaaattacgatgctgactaattgactagtacttttaacttgatccaagtatatatacatgcaagcaaatagtacaagcttcgttgcaatgtaaacaagtagaggtttagtttaagaaagcttgatgcggccggcatgattggagttgaagaacacgtcggatgatcctacaagctagctgccgtcatccactgggatgttcggtcaactccgtgaagttgaatccaaattcggctgccgacctgccgtccaagcccaactgctctccatttgccctcgagcaatcaatgtatacacaagccatggtatcacgccgtatgagatgacaacgagttagtcatgcatcctccccgtccactccatctttgcttgctcacgagcaaggttttaaagtcggctagtcgactctagtcgcctaagcaccgataaggtgactaatcgcgattagtcatcgattagctcgattagtcgactccctagtcgtcctatagtcgtccatctataacaggaccatatatatatatatataacagtatactagattgcaaatcctagtcgactccgatcctgatctg

SEQ ID NO: 9265 - DNA, 3373 bp, Zea mays
caacagtagccacccaagtagcgtcgagcgcatagcatgggccaggtctccaaaaaagcaaaaatgaatctcgtttccacggagctaggggcacgagtctcatttggactcttaaggccaggctcagcaactacttcaggctaccaaacagaccacgttcctgaacagcctaccaaacatgctctaaatctccttatcatgccttgttgaacttgggagatgtgtccttaggtactcaagagctagtataaaaaaaagacctcgtctatcaaacctctaaattgtgtaaaaaaatcaaacagaatagtaatggaagaagatgtggtcatcaaggtttacacaaaactcgagctattataacgtaaaaaagatgcgaggagaacataaataaagaataaattaacatgtgaatagttacggatgcggatgctgtagcctgcgaatgttcatatgctgttgtatagtttgtcttcgtttttctctatagttttctttttaaacttcaaacttacaagatgtatagctgatgcatggatgcttacatgctctattttcctatctaattttgaagtgtaaaaattaaattaaatttctctcaccattttttttccttcactttctttagaatacggttgtctctccgatcacttatcgagtatataactgtcttgtccgctatgttaaaagcagtaacgaaatagagataagagccataattggcttactctatgatctaactcatgatttttatgtatatacggcatgatgctggtcatagctaataagttacgtaaaactcacggccggaaatcactgtctcctctttggcgcttcatccttgtgcggtgggggatcatcacatggccttcagtattctgctaccatgcattcacgctccgcgctctgcagcgcgccagcaccgccgccgctcggagcagtgtatgagacggacgaatagtaaaggtccagacagacacagagacggacagaggatcgcctgcgctgcgagcctgccctcttctcaaatcccatggacgtgtttggtgttgccacgccgctccggccaccgtgtgttcgcagaatctctcgatccgcgcacccgctttgaccactctctctctctctctctctctctctctctctcgtaacgctgattttaataacccccgtccgtacggattatttgaaaacaactccctccaaacagccgaatttcgcgatcccgcccgcgggcgctgccgtcccacgaacaaaaccacccgaccgcgcgccaaatcgcccgccggctccacccgcgggccgcggcacgcaacacggcccagccaaagccccagccccctcttgcataacagttgcattgcattggttatggatggatggaaatcattgccccgtccatccccccacgcagaaaagctcgccggccgggcgccggggccccgccgcgtacgtgtccgcctggccgacctcacccccgacccacccgccttataaagcgagcgcccgggcacacgcctccatccaccacacacacacagacacaccaccacacgccggtgagccggtctctctcgcccccgtgcccgtgcgcgccacctagccgttcgttcgcatccatccgtccatccgtcacacgcacaccaccaccaccaacccgcgcggccgtgtctatctgggtctgggatcgagtagcaagcaatggcgctggaggccgtggtgttctcccagccccaggcgggccacttcggctgcggccgcggggactcgccgtacgcggtgccgtggagcgacctgctgcagggagggggaggaggaggaggagggtttggcgatgtctgcgccgcgggtgagtgggtcgaccagcacgacctcgacacctgctgggccgcgcccaccgtgggggacgactgggactggggggaggcgctctcgcgggaccactcctcctcggacgccgcctccacggaccacggcagcaggaaggcggcgcccgagccggcggcgggaaggaggaagcggaggcgcaccaaggtcgtcaagaacaaggaggagatcgagagccagcggatcacccacattgccgtcgagcgcaaccgccggcgccagatgaacgagtacctcgccgtgctccgctccctcatgccgccgtcccacgcgcacagggtacgtccgtacgtgtgtgataaactaaacctttcgataatctctctctggaatactagctagctagctcggcaatgtgtggtaattaaattaacagctgtgctatgatttattaccaccattaccaaccacaacagggtgaccaagcatcgatcgtgggtggcgcgatcaactacgtgagggagctggagcagctgctccagtcgctggaggtccaaaagagcctgaagcagagccgggggcggcggccagcaggcggcggcgccagctgctcccccccgttcgccggcttcttcagcttcccgcagtactccaccgccccaagcaccacgagcagcagcggcggagagaaatgctgcggccacgacgccgcggccgcggacatcgaggtgacgatggtggaaggccacgccagcctcaaggtgctggcgcgccgccggcccaagcagctcctgaagctcgtcgccgggcggctccccctgcgcgtcccgccgctccacctcaacgtcaccgccgccgtcgacgccatggtcctctacaccttcagcctcaaggtaatactgaattatacatattaaaaaaaatcaatactttactggctaaattaatacaacgacgcataaacacgaactttagtgctccggccggaactactccacactccagcaggttagtttaattaaagccggtagagacaaaacctggaaagtagattctcctccgtttccaatctatctatctatctatattagcgaagccggtggagggcgattataatggtggcttggctttcccgtttggacggcaggtggaggatgactccaagatgggctctgtcgaggacattgccaccgccgtgcacgagattctcggcagcatacagcggcagcagcaggaggaggaggaggaggagaccgccgccatgtgaaactctgcaccacctgcatgtccggcaggcacactgccatcctgccaatggaatccattgcctgtgcatgtgatgactgtgattgcgcccccttgctaggcacagacacctgagcctgccatgatgcagcaatactgtcccaatccggccgtggtcgcaaagaatatgctatgagaaatcttaggctgtaatctaagcaccacctcccttctggagtgagagcagcttgtgtagattattgacagagtacagggggaccgatctgccctctcgagctaaaaa

SEQ ID NO: 9266 - DNA, 2440 bp, Zea mays
agccgaacaagccgcgggcgccgctgttgcgttttcttcccactcccgtccgccacagcctacgcaccttgccggctcgcgggggttttgccgtgcgccttctccctcctcctcgctcgcggcgacgaccgggggaccgcagccgccgtacgccaggtgcgcaggtcttctttgggcccgtcgccggcgacgagcacccaccaggggcgtccgagtctggaatcctatctgatcggaaaatggttaaggtcgaagatcaggccgaggacggcggcgcagatgctgatgccaggggtctcagggagtctgctctggatccgctgcctgtctcggtgcatgccagcttgaaggaggaggaaggtcaaccaagttcttcatctggtaaactaagatcacagtttattggaatggggttttcatccaagctggtagacaaggttctccagagacatggtgatgatgattctaacacaattttggaatctcttctgtcctattctgaccttcagcagtctggatcagagtcatcagattctttcggaagtttttttgataatgataatgaagagaacaattctccttcagagtctaggaaaggaatctaccaagacatcaagagcttgattctttctcagagaagtggtcatttttactcagaacaatgaacttttcacaacaagaagttgatttagccttcaagcaactaggtgatgaagcgccattagaacagctcgttgacttcattgtcagtgctcaatcaggagtaccctctggaggactgcaaactggtgacgctacaaatgagggaaagactgaattactttatggtgtgatggagaaaacacttagcttgcttcagatgggctttaccgaggaagaggtatcatcagctattgacaattttgaccagagagcaactgttcaggagctggctgactcaattttggcaaggcgaatagccaatagcattgagcagaaagagataaaagttgaatctgacttcctagacgaggcagaaactgattattcttcataccagccctcatactctgatgtaagctattatgacgatgacaacaacaatacacgggttaaaagggctaagcatatatttatagatgacataggggcctccagtagtcaccttggcgatccatggtctatggggcagcgtgcagggacaaatgatatgtctgttaaggtagaactggaggcaatgacaccaggtcgccgtgcaaatgtacaaggtgaccttgctaaacccccatttttcctatatggaaatgtggttgaggttccaaaagacacatggcatcaactcaaacaattcttatataatgtggagcctgagtttgtgaacagtcagtccttctccgctctaactcgaagggaaggttacattcacaaccttccagtggagaaaagaagtgtcgtggttccaaagtctccaatgactattgaagaagcacttccattcactcgacagtggtggccatcatgggatacaagaaaacatatcagtgttattactacagaggctgcagggattgagcagacatgtgaaagattggggggcatggttagagagtcaagaggagtgctttcacaagcaagacaaatgcagattatacaccagtgcagggtttcaaaccttatttgggtcggtcgggacaggttaggccctttggagcctcgtcaagtggaaaagatactaggttacccttataaccacacaaatttgtttgaattaaaccaacctgatcgacttgctgccatgaaatatgcattccagactgatacattgtcatatcttttatcagtcctgaaaggtaagtatcaagatggaataagagtgttatccatctacagtggcattggaggtgcagaagtagcacttcatcgtctaggcatccctttgaaatgtgtgatatctgttgaggaatctgaggtgaatagaaaaattctaagaaggtggtggttgaaaactgaacaaactggagtactaaggcaacatgcaggaatttggaagctcaaaacacatgtgattgaagacttggtgaaagagtttggtggttttgatctgattatcggtgggaattatacttcttgcaaaggtggtactacagtaaatacgacaatgggcatggattcgaaccgcttctatgagtataaccgtgttgtcaaaagggtaaggactgcagttggactcagttgaagagtccatctttaatgaagatcgcacgtcttcataaaactagcctgtaggaggatatagaatcatctgatccgtaaatgtaggatgctacaagtaaactttacaagtcttgggacttgattattgcaagcaattgacttgtcctttattttggtttgtgtttgttggtcacttctaatgtttgataatcattctgcgttactcctttcaaaaaaaaaaaaaaaa

SEQ ID NO: 9267 - DNA, 1644 bp, Zea mays
attgggtacctcgaggccggccgggatagtggatgtggagaccatttccttttgcctctctcctccactccacctctcctctcctgcgctacagcgagggggaaggggagcgtcgaccgattcgtcccggcctcccgtcccgccgctggcctcgcctgccccgatggcggcggtggcgatccaccagttcgccgagtgcatcacctgccacgcctggagcccggaccagtcgatgattgccttttgtccaaacaaccatgaagtacatatctataaattcttcacagacaagtgggagaaacttcatgttctgtcaaagcatgatcagatggtttcggggatagactggagtaaatcatccaacaaaatcgtaacagtttcacatgatagaaattcatatgtttggacacaagaaggatctgattgggtacctaccctggttattctaaagttaaatcgtgcagctttatgtgttcagtggagcccaaaagaaaacaagtttgccgtgggaagcggtgccaaatctgtgtgtatttgttactatgaacaagaaaataactggtggattagcaaggttatcaggaaaaagcatgaatcttctgtcactagtcttgcatggcatccaaacaatatatatcttgcaacatcgtctacggatggtaaatgcagagtgttctctacttttatcaagggtgtagacacaagaggatcaaaatcgagcacttcaaccgattcaaaattcggagagcaaatcgctcagcttgatctatcatctacctgggtatttggtgtaaggtggtcaccaagtgggaagacattggcctatgcagggcacaactccatgatttatttcatcgatgaagtcgaatcatctcctgtggcacaaaatttggcactgcgtgatctgcctctccgtgatgttctttttgtctctgagcgcacattgattggtgtcggatttgactgcaatcctatgatctttgctgctgatgatactgggctttggactttcataagattcttggacgagaggaaagctgccccatcagcttcaaaagcctcgcagctctctgaagcccttggaaagctatacggccaatcaaagcaagggactagtagtgataccgttgaaccatcaaaacctcgtggcggggcccatgagaattgcataacgtgtattgtacccttgagaaaaggaagcgacggtagtatcaaacgattcagcacatcaggattggatggtaagatcgtggtatgggatttggagaatcacgtcagcattgcaaaatagctcgagggagactttatcaccaatcaaatcgagggaactcctgtcattaccagccgtcctgcaggttttcaagatccagggccagccagatagattgtttttttttaatttttaaattttgttgtacctgtacacagaaacattgccttagcgtagggacagcttgcatctatcaagtagcttcatttttggcgagtaattttgccctttgaattgaatctatccaatattgtactataattttcgttaggtcgtaggcagttgacgtgatcccgcgttctttcgctctttctttccggtgccctgtgtaaaataaccacacgtggaatcttatctatccgggacttgtggtc

SEQ ID NO: 9268 - DNA, 862 bp, Zea mays
  misc_feature (828)..(829): n is a, c, g, or t
atcgaccgttatcaggtagcagtcagggatccgcgttccgaccacgactacaggttgcggcggcgcgctcctccgccacccccttcttcttcagtttccctcacattactgccactgacgttcattccgtttccttgcttgctccaggtactcccatcgctatcgaccgggtcctcgagcgcgggagatggcggatcaggagaccccagttgcagttgaggcccctaccccggtccttggggagccgatggacttgatgactgctctgcagcttgtcatgaagaagtcgggtgctcatgatggccttgttaagggtcttcgtgaggctgccaaagcaattgagaagcatgctgctcagctttgcgtgcttgcggaggactgtgaccagcctgattatgtcaagctggtgaaggctctttgctctgagcacaacgttcacctggttactgtgcctagcgctaaaactcttggcgaatggtctgggctttgcaagattgattctgagggcaaggcgaggaaggttgtgggttgctcctgtgttgtcgtcaaggactatggcgaagaatctgagggccttaacatagttcaggagtacgtcaagtcacactagatacagtgcatcggtatctggaacttgtgctctacactagctttaagacctgaatttaaatttgtgctggttcttgggcttttctaggagattatctcaattcttgttttaagtgatgtcatctggtgttaatacaaatcattaagcggtggtattctgcttctgttctttgttaccattccatggcaactgctgccgagtcatttgtggttgcctgnntcagccgatagaaaaaaaaaaaaaaaagcggcc

SEQ ID NO: 9269 - DNA, 1271 bp, Zea mays
cacgggttcggtcctgagcggccgggaaaaactccccacgcagaaaacctagcagctcggcgctccctcttctgactccttcgaggtactcccatcgctatcgaccgggtcctcgagcgcgggagatggcggatcaggagaccccagttgcagttgaggcccctaccccggtccttggggagccgatggacttgatgactgctctgcagcttgtcatgaagaagtcgggtgctcatgatggccttgttaagggtcttcgtgaggctgccaaagcaattgagaagcatgctgctcagctttgcgtgcttgcggaggactgtgaccagcctgattatgtcaagctggtgaaggctctttgctctgagcacaacgttcacctggttactgtgcctagcgctaaaactcttggcgaatggtctgggctttgcaagattgattctgagggcaaggcgaggaaggttgtgggttgctcctgtgttgtcgtcaaggactatggcgaagaatctgagggccttaacatagttcaggagtacgtcaagtcacactagatacagtgcatcggtatctggaacttgtgctctacactagctttaagacctgaatttaaatttgtgctggttcttgggcttttctaggagattatctcaattcttgttttaagtgatgtcatctggtgttaatacaaatcattaagcggtggtattctgcttctgttctttgttaccattccatggcaactgctgccggagtcatttgtggttgcctgttcaagccgattgaaattaggcgtatactgtttctttgggacaagtgatcggcagctttttagcgctacgtaattttctaaaatataacatcgatgtcattatatttgtattgaaaaataattataattttttgtatcacataaattgcattgataaggaattttctaagtcatgaaaatatgcctaaaaatttcaagaggcagtagcattgtttgttcagcattttaacgcggcatctctgccacggcaaatatgttggttatataagcaacaaccagaacgatctgtttgggtcgtgtcaatcgatatagttcgtgtaattcggtctcacccgtcgatgccaatttgtgactagccgatgccaatttgtgagtagccgccggctttcgattcccacacacaaagacaaaagtgtgtttggtgcgcaaacacaagtctcagtcactttaatcgagaaaatatgagaattcccttgccggtgtcatgtctctggatagaagtgca

SEQ ID NO: 9270 - DNA, 2690 bp, Zea mays
  misc_feature (4)..(4): n is a, c, g, or t
ggcnccaggccggccggcatcccctcgcacggccgcagcacggagttcaacatcctgtcgggcacgtccatggcctgcccgcacgtgtcgggcctcgcggcgctgctgaaggcggcgcacccgagctggagccccgcggcgatcaagtcggcgctgatgacgaccgcgtacgtgagggacaacagcaacggcacggtcgcggacgagtcgacgggcgcggcggccggcgcgttcgacctgggcgccgggcacgtggacccgatgcgcgccatggacccggggctggtgtacgacatcggcccaagcgactacgtgagcttcctctgcaacctcaactacacggagcggaacatccgcgccgtcacgcggcgcccggcggactgccgcggggcccggcgcgccggccacgcgggcaacctcaactacccgtccctgtccgccacgttcgtggccgccggggcggcggcggcggcggcggcgagtaggacgcacttcatccggacggtgaccaacgtgggcggcgggagcgcggtgtaccgcgcgtcggtcacggcccccgaggggtgcaacgtgacggtgcagccgcggcggctggcgttccggcgcgacgggcagcggctgagcttcgcggtgcgggtggaggcggcgctcggagggaggatggagcccgggagctcgctggtgcggagcggcgcgctgacgtggagcgacgggcggcacgtcgtccgtagcccgatcgtggtgacggtgcaggcgcctctgcagtgagtgctgtactgaccagctgccccgaccgccacgatgggaggtggagaggagaggacacagtctcagtgttctagcttttctgtactattaaggttgctgttagctgtagaatacgtcgtggaagagctgtatcgttagctactacgtaacgtaagctacactggaaatcatggagccctggagctccgttcttccccatttctttctttctcctcgccttgctgctaccatttgcttctgtattgccggcctccggcgtgcggttttgcacggaatggttttcaagtgcttcgtcgtctgcacctacggagtacggtcggtctggtgtgccagcagtggctgacctgaatggtcctcggctgagctcacatggccgcgtcatgtgagatatgatcatatggttgtgagtggggcggacgggtgcgtactttggagtaggatcccgccttcaattcagctctcactcattcactcgcctttgattacatcacataggaaattttcgcgagcgggtggagggaagcaggtggcgagtgcagagagtgttgagagcgctttgtcaaaaggcgccgacgtagggaaattaatggcccctgacgagatggtactagcgagggctggtgcagagcagcaggcaggcggcgaatacccgccttgtggtttactccagcattgccagctttcccagcagatgactgtggccagtgttttcttacatcgcaaggagcactgccatatctagggctgtgcctcgagagctgccacactagtcttttttataacataaattaaatatttttattacatatatataataaaaacataaaaaaaatccagcaacatattttaaattatatatagcatttggtccatacaaataagaaaatacatcaataacataataaaatattagtgtaacaatttagcactgtatgattaggttggcttatgagtcagctcacactcgattagacttagcttggctcgctgttggagccagccacaaaagtaggttcagctctatctcggactctctgatccaaaccaagcctaaacgcaacctttttttcccagcctaggcatatcaggttgttatgagatattaagccacctttcccgacagatgactgtggccagttcttttttttttttttttgacatcgcaaggacagcactgacatatcacctaagatttatatggacatcaaccgcacgctcaagttaccatggtcctgctctccgagacacgtgagggcgtgagcagcggagggctactagtcgccgtatcgtcaacttggttggactccgtcgaggacgacgtggcgaggccttgctcgtgcagcagctacttaatcattccggctctcacagtcacaggaggaacaggaacaaaacatatggctcacgtaacgatgtccaccgctacaaaatacccgttccgccgtacgatcccgttcccacccttcgtcctgcgccacgctacgcactcatcctctccttcctccgtcgtcctctcctcgtcccctggagtcgtgacgagcatgcgagctcctctccccaatttctggcacgcgtacgtacaccgccgcatgtgccattactaagggcatgtttgagagctaattagctaaaattagttaagacatccaaacacattaactaatagttcaattattatctatttttggtaaattaattaatagttaggtatctatttgttaactagctaatttcactaacaatatgctaactaactattagttttaataaattcaaacaccctttaaaataacacctagtttttttaataagcggccgtttatggtggccgcttgtcataaaggggttttccacgtgggccacttaaattagctgcttgcaaatatattatgtatataaaatttgaaccccgaccgccgcga

SEQ ID NO: 9271 - DNA, 842 bp, Zea mays
  misc_feature (842)..(842): n is a, c, g, or t
ccggccgggtattctggtgtcctaggcgtagaggaaccacacccaatccatcccgaatttggtggttaaactctactgcggtgacgatactgtaggggaggtcctgcggcaaaatagctcgatgccagaataacccgccccgaccctcgtccaacgttcgtgccgcttgctgggccgccgacgcgccaggccgctggagcagctcgcttgccccccagcccccacgccgtgcccctcgctcagcctgcgctgcctcgcactcctcgcgccgctagcccggccggagccgctcttcttccaccgcgcttgccagctgccgccgctcctctaatggtgacgaggtggagccagaagagcccgggcctcaagatcctgtggatctggaccctgggcaccgccgcaattgtggtcggcggtatcgtccggatgcgggtaaacgatgtgcagaagatccttcgggaagaagaggaagccgccgctaccgccacggccacgtcgccccccagcgagcgagtcctgaaagacgaagagtagaacaggaagtggagagttttgcgccatttgagctggggggtgcatctgtatcgggcccataatgtagtatctccattttaaaaaggtttgagtttaggaaaagaattgtttactgtagtgattcaataacccttcaccctgtctgcattacaactttcatatatgatgtgaacgtttggtgacaagaaagagatggcgggcaatatctgtagaaaaaaaaaaacaaaaaactcgagcccggaacctgtgaggtgatctgtatccaggagtttaaaagggccaaaaaaaaaaaaaaaaaaggcccctan

SEQ ID NO: 9272 - DNA, 1036 bp, Zea mays
ccggccgggcataaagcagatcagataaagcagatagagcgggcaacatcgcagatatatatatatatatatatatagagagagagagagagagagagagagagagaggcaaactggagaggccgaggctgatggtttccaaggagcagaataagcgaggagctttgcatgagaagctcaagattctccgcagcgttactcactctcatgcgggggataaagtgtccataatagcggacgcgtcatcgtacatcaaggaactaaagcagaagatcgcgaagctaagccaagagatggcatcgtcgtctccgcagcacgccactactggtgtctgccaacaacaacggtcgtcgtcgtcggtgagtgtgggagtcctggacaagaagggccgtttcctcgtcagtgtgttcatggacgagagctgcggcccgccgccggccgggctactcgcttccgtcctcgaggccttcgacgacatcggactcacggtgcttgaggctagggctacctgcgctggttcctttcggctagaagctgtaggagaggaagtagtagatgggggcctcatcatcgacgcgcacgcggtggagcaagcagtagttcaggcaatcaagaattgccctgcaaattaaactaatcgacctagtcctccaattcgatcgatcgagttgacgatgcgctggtggtgtagcacaaagttcatgccaagagactccgagctatatatacatactgattcgcatcgtactttttgaagagagcaaagcaattttttctctcttgcctgccgcaaggagtcagtcttgcgagttctgctatttagtcaggccagggggcacctgtgctcatcgtttggcaatgccaatatatatatctcaattatccccaaaaaaaaaatatgccggccgcaaggggcacgcgaaccccggattttttttcattcctaaaaaaacaaatggggaaaatgaatacaacgtcgtgggaacaaataacgccatgaaaccaagccggggggggcccccccccccaaaaaggg

SEQ ID NO: 9273 - DNA, 1203 bp, Zea mays
aatccaaattatataatccatgggggtaaacaaataggccctaattagcaccttcctttttttctctgccgtcaaccacgcccacgtccccgcggagcactgacatgcgcgcgtcgtggtaccctggtctgtggcctctgcgctccccttcctccgcggccctcgcctcgccagaacagcgggagatctcgggatcgggcggccctcctccggcgtccggatcgagaggattggacccgaatccgatcgcctagcagggggcgcggcgcgcgcgcgatggcgccggcggtggtgtcggcgctggccaagtacaaactggtgttcctcggcgaccagtccgtgggcaagaccagcatcatcaccagattcatgtacgacaagttcgacaccacctaccaggcaacgattggcattgactttctgtcaaaaacaatgtatctagaagaccgaactgtacgtttacaactctgggatactgcaggacaggagaggtttaggagtcttattccaagctacatcagggactcttctgttgcggtggttgtttatgatgtatccaatagacagtccttcctgaacacctcaaagtggatcgatgaagtgcgcaccgagagaggtggcgatgtgataatcgtgctcgttggcaacaaaactgatcttgtcgacaaaagacaagtgtccacagaagaaggagagagcaaggcaaaagaattgaatgtcatgttcatcgagaccagcgcgaaagccggcttcaacatcaagccgttgttccgcaagatcgctgcagccctgccaggaatggagacattgtcagcaaagcaggaggacatggtggatgtcaacctgaagtcgacttctagccagtccaactcgcaacaacaggagggaagtggatgcgcctgctagaagtgtgttagcttcaggcatactttcacttgaagagcgtgtgtcggtaactgttgtataagcagttacatatttcactagtgttactacttactatccttaattctctgatgcttctgtagtgaggctcacatcgttttctcattttccatcttgattttgtatgttgcggcaaaagaccagaaataacaacattttgaatcacaccgggtcttttgtttcgaaataacaattagttatcggggaaaaaaaaaaaaaaaaaaaaaaaaaaaaggactctgcgttgttaccactgct

SEQ ID NO: 9274 - DNA, 1813 bp, Zea mays
acaaatatgttatctgcttcaggttggggaagatgtgatactctatgcaatgttgagatctgatcctgtggcaaagggaacaattacttcaactaatccaaacactgtgctaggaggtgaaaatcttggaacacaattttgtgaagtagttgtgaatgttgtgctaaaaagggacgcagatctgcctcgcccttatgaccatatggagaccatgggtgatgcttatatgatgcctgttgcatggccatacaagagaatgaaggtcagcaaggcttccaaatcatcccatgttgctactggtaattctgggatatgctaggtagcacatttgatggaccagctgacagcaacttgttcaaacagcaagcatatggtgtaatggagaagggttgtcttcttagtttgcagcttttgggtttcctacattaagactgtagttatagcttttgggttgcaagcatatggtgtaatggagaatggttatagcttttgggttgttgtgttgacaactgtaatagtactgactgtgtgctgtttggaagcgacaatgcacttttgctgcttgtgcttggtacctttgtttcaaagattgttgaacaatttcttgtgtgtcctgaaaaaaaaaaaaaaaactatgctgatgttgaatcaatgaatgattgtgccaataattgtgtgcaaatggtgaattgtattgataatttgggggtattataataattagaaatatattgtacatattttatgtctgaaaagttcgcgtcaaactgtgggtcgctaaaaatgcatataccgtttcactatcagtcggtacaactagtcacaaactgcgtgtcggcacaaccaggtcggtcggtattactcattatggtgtccgactatccgtcggcatagatccgtcggtcggcaaaaacttttgccgacgccagtatcaccgacctatacttgcggtcggcataagtctataccgactaatgctcagttaccatatcaacttttaacgactccaatggagttgcagattttgggttgtggtatagtataatgatacaatgccatattattacactattacattattatgtttttgatttattttcttatgctagatatagtttaaaatatgttgttgtattttttatatatttttattatatatacaatgaaaatataaaatttatgttctaaataggacttagtgtggcagctcgcgagcctgaacgaggccgagccgagccgagtctaactcgctaggtcaccgagccacactgagtcgagccgagtcgagctcgactcgtttccggccctagctacgtgtgatgaatgtggattcattgttcttgtggcagcttactacttcggatagcgacgcttcggtaccaaacccatcatctgttgattcgtgactagcaacacaagaacaaacattacactttcaataatttaggtggtttccagatattcgatttgatgttatttacaatgatactcaactttttgataaactcgttatccttattgcatattcacctcatttcaatttgttgtagggttaacacaatttcatagcttaggataagtaaacattcgatttttttgctcacgtcattatctcgatcactttttgccacgattcttaatgtgtattcacttgttgccttttagatttgtcatatcgttagcacggccacctaactagtttacttgaagtaatcgtctcctgagaataatatatacgcatgtgagcagattcagtgctgggtagattcaaagacacccgggtaacaaagataactaagtaagaatcattagg

SEQ ID NO: 9275 - DNA, 4317 bp, Zea mays
  misc_feature (2672)..(2672): n is a, c, g, or t
gcacgagaccattacctagaacatcctaatcgaaaaagtccctccctgcacgcctggcctgggctggccgcctccgaccaccgtacgtccgcgattgggttcctcgaggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacgcccaccaagaagcaggacgacaagccgaagccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcagcaaggtctctgatgaggcggcggcggcggctaccgcggtgccgcctgcaggtgccaagacctccagcagcaacgatgcccgcgacggcgccatgggcagcgtgcaggacgagccgcggcagcagcgccacgatgactatcaccaccccgagatcgtccccgagaagatcatacacgaggacgcgttgccggtcgttgctgcggagaaggagactgccgccgccgccgcaacctcgaaggaggaggaggaggtggagtcgcccaagaaaggagcggctctgtcgccggtgccggaggctatcgtcatcgccacagccgcaacctcgaaggaggaggaggaggaggtggagtcgcccaagaaagaagcggctctgtcgccggcgccggagcctatcgtcatcgccgccgccttaacctcgaaggacgaggaggaggtggaatcgcccaagaaagaagcggctctgtcgccggcgccggcgccggaggccatcgttgccgtagcagcagtggaagacgtggtggcggacaagttcgtgacggttgtgaaggaggcgatcaagaagcaggaggcggaggaggacgagaaggaggaggcaatgcggaggttccagggcagccgtgtgaggacggcgttggaggcgcgagcggagtcggagcagccgcgtcgccgagaggtggcgcggagcaacgacgtgatcgaggaggcgcgcacgaagctgctggagaagcgtcggagcaaggtcaaggcgctcgtcggcgccttcgagactgtcatcgacaccaagaaggacagcgacgacgcggccgccggcaagccggagcaccacaaccgcaacaagtcggcttaaatgattaagcgtatacgcttcgtgtcttctccttaattattataattattactggccagcccatcgccgcatggatgcatgcacggcgctaattaatccttcttgctactaattaactccggttaattggtggcacaccatgtatagcgtcgtggagttctctatattacaccatagagggaaatgtggagaccggtgttgcattctatacaatttcttcttataattatatgattcatcggttttattctcccgtcgacgcgtgtgggtttctcaggtcactcttattagacgcgttttgcttggactttagtttttatgatccatttggaacagctacaccgccttagttcctttaaacccaaactttagggactaaaactgtcctatatttttttggaaggctttatttagttacacggtttgatattgacagtttatagactaaaagtgactaaatttgagtcgctgggaacgaaaaccgcctaaatataactacactatacagtcactccatcagtgaatcatccagtatggaaagtgtctagcagtggttggagacacagtctcccaggctttgcgtcttggccacactgaccgagccgtcgaactggtggatgaattcagaacggcaggacgcatgcgaaggcatcagtttccttgcgaactggtggatgaacaaaaaccccctaaatataagtcatataacggagcatgtacgatggggtctcctctcctcagagacagcccattgctactgctagtgtagagagcaccaacattctcttccagttattacaaggaaaagaaagaaaaaagcgaaggatggtgattgatgagaatggctgaaatgggcacaagcttggatgcctacatgatgactgatgagcaaaggaacggcatgcacagagcaccagtgagctgcgtgaaatgcccttggggccatcccatgatctcaatctcatacatggacccaatggtgcactgcagccttgccttcatcgaggcctctgctctcctcctcctccccttcatctagtcctctcaatgttctctctgcagcaacagatggaggggattcatggctcatcaatatgggttggtggcagtggaacgcgggctttgtgtcctggccaaagaaaatcttccaacccaggtttccatcattagcggtcttaccnaaaaatgtgtttatcagatttctcggttttttcgtttttaaacgtgattttcggttttctcgaaatgttttcgctgagaattttatccatgctctcaatatcatcgtcgtccatgacttcttcagctcctaacttgtaccttcactcacccttctccttgctgcgaagccacacacctggccagtggcagcactcggctgtcggctgtcggctatcggcggcagcagcagctgctgatagactgctactcggcgtcggcagtgcagtctgcgccactgtgagttgtgacaacgctccaccactagtctcttccctcgcctccgcccacgtacgttagcctacacacgtccacttccaccccgcgcccgccatgaggacgggacggtgggcggcgctcggcggcgagcggccgcgcgcgtgtctccgccttcgacgctgccatcgcgcggtgcaacaagaaagtgaagagagctggcggcccgacctgcgcggcggcggcgacgacaagcgggccgtgccgaccggctccaacggtccaaccccttgcacaaccgatgacaagaacaagatcgcccgtgcttttgcgcttcgcggccaaggacgtggggcctctctgtcgctcttgctctgtatatatgcgccctgcgtcgtcactccatggcggatggattggttggcttggcggagcggagcgagaagaaatggagctagcagaggaaggagaacttcatggccagtgaactagggaggaacagaactacagtagtgtaaaatcggttacttatactatttactgatgtccgatccgacgtgttagtaactggtagttcttcttgttccatgatccctgctatcggctggcgttcgtcagatatcagttctttgatcaactgagccgacgaattgtagtaagccacggtttggaacgccgggatttcgtgggatttttaaggaagctgtatacgtttcttcctacgaagtccttgcgtctcaaacaaggcccagaattggggtaatgaactctaaccattaactcttgtcagtttagagttagctagcctatgtttagtttttcaaataggcatttaaaaatatgggctaattgttaaccccccctgtatccaacaggcctatagtatgtcatacaatcctaacacacaggagcatgcatgctttattggcatgattatatacacatgattattcagcagctcgtaatcgtgttagaaagaatttcgtagtcgcttctgacacaatccatccgatctgatttggtgaacagggaaatggaggggatccacgggagaggaatctcctccctatttaaaattgaatagcgatgagatccctctccaatggaccctctccattttcctgtccaccaaactagccctaaagtatcactaagcatagatattttatttcttttgaaagaaataaaaaaaccactaaacacaatcacggacgtgtacatggagctaatcaagtccagtccagttaaaagcaaacaaatgaagaaaaggaaaaacatggaaacaaattaatgaaatgaaacaatgaaagccatgctaaattaaaagagtgaacggacagagacacaaatttgaagaatatccgcgagagacgatttcaataatcaccaaca

SEQ ID NO: 9276 - DNA, 2811 bp, Zea mays
  misc_feature (96)..(96): n is a, c, g, or t
  misc_feature (203)..(203): n is a, c, g, or t
  misc_feature (206)..(206): n is a, c, g, or t
  misc_feature (295)..(295): n is a, c, g, or t
tcatcatcagaggagaatatatagcatgtatgaagggactttctaataatgatttagtgtgaaccaggtgatgcattcaacatcaggctattaagntaagctgtcataagcacagaaatggatcaggcaattagattcagagcttgaagtacgtctgtagaaaagaaaactcaaagtccatcccccaatttttacccccctcnccngatgcaatactagatccggtcatatctctagggccgcaatgattcggggccgccataccggtggagagccaaggcgaccgaatcaccanacatgggccgtggaagcacgcacagccactcaatgacacacgcacccggcacccagtcagagaaagcaagcagccggtcggctcgggatttccgcaaacgggtagcaggcgcagggagggagcgggcgaagaagccttacgggtcgaggaggacgacgtcggcgtggccctgcatagtcttggcgaggagggagccggcgacgccgccgccacccaccacgacctcgccttctcctccgcctccgccatcgcctgacgctcgcgccacccagctgacaaactcccccacccacacccagctcacgcggcgttattaaccaagctcgcgaggacataagtggcggctttggaagaatcgggtgccgagtgctgaccgaccgctgacgactcgagtactcgaccgacgcgtcgggacggacggtgaagcgcgcgccatggtgctgccaccccctctcaggctctcaccatccgaccgcatgtgacctaccgacatgtgaatgcagttcctcccggcccggccgccctcctggactactactacacgactactattattataattacatgaataaataagctgtcaatgaatctatttaaacaaaaaaaaagttgtctttgccatgacagggcatggtcgctgtcgcgtggtcgaaagtagcctttgccagcagcgggtaaccgaaataaccgtcgcgaactaccctccgagccgtaggtgtacaagagcggctggggatgctgccacgtgggccacccgggcgccctcgcgcccgcccccccggcctccccccccgcccagtccctccctgcacgcctggcctgggctggccgcctccgaccaccgtacgtcctccaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacgcccaccaagaagcaggacgacaagccgaagccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcaacaaggtctccgatgaagcggcggcggctaccgcggtgccgcctgcaggtgccagtgccaagacctccagcagcaacgatgcccgcgacggcgccatgggcagcgtgcaggacgagccgcggcagcagcgccacgatgactatcaccccgagatcgtccccgagaagatcatacacgaggacgcgttgccggtcgttgctgcagagaaggagaccgccgccgccgccgccgtctcgaaggaggaggaggtggagtcgcccaagaaaggagcggctctgtcgccggtgccggagactatcgtcatcgccaccgccgcaacctcgaaggaggaggaggaggaggaggtggagtcgcccaagaaagaagcggctctgtcgccggcgccggagcctatcgccgccgccgccgccgcaacctcgaaggaggaggaggaggtggtggaatcgcccaagcaagaagcggctctgtcgccggcgccggcgccggaggccatcgttgccgtagcagcagtggaagacgtggtggcggacaagttcgtgacggttgtgaaggaggcgatcaagaagcaggaggcggaggaggacgagaaggaggaggcaatgcggaggttccagggcagccgtgtgaggacggcgttggaggcgcgagcggagtcggagcagccgcgtcgccgagaggtggcgcggagcaacgacgtgatcgaggaggcgcgcacgaagctgctggagaagcgtcggagcaaggtcaaggcgctcgtcggcgccttcgagactgtcatcgacaccaagaaggacagcgacgacgcggccgccggcaagccggagcaccacaaccgcaacaagtcggcttaaatgattaagcgtactatacgcttcgtgtcttctccttaattataaattattactggccagcccatcgccgcatggatgcatgcacggcgctaattaatccttcttgctactaattaactccggttaattggtggcacaccatgtatagcgtcgtggagttctctatattacaccatagagggaaatgtggagaccggtgttgcattctcaaaaaaaaaaaaaaaaaagtcgacgcggccgcgaattccagataaaaaaaaa

SEQ ID NO: 9277 - DNA, 1715 bp, Zea mays
gtgtaatattttattctgatgagttcttgtatatgctgtctacacgcaggttaaatattaataacccctgcagaacccagttgcttactggaaaacaggcccagccaccacctttccatggcactggcaccggttgttgactgctctgctgcctgcacactaatggcggtctctgtccgtctacatatataacacagagggggcccctccggccgcccgcgcggagcaacaccgtccagtccatcactgccctttgttctcctccacagtcgcagacaaagctggttcgtctcgcggagaggggaagccgggaaggtggataggcggcacccacccatcacccatggctgggttgcaaagatcggcgaccacgttcagacggtccggctcgtcgggcctggtctgggacgagcgtttcctgaccgaggccgacgccgaggcgaaggccggcgccgcggaggatgccgagcagccggagctccggcactcgaggagcgtcggcatgctgcgccgtgcgggcggcggtggagacagccgcagcaagaagggcaaggagagtaggcagaagcaggcggagtcggcgcggcgcagcaaccagcaggtgttccggaccaaggacgtggccccggacatggatcccccctcgccgagggtgtccggctgcgccttctgcgccgtcttccgcgggggctctggcggtactggccgcagggcacaggcacgccgccggtccaagcccaggaagaagtgacggcgtagcaacacgtacgtacgtgcggtacgttgttgtttgtgccatctgtaaagtccgggccatggttgttcgtgcgtgtacatgtttactatactaaatactagggtcatatatagatgagcttgctactcggtaatcggtatacgtacgccattatttagttcaggatagttcctccttttttgggtcggtcggttggtttcttgatccagatccatgcttttgaggtttgggcgacggttagatgttacttgtctactatatatgcagcagctatttatgagatctggggctgttgttcttgttcttactagcttggtgcaactttttcgcttgggttctgccgctggtccttcgggaagcgcatgtggttttggttttgaaactgggagggaagcagggtggagcgacgatgaattggtccgtgatgcggctgaactgggagggcagacaggcaggctggtggtggcagatgggatgagcggcgataattcagagtgctaattactagcaagttggtgagcgacatgattgcgctgtggaggtggatggacatagtgacggccatccacgccgacgtcgacgtgggatgtgaatgtatatcccgattcagtcctgctttcacacggccggggacgacgcccgtctcgtgccgtcgacctgtcgacgacgacgacgatacggtcagcggcagcgtcacgcctctgcctctgcgtgcgtataataatggaggactggtggccgtctctttctccggcaccttcaccttattactacgtctctgttgggaccgctgcacagacgagacgactcgtcaattgatgattggtaacgtgtcttatgcagaaacaaaaaaaaaatgttggaggctataccctcctctcctatagcgaatgatctttgtcccacagtgattcctagcgtacacatgacatgagtcgactacgtgcattatggtgat

SEQ ID NO: 9278 - DNA, 1581 bp, Zea mays
actggaaaacaggcccagccaccacctttccatggcactggcaccggttgttgactgctctgctgcctgcacactaatggcggtctctgtccgtctacatatataacacagaggggccccccgtcggcgcgccccggcgcaccgtccagtccatcactgccctttgttctctcctccacagtcgcagacaaagctggtccgtctcgcggagaggggaaggtggataggcggcacccacccatcacccatggctgggttgcaaagatcggcgaccacgttcagacggtccggctcgtcgggcctggtctgggacgagcgtttcctgaccgaggccgaggccgacgctgacgccgaggcgaaggccggcgccgcggaggatgccgagcagccggagctccggcactcgaggagcgtcggcatgctgcgccgtgcgggcggcggtggagacagccgcagcaagaagggcaaggagagtaggcagaagcaggcggagtcggcgcggcgcagcaaccagcaggtgttccggaccaaggacgtggccccggacatggatcccccctcgccgagggtgtccggctgcgccttctgcgccgtcttccgcgggggctctggcggtactggccgcagggcacaggcacgccgccggtccaagcccaggaagaagtgacggcgtagcaacacgtacgtacgtgcggtacgttgttgtttgtgccatctgtaaagtccgggccatggttgttcgtgcgtgcacatgtttactaaatagtaaatactagggtcatattatcatatatagatgagcttgctactcggtatacaccattatttagtccaggttagttcctccttttttttttggggtcggtcggttggtttcttgatccagatccatgcttttgaggtttgggcgacggttagatgttacttgtctactatatatatgcagcagctattgatgagatctggggctgttgttcttgttctttactagcttggtgcaactttttcgcttgggttctgccgctggtcctttcgggaagcgcatgtggttttggttttgaaactgggagggaagcagggtggagcgacgatgaattggtccgtgatgcggctgaactgggagggcaggcaggccggtggtggtggcagatgggatgagcggcgataattcagagtgctaattactagcaagttggtgagcgacatgattgcgctgtggaggtggatggacatagtgacggccatccacgccgacgtcgacgtgggatatatgtgaatgtatatcgattcagtcatgctttcacacggccggggacgacgcccgtctcgtgccgtcgacctgtcgacgacgacgatacggtcggcggcagcgtcacgcatctgcctctgcgtgcgtataataatggaggactggtggccgtctctttctccggcaccttcaccttattactacgtctctgttgggaccgctgcacagacgagacgactcgtcaattgatgattggtaacgtgtcttatgcagaaacaaaaaaaaatgttggaggttataccctcctctcctatagcgaatgatctttgtcc

SEQ ID NO: 9279 - DNA, 1426 bp, Zea mays
gcaaaaatctcctctctcgcttcatttcttttttctttccatcgaattcctcgtcaccaacacgcacgcggcctctgcctccgcgatccgcgtctccatcctgaggctccgaatcgatctcccttcctcaccaaaccggagcacttcggaggccggacccggcgagaagcgaccgaccgcagccagctcacgtctccctcttcatccaccatgctgagggtcgcgggcaggcgcctctcgtccgctctcgcctggcgccccgccgccgccgcctcaggctcccggggccctctcgccggtacactacccggccgcgacgacgacgacacacgcgactgcagggcgcgtttcgccatcgaatctcccttcttcgccgctgccagagggttttctgcagagactcttgctccaagaaaccaggatgtgggcttatccgagctcccagcaactgtggcagctgtgaagaatccaagtggaaaaatcgtgtatgatgagtataaccatgagcgctacccacctggagaccccagcaagcgtgcatttgcctactttgtgctgagtggtgggaggttcatttacgcatctttgctgcgacttctcgtcttaaaatttgtcctaagcatgtcagcaagtaaggatgttctcgcgcttgcctcacttgaggttgacctctcaagcattgagcctggaaccacggtgacggtgaagtggcgtggcaagccggtcttcataaggcggaggacagaggatgatatcaagttggccaacagtgttgacgtcgcatccctccgccacccagagcaagatgcagagcgcgtcaagaaccccgaatggctggtcgtcattggggtctgcactcacctgggctgcatcccgctccctaatgcaggagactttggtggctggttctgcccgtgccacggctcgcactacgacatttctggtaggatccgcaagggcccggcacccttcaacctggaagtgccgacatacagcttcttggaagagaacaagcttctcatcggctgagattgctgttagtgttgttcgtgtggccctgtcgtttttgtttgatcaacaacttcaccttttctcttgcctgggttagggcatacctttgtgggttgtttctgagtgcagtgttgttgctagcacctgacagtaatgaataacctgctgctacataaaggatactgttaattgttgtcaaatttggttctgtttttttcctgacagcaatgaacaatcttctgctactgaaagtatactgttaattgttttcaagtttgcttgtgttttttccctgatctcaagagggattgattatgtaacacatttttaactgctacggtccatttttatctcgtcggttagtaggaatgtaatcggatattgatgaatattactcgttccatatttgtttttc

SEQ ID NO: 9280 - DNA, 1273 bp, Zea mays
ttttttttttttttttcgaagtaaagaggattagtagtaccattcgcagttttacattttccaaacacactgcaaatactttattaatgacaaggtaacctaattaactgagcagcgtctgaccagcgtaacctttttttttatcagcaaatcccttgacacggctagtgtttcattctatttatacgaacatgaacatctaccatcagctcggcacacacagagaacacatgagctctaccgcttctgatccacggcaggagggagctgctggaggcctcccctgaggggggctggctggctggctcggtcgattcggaaaggaatctccttcagccgacacgctcattcttcttcgtcctcgtcttcttcattattgatccccacccagtgagtgaaagcgaaaaggaattccttgaaggtcaccgttccattcttgtcccagtccatctcctcgaatcttttcatgcctatgcgcccagaagagcgctctcctccaatagtctcatttattgcttgtatcatctcgctcttgctgacatatccatctttgttcttgtccaagaagacaaaagactcgaccaatgtttcaaatgttggttcaaggctacctaaccccattctttttctaacttcagacactgcaggatcatctagaagataaacaaggcacaggaagacaatgaactcattgaacttcatgcccatgttctcataaatgtcacatgcctgaaacagatcttttatctcctggtcagtcgattcaatgcccaaattttggaaacaatgcttaagttccagctgatctatttcaccattggaatcttcatcaaattgctgaaagatagtcctgcattttctcaaactctcgtcgatcttaggaaatttcatgatgacactgttcaatgatttcactgaggttccttttaatgctctctgctgcatggcttcaaccatcttcttctctaacttagatgccggcgaggtgtgccttggtgagtcaccactaattacacctcccatttccgcaatttcgacgatcttgtatggtgccaaaacctccttgcttggaccgaggagaaatccaagtccggatggatctccagcactaactccaccggcagggccgaggggcgatcgacggggtcacgggggacgcctgcgcctgcgggcgggtggtggagggaggggaccgggaagggaggcgcgggttgcgcatacggtgggaggggaggggatgggatgggatggagagaaggagaagcagaggcgc

SEQ ID NO: 9281 - DNA, 3043 bp, Zea mays
  misc_feature (1356)..(1356): n is a, c, g, or t
  misc_feature (1442)..(1442): n is a, c, g, or t
tacatataaataatatgtgttaagtttatttgcaaaaacataaacacgtacattgatatatatttaatttaatatgtcttataattatcgagatataaaatcgaccaaaataaaaatatatttagtgttagttgaataacctaatttttctaaggaattccattttttcaagggaaaattaactcccttaagaaaataaaatttttttggaaaaatgatgttgccaaactagccctgatatattggagctaatatgattaccttaataaagaacagaactccatcacatccattatttctcatgaaaaataaacatctaagacctagtcagaaaagcaagtaattatttcatcagaattgaaagtttacaactaaatatataagacgctagataaataaaaaaataactataaaagaatatgtctaaatatgaaagaataagaattagtgaatattgaattatctaggagctgcgagcctttgacatgcgattggcgacaacagtgaggacgagactggttctgtgcaacggcgtaggaggccttcaaccgacgctttagtctgatgtgtgtcgtcttttctgtttttgtgcaattcgacaagacaataatttaacattaaccatactattttattagatattgggcccctttctttcttaggccccaggcggtcgcctccgctgcatggccctagggcccgccctgctattaggtactagtcgcattgcaataatggagatagtaaatagtcgacacatgatctaggaattggccatcaccatatcttggaaaaattcctggtatgccatcagattttatactcattccttgtgtgccactgagtggcatataggtatatttttttggcgcgcgcagcaccgttcatgagtttttaggggtcataacaatattgggctagatatggagccatctcggctcgttcgagttcgaactcgctcggctcgttaagctaacgagtgatagagttaactcgactcggcttatttacaagctcgagctagagcagaaaaaacattatgtatataataatccatttctagttaatttcaaactaatttaataatagaaaataataattatactcatagtttcaaatacaacatcaatgtaacgccaaattaacataacccactagtcataaatttacaattcacacacatattcatcagtttaaccaaagttaattttgcattaatcaatttaacatatagacatagtttatctatcattagtttatatatatatatataacatgttgatcaattgttacgtaaaggatatgcatataattttgttttgctgaattgtgatagcttctttagctcgcgagatngctcattaacgaatcgagctagaatgtcagcttaactcttaaaaaattcaaacaaaccgatactaatcgagctgagctgaccacgnactgagcgagccaacaagccacgagcatttcatccaaccctagttgcccgcataaacgaagaaagccaaaaatcaatgtttgtctggttggcttctctatcattatatacaatataaatgttctagatttaaaatatacatgtgaatattgtacctctccaaatactagattcaataatttggaccgtttcttgctctataatagggaggtgacaaaactggcggggatataatacgcctgcacggcttgacggatgtttgtgaaaaaagaagagcgtgttttttttctgttgacctacaagtagacgttgacctggagtccctttatcaaggctgcttgctcccaccgctcgttgcaacttgcaaaggcagctacctgctcaccgtcctattgtctctgcccccacctaccggtacgacgcgcatgcatgctccaaccaaaacacctctcatctctctctctctctctctctctctctctctctctctctctctctctctctctcgcgctctctctctctctctctcctgtttgcattgtatatcccggatctccaaatatctatgaatctatctttagttatacatacgcctacaccagtatgtgtatcaaattactaacgtgcaagcagaagcaacagtgttgtttcaattcctgtgttgtagtcgtatagctaaatagtaacagtatcgatcgtctcacttttcttgatcaactcggtctactgtgtgtgggcagtgtgcacgtaccagcagggatgttgaacagcggatcatgcttggccggcggacatgacggcaataacgaccagccgaacggagacggtggtggccagcagtatgaagggaccggcggcaagaagcagctcgagtcctcgaggctcaagaagagcagcggcaacaaagataaagccgccgccgcagaggacgactaccccaaccccaagtactgcaccaacaacaccagcggtggtaccagcgtagccggcgcgccctactgcgtcggcgtcggcgtcggcggcggcggaggcggatacgggaacagctctccctgcggcggcggtggcgacggcgacagctatggcaacagctgtccctacggcaccggcggcaacgcaccatacaacaacgctcccgccgccttctgggctccccaggacggcgccaggtcgccgttgtacatcaatacccaggcggtgcacgtgtacggcatgccttgtgtgtccaacaacgataacagcaacgacgacgacaagaggacgaagagaggcgacgggttcttcggcccggtgttccatgccgccggccacttcttagatcgaaagttcggcttcgacggcagggactgatgactgatccatatgtagacatggccgacgtgccatctatatatgatcatatatgtttaatttgcttcaccctagccgtctccacatgtagacatctatatatgatcatatatgtttaactagctgaatgcccgtgcgttgcaacggaaatatataataccaatatactgcgataacttatatacaaaatgtgtgttatattgttatgagaaactgtttcatattccaaaaagaaaaaaaaaaaagagaaaa

SEQ ID NO: 9282 - DNA, 952 bp, Zea mays
  misc_feature (948)..(948): n is a, c, g, or t
  misc_feature (950)..(950): n is a, c, g, or t
ttggggaccctcgggctgccgggcacttgcaaggcagctacctgctcaccgtcctattgtctctgcccccacctaccgtgtgcacgtaccagcagggatgttgaacagcggatcatgcttggccggcggacatgacggcaataacgaccagccgaacggagacggtggtggccagcagtatgaagggaccggcggcaagaagcagctcgagtcctcgaggctcaagaagagcagcggcaacaaagataaagccgacgccgcagaggacgactaccccaaccccaagtactgcaccaacaacaccagcggtggtaccagcgtagccggcgcgccctactgcgtcggcgtcggcgtcggcggaggcggacggatacgggaacagctctccctgcggcggcggtggcgacggcgacagctatggcaacagctgtccctacggcaccggcggcaacgcaccatacaacaacgctcccgccgccttctgggctccccaggacggcgccaggtcgccgttgtacatcaatacccaggcggtgcacgtgtacggcatgccttgtgtgtccaacaacgataacaacaacgacgacgacaagaggacgaagagaggcgacgggttcttcggcccggtgttccatgccgccggccacttcttagatcgaaagttcggcttcgacggcagggactgatgactgatccatatgtagacatgggccgacgtgccatctatatatgatcatatatgtttaatttgcttcaccctagccgtctccacatgtagacatctatatatgatcatatatgtttaactagctgaatgcccgtgcgttgcccccgaaatatataataccaatatactgcgataacttatatacaaaatgggtgttatattgtaaaaagaaccctgtttcattttctgcttgggcggggtaagaaaaaaaaagttttaantnag

SEQ ID NO: 9283 - DNA, 1372 bp, Zea mays
gtgttcacaggaaccatagttccatgcctgcaccattagggatgggcaggtgtttctacaaaatgaacagaagcttttttttttttttttggaacaaagtaaagcactactaccgttcacaagtttacattgtcatacagaatgcaaatagtttttaaagacaatgtacgctaacagaacagcatctgacccggtgtaactttttataagcaaatccttaacatagctagtgttcatcctgtttatacgaacataaacatattcatcagctcggcacacaaaaaacatgaactactgcttctgaacaacggtaggaggaagctgctggaggcctccagtcaacctggccaattcataacgcctaatccttagttggcacactcattcttctttatcttcatcatcatcgtcttcattatcgatccccacccagcgagtaaaagcaaaaaggaattccttgaaggtcactgtgccattcttgtcccaatccatttcctcaaatcttctcatgcctatgcgccctgaagagcgctctcctccaatggtctcatttattgcctgtatcatctcactcttactgacatatccatctttgttcttgtccaagaagacaaatgactcaaccaatgtttcaaatgttggttcaaggttccctaaccccattctttttcttgcttcagacactgcagggtcatttagaagataaacaaggcacaggaagacaataaactcgttgaacttcatgcccatatgttcatatatgtcacatgcctcaaaaagatcttttatctcctcatcagttgattcgatacccaaattttggaaacaacgcttgagttccagttgatctatttcaccattggaatcttcatcaaattcctggaagatagtcctgcagtttctcaaactctcgtcgattttaggaaatttcatgatgacactattgaatgatttcacagaggttccttttaatgccctctgttgcatagcgtcaaccatctttttctctaacttcgatgctggtgagctgtgcctaggcgagtccccactaattatacctcccatttcggcaattttgacgatcttgtatggtgcaaaacctccttgccgaggacaaatccaactccggatggatcaccggcactcactccaccagcagggtcgagtggcgatcgacgggggacgcaacacctgggggcagggggctggaccgggaaggcaggcgcgtgttgcgcatgcggtgggacgtgagaggggaggaggagaggctacgctcgcggggatctggtggtggagtggatgggatgggaatgcggatgggatcgagaggagaagcagatgcgtgttcggcgccgagggccgtgggcagcct

SEQ ID NO: 9284 - DNA, 1950 bp, Zea mays
  misc_feature (15)..(15): n is a, c, g, or t
gtgggtacccctcgnggttcggccggggcgcaacgtttactcgcaagcacggactgggaccgcgccagccaagcgtgtgcaggtcgctgtctgctgccatagcttgccccgtctgcctgcgcggatgaagctaggcgtaggcagtaggcacctcgcctagtctcctgtaaacacccgcccgctagtgccaactgccaaccacctccaattacttcacagcagcgcggcgccgagaagatggcttccccctcgtacaggcttgcggcggcgatcacggccccctctaccggcgagttcctcgtcgtccggcagccgcgcccgccatccccacccgaggaggaagaggattaccggcgcttcgtcgacagcgatctctacgacctcccgtccgcgcccctcgggccactcgagggggcaccccggtcggaggtggccatcggcggcgcggactctgtcgccagccgcctcgacctctcgcgcctcgacgtgtccgccgcccttgatcagatttttcaccaatttggcttgccggctgggatgagtggggagtggaggctcctgaagtatgtggaggaagcagaatttggcccggatgctggcattaacacggtgtacattgtcggatctcttgagttgagattggatgatctgccagagtcatgtaaatggatgtccaaggagtgtgcattgaggttgctttcggaagcgaaaccaggtaatgatcgcataggacagtatgcatatattggacttctgaattcggagctgtcatcaaactgcacagcttctcctgcattgcccttccaggaatacccacctggaataacacttgtacctatgaagagtaggacactagcgccattccgtacaactaatcttgtggtagtacgatcaaccaatggtgctggtggatctacatgttctgatttttttgcttcgggggaagctctgcttatagatcctggatgcagctctcaggttcatgcagagcttgcagatctcattgattcccttccaaaaaggttattagttcttgttacacatcatcatcaggatcacattgagggtctttcagtcgttcagagatgcaatcctgatgctgttcttctgacacaccaaagtacaatggatcgcattgggaaaggaacttggcagattgactacacttcagtaactggtggtgaaaagatatgcataggtgaccaagaactacaagttgtttttgcacctggtcatacagatggtcatatggggcttctccatgtaaataccaatacattggttgttggagatcattgtgtagggcatggaagtgcaaccttggacagtagaaatggtggcaacatgaaggattactttgaaactacatacaaattcttggagttgtcaccacatgtattaattccaatgcatggaaggattaatctatggcccaagtatatgctttgtggatacctcaggaatcgaagggctagagaagcgtccattctgcagtctatagagaatggggcccaaactctttttgatatagtttcgaagacttacagtgatgttgacaggaagttgtggattcctgcttctttcaatgttcgccttcatgttgatcatctgaactccctacataaattgcccaaggatttctctttggaaatgttcagtcgaagttgtgatgattttatctctagagtttgatggcaagtacgagaaaaggatcttctaattcactgcgttgtgattgcatttaagctgccccgttcaccatttgttgttttattatgtgcatgacactgaacaattcaatgatggggaacgaagtcttgtaataaccgataaatatgtagactggacaccaaggctaccattcacacttccgaaaatttgtaagatttaacaactcgaatatatgcaggacttctcattggagaactttaagcaaaaaaaaaaaaaaaa

SEQ ID NO: 9285 - DNA, 3521 bp, Zea mays
gcggttagattgggacatcaacaccatacaacttaactcgtcggttggattgggacatcaacagaacacaacactcaccaccgacatagagtgcttaaataacaacacaggcagcggcaaccccaaacacaaagcccttccagagtcatcgttaccaagctcaacacaaggtacgagccactccgactttgctagacgggccgcatattgccaaaaaaaacacgaccacgcctacaccaaaacctggcacagaagaaggaagatagtgacgcgccatcgtgccaagcctcgacacacccacactcgatgcaactctgattcttcatcagcaatcttgattcaacacccacctctggttatttgcccgacctccaaaacagtctagaccatgaggaagggggctcacctcatatcatcattgtcgagccatatcccttaacgtggcagcttcgacttcacattgcaaaaaacactatgtccacccttaaactagacgtcgagaagtgaaagcatgaaccgaagataacgtcgaggccaagacgaactgaaagactgagcaatgtgacgccctcaacaggggggagtggcccccacagacgtcaccgtcgccgatgctttcgatcaagatgccctccagcacattgaaaggccaggaccccagatcaaagcaagcagcctccgtcgttgccaccgttctagccaccacgtaaacccctccagaggggcacaatgcgccggctgccgcaaagctgtgtcggctgccatcctctccggctaggcattgccgtgtgcgttaactgccgccgagcgcagcgccgatgccatctctatttaagactactgggaaaagcattacttccacataatgcttgggagattttgctttgtctaattacaatctccatctctttctaggaatcacaagaatgttgctggcttactctgtaattgcttcgaaatcctgactcaccatatattgcagtcgaagttttctaaactaattaatatttcagttattaactgtcaatcatggctatatattttatttgatgaagctatgtgcataacttcatcaactcagtcaccacttcctgacattcttttaatcaaaaaaaattagcccttataaactgtatccatatttgttatgcttgaaaataaaatatgtaaggacttgcattctacctcgggaagacatctgcatgttcattcgttcttctttctagcaaacagagatatgtatttgctttgttgacaagcaaaattaccaggtcccgttatgttacattgtttctgtgctgtcataagtactgcaggcagcaaattctgatcgatcgattgattgaccaagttaactaatgctgtctaacagtatcttgtagcaaaatggttcagatgcctatatctatactgaaccatttacttgaatgcttgagagtataaaaacacatgatcaaatgcagatcagtctccaatcaagaacttataaaagcaattcgtacaaattagcagctggatactgcatgcatggctacatcgcaaaaactaaaacctatccactagaaaagcagtactagctaggaaactaggtgaggtctacgatggttccggcgtgcgcgagcacatcgacgttcctgaagaagcgatccatcattagcaggaggacgtcggtggtgagcaggctgtcggagccggcgcagtgcgcgcggccggcggcgcgcttgacgccgagcgcggtggccacctgctccagccccccgcgcaaggcgcagcatctggcgaggtgcttcacgtcgaacacactgtgtccgaacagccgacggaccagggcgaggaagccgtccagcgtgtccggcagcggctggccgccggtgagcgccttggcgaggtacccgaagtcgtacgagcccgagaaggcggtccaggtgagccacccgcaggcgaggccgctgcggcggaacccggcggcgaagtcttcggggtcgatgccgaactcgttcagcatggcgaagtccatcccctgctcgcggagcatggcgatggaggccggcgcgtgcgggtgaagcgcggggtcgaagccccggatgttgaactgccacgcgatggggaaccggccggcggggcccgacagcgcgatcccgacctgcagcagcttgaggtcgtctacgttccgcttcaccagctcgtagctctcccgcgggccgcgcatgtaccgcggcatgtccgagtcgtgtaccgcgccggggaactcggtgtccaagcaaacgcaggggtagcgcggcagcaccgccgataggttggagagctcttcgtcgaagttgctggcccaaacgtcgcgcacggcggcgttcatcgacgcgccgatggacgtgaagaccaggggtggcgccatgacgtaacggggacggctgcatggcggtggcggcacgtggatgagttccgacttggagtacatcggcattgcttcaggtggctgtgccttgtcgagacgttttgatcttggaacgtgggcgtggtgccctggttttataggtaggggcgttcggacatcacgggcgttcggacatcggcgaagcggaccacctttcgtcaaagtttgcaacagattttatctacagtaacagcggctctgcacagccgacgcgatgagggactgggcgccgtcgatcttcgccacggcgctgttcgcgctcctgtgcccgggcggcgtgctgcaggtgtacccttgccgcatccacatccgccaccgctgcccatccggcacggcaggcacagcgggactggaccctgtgcacctctggccggcgtgtgcagacagtgagaggagagagagagtgtgtgtgtgtgtgtgttccaggatccaaggcggcgtggtcgagctcgcgaggcaggcggcggccgcggcgagggccgagcgaggaggggcgcgtggcgcggccaggccgcccgtgcgtaggtaccgtggcgtgcagaggcggggcgacatgtacgtcgccgagatcatggacgccgagggcatcctcccgctgtgcctcggctcgtacgcgactcccgaggaggcagcgtgcgcgtacgacgccgccgcgagggtcgtgcatggggacaaggccgagcccgacttccccgagccccccgccggcgcgccgccgcccgcccgcgccggggtgctcccgccggtcgggcacgctcgcgtgcgtgcgcctctctacggccaccagcagcagccggcgccggtgggcggcggaggacagcagcgtcaggcattccccgtcccacatttcccggcgcccccgggcgcgttctctcagcttttttaccgtccagctgcaggtccagccgccgccgccggtggaagcaacggcgcaggcttctacggtatggctcccatgatcggccccgggcccgaggtgcccatgcccacctatgcagcgagctcccaactcagcagctctgacaagaaaaacaaggcggctgtccatccctcggcggccaccgagcctaagctgatcatcttcatcgag

SEQ ID NO: 9286 - DNA, 2001 bp, Zea mays
ccgcaaagttgtatcggttgccatcctgtccggctggccactggggtgggaaaagcttacttcccataatgcttgggagaattgctttgtctagttacattctacatctctgtgtgagaatcacaagaatgttgctggcttactctgtaattgctcctgaatcctgacacaccatatattacagtcgaagttttctgaactaattaatatttcagttattaactatcaatcatggctatatatcatttatttgctgaagctacgtgcataacttcaacaactcagtcaccacttcttgacattattttaataaaaaaatagcccttgtgtacagtatctacatttgttatgcttgaaaataaaatatgtatggacatgcattctaccttgggaagatgttcgttcgttcttctttctagcaaacagagatctgtatttgctttgttgacaagcaaaattaccaggtcccgttatgttacattgtttctgtgctgtcataagtactccaggcagcaagctaatcagaataaaccagttattctgatcggatcgattgattgaccaagtaactaatgctgtcggacacagtaccttgtagcaaaatggttcagatcgtgcctagctatactgaaacatttactcgaatgtttgagagtataaaaacacatgatcaaatgcagatcagtctccaatgaagaacttcataaaagcaattcgtacaaattagcagctggacactgcatgcatgactacatcgcaaaaactaaaacctatccactagaaaagcagtactagctaggaaactaggtgaggtctacgatggttccggcgtgcgcgagcacatcgacgttcctgaagaagcgatgcatcattagcaggaggacgtcggtggtgagcaggctgtcggagccggcgcagtgcgcgcggccggcggcgcgcttgacgccgagcgcggtggccacctgctccagccccccgcgcatggcgcagcatctggcgaggtgcttcacgtcgaacacactgtgtccgaacagccgacggaccagggcgaggaagccgtccagcgtgtccggcagtggctggccgccggtgagcgccttggcgaggtacccgaagtcgtaggagcccgagaaggcggtccaggtgagccacccgcaggcgaggccgctgcggcggaacccggcggcgaagtcttcggggtcgatgccgaactcgttcagcatggcgaagtccatcccctgctcgcggagcatggcgatggaggccggcgcgtgcgggtgaagcgcggggtcgaagccccggatgttgaactgccacgcgatggggaaccggccggcggggcccgacagcgcgatcccgacctgcagcagcttgaggtcgtctacgttccgcttcaccagctcgtagctctcgcgcggaccgcgcatgtaccgcggcaagttcgagtcgtgtaccgcgccggggaactcggtgtccacgcacacgcaggggtagcgcggcagcaccgccgataggttggagagctcttcgtcgaagttgctggcccaaacgtcgcgcacggcggcgttcatcgacgcgccgatggacgtgaagaccaggggtggcgccatgacgtaacggggacggctgcatggcggtggcggcacgtggatgagttctgacttggagtacatcggcattgcttcaggtggctgtgccttgtcgagacgttttgatcttggaacgtgggcgtggtgccctggttttataggtaggggcagtcgtacatcacgggcgttcggacatcggcgaagcggaccacctttcgtcaaagtttgcaacagaacgggcggtgcaaggtagggtttgcaacagattttatctacggtaacagaccaggcgcccaggttggttttcttgcgttcctatcacatcggactcagagcacagaacatgcgccttgtcaagtttgcagcaatggcggagatttgatagaaatcatgtgaggctaaacgaaatagc

SEQ ID NO: 9287 - DNA, 2435 bp, Zea mays
ctcctagtccccgtttggttagaagactaatctttagtccctttttttggttttagtctcatttagtccctattttgccaaacataagtactaaagtagatgctaattgattttagtctctagtctctcacataattgctaaaagggactaaagggcaatatttactccaattacctttgcctagaaaactcacgtcatacacaaaaaacaagaaaataggtatttatgtatttatatgttgaatttgatatattcagaatttatttagtccctgcaaccaaacagacaaggaataaagtttaagtctctagaataaacagttctagaactaatggaggccctagataaattatccttctgcagctgcctatcctgtcagtcatgtatcggtatggtttgctttcgctgttaatggcttactagtatgtttatgaagtactgcactccagaagttcaggcatacttccactctcttgatttctccataacagtttcgagcgagttctacatgtaatacgaactttctgatgactgggttaaagagtcgcctgttgtgaccggaacccattatcagagaaggctcatgagctagtagggacatttataagcccagtctatcttaagacatatttcagattagattagattcatattttagattagattcatatttcagattagattatattcatattttagattagattagaatcctttttagattcatatttcagattagactaaattcctttttagattcatatgtttcaggttagatctctttagagaacggtaaaaccagttcttctggtcgatcaccaaataaccaatgctaccacacagtaccttgtagcaagaattgttcagatcgtgcctatactgaaccagttactcgaatccttgagagttcaggttaatcatcgattcatcggtataaaaacacataatcaaatgcagatcactctccattctccaatcaattaatcaagaacttcctcaaatcaactcgtacaaattagaagatagacactgcatggctgcagtgcaaactacactaaacctttacaaaagaaaagcagtactgggaaataggtgaggtctacgatggttccggcgtgcgcgagcacatcgacgttcctgaagaagcgatgcagcattagcaggaggacgtcggtggtgagcaggctgtcggagccggcgcagtgcgcgcggccggcggcgcgcttgacgccgagcgcggtggccacctgctccagccccccgcgcatggcgcagcatctggcgaggtgcttcacgtcgaacacactgtgcccgaacagccgacggaccagggcgaggaagacgtccagcgtgtccggcagcggctggccgccggtgagcgccttggcgaggtaggcgaagtcgtaggagcccgagaaagcggtccaggtgagccgcccgcaggcgaggccgctgcggcggaacccggcggcgaagtctttcgggtcgatgccgaactcgttcagcatggcgaagtccatcccctgctcgcggagcatggcaatggaggctggcgcgtgcgggtgaagcgcgggatcaaagccccggatgttgaactgccacgcgacggggaatcagccggtagggcccgacagcgcgatcccgacctggagcagcttgaggtcgtccacgttacgcttcaccagctcgtagctctcgcgcgggccgcgcatgtaccgcggcatgtccgagtcgtgaaccgcgccggggaactcggtgtccacgcacacgcaggggtagcgcggcagaaccgccgataggttggagagctcttcgtcgaagttgctggcccacacgtcgcgcacggcggccttcaacaacgcgccgttgggcatgaagaccagcaggggccgcgccatgacgtaacagggacgggggacgaatctgcatggcggcggcggcggcgcgcggaccgactgggagtacatcgccattgctaccggtggccgtgtatattagcgagacgttttgatcatggaacgtgggcgtggtgccctggttttatagggtggcacggcagcgaagcggactagaatattccagcccggccgcaaacagactttgtgtaaaatcgttcttatccaatcgcaagttatccaaggataacagtgttttcttagaaataaaataaaatctgttttccagctcgtacaaagttaaattctgttgcatagaagaaacctagacgttgtagatctaaatctaaattctagatcatgcccggcgtaaactactcctttaggacagttatgaaaaccctttcaaatcaaatatctacaagttttcgaaaaaagattatttttttttttaaaactttcaagtgcgatgacaaatttatgattacatcaaatattttttttctctccaaaagtcataatcataaaaaactaaagag

SEQ ID NO: 9288 - DNA, 4342 bp, Zea mays
  misc_feature (143)..(143): n is a, c, g, or t
  misc_feature (843)..(843): n is a, c, g, or t
  misc_feature (1914)..(1914): n is a, c, g, or t
  misc_feature (2839)..(2839): n is a, c, g, or t
ggcggacggtgtgggcgacgcgaggccctagcgccatcattactacctttgtgccacgtctacctttggcttcagtagcctaggtctcggcgtggctcgtcgcgttgcgggctctgtagatggactacgcgcttaggcctagnctcgatatgccatgagtgagttgtaggccgaggggcttcgcatgtcatgagtgggaggcagatcgaccctctactgtagcttggtgccaggcgtaattaatgtggacgaccacttatggcgggccagccttgggctagacgacgaatccactcgagtggcttccctccggttcgcctgagtcccctctctagctacgccacgctcgacctcaggctcggtgcctcagggtttatccaggggcaggcgcttccaggggcacggttcccttactccctcgttgaccgatggtccccagtagtccggtccttatcccatgcactctctgaccggtgggccccaggggtacggtccggcgatcttttccactacaaaaggcttgccacgctctagaagcactcgctacaatgtcatgatctgatgtgttattttagttttgcttaatcatgttgtttttgcattggtgttgtttgataggttatacatgttagtatgagagttccttatgatttatgttcataaaattgcttattttctcaacaccaggtgagatttacgttaaactagcaactagtttatcgtagaataataataattcttgtttttaagaaattacatgtaaatatttatggcatataataagtatattagaataatcattagatgtgtttttataagaatattttactgcacaagtaaccnttaaacaattaaactttaaaaaccagacttagtttagatgtatagggttacacccttctggaacatagagtgaggatcactagcttctaaaagtcaaactaaggtcatggtactgcaatttcacttttctatgaacaacaatgttggttgcaggtgatgctagagccgtttagatcctatttagcaaattaacttcacatgtcatagaaaatagctcttaaacattgaaatgactattatatactcctttttcctcctttatttctctctatccttcaaacgattcatgaagccgacagagaagctgtataaaactgatttgagaatgagatccgagagttgaggccctgccgcatatgcaatgcaaggccgtcttcaggagcttatctcatctctgtctcattctatattttaaaaatctatttataaataatattaaacattatcatctttgtatcctctattttatagggtccaccaaaagtttgcttttggggaactacagtcttcacttggaagcttgagggaagcgcatctgatgcccctggtccttgtcagcatttggctagtagcacgctgttcaagtgggaacatgcacatgcgatgtccccgtggctagtggccagccttcgcaggacggagctctgaactgaagacgactcatgcctacagacgaccgatagtaatccactaatccgtgactaatcacaaataccagtagtaattacaatcggtgcaataaaattgagaccgtcttacgatcctcttctcagtctttcctagcttacataaggagacgtcacccctcctcagagcacatattctcacaagtcctgcttaacactttaggagacgtttcatttctcactcaaagctttctgctatacttgagaagtgcatctttcattactagggccttaagcgtatggacatggtaagagcaggtatttatgatttagctgaagatcctgctcgacatagtcaacttttttgtaatttagccttttttaggtttaattttcacaaatatgtatgttattttcagttttattttgaaaaatagacccttangtcggcgtcaatagcattagcacttagctaacactagtcgacgccgatgctattgacgcctaggtctcggatgcggtcgaggacgtggtggtggcgtggcgcctatgtggtaggggatagacgccaaggtctatgtcgcgaccttggcgtcatagatctcgacgtcaacctttgtattcctatataatacggcgtcagttttatctcctccatctcaattttctcctcttcactgcgacaaacatcttttattggtggcaaggtaatttcacttggaccaacattcctatataatatggatttgatggatttagagtttttgtgtaactttttttttttttgagcgaagcgccggagagcgtgactgcgtgaggacattcatgggagctggataggcatgccatcattcaaatcagatctagaacggcagtccttatggacgtcacacgccagatgtgaagtgaacctccggaacgtcatacccatacgacaagacaaggcacgcgtatgggctgggcaccggccgtgttgcatgaacagcaatcctgaagcaacacctcgcgtaccgcggacaccgactcgcggaccaacagtatcgctgaaagcaaaacgatgggacaggaggttcttgtgtgttgctcgacttgactgactgagagaaagtgatattgagcctgtaaaatgaaatctcatacgagcaattgaatagctgcagaaaaacaaaagaacttcagcaaatttcagctaactgcatccaggagagacgtttggtgagcatagcttctgctagttaacctcccatcgcgacatccacaaattcttctggctttgtggtttgattcttcagcaaaagtcgcccatgccaccaatcaatctcctcccaaacgttagtacagtgaaacacgcacccgccgaccgccgtgcnctccttgccgagccacgatagcccccaactaatcccaccgcaaaaaggcgccgtttccgggcgcggccgcttcgggaccccgttctcgtgccggcttctcaatcaacccaaccattccaccgattccctcgtcgacagccgtagtgtgctcggtgcccgatgccatgctttccgtccgtagtctgtaccactaccgtagtaccgtgcgcgtcttaagcatccgtgcacctggcccagtgactgcctgcctttgccttccactggttcgcttctccctctcctgtgcttggctgctgcttgcccgttgagcacagcagggaggcgatgagggactgggcgccgtcgatcatcgccacggcgctgttcgcgctcctgtgcccgggcggcgtgctgcagatgcccggccggcaccgccccgtcgacctcatgaacatgaagaccagcttcccgtccatgctcgtccacgccgtcatctacttcctgctgctcatgctcttcctcgtcatcctgcagcctcacctctacatctgacgtgagcgtgttccccaccccttcacacaagcttctagcatgtttcagtttcttctttcttgggatgcagttttgggcccttttaatagctttgtaaccttatgaaccagaggattatatacgtaatatgcgatccgtagcttccgttgggcaataaagaactgaagtttccctgcttcctaaaaaaaaaaaaaaagcttccgagtttcaggcggcttcagtgtgtcagtttatctggacacaaaaaaaaaaaaaacccgccgcccccggcgccatgacgtgcatggtttaaaaaaaaacagtaacagaacatagcacagcgtggattttcagtgtttttttttttttttttgcagcaacaatttgaaattcatagagtgactagtgcaaatatgtgcatcttttacaacgtgtttggttgtagggttgagtacgttcagcatacactcgtcatacttgtctggcgaaattggaggaaccgacccaacctgcagatttggtatgttgctgaacgtgtttgtgacggacgagttggctccactacgttaaccaaacagttccagcagcttcggtgtttgaatcggattatttcagaccggtcatcttgcaaaccaaacacgctattagtgttctgatatctgttcctatctaatcgcatatagcactccccataactaagaaggaaaccagctatcagtagcagtacttcatgagcttgcagatctgtaggcagaaaagaggggaagaaaacttagaccagaagcagaatcatcctttgttaatggtttagtcatgctgtccagtgacattctcctgtagtgtagtgatacaagctgggcagtttatctgccagcctttcacttcacactaaaaaaaaagagtccagttgcaactagagaaagtaaggtgctaacagctgaaactgaaagtaaggtgcaacaatagatcggatttattgtttgggttgtttgg

SEQ ID NO: 9289 - DNA, 706 bp, Zea mays
gggaccctcgaggccggccgggggttaaacggccaatcaggagtccaaaggccacatgtatcagagcacgtccgtcgccccctggaccacgcagccggcagcccagagccggagagcccagtgaaacagagccggtgaacgcagcccagtcagtgagccccccgatcccgactccggcgatctccccaaccccatggcctccgccggcgaggcccccagcacgctcctccgcttcctctacttcgtcggcgccggagtaatctgcaccaaggccatcaacacctatcgcgactacgagcacaagaaggagtccaccgccgccctcgccgccgccgaatcggcgttggctgctgccgcggcggccgagcccgctcctgcaaccgccgccgcgaagccctgattgtggacgagggcctgtcttcggcggttagggttctcggaatgttgctctccataggggagatagatattttcttttgtttctgatgtttcagctacgtgtatgtgctcttttggcttgaatcaatcagtaataatacttctcttcctgtctcgtgatcatggtactgctggcttgaaatttgttactacatagtttccctatgatgattaatgttattgcacttctgttagctaattatcaaaaaaaaaagtgctttgccttgtattaattctgcgaggaaagaaccacaaaaaaaaaaaaaaa

SEQ ID NO: 9290 - DNA, 628 bp, Zea mays
ttccgggagtccaaaggccacatgtaccagatgacgtccgtcgccccctcgaccacgcagccggccgcccagagccggagaccccagtgaaacagagccggtgaacgcagcccagtcagtgagccccccgatcccgactccggcgatctccccaaccccatggccgccgccggcgaggcccccagcacgctcctccgcttcctctacttcgtcggcgccggagtaatctgcaccaaggccatcaacacctatcgcgactacgagcacaagaaggagtccaccgccgccctcgccgccgccgaatcggcgttggctgctgccgcggcggccgagcccgctcctgcaaccgccgccgcgaagccctgattgtggacgagggcctgtcttcggcggttagggttctcgggatgttgctctccagaggggagatagatattttcttttgtttctgatgtttcagctacgtgtatgtgctcttttggcttgaatcaatcagtaataatacttcttttcctgtctcgtgatcatggtactgccggcttgaaatttgttactacatagtttccctatgatgattaatgttattgcacttccgttagcaaaaaaaaaaaaaaaggccccgccggcc

SEQ ID NO: 9291 - DNA, 1667 bp, Zea mays
  misc_feature (787)..(788): n is a, c, g, or t
  misc_feature (790)..(790): n is a, c, g, or t
  misc_feature (800)..(801): n is a, c, g, or t
  misc_feature (940)..(940): n is a, c, g, or t
aaaaaacagatagatagagtagtagtaggttgttagctgaggggaggcatcgatggctggagccaagagaggaatcctgctcgtcctgtgcctggccgtcgtcttggtggcgctcgggagtggcggcgtggaggcgaggaagcgagggaagcagtccctggggttctacgagctgcgtcggggcgagttctccatggtcgtcaccaactggggcgccaccatcctctccgtcaggctccccgataagaacgggcacatcgacgacgtcgttcttggctacaagaacatcggatcgtacgtgaacgacacgacctacttcggcgcgctggtggggcgcgtggcgaaccgcatcgccggcgggcggttcaccatcagggaccacgcctaccacacgtatcggaacgacggcaacaacacgctccacggcggccaccgcgggttcaaccaggtgttctggtccgtccgggagcgcgtcacgggggagttcccgcacatcaccttcgcctaccgcagctacgacggcgagcaagggttcccgggcaacctggacgtgctggtcacctacaagatcgacggcgactgctcgtacagcgtcaccatgtacgcgcggccgctggacaagcccacccccgtgaacctggcgcagcacacgtactggaacctccgcggccacggcaacggcaccgtcctgcgccacgccgtccagatcttcgcgtccgcggtcacgcccgtgggccgcggcctcatcccgacgggcgcggtcacccccgtcgccggcactccgttnnanttccgcgccnngtcggcgcccggcgcgcacatcgccgaggtcgagggtgggtacgacatcaactacgtgctggacggcgagacggacgggcaaggcgtgcgcaaggtggccgtggtcagcgaggcggactccgggcgcgtcatggagctntgggccgaccagccgggcctgcagttctacactggcaacatgcttaagggcgacgagggcaagggcggcgccgtctaccccaaatacgctgggatgtgcctggagacgcaagactacccggacgccgtgcacgagccggccttcccggccgaggtgtaccgccctggccaactctacaagcactacatgctctacaagttctcaatcagcaagtaggaacttctagtacctctcgtgcctgatgcctcatagtttcggtaggtttgcaacctgttgcgactagtaataagggttctgagtctttttttttagaaaaaattgcaacagaaatgtatggttcgagttcgtccaaactttgtctagtcaacattttctgccatttgaatgccatcttaatagtctaaaaaaaaaacaaaaaaaaaaaaaaaattcgtcgtgattacatggttacaccaaaaacaaaaggaattggcgagatttcaagcagtttttttgtgtgcgatttatatacaaggaaagcacggcaatcaacttggatggaagttccatgactaatactccacttgaccttgagatttaaataaaggttaagaaacaatacagaaacacatgtcctccaaccaatttaattcgcatatgcataaacactgccaacgaacccaaatatctactctgtaaaagaatgatcacagtttttacactggactactcccttatagtggcggat

SEQ ID NO: 9292 - DNA, 1051 bp, Zea mays
cattggtaccctcgaggccggcgccccaaacccagggcagagtcgcagggtgacggggagagcccatcatggcgccgcagcagccgtgaagcacaagagcttttctgcagcacgacggctttgtcctctctcctttaaagcggactgctctcctcaattgtcagtcagtagcatccaattgattgttctatcctcttctctgttctcacccccttgcaagcaacaatcgttcaccgatcgatccagtgcgtcctgcatggaaactgccgccgtcgccgccgccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgtcgagaggcacgccaacgcggtctcggcggcggcggtcgacaaggccaagcgcgtctgcgcggaccacccgcacgtcaaggtggagacgatggtggagagcggggacccgcgggacgtcatctgcgacgcagccaacaagatggccgcggacctgctcgtcatgggcagccatggttacggcttcatccagagggcgttcttgggcagcgtcagcaaccactgcgcgcagaactgcaaatgcccggtcctcattgtcaagaggcccaaggagtagaaggttcctcgcatgtaacgctgcagcttagccaataatgtttcatggcgaccatataggcatatatgtacacacttcacatcccattgcatggcagtgtcttccctagttcaacaactagctttctgctggaataaggtgttcagagttcagacagagtatgtactgtacatactatcttcttgcatttggtactcttgtttagtgaaaagcgttccgtaaccttcggttgcatacatgtgactttctcctgccgcgtttagcttatcttaaaaaaaaaaaaaaaaaaaactcact

SEQ ID NO: 9293 - DNA, 941 bp, Zea mays
acccagggcagagtcgcagggtgacggggagagcccatcatggcgccgcagcagccgtgaagcacaagagcttttctgcagcacgacggctttgtcctctctcctttaaagcggactgctctccccaattgtcagtcagtagcatccaattgattgttctatcctcttctctgttctcacccccttgcaagcaacaatcgttcaccgatcgatccagtgcgtcctgcatggaaactgccgccgtcgccgccgccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgtcgagaggcacgccaacgcggtctcggcggcggcggtcgacaaggccaagcgcgtctgcgcggaccacccgcacgtcaaggtggagacgatggtggagagcggggacccgcgggacgtcatctgcgacgccgccaacaagatggccgcggacctgctcgtcatgggcagccatggttacggcttcatccagagggcgttcttgggcagcgtcagcaaccactgcgcgcagaactgcaaatgcccggtcctcattgtcaagaggcccaaggagtagaaaggctcctcgcatgtacgctgcagcttagccaataatgtttcatgggcgaccatataggcatatatgtacacacttcacatcccattgcatggcagtgtcttcccttccctagttcaacaactagctttctgctggaataaggtgttcagacaaatcttcttgcatttggtactcttgtttagagagaagcgttccgtaaaaaaaaaaaaaaaa

SEQ ID NO: 9294 - DNA, 1522 bp, Zea mays
  misc_feature (105)..(105): n is a, c, g, or t
  misc_feature (122)..(122): n is a, c, g, or t
tctagttctaaaccatgccagagggaggtaagcagcgaaagcaaatcccaccactttattattggcaggcactctcaataagcgaatttccaggccctcctactntgcagctttcccaccgncggcctcattctggctggccttgtatttgtcaagcgctgcgccggcgagccggcagatgcgccactgcgggagcacatcggcgcccatcccctcgtagaagtcgatggcgttcttgttccagtcgagcacgcaccactccacccggcccatcccgagctcggcggccctgccggcgacggcagacagcatcatccggccaaggccgcggcggcgccagggtgcgcgcacgaagatgtcctcaacgtacagcccgggcttggagaggaaggtggagtagttggggaagcagatcacgaacccggccgtgacgcgcccgccgccgcgcggggaggcgaaggtggcggcctccgggtctgcgagcggggacgcggagaggtcgaggcggcgggaggcgatggtggaagaggagtccgggaggatgggggtgggggataggtcaaggacgagggctgtgaaggaggtgaagggaggcggcgtcggcgatgggaagagcgtggacgtgaggagctcttcggtggcggcgaagaggtcggtgagcagctcgaactcggccatatggtgtatgaggcggtggatgtgcggcacgtcgcgggcgtcggccaggcggagctccgcccacacgtcgccggagaaggtggtggagttggccggcgccgccatctggataaggaagatgggaacggaggatcgttgatgccggatacgtgacggtgtgacccgcccgcccggttcggcacgaggcaacaatcgttcaccgatcgatccagtgcgtcctgcatggaaactgccgccgtcgccgccgccggtgccgggcgccgcatcatggtggccgtggacgggcgcggggtgagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgtcgagaggcacgccaacgcggtctcggcggcggcggtcgacaaggccaagcgcgtctgcgccgaccacccgcacgtcaaggtggagacgatggtggagagcggggacccgcgggacgtcatctgcgacgccgccaacaagatggccgcggacctgctcgtcatgggcagccatggttacggcttcatccagaggtgagctgatactgacactgatcatacttgctactagtcgctttctctcttgtccaaaaaaccaacaacatatcgtttttttgttgagtgcgtctgtcgagggcgacaagtgcttcagatcttttttttttcttggcctgcaattatccctgtgaggcagcaatctactcactcgtttaccttcgtttcaaatgaacattgctgca

SEQ ID NO: 9295 - DNA, 1805 bp, Zea mays
aattcggcacgaggccgtgccgccggcgggggcagcggcggcggcggcgcaggcgggtgccgaggagatcgtgctgcagcccatcaaggagatctccggcaccgtcaagctgccggggtccaagtcgctttccaaccggatcctcctgctcgccgccctgtccgaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggatgctaaagaggaagtgcagctcttcttggggaatgctggaactgcaatgcggccattgacagcagctgttactgctgctggtggaaatgcaacttacgtgcttgatggagtaccaagaatgagggagagacccattggcgacttggttgtcggattgaagcagcttggtgcagatgttgattgtttccttggcactgactgcccacctgttcgtgtcaatggaatcggagggctacctggtggcaaggtcaagctgtctggctccatcagcagtcagtacttgagtgccttgctgatggctgctcctttggctcttggggatgtggagattgaaatcattgataaattaatctccattccctacgtcgaaatgacattgagattgatggagcgttttggtgtgaaagcagagcattctgatagctgggacagattctacattaagggaggtcaaaaatacaagtcccctaaaaatgcctatgttgaaggtgatgcctcaagcgcaagctatttcttggctggtgctgcaattactggagggactgtgactgtggaaggttgtggcaccaccagtttgcagggtgatgtgaagtttgctgaggtactggagatgatgggagcgaaggttacatggaccgagactagcgtaactgttactggcccaccgcgggagccatttgggaggaaacacctcaaggcgattgatgtcaacatgaacaagatgcctgatgtcgccatgactcttgctgtggttgccctctttgccgatggcccgacagccatcagagacgtggcttcctggagagtaaaggagaccgagaggatggttgcgatccggacggagctaaccaagctgggagcatctgttgaggaagggccggactactgcatcatcacgccgccggagaagctgaacgtgacggcgatcgacacgtacgacgaccacaggatggccatggccttctcccttgccgcctgtgccgaggtccccgtgaccatccgggaccctgggtgcacccggaagaccttccccgactacttcgatgtgctgagcactttcgtcaagaattaataaagcgtgcgatactaccacgcagcttgattgaagtgataggcttgtgctgaggaaatacatttcttttgttctgttttttctctttcacgggattaagttttgagtctgtaacgttagttgtttgtagcaagtttctatttcggatcttaagtttgtgcactgtaagccaaatttcatttcaagagtggttcgttggaataataagaataataaattacgtttcaaaaaaaaaaaaaaaaacagccacgatctaggcgatggcattagacattcatcatcaacaacaataaaaccttttagcctcaaacaataatagtgaagttattttttagtcctaaacaagttgcattaggatatagttaaaacacaaaagaagctaaagttagggtttagacatgtggatattgttttccat

SEQ ID NO: 9296 - DNA, 857 bp, Zea mays
cctcgagccggccggcggcgcgaaccattaatacgcaccaatcgccgccgcccgagccgcggagctctccactcctctcttacccttcctctcccaacccacgcagcctcactagggtttagcggcggcggcgagatggtgcagcgcctcacgtaccggaagcgtcacagctacgctacgaagtccaaccagacccgagtcgtcaagaccccaggcgggaagcttgtgtaccagtacaccaagaagagggcgagcgggcccaagtgccccgtcaccgggaagaaaatccaggggatccctcacttgaggcctgctgagtacaaaaggtccaggttgcctaggagccgcaggactgtgaaccgtccttatggtggagtactctctggaattgctgttagggagagaatcattcgtgccttcttggtcgaggagcagaagattgtcaagaaggtcctgaaaatacaaaaaaccaaggacaagacagccgcaaagtaaatctccaggaatggggaagcctagccctgttttgtacactgcgaaaagtaattttggtggatggaaaatctaggtgccttgttgagcatttagcatgtgtgagtttagagagtctggacactgaatccaccctttcacctttgaattgttggaatatcgggaatctgttcccctagttgcttttattatgaattcagatccaatctgggtaagatcaaccttctggtttgtaacatcttttgtccatgttgctcgttgttgctcttgatgctcattcatatctatgcaaagatcaatataaaggcgtcgcggaggtgtattacctaatttacaagaaaaaaaaaaaaaagggcccctagggc

SEQ ID NO: 9297 - DNA, 7008 bp, Zea mays
  misc_feature (135)..(135): n is a, c, g, or t
  misc_feature (1050)..(1050): n is a, c, g, or t
  misc_feature (1433)..(1433): n is a, c, g, or t
  misc_feature (3344)..(3344): n is a, c, g, or t
tggtcgggggccgggccggggccgactgggtttttctgctcctccttcctctacctcggtgccacacggtgaaagggagcagttgcgggggaggagaggaggaagagagcggagaacaaggagacacacacgganggagcaaaaacctcttagagcagttgtcgcgtgagcgtcgtgtggagagcaggagaggagatagcaacgcacgacgctgatagggagcccaccggagcggcatggtggttgaggtcgtggaagctccatagcatcacggggatccgtgcgcggatcagacgtgggggcgaggaccggagatggtggtggatcaggagcagggccggccctgagggtgtgcagagtatgcgaccgctcagggccctcaagatctatagggcccccgtttatcgatcttatatccaaatacatataagttacagataaatctctattctcatttttttgttgcatctctttgattttctggcaatcgtctctttgaggtcgtgcaacagtctgcttgataactaatactaaaattgacgtgggaaggacgaaaggtattgtacacttgtggctgtcgcgttgcttaattctagcctaccggagggccgaccctaataacctacatttcttaatcctagtttagtttgttgaactttgttttcagaaaatttgctctaatgtatttagatttggtttactgtgcattttaaggtttaggctagtttgacaaattaaaagtaaaaatactctctcaaaagtcaaaataaatgcagagttatattacataatttgtataattttacgacttataaaatattgtaacaatgtctctagtcataccattttgaataaaattgtgtaaatcatcaactttttttatttttcagatattatttaaaagttgaaaaataataaactcaaattttcttatagggcctccatgtaaattttcgcttagggccccaaaacgtgaggactggccctgatcaggagcgggggcacatagacggacggcttagatttgatggatgtagatggatggtgtanatttgtggatggcagaaccagtggaggcagcctactccttgctgccttaatatagtagtatagatttcagtacggacctttgctaccgttacttttcaaaaaaaaagtttcataaaactatattaaatacacttatgtagcaaaatataaatagagaccataaaaaaaatttttgatgtgcgctatttcaatatatatgagaataaattagactgggacatcaaaccactagccgaaccgcacgccacccggcctccggccaccgtgcccgcctccatgcgcgtggcttgctctgccgcccgggcaacacgccaacacccactaggcgaacccaccgcgccgcatgaacgcccgtgttctggtggcacggccacgacaccacncgacaaacgcaggcgcgccggctactaactgctgcatgggctcaatacaggccaacagggacgtactggtacggctaggtaggtacgccatcggcatcgtgacatcgtcgatgggttgggcaaacaggggcagcaatgaattctcgcacgtgcgcgcaccatgacatcaatgcgcgacgtagggcacgggtctgctagcatttgctgccgtgggtatatcatcacgagccattatctttattttaattggtacgactactatatactacgtactagtctaactagctaaggtcctatttgaaagcaatctagtttttaaagaatgggtgagctctcgatatgtcctataagacactgtgatatgtcaggctcgggagagctctcgattttgggtgtcacactagggtctgactacgagggttggcccgagatggcctatctaggagcttggtccaggcaaccaaacaactcatgggggttgctgggtttgtcctagctggggttagatcacccaaccaatcaattccaaagtgctgctcaagtagatggtatgtttggctgactaaaactcattccatcatcttatgagggtgtttggttctagtgactaaagtttccgtgttacatcgaatgtttgaatgttaattatgaatactatatatagtttaattacaaaaataattacataaataaagactagacgacgatacaaatttattaagtgtaattcatgattaataaatattattacagcatcacatggactaatcatggcttaattacgtttaatatgtttgtcttgtcgttcattccttatctgtataattaattttataattataatttaatatttctacctaaatatccgattgcgataggaactaaaatccagcctgagaacgaaacggcccgtaaaacagtccatgcagcccagcaagcagtttagacgaatcgaccggacgaaaaggcccagtccgatcaaccgccaaatcaagcatcaatcctagccgtctgttacctcttcagagccaaccattaatacgccccaatcgccgccgccagagccgcggagctctccactcctctcttacccttcctctccccacccacgaagcctcactagggtttagcggcggcggcgagatggtgcagcgcctcacgtaccggaagcgtcacagctacgctacgaagtccaaccagacccgagtcgtcaagaccccaggttcgccccgtctgttcattcctgctcgatatgggaggggtctttggtttctttatctgtgttgtgttcttggttgtattaattggttcgctggattcttgcaggcgggaagcttgtgtaccagtacaccaagaagagggcgagcgggcccaagtgccccgtcaccgggaagaaaatccagggggtgagtgattgattgttagcgcagctctactcttcttctgtctcggttgtgtgattcgttggtccttggtaccgaggtggggaactggtagcgtgtttgtgctatccatattgaagtaacagattgaagtaattggtgtgaattagtagatcttaattagaagggcaagcctggtccagttgtaagaactgtctgagtcaccagcgggtttgaacccttgcttcggtttatcccttccccagatcgcacatgagttgagcctccggccctccctttattttagtagattttaattgattgcttacatggtttactgtgttttgccctgtgatgccacattgtgcttgtataggtctattggacgatgtctgtagttaaatgggcctttatatctagctctcgtctaaattttttccttgcgtaaatggctgtgtcatgtgaaattgaagtacttggtacctacatttgggggaacatattactgttactgcatgttattttgctntttacaaatagtgttctttcttaccacatactccctccgtcccaaattaaaatttgatttaggattttaatagattcatacaatagctaagttgatttgcccgttttccctgttgagtaaatactattgtcatgtcattttcttcagaatcacttcctaggacttctgtttgtttgaggttgaagttttaattagttctatcattctgtgttatcttttcttctcttttatgtaaagcaccagtttccaccatcatcgtgctcctccgcatttaaatggtaaaatactaaaattatgcataaatggtgatttgaaccatggttgttggctccaaacccacaaccacacccgcctagccaacaaaacacacatgtctttctttgtgtctttgtgttttatattctataatcaacataaaagggaactgtagcaatatacgtgcattttgctattttttttcttctatgtgtgcttgcactatttatttggttgtttccatggcataatattctccatagtaatcatcatctggtaatttccctccctacctgaacaatgccctcagtgtcaccaaaactgggtattcatctgtcattggatatttccacctaatattgtttaatgctattgtttccatatttccagatccctcacttgaggcctgctgagtacaaaaggtccaggttgcctaggagccgcaggactgtgccccgtcaccgggaagaaaatccaggggatccctcacttgaggcctgctgagtacaaaaggtccaggttgcctaggagccgcaggactgtgaaccgtccttatggtggagtactctctggaattgctgttagggagagaatcattcgtgctttcttggtcgaggagcagaagattgtcaagaaggtcctgaaaatacaaaaaaccaaggacaagacagctgcaaagtaaatctccaggaatggggaagcctagccctgttttgtacactgcgaaaattaattttggtggatggaaaatctaggtgccttgttgagcatttagcatgtgagtttagagattctggacactgaatccctttcacctttgaattgttggaatatcgggaatctgttcccctagttgcttttattatgaattcagatcctatctatgcaaagatcaaccttctggtttgtaacatcttttgtccatgttgctcgttgttgctcttgatgcccattcatatctatgcaagcagtgtggccgtgtattatttattttgtcgatttatcataatcataaagttctcaaacatgcgcacaattttatccaggctgtgtacgtggctcccgtagccaaaactgaagaattcgcctaacagaaatgctaacggagggcgtatttggttcatcgattgtagttcaatgggaggtaccagtccaaaatgtagtttaatgcagactggccccagtgttttgacgcaataaagtattcaaacttgcactgaagtattcaaagagctgaatagtgtacgtacaacacaaggttccttctctctgttagctttgctgttaacaatgctacatagctcgtggtatgtacatggcattcctaaccaaaactgaaccaaaaaaaaatgtttctgcagctaacagaaatgctaacagatgaaggaaactcacactcacagcacctgtagactgtacatgtaaacctatgagatactctccgtaatgcaatgcaattgctaaatgccgctgccctgccctagtgtggcagcagctcagcctggacagcagccggggtcagcaaggactcccagggtatgttgcacctccactcctctgaagaatctgcacccagatcaaaagggaagctgaccctccccgcagtttcccagtcaccgctgctggtgctgaagccattattgctgggcttcctggtggacgagtcctggctcctgccaccgacgatgccgccattgacatcggcagaagagtcgacaacgaacccaccgaggtgatgatcaggatgcgcgccgaagaagactggcgcggcggctgcagtcttgtgcgtcccttgcacttcaaaggggaaggtgactgggaagctcaagctctggggtcgtccctcctcggatgggctgctgctggtgaagttgatgagcttgcatgaggaggagccgtccagagacgggctgttggtacccttcttctgctggtgctggccatgaacatgcaagccatgcctgctgctgaactggcctgctgcaggcgcagccggtgcaacctgcagtgagctctcgagagcgaattctgaagcctgcactgactgcaacgcgttgatcatatcatctgcctctgttgcccccagcagtgggggcccccaggtgtgcgacagcgctcgttgcgccagcgaactggttttcttgaagatcctacagatagtccacgagtcctgcttgcgccaaaaaccacgtttggaatctagctcttggactgtacagtaatgtgaaattgcctgcagacgctagctacttacattgagtggaatggtcttgtcgatcggacgcttggggagcgagggatcggcgagcgaagggagcctgaactcgtgcatcatccagtcggtcttcatccctctcgccgctctccctttgtagaacacgagggacttcttcaggcccacgcacttggtgccctcggaggagtagatcggcctgtctgtccctgtggccttccagaaaccggctgccgtcactctgtttggtcttacgctgttgcggtatttccgatcccttgggcagtagaagtaccactccttctcaccggtgctcgcaagctctgttgatgaatgaacaagaacaaaccgtaaacttcaagaaagaaggtctgagcagtacgagttctgaaagaaggtgtggcgtcttcttacttgggagatcccacgggtcgtacttgtatatgtccagctgcctgatcagctcgatggagataggcttttgctggaccttcctcttgaggtagaaactgaccagctcttcgtcggtgggatgaaaccggaaacccggcatcaggatctcatctgacttctccatgttggtgccattcctctcctccataccttgcaaactaaagcgatgaagcccctgcttgctcctggttacaaacttacaaggtatcttgtgaatggctttctgggatgaagctgctgaggtgaagacaacacccaagaactgtatactactgcacttgcaaatctattacacaccttgtgtttatatatgaaggccagaggtgcttgatgaggcccaccagcctgaagattaaacaattgtatgtacttccttctctatttgaagctgtcatggtttatttaaatggcggatcagtgactcaataaggacaatctaggagagataagactgtctccgtccctttcggttcacacttacaccacccaggtacggcagtcaaaacaatccttaaactaagcagcagtgcttcatataccagtttgagcctccccaggtaaacaaaacagcctgaaaaatacgcccaacttttactttgatctgcatgaacttcaagatatgttcctccagggttctggatccaaaaatcccttcccatgtagctttatgcattgcttttgtcagtttgtgctttggggttctaatatgatttgtggccgcta

SEQ ID NO: 9298 - DNA, 8914 bp, Zea mays
  misc_feature (1261)..(1261): n is a, c, g, or t
  misc_feature (1438)..(1438): n is a, c, g, or t
  misc_feature (2152)..(2152): n is a, c, g, or t
  misc_feature (4069)..(4069): n is a, c, g, or t
  misc_feature (8150)..(8150): n is a, c, g, or t
  misc_feature (8691)..(8692): n is a, c, g, or t
cctgctggactgatgaatagtgtgctagactccgcaaaatacggatccggagccgcatgcggagtgctgctggagttggtcttagtggcgcagataattcacgtttgctgtcacggatatgtataggtgtatttttttccttttttgtgtaaaaaaacggcaagctgatattggtgggcttgctatctctggcgccgggcaaagaaaaaccacagaacgccctcaggcctagattttggtgggcttgctgacagtcgctgttattagatctgggcctcaggtctagattttggtgggcttgttggcagccgctgttattatatctgacggtggagatgaaaaaggtgacatggcttcatatgcgttcagatttgctcccgtaaataaaaatctgataacatcttaattgaaccgcacgcggcaatcaaccaggcaagaacctagcaattggcataaccctggcctccatttttctgagagagtgaattgagtgttttttttatataaacgtgcgccttgtgctgtgcattagaaaaacggattaggttccagcgtcgtgtacgaatagattagggcaataaaaaacgttggatcatatcaaatcttatcaaatcgaacctcaacagggagcgtcgttttggctagaagctggaccctaggcagcttcagagctggtatcgcagaaagctgacccgtgccacccttcgcttatcaattcatcgatgtgccatttatattcgatggtgttccgcaaacttctagctatgcagtacatttatctatgtacgctatcagaatatcgaacacatgacagagctcggcgtcgtggtctatgacgccaagctctagccacatgagcgccagcaaggcctgcgtatgccaacgaggccagtacctcagcgtcattgatcaaggcaccgagcattgttatctcggcgccacagcttatggcgccgagcaaaaggtaaaaaacgacattaagctgttcagagatcaaacgtgacttttttttaaaaaaaaagagtaaattgcaaaatgttcggtcggaccaacagccacatcgagccaatgaatctagccgtccgctccctgttgcctcccaagccaaccatatccactctcggcgccgccgcgcatctctcccctcttcttgcccttccttccccccaggccccaacccacgcagcctcactaggggtctaccggcggcggcgacgagatggtgcagcgcctcacctaccgaaagcgtcacagctacgcnacaaaatccaatcagacccgggtcgtgaagaccccaggttcgccccatctggtcgttcctgctcgatctgggcgcagtctggtttcttgatctgtatcgcgctcttggttgtattgatggcttcgctggatttttgcaggtgggaagcttgtgtaccaatacaccaagaagagggcnagcggtcccaagtgccccgtcaccgggaagttgatccagggggtgagtgattacttgttagggcagctctactctgcttttgtcttcactgcggatgagtgtagtctcgggtgcttggtacaatattgaagtaattggtgtgaattagtagatcttatccattggttgcttaaatggtttacagtgtattttgtcctgtgatggtatatcagtatatggattgctgtggtactggcaatttgctgccacattgtggtataggtctattggacgatgtgtattgctgtagtttacaaaatagtgttattgcttacctcatactttattcagagtgacacatgattgagctgccaagtaatcttttctgctgtttgcttcagattcatcattttgtgcatatttaaatttttttaggcgaaactgagtgcattaagctgataattaggagaatgtgcatgctatgtttaaaaccctgctgagttatgacttactccctccgtcccaaaataaatgttgccatggcatttgggccagtcaaatattcataacttttgctatgtttgtagaaattattagcatcatttgtatctttaaataagtttactatgaaaatagattcaacatctaccaaatgttacatttggtcaaatttaaaagcatttgacttattggaaagcgagaacgacacttattttgcgacggatggagtatgcnggaaatggtacagataactttctcaagttggctgaccctagtcaaactttcttgaagcaaattgctgtgttcatactgtcttatcttgtatttattcacatctgatcatgtttctaaaagtgaattgcttatctgatgaaatggcgtggttgtatcaacattttgtcaagcatacatttactttcagaagatgttgttggcacttaggccaatttagctaagttgatttccctggttttcttttttgatcagaatcacttcctaggccttctgtttttgtttgaggttacgcggtccccttggttggttctaacactccatgcgttagtttgtcttctatgtgtgtttggattatttgtttggttgtttccttggcataatactatccataaatcatcatttagttcacatggtctggtaatttctctatctgaacaggtcttaacagtcaatgctaatgctattcttcccatatctctagatcccccacttgagacctgccgagtacaagaggtccaggttgtctaggaaccgcaggactgttaaccgtccttatggtggagtactctctggaattgctgttagggagaggtgagtaaatagaggcgggcatattgtgttgtgaaagcccaggatctgtcatcttgtaatcttatgagctactctctggaattgctgttagggagagaattatccgtgctttcttggttgaggagcagaagattgtcaagaaggtcctgaaaatacagaaaaccaaggacaagacagctgcaaagtagagctccaggaatggaagcctagacactgcgagaagtaattttggtggatggaaaatatgtttgccttgtgtcgagcatttagcatgtgagacatgcctgttgaagtgtttgagtttagagaccggaatccctttcacctttgaattgttgctatgtcgggacatctgctcccctagttgctttgttatgaattgagatcatatctgggtaagataatcttgtctaacaccttggcttgtagctctttttcgtccatgttgcttttcatttccatctgattttttacacaaccactgtgtctgggttattgctaggatcgacaatattcttgaccatttggttattcgataaattgcgcacccattctttcattcccgatgttttatacacgatgggatatctgtgcaaatatcagttcagactcgcaattttccacactgagggcttatttcgaaagaagggaattgacggagttctgttcaaaattaaatagctgctttctgtggcttattccaaaagggtttttactttgtctacagtattttatatctatacagtagtctaaccagctggtttaaagccacagcgaacaggcttgtgtacaatgggacctagatgaataaaagaaatgctaatgtagtgttaatattggttgttcaccggtcccttgcctttgcgttgcaatttttattttatgataactagcaggacaacgaccgagacacaaacggcctagttagcaagtgtggtggaccattttcacaaaaaatatccataaaataaatctaataccaaagttaatatagttcatacatcaaatattaaattgataagaacaaatattacactttaacttgatcaaaagatcgataaaattaagagttaaaaggagattatgaattaaaaggatcttgatatgagttgaaaaagtcctaactttttatagctcgctcggttgctcattttccttcaactaacagggtgatactatatgagagtgctatgctacgttgcctgttgtgttgaacttggttggtttttcggcgatactatatgagagtgctatgctacgttgcctgttgtgttgaacttggttggtttttcaaggggctaacgtcatactggtagggaagaagcnggagagagaaatagacctacgccttatcatgttggtttctcatagcccatatatgagttaacgacccattgcaagaagtgggggagagggggatagatgtgcacattgtgcgtgacgcaccgtcagaactgatgttttaaaggagtgaattaccactgccccagtagaaactaactttttaggtcacgcaacgcaagaccaccgtagacgatgatagatactggcatgttgatatatataaagtattcaaacttgcacagcattttcgcactgaaagtgcaatattttcagtagtgtactgtatgtacagcacaggttccttctgtctgttagctttgctgttaacaatgcctaaaccctcacggtatgtacacggcactcctaaccaaaactgaacaaaaacatgtctcggcagctaacaggaatgctaacagatgaaggaagctcacactcacaccagctatagactgtacatgtaacgtgacctatgagatagtacgtagtgcacaatgcaactgctaacagccgcagtccgcagccctagcgtggcagctcagcctggacagcagctgggctgaggaaggactcccagggtatgctgcatctccactcctccgaagaatccgcacccagatcaaaagggaagttgatcctccccgcagtttcccagtcgctgctgttggcgctgaagccactgctaggcttcccggtggacgagtcctggctcctgccgccgatgcagccactgacgtcggcagaagaatcgaccacgaatccaccgaggcgattgtcagggtgcgcgccgaagaagactggcgctgcagccctgtgcggtgcctgcacttcgaaagggaaggtgattgggaaattctcgggctcctcggaggggctgctggtgaagttgatgagcctgcaagaggcgccgtccagagatgggttgttgacacccttctgctgctggtggtggtgctgactatgcaggccatgcgtgctcgtgaactggcctgcggcgggtgcaggcggcgctgcttgcagtgacagcgatctctcgagagctaactctgaagcctgcactgactgcagcgcggcgaacatgtctgcctctgctgttgcaccaggcagtggaggcccccaggtatgcgacagcgctcgctgcgccatggaactggtcttcttgaagatcctacagatagtccaggagtcctgttcgtggcacagaaaattacttcattattcattcagaactcgccaaaacagcatttggatgaatcggcagtacttacgttgagtggaatggtcttgtcgaccggacgcttggggtcggtgagcgaggggagcctgaactcgtgcatcatccagtcagttttcatccctctcgccgctctccctctgtagaacacgagggacttcttgaggcccacgcacttggtgccctcggacgagtagattggcctgtccgtccctgtggccttccagaacccggccgctgtgactcggttcggcctcacgctgttgcggtacttccgatcccttgggcagtagaagtaccactctttctcaccggtgctcgcaagctctgtcgatggacaggaacagttgagacgtcagaaacgcagaagatgcaacatcattcaccgctgcctgataagctcatagaatgatagaactccaagacatgatagaactccaagacatgcatccacagaaaggtcaagttctgaagaaagtggtgtcttcttacttgggagatcccatgggtcatacttgtagatgtccagctgcctgataagctcgatggagataggcttctgctggatcttcctcctgaggtagaaactcaccagctcttcgtcggtgggatggaaccggaaacccggcatgaggatctcgtctgacctctgcacgttgatgtcattcctctccccctccatgtcttacacagactactagagtgacgaagcttggaggcgccctgctgctgcctacaaacctacaaagcctacttgtgtagtatgtatcttgtgaatgggtttcggggatgaagctgccgaggtgaagacaacagccgagagctgtatactattgcgcttggaaatctattacacaccatgtgtatatatatgaagtgttggaatgactggatgaggcccaccactctgaagattttaatagccgtatctacttccttctctatttgaaagctgtcatcgcatattttaatggcggattagcgactcaataaggacaatctaggaggaattacactgtctccgtccctttcggttcacactttagaatacccgagtacgtaatacggcagtcaaaacaatccttaaactaataagcaacagtgcttcgtttaccagcttgagcctccccaggcaaacagaacgactgataaatacacacccaagttcattttttcggattcaaattttcaacgggggtatgggactcttctcaactagtagttttacttttatctgctgcatgaacttcaagatacgttcctccagtatctggatctaaaaacccccttcaagatatattcctactttttgtcagtttgtactttgggattccaaaataatttgagtgtgtgtgtgtgtgagagagagattcatacaatcatactactgcttggtttctcttcagaaactattttctgttacatacagacagtgacggcctgtgaccagcagcggacctttatccatatgtttattgactagctaccgtgcgtgccactgcgaagtgttggaagggagagaagcttcttattctgataagcacagtttgctacactaaaatttattgaaaggtgagttgccacggtgggaatctggtccagtttgcctgtcaacagtcagcttgcttaaccttaacccccgcatgctggctctggctggtcctccttccttccacatggctgtgctcattccatagtccacaaggctccatttttttttaaaaaaaatactatatgggggcgtgcaggatttttgagcatgctagcacggtgaactggatagctatgctgaatagggccggtgagccgatcctgatcctgtagttcacacgtaataatgtaaacaccggctgtctttggaactttatccggtgcgcattttttgcttctaaaaactgcaggcacgctagtacagaaacgcttacgatttttttcttgcatttgtgttgtctatcttggtgtgcagacataatcgtttcagtgtgatttggttggctgcacacatccatccatactctctaggtgcattgaccaagggatagctcatgtttgcttccctgcgcatacaacgccaagcctgcagatacccatgatagttccgtttccagcgagtcatgctcacaagactcaagccatactcgacaacccaaccaattatgttaaatgtgaaacacatgtcatacaatacttgtccaaataggttggcctcggcacgaaattcagatggccgtgcttgggccaagaaaccggcccgtggagcaggcgcgacccatcagtgaacaatgtggcccaatctggtccagcagcggtagtcatgctgggccaggccgagcaaaggagcccacgggcggccccatatgacacgacatccgaaccgtattggaccttggcatgtcctcatcatgccggtcgagcggtttttaggctgatacggtacgacacgtctaaatagatatctatatgctgtactatagactactgaatatcgtgaataagaagactattttctttagggtttcttttcccttgagagagcattttcgcggtgcttcacatgatgttttagccaaaacagatactgtttgacaatggttgcgtagcccggttataaaatgctacatcgggtacgttgtttcggtataatatcctgtctaaaaggctgtcttgctccaataatagctaagatgtagacggacgactatttaacatttaaacaaccggacgtgtaaactcattcagaactgaagcgaaaacttcaattagggcaatctcatgagagcttcataaatactcccccgttccaaaatattattagtcattttactctaaatntttatgtctatattcaaatgtatgaagataaacctaatcacatatataaaatacatccatcaagtattgtataaacctattaattaattaaaaacgaattttaatttgagacagaggtagtattaaataatttgacgtgccatagtattcagtgacaaagatagaacaaaattgatgagggtgcataagattttttttatagggatgtatatatgtgtgaaatttaactaaatctatagaaattgcattttgtgggggtgcatttacatccacagctatcaacctaggttcgtccctgatagtttttgatgaaggcagattgataaaaggtagtttctgtttatgtgttttcaacgtatgaaagttttaaaaattaaaatgaaacttcaactaaaactgacgtataaccggttttgtttatccttgaggcctaatttagatactctagtattgaagtggtttgaagggattggaaagtgtataaatctccaatagatcaaaaacttccatactacatctcaatccacttcaatccattttnntactagattaccaaaactaggcctgagtaagctagcaaaaccacacaaacaaaagcatccaagaacaatcactctatatcatatagacaatgacgcgaaaattctgcgcggggcgagagttcttgcctcctccaatcgctgaaggacaagaaggtttcgcccgtgcgctgcgcaggagtcaaatacccgcgaaacgttctgttccattctcgtgcggtcgcc

SEQ ID NO: 9299 - DNA, 797 bp, Zea mays
gattgggtacctcgacatctagccgtccgctccctgttgcctcccaagccaaccatatccactctcggcgccgccgcgcatctctcccctcttcttgcccttccttccccccaggccccaacccacgcagcctcactaggggtctaccggcggcggcgacgagatggtgcagcgcctcacctaccgaaagcgtcacagctacgcgacaaaatccaatcagacccgggtcgtgaagaccccaggtgggaagcttgtgtaccaatacaccaagaagagggcgagcggtcccaagtgccccgtcaccgggaagaagatccaggggatcccccacttgagacctgccgagtacaagaggtccaggttgtctaggaaccgcaggactgttaaccgtccttatggtggagtactctctggaattgctgttagggagagaattatccgtgctttcttggttgaggagcagaagattgtcaagaaggtcctgaaaatacagaaaaccaaggacaagacagctgcaaagtagagctccaggaatggaatggaagcctagacactgcgagaagtaattttggtggatggaaaatctgtttgccttgtgtcgagcatttagcctgtgagacatgcctgttgaagtgtttgagtttagagactggaatccctttctcctttgaattgttgctatgtcgggacatctgctcccccagttgctttgttatgaattgagatcatatctgggtaagataatcttgtctaaaacagtggcttgtagccggccggcggccgggggggcggccgag

SEQ ID NO: 9300 - DNA, 952 bp, Zea mays
gctgtcacacacacacagaggcaagtggtttccaaagccaagtgtgtactagcaaccaactagctcgggcggcagcaggcagccatcatgtcggaggagaagcaccaccacttcttcaaccaccacaagaaggacgaggagcagcccgccggcgagtatgcattgggtacctcgaggccggccggcggagctctccactcctctcttacccttcctctccccacccacgaagcctcactagggtttagcggcggcggcgagatggtgcagcgcctcacgtaccggaagcgtcacagctacgctacgaagtccaaccagacccgagtcgtcaagaccccaggcgggaagcttgtgtaccagtacaccaagaagagggcgagcgggcccaagtgccccgtcaccgggaagaaaatccaggggatccctcacttgaggcctgctgagtacaaaaggtccaggttgcctaggagccgcaggactgtgaaccgtccttatggtggagtactctctggaattgctgttagggagagaatcattcgtgctttcttggtcgaggagcagaagattgtcaagaaggtcctgaaaatacaaaaaaccaaggacaagacagctgcaaagtaaatctccaggaatggggaagcctagccctgttttgtacactgcgaaaattaattttggtggatggaaaatctaggtgccttgttgagcatttagcatgtgagtttagagattctggacactgaatccctttcacctttgaattgttggaatatcgggaatctgttcccctagttgcttttattatgaattcagatcctatctatgcaaagatcaaccttctggtttgtaacatcttttgtccaaaaaaatcgggtagctcttgatgcccattcatatctatgcaagcagtgtgcccgtgttttatttatttttggccgattatgattaacat

SEQ ID NO: 9301 - DNA, 829 bp, Zea mays
gccggccgggttggaagccaatgaatctagccgtccgctccctgctgccccggaagccaaccatatccactctcggcggcgccgcgcatctctcctctcttcttgcccttccttcccccaacccacacagcctcactaggggtctaccggcggcggcaacgagatggtgcagcgcctcacctaccgaaagcgtcacagctacgcgacaaaatccaatcagacccgggtcgtgaagaccccaggtgggaagcttgtgtaccaatacaccaagaagagggcgagcggtcccaagtgccccgtcaccgggaagaagatccaggggatcccccacttgagacctgccgagtacaagaggtccaggttgtctaggaaccacaggactgttaaccgtccttatggtggagtactctctggaattgctgttagggagagaattatccgtgctttcttggttgaggagcagaagattgtcaagaaggtcctgaaaatacagaaaaccaaggacaagacagctgcaaagtagagctccaggaatggaagcctagacactgcgagaagtaattttggtggatggaaaatatgtttgccttgtgtcgagcatttagcatgtgagacatgcctgttgaagtgtttgagtttagagaccggaatccctttcacctttgaattgttgctatgtcgggacatctgctcccctagttgctttgttatgaattgagatcatatctgggtaagataatcttgtctaacaccttggcttgtagcatctttttcgtccaagatgcttccccatttcgcccctagggactaaaacaaggccccctagggg

SEQ ID NO: 9302 - DNA, 2558 bp, Zea mays
gttgtggatgaagaagatatgggaggtgtacgtgatgccattgcgcaagcattgatggaaaatgcttaataatgtaatatttgtgcaaggattgatgtaatgaccttgtattttgtaatatataaatattttatgaattttctatcattaaaataacaacaccatatgtctctaggtaataaatatatattcagaaataataagggtatttcagatatttctctattctatcagggtttcagtccattcaataagcgaactgccaaatagctagtttctcagaccagctgcttctcagaccagccagccataaaggaggcttctgcacaagttccagctgtgccaaacagggcgtatgtctaacgctctcccatagtcgatacgatcatccgaaacaggcgctatagcctatggcgcgagctacctgatacgctggactaactctattgtgatagcgcctatgtggctgtccagcagttcgtcgaggttgtgccatgacggtgagacatgcccgagcaagctagcaaagaagtctagcgctgcaggtatctcggtgtcataggctacgacgcggagccgtattacctcggtgtcatgatttatgacgccgagtaaagggtacaaaaataacgttaagtcatgcaggggctacacgtgattttttttttgaaaaaaaaagtccaaattacaaaaaaaccggcaaaccgaaagtccgaaacatgtctgtcatgcgacaaagttccctggttcttgcctacaggctgggcgcacgtatgtagctgaaagtccaaatgagaaaacatgtctaccagttttccccgagaaactggaacgagacggtaaccgtcgctgaaagcctgaaactatggtgggtgcaagttcaaactgcagaaacgaagcagctgcaatgcaaacgaggacatttggacatcatccaagcgccccacgccttgtccgtcggagctggagttggaccggaccctgtccaaagcaataatgcacaaacgccattaacattatctacccagccagccattactaggctctttccgggcctttaaaataggtgtccctcccgtctccaccttcctccaatagttgcgcttccacttccacatcggtagccatcgctggctggctccaagtactggactccctcctgagtcgggaggaagcaatggcggctgagaggaggcagcagcagcagcagcacgagggcgcggtggcagcggcggagccgaggcgtggcgcggcggctgtggcgcgtggtgcgcgccgtgctgtacatgctgcggcggggcctcccgtcgggccgcaagctcggcatggacctgcagctcctcctccaccgcggcaaggtcgcgggcggccggttcctcgcctcggcccagcacggccgccacgccgcggccttctcgtcccacgccggcgccggcgccggcgcggggggttcgttctcgtgcggcgcgctggacccgagcgtggcggtgcacgagccctcgcgcaggcggcgcgaggtcgagttcagctgcagcaacacgccgtcgtccgcctcgggcgtggggggcctcggcctcctcggcgccgccagacgccgccgccgacgccggcggcagcagcagcagcagcagcgcgacgagccggagccggcggccggcggcagcgggtacctgatgcagtactacagctacgacgcggccgaggtggcgcgggtgttcgagatgctcagcgacgaggacgaggacgaggacgaggacgtggtcgacgtcgacgaccgcggccggctcttcggcggcgacgccgtgcgagtgccggtgccgggcgcctcctccgcgacgccgtcccccgcgcaggcgcagctgctgcgcctggtggcggccgcgggtacgggcagcaggaagcagcagcagcagcaggcgcgcgtcggcgtcgccgccgggtcgtcggcttcgccggcggacggcgccgcccaggtggaccggcgcgcggacgagttcatccggcggttctacgagcagctgcgcgcgcagaggagcgccgcgtccacccccgactgctacggctacggcgtgggcggggccagcccctacgccgcgcgcgcgccgcggcccgtcaccgccggcatcgcgtagggccgcagcagcagcactacttgcttcacgtgtggctcactgcgcgcggccccgggctgtcagtggggggtgtgtgagtgtgtcaaccaagctgcatgagccaccctcgcgttccctctcccgggttccgggcccggcgagttgtgcacccaactcgaaacagctaaaatcatgtgctcttattgtctcccataatcttgcttaatctactcagtatttctgttaggttgtagaatgaaaggagttaaattaattaacgtgtggcattcgttattaggaacaccaggggcaatctcgaataagcgcatgcatgcgtgcaaggacaagcgatttggttgggattttgggggtagtgggcaccgggcttttagtacgttggttgtgggtgtgtcggctggtacaccaatattcgttagcgcccggccg

SEQ ID NO: 9303 - DNA, 1357 bp, Zea mays
gcacgagaccattacctagaacatcctaatcgaaacatgtcatttgacagcgcaacacggcgctgcagggtaaagatctcccccgctcgccggtctctctgcccaggccagcaggacgaagaagaagccggccgggaagacccaggcctgaccgcctgagctaggggagaggaggacgacgatggggctgctgtctcagcgggtggagcggtcggagatggagcccggcgaccacatctacacctggcgcgccggctacacctactcccaccacgggatttacgtcggcggcagcaaggtggtgcacttcacgcggaagagggaggcgggcggcgcgggtctggactcggccatcgccgtgtccagcctcctcctctcgcggggctcggacgagtgccccagcttcccggactgcggcttccagctccccgacagcggcgtggtgctgacctgcgtggactgcttcctcggcggcggcgcgctgcaccgcttcgagtacggcgtgcccgccgcggcgttcctggccaaggtccgcgggggcacgtccaccacggcgcgcgccgacccgggcgacgccgccgtgcgccgcgccatgcacctcctccggcacggcttcggcgactacgacgtgttcgagaacaactgcgaggacttcgcgctctactgcaagacggggctcctgctcctccccgccgccgcggctggcggcggggtcgggaggagcgggcaggccgcggccgccctcggcgtgccgctggccgcgctcttctccaccccgttcaagctcgtggccgccggcccgctcggcatggccgccgtcaccgcgggcgtgtactgcgccggcaggtacgtcaccgacatcggggtgaggacggacgtggtgaaggtggaggtgaaggacctgtcggcgcacctcggctggcgccgcgccagggctcaggagaagaagaagaagcagcagcaggaggaggcgccggcggcggccaagagcttgcttccgctcaagcggaaacgggagacctgcgtttgattggcgtgcggttgcaaatagatttgatttcttcgtctttagttactgcatagaaattaataagcccgatatagatagatatatgtcctagcgttcttgcccgatgccccgatcgatattgttcgttgttctttgtacgtactctgtatcattctaagagtttcagttactcctacatacattcttcattactgcaacaagatagttgagaacacagttgttaattgagctgagctgtacgtctcgtactgttccacaatagaatgcgaaggcatgcatgaggtccacgacatttggtccatttctgaatcaaaaaaaaaaaaaaaa

SEQ ID NO: 9304 - DNA, 2054 bp, Zea mays
tccggccgggcaaatcttaaaatggcgaacatgcgagcccctagaaacgatgacaaccaagagagtgcctcctgtcctcctcacatcgattttcctccggaatcgtaacctcagaaagccaaatctcattctccggcgctcaggcccacccaagcgtcgactctcccgatccaatcggtacctcctagttcctcgccggcggtagcggcgtcgggcgaacagcggtgacttggcgagggcgcttggccggcgacaatcatccactaggatggaaggtgaggcagagaccgtggttggttcttgttctaaaccatgtgggcctctggaggactactacattccagattacattctgaagccaggtgcccaacaagtacttgttgatcatgcggcaccctgccccgttgtagtgttcatcaactcaagatctggaggccaacttggaagtagtttaatcaaaacatatcgtgagcttctcaatgaagcacaggtttttgatctctcaaaagaggctccagataaggtattgcatcgtttatatgccaaccttgaaaggctgaagatggaaggagacattcttgcagttcaaatttggaggacactgaggctaattgttgcaggcggtgatggtacagctagctggctgcttggggtagtcagtgaccttaagctttcccacccacctccagtggcaactgtgcctctgggaaccggaaataacctccccttttcatttggatggggaaagaagaatccttctactgaccaagaggctgtaaaatcattcctcgggctagtaaagcatgcaaaagaaattaagattgatagttggcacatcattttgagaatgcgagttccagaggaaggtccatgtgatcctattgctccactagatttgcctcattcattgcatgcgttccatcgtgtctcaagtagtgattctctcaatatggaaggttaccacacattccgtggaggattttggaattactttagtatggggatggatgcagaagtgtcttatgcatttcattctgaaaggaagaagaatccagagaagttcaagaatcagctgacaaatcagggtacatacgctaagcttggacttaaacaaggatggttttgtgcttctcttagtcagccatcatcaaggaaccttgctcaaattgcaaaagtaaagatcatgaaaagagctggtagcctctgggaggaacttcacattcatcacagcattcggtccatcgtgtgtctgaatttgcctagtttttctggaggtttgaatccttggggcacacctggcacgaggagagcagaagatagggagttcactgcaccttttgtcgacgatggacttcttgaggttgttggcttccgtgacgcctggcacgggctggtcctgctggcccctaatggacacggcactcgcattgcccaggcccataggatccgctttgaattccacaaaggcgcagcagagcacacgttcatgagggttgacggagagccctggaagcagccccttcccaaggacgatgacacggttgtggtggaaatctctcaccttgggcaggtcaccatgctagcaaatgagccgtgcaggtccaagagcgtcaacgaccagtcgtcactgtcgccggcgcacgacagtcatggtgattacaatgatatcgctgaggaggacgaagacgagtgggaggacggcaggaggaagtttggggcggcagatacatttaagattcctgacgagattgacattgctcatttcagttgagctttgactagtgcatcgtcgtgtgcgttctgatcatacgagtatggtttggtttataaccatctcctttcttttgatttcatatatttgcgatatgattgttgcagccatgtgtaagtgaatcctaggtaaccaagtgctgcgttgctatatatgaccaatgtatgtatagattcagtggaacggtaaaaacacgcgaactctacggttttctccttttgttgttaccagttcaattgaacaatatagcgggtgtttggtttgggtaatcacgctattcaaa

SEQ ID NO: 9305 - DNA, 990 bp, Zea mays
  misc_feature (157)..(157): n is a, c, g, or t
  misc_feature (987)..(987): n is a, c, g, or t
tgcacatagttgtaatctgtgggtatctcctataccctcttgagcaagtcgccaaaggaaaggcgtcgtttaagtccacatctgggtagctttccgttgtctctttgaatggtctcggtatggatggtactgtagagtggggtcgaggtggccttcncaaattagaaaccgtaggtacgcactgcttctgtttctcatctacgattgcatctccatgccctctatcaatgtaacgttcttgtacttcgttcctgtttaataaattgcctagtcttgttgatctgcactgtatagcgacaggagagctaacaggagagtgccctgctgagcaagaacagtattttgaacgaggagaatcattttccatggcagaatgatctttcggggttcttattgcatattctctagagaacggattcccttctggagaccacatgtcgggagcgacatctttggcatggtggggtgcatcagattcatcgtacaaagagcacggaacatcacccgagaagctaaagcatcgttcctccacacagctgcttctggccggggatgagaaggacatggacctcctgagttgtttggggttagccggttcctccttattccgcttctgacgacggcttctggatctcgacaatctcgcggtggagatgtcctttccctcatctgtctttctatgtccagtcctgctatcattgaccggttgcccggctccctcaccagcgtttgcagcaggggacccgaagaaaaagaaccttctcatgtttcacaagtgtcgaggattcacaggttcctgggtttgagattccgccacaaactagtccctgcgagaatctcaggcgagtcgatcggagtggagtggagccggcggtgtggggagggatatggggtagcaacggtcgggaggacagatgagcatttgattagcgcgcactaattgcgattaacagctactagctgccctggtcctctgctgctccgctnctg

SEQ ID NO: 9306 - DNA, 1661 bp, Zea mays
gtcctttctggttgctgccgcgggctaggttcgctggcagatgcagagcgggtgctggagactatgtcggctgttggtgtctcgccagatgtagagagctttgggtgcctcgccttcctgtatgcttggagaggtgttcccagtcgggttgatgaactggatacattgtttgatgctctgggcttcagcaagaaggggtttttcaagaacctggttagtgggtacctcaaatctggtgacttcgagtcggtttcaccaatcattcttcgtgcagtgaaggagcgcagagttggggatgacaatggacttgatgaggaaacctatactgaggttgctcagtgctttgtggatcgtgcgaggattagggaactagctcagttgatcatccaagctcatgagattgagctcgctcaacaatctatatcagttgaggattctgttgggtttggaattgtgaatgcttgtgttgagctcgggctattgaacaaagctcatagcatactcgatgaaatgacagctcaaggagcctctgtagggcttggtgtgtactcttcaatcttgaaagcctattgcaaggagcaaaagactgcagaagctgcacaacttgtggcagagattagtgcagccgggctacagcttgatgctggtaggttatgatgctcttattgatgcttccatgacagcccacgatttccagtctgcatttgctcttttcaaggacatgagggaggcaaggctaccagaacttaggacaagttatcttactataatgacaggcttaacagaaaacaacaagcctggcctcatggcttccttcttggactcggtggttgatgacccgagaatagagattgctacacacgattggaattcaataatacatgctttctgcaaggtcgggaggttagatgatgctagaaggacataccgaaggatggtattccttagatttgaaccaaataatcagacatacctctcactcatcaacggttatgtctcaactgagaaatactttagtgtgctcatactgtggacagaagtaaggaggagggggattgaattcaaccatgagttgattgatgcctttctttatgctttggtaaaaggagggttctttgatatggcgatgcaggtgattgaaaaggcgcaagagttcaaaatatttatcgataaatggaggtacaagcaagcattcatggaaacacacaaaaaactgaaagtggcaaagctaagaaagcggaacttcaggaaaatggaagccctagtggctttcagaaattgggctggtatcaacacataacatcgcaaccttgattttatcaacctgtcatgtgtcatgactgaatttatgatcttcagaaagctgtagcaagcgctatggatctttagagatggttaaagtaaagcagctgtttggctgtggtaaatttgcattttgcaacaaggttagataaaaattggctcgcttgtgttctctatgttatttataggactggatgtttactttgtactttatagctatactgacctgtctaggcactggtttgcagtaggaccccattcaaacttcagaccatgtgtagtactggaatgatcaatgacaagtttctcttgaaataaaaaaaaaaaaaaaaaaaaaaaaaaaaaaaaaaactcgaaga

SEQ ID NO: 9307 - DNA, 4504 bp, Zea mays
gcacctacccggctacccctgcggccttgccggggagtcggggacggggaaggaaacggcaacgagcctgctgctccagctaccccgaaaccccgtccaacgtccatggctatccacctccgggcacacgccttcgcggccaacccgctgcgtggcgtctccgccgccaccaccgccatgtccccctccgcggccgccgaggcactccgctacctcctcgaccccagctccgccgccgccgccgccaatcccagccagtacctctccaagatccttcctttccgcaggggccgcccactcgcgcgctccactgaccctcccgcggcgccggcctggcgcctcgcgtggctcccgccgtcccgcgtccccggggtggccccggacgccttcgtcttcctgggcgcgctcgtcgagggggacggcaaggaggccgccgcgtactgggcggtcgacgtcagcgagggcgagggagccagggttggtgggccggcggacggggatgggccgtcggcgtttgtggacttgaggacgctcatggtggccacggactggagcgacaaggacgccatggcggagctcgccatcgcaggacatgctcgagcactgctagaatggcacagcacggcaaaattttgtggagcttgtggagcaaaggctgtacctactgaagccgggaggcgtaagcagtgcagcaacgattcctgcaagaagaggatataccctagaattgatccggttgtgatcatgttggtcattgataaagaaaatgatcgggcactcttaagccgccagtcaagatttgtgcctcgtatgtggagttgtcttgctggtttcatagagccaggagaaagcctggaagaggcagtgagacgagaaacatgggaggaaactggtatcgaagttgggcaagtcgtttatcacagttctcaaccatggcctgttgggccaaatactatgccgtgtcaactgatggtgggcttctttgcttatgctaaatcattggagataaacgtggacaagcaggagcttgaagatgcccagtggcacaaccgcgaagacgtcaagaaagcgttgacgtttgctgaatacgagaaagcccagagaacaagcgctgccaaggtcgatcagatctgcaagggcgctgagaaagggcagaacccctctgccgacttcaaagttggaagcggcgagcctgctccaatgtttgtcccaggaccctacgccattgctcaccaccttatctcgtcgtgggctttcgagggagcaccgaagctgcctagttcattctcaaacctataagcctggaccctggtgttcagacagacgatgacaggaactggacccctgtgctgcgggctcatggatcacctgtgttgccgtgagtgtaattctgatagtgtgtgtccgttgccggttgtgataaaataaaatagcaatagagtactgggtacagaagacttgccggaggatttggcatcaatggacatgtatatccattgcctttttacatgttgatcctctttgtatcacacgtaatgttgcatacttgcatagatacaacaatgatatacatcacacagtgtactcatgcatttatacatgtattcagataactggattcaatagtagagtctttgtctgtctctcaaaaaaaaaaaaacatgtggtttgataattgctacagatgttcctggcctcttgggcaatttgttcttgtttcccacatcaatttcgccaccttaacatcacaaatgcagtgtagtccgtagaagcggcgctacgtggatgtagaatacatgaaaaaccggcgatggtagcaaacacgaacaccagaaccaatgcctttgaagtcgaatattcagagcgcggtagtttgttgcagcaagtaatctgcccagattctcttggactaaaagttggtctcgtgtctggttgcaacaagcaaggactaaaactaaactactgataccttggtttgtctagtctagtgcacaagcacacgaggcagtctgcaattctgcatcagcctccaattagtcagcaaaacctgtagaatatagtactgcattatcatgtgcagagactagtcagcacaccaatcgtttgcagatagcaacggctgagtggcacctctgtcagtctctgtgctgcactgcccatttcctactctgttcaaggaagtcatcaaggtatggttcatgtggtccaaagtccaaacaaggacgagatggtcgcattggtcgacatcggatctcctatccggttagtcaaccatgaccgctacaagtcacctactataccaacacttccacagctaccacaagataagatcacttgcccttcactgcgactgcgagcaagcagctctggtagtctggtctgatcactgatcagatcagccatggcggtcggcgtcgtcgccgctgagggcggccaggaccgccgctacggcggaaggatcaccgccttcgttgtgctgtcctgcatgaccgccggcatgggcggtgtcatcttcggctacgacatcgggatcgcaggtaaaaaaaatggatgccacgagcgcgcggcagccggcaagtagcagcaaggtcgtcgccgccgtcatcccatgttccacgatgactgactgacgtgtgaacaacgggcactcgcgttgtcgctcatgcaggcggcgtgtcgtcgatggagccgttcctgcgcaggttcttcccggacgtgtaccgccggatgcgcggcgacacgcgggtgagcaactactgcaagttcgacagccagctgctgacggcctccacgtcgtcgctgtacgtggcgggcctgctgacacacgttcctggcgtcgcgggtcacggcagggcgcggccgcagggcgtccatggtcctgggcggcgccgcgttcctggcgggcgcggccgtgggcggcgcgtcggtgaacgtctacatggtgatcctggggcgggtgctgctgggcgtcgggctcggcttcgccaaccaggccgtgccgctgtacctgtcggagatggcgccggcccggctccgcggcgcgttcagcaacgggttccagctcagcgtcggggtcggcgcgctggcggcgaacgtgatcaacttcggcacggagaagatcggcggcggctggggctggcgcgtgtcgctggcgctcgccgccgtgcccgcggggctcctcaccctcggcgcgctgttcctcccggagacgcccagcagcctggtgcagcaaggcagggaccgccgcgacgtggcgcggctgctgcagaaggtccgcggtgccggcgtcgacgtgggcgacgagctggacgacatcgtcgccgcgggtgagtctgcggccggagccggagggggcggcctgcgtcggctgctcgtggagcggcggtaccgccctcagctggtgatggcggtggcgatccctttctttcagcaggtgacggggatcaacgcgatcgcgttctacgcgccggtgctgctgcgcaccatcggcatgggcgagagcgcgtcgctgctgtcggcggtggtgacgggcgtcgtgggcgtggcctccacctccgcgtccatgctcgccgtggaccgcttcgggcgccgcacgctgttcctggccggcggcgcgcagatgctggcgtcgcaggtgctgatcggcgccatcatggccgcggagctgcgggacagcggcggcgtggggaaggcctgggcgggggtgctcatcctgctcatcgccgtgtacgtggccgggttcggctggtcctggggccccctcgggtggctggtccccagcgagatcttcccgctggaggtgcgcgccgccgggcagagcgtcacggtggcggggagcttcgcgttcaccgtgttcgtggcgcaggcgttcctgtccatgctgtgccacatgaaggccggcatcttcttcttcttcgccgcgtggctcgccctcatgaccgccttcgtgtacctcctgctgccggagacgaagggggtgcccatcgagcagatggccggggtgtggcgcgcgcactggttctggagcagggtcctggggccggagtcggaccccgacacagacgagggccgcgcgcgcgggaaactatagcgcggatgcaacgaacagaaccatatgagggtggtgtgtggcaggggactctgaattcgaaaaggggaggaaggccaagcaaactagacggcctcaggtgacttgaaagaaaacagacagtattcagacaagttctgtgagccttcattcatcaagtgaaaattgcaggatcatcataaccatgcaggttgcagatgcagccccaagctacgagatgtcagaccgcagcacatatacaagaacctgctggaggcctgttcccaaaacgcttatactattactactgcgaattcacagatccttggattattcatacgtgatcaatttcatttcggctcccttccgattctagaaaaaaaggggaaaaaaaaaaaaaaaaaaaaaaaaaaaaaaagggcggcgctcgcaactaac

SEQ ID NO: 9308 - DNA, 2537 bp, Zea mays
agaacacaagctgaactaaaagttcaagatacattatggccgaaacagaaattgtacaagctgaactaaaagttcacagatagtacaagctgccagtcaagcttagataaatgaactacaagttcaagatacattatggccgaaaccaagttgaactaaaaatacatcatcaactacaagtctcacaaaatacattgccaatagaatactacatcaaattaaaacatggctattgtccacgagacaactctctcacagacaaataggtcagataggctcattcatatgtgataaacggcgatcattgatctcatccgagtcaaaagaagagttgtcttcatctgaaccacactgctcataacaatcacaatgaacatcagatttgaaatcatcatacattccaagggcttcgtaatcctcaattagaggttgcggaccaataagaacttcctccaaatccctgctcatagtgtctagaccttttgccatttcactaacatcactcatggcattaatcaagcaattcttgtgcaccatatcataatactcaggcacatgattgcggcggctcaacttcctcaactcatcggcagataactgcatttgtctaatggcgtctaaaagaccatcccaaactcgattatatctctgcgccggatcatgtgtggtacataatcgatggcgcggacgtaatctactagtgccataatcaattttgctcgtgtcgacaatgcatgtgcgcctaatcccatctgcagcttctgcgacatctttgcgtgtgtcggccctagcaggtccagatccgatacgaattgatcttggtgatttatccatgggcgcggtgaaggatcctacgacgagctggagcgccgggcagagggaccaagacctttcggtaggagactcgcgagctcgacgaggagcaccgcaaactggcgagctcgacgagcgccggggtgctgggagcagtcggggaggagccgtcggggagccggacagagagcgagaggaagaaactcagctcgcgatccgttctgaaggaggttggaaggccgatccgttttgacgaacgggaaatccaaatcttcaacgtaacagcagctggcgacggattaaagtgcccacgatgacgaatttccaaacggaagccgattttattactaagattccaattgcaaggttgggggtaccaaacttccgaagcccgccgttcgggatacctcagcaaaaaaaattgcacgcaagggtccacgcggcgaacagatcgtgccgttccgcggcggcgtcggtgcggcgctggagccgaagtgaaaagtcgatcgggattgggccgttgggggtgcgatacccctcgcctcgaatgcgagctccgtaggtccgcccccccggcggatggccgagctgggccgccgccgccgcccgctgggatgaggcagcgtgaggagtcgcgctcgcggcttccctgcccccaggcctccgctctgaatatccccgacgcgacggtaaccgaacaagcctcagttagaaaggctaagatcagagcatctccgtgtctccacaacacatcctggattcgcaattattgaggtgcctccactataaaaggccaaccatcctcaaggaatgaacacagccagccagcaagcaagcagagaacaaggataacacagcaactgaaaaccttattaccaagaacaaacaactacaagaggctttgcaagttcacagaggcagctgttcactgcgaatgaacaaccagaggaagcctggagactggaactgcaagaactgccagcatctcaacttcagccgccgtgactactgccagcgttgccgtgatccacgccctgacttgcagttcggcgacggctatagcacggttggtgtgctgacctccctggacatccgcccaggtgactggtactgcagctgcggctaccacaacttcgccagccgcagcagctgcttcaagtgcggcacgatcgtcagagacttcccagcggggcaaggcgcagccggtgctgagggtgactttgctggtggacgcgacagcgccgcagtccgtgctgggtggaaagctggcgactggatctgcacgaggcctggttgcaacgtacacaactttgcgagcaggatggagtgctataggtgcaatgcaccaagggaggcagcaggcaccgggaggtaagaggcgactggggtgataccaagagcgtgagatgtgacgagctggccgagcagtggaacctactgccgtcacacactcaccatcaggcatccaggaaggatgagtctactacgtacacgactatattgctgattgccgcgcgtagtgccgctgctgtggtttgcgtgggtggagaagtacccaagcgcaacacctgttacgtgtgttgtttgctcctttttgaggttgtgttgattcagtgacagctgagttgtacggcctgatgatgtactcgcattgtgtatttgtcttaaacagcatatataattatgtaataataagtgcttgcttatctaaaaaaaaaaaaaaa

SEQ ID NO: 9309 - DNA, 2736 bp, Zea mays
tcccggcgctcgtctgatctctctgcccggcgctcctggtgctctccccgactcctccccgacggtcggtgccgtgccgcgccttcctctccctctctctatcctctccctcccggcgctcgtcgagctcgtctgcggtgctcctcgtggctcctcccgacgagctccctccccgatggtcttctctgcccggctctctccctccaggagctccttggagagcgctcctcctcggacggcgcgcctctccctggtgctcggcggtgcgccttaggtacgtggttgtcggctatttcattgtgccaatctaataacaaaatagaaaatatgtagacagcacgtttaatctatcactctcagccaggtactgcaatggagactcctgacagcaatggagacgttgagcacaatgcgacagatgcaaattggtttgtcaccattgaagaggttgaacacttgttgattgaggcaccagcctcgcctgaggatatcagtgcaccccctcccattaatgatgtagagcagggtcattcggtagcggattcgtcaactcgaggaaatgattttgagggaattttaccggatttgcgatggcaagaagagggaccccagcatgtacccaatgagagtgttatgtaccacaaacttggattagctgccgaggatgaacgagaaaataaagagagagaggatgcttgcaatcgtagagttgatggaaataatatagatcaacttggtggcgatggttccgcagctttgtcttatgttgattttttgcagtaggagactagaattgtctatgactctaatgatccagtgatggaggttggcagcttgtatgcatctatgactgaatttaggctggcaatgagacaatatgccatagacaaagagttcgagttaggtattaaggcaagtacaacaaagaaatatagaggctattgtcgtggaggcggctgtctttggagcataaatgcaagaattgagagggatggttcgccgaccataattgtatgttttttgtttatatcaagaacttatcttatttaaaaaaaaaaaaaatcgaaagtaatacaatgagagtgttattgttgttgctatttttgtaggtgacagtgttgaatgatcatcacacttgtacttctagtggacggaggaggactagcacaccaacaagtgcttgggttgcttcaaaagctcttcctattattgttagaaaaccacatattggtgctaaggaattacaaactacacttcaagatacctacaaatgcacaattgcgtatgacacagtttggtatggaaaagaaaaagccttgaaagtcttgtttgggacctgggaagagagctttcaacttttgtacagttggaaggaggcagtattgcagaagtcacctgatagtgtcattgaaattgatgttcgagtagaagatggtcgattctacttcacgcgcttcttttgtgctcttggaccatgtatcacagtaacaggcttcttacagggttgcagaccttacttgagtgtggattctacggctttgaatggtcgatggaatggtcacctaccatctgctacagcagttgacgggcacaattggatgttccccgttgcttttggattcttcgagtctgaaacggaggacaattggaaatggttcatgcagcagttacggaagaccattggagatcttcctatactagcaatttgttctgatgcttgcaaaggtttgaccaacgcaatgagggatgtttttcccaatgcagagaaaagggagtgtttcaggcatctaatgaacaattttgttaaacaatttgccttcaactgctgtagttgctagtgtacataccctcccagctgccaaactgccgctaaagtgagatcatctaatatttgattgtaacagttttgtagtgatacctactagtgcttgcagattttatcttctgttttgagttttgaccatgcctgtagttgctagtgtacatatttgttgattactgcctgtttgtttgaatcacctatgcatttgccttcacctgtgtgaattggtgagccacaaatatggaaatgccttcacctgatataagttctgaaaatggtactgatttgagttagcttcacatattcacgacacctgaattcatgtttagatccattttcaagctggaataagctgaattcattaaactgggcacacatagttgaagatacatcatgagtagcaagttgaagatacattttggccaaatcaatcatggtcaaaaccaagttaaactaaaaattccacatgaactacaagtctcacaaaatacatttgcaatacaatactacatgaaattaatacatggctcagatagggcccttcatacggcgatcagggatctcatccgagtcaaaagaagagttgtcctcatccgatccacactgctcagtacaatcacaatgaacatcagttttgaaatcatcgtacattccaagggcttcgtaatcctcaagtagaggttgcggaccaataagaacttcctccaaatccctgctcatagagtctagaccttttgcaatttcagtaacatcactcatggcattaaccaaacaattcttgtgcaccatatcataatactcaggcacatgattgcggcgggtcaacttcctcaactcatcggcagataattgcatctgtctaatggcgtctaaaagaccatcccaaactcgattatatctctgcgcctacaacc

SEQ ID NO: 9310 - DNA, 3180 bp, Zea mays
aatgcgcctcaaacctcagaactcagaagtaaacccctcctagtctgtcgtctctcttcgcacgccgccaccgagaggacgaaggagcgcgcacgcgcgtgacagagtggtaagatgggaggcgggcggaagcgcgggcgcacgcagcgccgccacttcaagcagggccgcgagaacgtctggaagcacaaccctcagcgtcctcccgccggcgaaggaggagaggcgcgagaggacaatccctcgtggcagcccttcgctaccgagaacccagccttcgaggagtactacaaggagcagcaaattgtttctgaggaagagtgggatagcttcatgagcatgctccggaagccattacctgccacttttaggattaatgcgagctgtcaattttttcaagatatctgctcgcaattggaaaacgacttcaggaaatcattagagactgaggtgaccgatgatcatgaagaagatgctattcggcctttgccttggtacccgggtaatcttgcatggcatttgaacttttctcgaatgcagctgaggagaaatcaggcacttgagagttttcatgaattcttgaagcgagagaacgaagttggcaacataactaggcaagaggctgttagtatggtcccaccactgtttctgaatgtgcaacctgatcatcatattcttgatatgtgtgccgctccaggatctaaaactttccagttacttgagatgattcaccagtcaacgaagcctggactgcttccaaatgccctggtggtagctaatgatgttgatgtgcaaagatgcaatcttcttattcaccaaaccaagagaatgtgcacagctaacctgattgtgacaaatcacgaagcacaaaactttcctggttgtaatcttgcaaagttctgttcagagatgtgtatggatgaggcaaagctgcagaggttggagtttgatcgcgttctttgtgatgtgccttgtagtggtgatgggactgtccgtaaggctcctgatatgtggaggaagtggaatgctggtatggggaacggacttcatcacctgcaagtggaaattgctatgcgtggtatgggcttgctcaaagtgggtgggaggatggtttattcgacatggttcaatgaaccctgttgaaaatgaaggcgttgttgctgagattttgcggagatgtggggactctgttgaacttcttgatgtttctaatgaactacctgaattagcccgtcgtcctggacttagcacctggaaggtaccgcggccgcggcctcgctttggtgttcatgaagatgtacctcgctacaggaagcatgtgatatcagcaagtatgtttccttctgggaaaggcagcaaagatagtggtacggggagcagcagcgttgaggtcaacacagatgtagctgatgcagacatgaaggattcaacagacatgggagagggagaacaagaaacaactgtaacaattgatgacagcaataatggtgacaatctgaaaaccgaagagggaactaaagttgattgcgagtctggtgaagtcacaactagtagtagttataaaaagttaaattctacttccatccgtacggaacattcagattacccactgcatcgctgtatgagaattgttcctcatgaccagaacagtggggcatttttcattgcagtccttcataaactctctcccctgaatgagaaccaggtggtagatggtgtcagaattgaccagaatatctcaaaagacaagactgagaaacttgagaaggatttagtatcacataaggcatcatctgaagaaaatactgtgcatcagcaagtgattgataatgcaaatgttctggatggagaacagaatagagacagggataacaaaagttcagaagataagagctcagaggattctaaggtcaatgttaatgaggcagcaaagggtcaagcaggaacaagggataggaggaggcagcaaaaccaaggcaggtggagaggggttgaccctgtgatattttttaaagatgaagtgacagtcaaaagcattgtatctttctatggtatcacagattcatttccacttgaaggtcatctggtgactagaaaccctgatactagtcatgttaagagaatatactatgtgtcaaaatctgttcaagatgttttggagctcaacataaaaattggcgaaaggctaaagatcacctcactgggcctaaagattttttggttctcatatacctttgcactctttcaggaaaggcagtcttcaaaggaaggctccccatgcacatttcggttgtcatcagagggattgccgctcctgcttccatacatcacaaaacagattctatatgcatctgcaattgacttccaacatcttttacagtacaggactattaagtttcctgatttcgtggatgcaaaatttggtgaggaagcttcagctttgcttccaggttgctgtgttgtagttttacgtgaagggcatcaggatataggatccatagctacagatccctcggccattgccattgtttgctggaaaggaaagaccaatttgtgcgtcatggtttctccgctagatggtaaagaattgcttgagaggatttctttgcgccatgggctcaaaatccccaaaggggataaagagaaacccagccaggagattgctggatcagacgagctgcttgattgtgccactgaggtggacgatcaagagtctcttcctgaaagcaaagcatctgacatcgaaatttcagatgctaaggaggctgagtagcttttgttttatgtcactacgcatattacacaggaggtagctgtatcctcgagatggctattagcttttttaagtcacttcggttgccaagggagagagatgatagcccaccacatgggaatgacagactcaaaacaccatctggtaatcgttcacggtgacacagaatctatagacttgtaacttcttggttttatttcttcgagaggatgtattgcatcgattttaatttgttgcactcaacacagaatctagtaaagattgagaaaaacattttttttgagatatctctgtgtaggttcactacgaatgctgaaatctgacattttccgaggctatctagttcccatgctaaaaaaaaaaaaaaaaaaaaaaaaaaaaacaaaaaaaaaaaaaaaaaagcggcc

SEQ ID NO: 9311 - DNA, 625 bp, Zea mays
cctttctatataaagtcttacatctctcgtcttcccattgacccgccgcctctacgcctttcagtatccggaagaccggaagcttcttcctcctcgcctctgacatggccggcggcaacctattcggtcgagcgctgagctacgttgtcaacgagttcttcgtccagggcctcgccaacaaccgtgcagtccagaggtttgctgtgaagaccaacaagactcttgagagcctatcgtctaaagccaaggaaatgagggaggagttatcggaacaattcaaggatgctcgtggccagaaagatcacttcaagcagtgaagccgatccccaaagttgattcaacgacacgaatctagctatgagttttttctagttctcgtccgggtcctatttatgaatggcatttgaagggatttcttggtgtcgttcaatggacggatccgttgtataaagtttatctgcacttagattagtagatatattggtagacacatcactttctgctgcccctttttcataaatacatatatctcgatctctactgtattagcaaaactacctcagtttctaccgttttcgtgctctacaaaaaaaaaaaaaaaaaaagcgcccctcccccccacagt

SEQ ID NO: 9312 - DNA, 875 bp, Zea mays
ataaaaaatctccctcctcctctccgccctcgccccctcgccctcgcccgcctgtttaaacctgactgtctataacttaccgccggtccgcacccgcccaccgtccctgtccccttccccgtctaagcactcggatcctctgccgccgcgatgagctactacggccagcagcagccgcccgtcagcgcgccgccggcgcaaggttatcccgggaaggacgcgtacccgccgccgggctacccgcccgcgggatatcctccgccggcgcagggctacccaccgcagggctacccgccgcagggctaccctccgcagcaggggtatccgcagcagggatacccgccgcagtactcgcagccgccgccgccgccccgccagcagcagagcagcgggccctctttcatggagggatgcttggccgccctttgttgctgctgcctattggaagcctgcttctgagatctaagctgcgcacaacttgttctagaaacaccacttcaatttgcacggttgatataactggggattggcttgttagcgaagaaccgaagataccatgggttcttatgcaaatcacagttctcctagttctttctatcgttctgattgtccgttgcgatgtttggtgtacctagtagtatcttaattatataccttacactgtttacctatccaatggaattcttggtctagctaacattgtgagattatgtcacttttctcgttctctgtagtcattgcattttgctcccaaaaaaaaaaaaaaaaaggcggtcctggggctagcacttttggagcctttgaggagggggagttggaggcttgggggggtagagggggtagggggggggcgtgggggggtaggtggggggggg

SEQ ID NO: 9313 - DNA, 1435 bp, Zea mays
  misc_feature (1425)..(1425): n is a, c, g, or t
cattgggtaccgcgcggcccccgcgagacacgtgtttctgttaattcgtctcgttttctcccttcccctgcgggctggagagcggcggcgaacgagacaaggtcaccggtgacgctcctcacctactccctgccgcctttcgctttccggcccggcctgccgcaagctcgcgcgccgcctacatcgacccctccccgcgccgcaggccgcctcccacagacgcggggcagccacgtcgcccggctcggagggattcggttcggcccgtcgtgctcccctccgcactcttctattggcctggagagcagcggagatccaccagcaatttggattgcttctcctttttcttggatatacttggtctcctcggtgttggctaggcaatccagctttccaaagtgtgatcggacaggtttattttggttctgagatggctgatgaggactcatccgacttcaccttctgcagggttagttctgcagaaaatgacggtcaaccagaatctcctaaagccattcctatggcaagtatgacgctcgaggatgttcgtgttaaaagtgcagatacttcaaagaataatggcatgaaaactgttgactcagaaaaagataggtctggtaacaatgtcagtgtttcaacaaaagacgataacatgaaagcaccagttacacatacaggtagtggagcagaatcaaatgtcccattacaggcaaaacgttcatccaagaaacccgcagcacgggcaaaggttccttttgagaaaggctatagtcaaatggattggctaaaactgacacaaacacatcctgatctagctgggcttaaggggcagtcaaaccgaaggttaatttctttggaagaggttaagcagcacaaagcaggagattgtatttggacagttctcaaaggccgcgtgtacaacattgctccatacatgaaatttcatcctggaggtgttgatatgcttatgaaagccgctgggaaagactgcactgctttgttcaataaataccatgcttgggtaaatgcagagttcctcctggagaagtgccttgtcggattccttgatcccaccgcgtagatatccaggtctcatggcattttatcacacccggactgtttgtagggcaggcacctcagtcgacgaattaaagaatctaaatgtttgtatcacaacgggagtacaacaattaaattctgtttcaaaaagaaaacggaattgttatgacgatgagaaaaaatcagtctaatactggtatgccattacagtgcgaggtgaattacaacacctgatgaaattactgcattgtcaatatgaaaacatgtggttgtttatatatacctggggtataatcctttccaagcgctgtaatatgcatgtatattgtttttttccacatttgtttgaagttttgttaaaaaaancaatatacgt

SEQ ID NO: 9314 - DNA, 1860 bp, Zea mays
tcgctggtactgggagcgggtgacagttattgtggatgcatgtgctattgtcggttaatgaacttcggaagctatttaagatcttacaatgccctttggcatattttaaatggaaatcaaagcactctgtttctttgttatttatttgttgtataatttgcttccacttgcagaattggtcttctagtggtctgcttgagaaaatgaagaaactttctgaaagaaggaagcttgaagatttaacaattggtccagtccttacagtaagtcaggggcggagccagcccttttttgggggtcagctgaccccggtaaatttctgaatatctaatagaaaatggtgttaataacaatagttctatagtgaagatctagtagaaaatactgatgaccccgataaaatttttgctagcttcgctactgcagtaagtggacagttctggattgtaatcacaattgttctttgtaactaaaatgatatggtgtcgtgttgggaacaaacagtagttaaaaacttaatcaagcaataaatggaaccaggtaataatatattattttctgttattttagtagatgtgaagggcaatcctagtctagcggtgagagttgtctcaccgagtcaccaggttgagggttcgaagatttgcctatcccctttctaaaccttactcatgtgtgtgtaagaagagaagtttttttttattttagtagatgtgagggtgtccagacatcaaatagtgtgtaagaagagaagacaaaggaaattgtctttgcacagtacaggttttcatataaaaggtcaaatatgtgtggagaaagaaaaagaacatgtagctattcatcactatttttttgtctcaactgtttatatggtcacaactcacaactggattagcggtataaagtttttctgtttcttcttattaacatatcatggatcttttctgatccaggttactacagaagccatgatagagcacatgaacaaccttctcaaaataagaggatcaaaggttctgtttggtggtgaaccgttagcgaatcactcaattcccaaaatttatggtgccatgaagcctactgctgtatttgttcctctagaagaaattctaaaaagtgggaacttcgagcttgtgacaaaggagatatttggtccattccaggtagtcacagaatactctgaggatcagcttgagttggtcttagaagcctgcgaaaggatgaatgcgcatctgacagctgcagttgtctcaaacgacccgctattcctgcaggatgtacttgggagatccgttaacgggacaacctacgccggaattcgagcgaggaccacgggcgctccacagaaccactggtttggcccggccggtgatccgcgaggcgcagggatcgggactccggaagccatcaaacttgtctggtcctgccacagggaagtcatatatgacgtcgggcccgtgcccgagagctgggcgcttccttccgcgacctgattagctagacgaggatagactattccatgtcatcacgagaaataaaaggggaagataagcgaagccagcaggactggagcgaccgaccgagagcgagtggctgcatgcctaggcattcattctctgcacgcaactgcactttcaaccctggagaaaacataataaatgttcgttcccctgtacttgagatacatggtacttggaccggaacgtcggacaagtcgtctgttcgcagctgcactgggttatcttcttagtccttatttatttggaattataatcagtagattatatattctaacaaattttatatgaactcttatttcaaaatttgttagattatataatctaaatagattataatttt

SEQ ID NO: 9315 - DNA, 2250 bp, Zea mays
ctcgaggggccggccgggccggggaattcccaaaaaaaaaaggagagagagagagagctaactagtccccccccccaacacgaggagagactgcggcagcggagtgcagagagcggacgcaacgcaacaccgcccactctctatcactgacgatcgaagcgaggagcgcactgaagccagccgccgatgagtcgcctcctctcgcggcagcaccttgccgccgtccgtcgatctgcaccctttgcgtgcgtgtccaggtggctgcacacgccgtcattcgcgacggtgtctccgcaagaggtttcaggttccagcccagcggaagtgcagaattttgtgcagggcagctggacagcatctgctaactggaactggatagtcgatcccctgaacggtgataaattcatcaaagttgctgaggttcagggaacagaaataaagccattcgtggagagtttatctaaatgcccaaagcatggacttcacaacccacttaaagctccagagaggtacctcatgtatggagatatatctgcaaaagctgcgcatatgctgggccaacctgcagtcttagatttctttgctaaacttatccagagggtatctcccaagagctaccaacaagctcttgcagaagttcaagtttctcaaaagtttttggaaaacttttgtggagaccaggtacgctttctggcaaggtcatttgctgtaccaggtaaccatcttggacaaagaagtaatggctaccgttggccatatggcccagttgcaattatcacaccattcaattttccgttggagatccccttactacaattgatgggagcactatacatgggaaataaaccagtactcaaggttgacagcaaggttagcattgtgatggaacaaatgattaggttgcttcatgattgtggattgccagcagaggatatggatttcataaattctgatggtgccgtaatgaacaagcttctgttagaggctaatccgaaaatgacccttttcactgggagttcacgggtagcagagaaattggctgctgatttgaaaggccgagttaaattggaggatgctggttttgattggaaaattcttggtccagatgttcaagaggttgattatgttgcatgggtttgcgatcaggatgcttatgcttgtagcggtcagaaatgctctgctcaatctgttctattcatgcacaagaattggtcttctagtggtctgcttgagaaaatgaagaaactttctgaaagaaggaagcttgaagatttaacaattggtccagtccttacagttactacagaagccatgatagagcacatgaacaaccttctcaaaataagaggatcgaaggttctgtttggtggtgaaccgttagggaatcactcaattcccaaaatttatggtgccatgaagcctactgctgtatttgttcctctagaagaaattctaaaaagtgggaacttcgagcttgtgacaaaggagatatttggtccattccaggtagtcacagaatactctgaggatcagcttgagttggtcttagaagcctgcgaaaggatgaatgcgcatctgacagctgcagttgtctcaaacgacccgctattcctgcaggatgtacttgggagatccgttaacgggacaacctacgccggaattcgagcgaggaccacgggcgctccacagaaccactggtttggcccggccggtgatccgcgaggcgcagggatcgggactccggaagccatcaaacttgtctggtcctgccacagggaagtcatatatgacgtcgggcccgtgcccgagagctgggcgcttccttccgcgacctgattagctagacgaggatagactattccatgtcatcacgaggaataaaaggggaagataagcgaagccagcaggactggagcgaccgaccgagagcgagtggctgcatgcctaggcattcattctctgcacgcaactgcattttcaaccctggagaaaacataataaatgttcgttcccctgtacttgagatacatggtacttggaccggaatgtcggactagctcatgagcggacaagtcgtctgttcgcagctgcactcggttatcttcttaggacttgtttgttagattatatattataataaattttatattaacgcttagttcaaaatttgttaaattatataatgtaaacagattataattttaaacaaacatcgccttacatacttatataatctagttattatagatt

SEQ ID NO: 9316 - DNA, 2191 bp, Zea mays
gagagagagagagagctaactagtcccccccccccccacgaccacgcgtccgactgcggcagcggagtgcagagagcggacgcaacgcaacaccgcccactctctatcactgacgatcgaagtgaggagcgcactgaagccagccgccgatgagtcgcctcctctcgcggcagcaccttgccgccgtccgtcgatctgcaccctttgcgtgcgtgtccaggtggctgcacacgccgtcattcgcgacggtttctccgcaagaggtttcaggttccagcccagcggaagtgcagaattttgtgcagggcagctggacagcatctgctaactggaactggatagtcgatcccctgaacggtgataaattcatcaaagttgctgaggttcagggaacagaaataaagccattcgtggagagtttatctaaatgcccaaagcatggacttcacaacccacttaaagctccagagagctctaatgtgcaggtacctcatgtatggagatatatctgcaaaagctgcgcatatgctgggccaacctgcagtcttagatttctttgctaaacttatccagagggtatctcccaagagctaccaacaagctcttgcagaagttcaagtttctcaaaagtttttggaaaacttttgtggagaccaggtacgctttctggcaaggtcatttgctgtaccaggtaaccatcttggacaaagaagtaatggctaccgttggccatatggcccagttgcaattatcacaccattcaattttccgttggagatccccttactacaattgatgggagcactatacatgggaaataaaccagtactcaaggttgacagcaaggttagcattgtgatggaacaaatgattaggttgcttcatgattgtggattgccagcagaggatatggatttcataaattctgatggtgccgtaatgaacaagcttctgttagaggctaatccgaaaatgacccttttcactgggagttcacgggtagcagagaaattggctgctgatttgaaaggccgagttaaattggaggatgctggttttgattggaaaattcttggtccagatgttcaagaggttgattatgttgcatgggtttgcgatcaggatgcttatgcttgtagcggtcagaaatgctctgctcagtctgttctattcatgcacaagaattggtcttctagtggtctgcttgagaaaatgaagaaactttctgaaagaaggaagcttgaagatttaacaattggtccagtccttacagttactacagaagccatgatagagcacatgaacaaccttctcaaaataagaggatcaaaggttctgtttggtggtgaaccgttagcgaatcactcaattcccggaatttatggtgccatgaagcctactgctgtatttgttcctctagaagaaattctaaaaagtgggaacttcgagcttgtgacaaaggagatatttggtccattccaggtagtcacagaatactctgaggatcagcttgagttggtcttagaagcctgcgaaaggatgaatgcgcatctgacagctgcagttgtctcaaacgacccgctattcctgcaggatgtacttgggagatccgttaacgggacaacctacgccggaattcgagcgaggaccacgggcgctccacagaaccactggtttggcccggccggtgatccgcgaggcgcagggatcgggactccggaagccatcaaacttgtctggtcctgccacagggaagtcatatatgacgtcgggcccgtgcccgagagctgggcgcttccttccgcgacctgattagctagacgaggatagactattccatgtcatcacgagaaataaaaggggaagataagcgaagccagcaggactggagcgaccgaccgagagcgagtggctgcatgcctaggcattcattctctgcacgcaactgcactttcaaccctggagaaaacataataaatgctcgttcccctgtacttgagatacatggtacttggaccggaacgtcggacaactcgtctgttcgcagctgcactgggttatcttcttaggccttatttgtttattatatattctaacaaattttatattaaaaaaaaaaaaaaaaaatgttagattatataatctaaatagattataattttaaacaaaaaaaaaaaaaaaaaaaaaaaaa

SEQ ID NO: 9317 - DNA, 806 bp, Zea mays
ggagaagttgtggaccatctatggaggggacagatgggtttatctgtggagcagcagaagcgagctctcgagcttcggaacatggtaaatggtggcgaagaatcccttgaagaaaccagaacagatggtgcttctttcaaccctgcagcagctggtggatgctgccaaggcaatggtggcttcacctgctgccaaactgacctgccaaaggaaaaacaagacaagagcatcatagctgagcagaaccccaagagctctgacaaggagggtggtgctggcagcaagaagggggatacaaagacttgcccagtgcccatctggtttgagacctgggagagagctgacacatatgccgctcttgctgttgttgcagctgccgcagcggtgcttgtctccttcagaatctacaagaacctcaactgaagaacatgggagatcctggaagaggtgaccaaaacaagtataggtgaaacagcgtactgtgataaaagtctgggatgagaataaatttacctgtgcataatgctaggcttaggctatggctagcaaatcgttgtgcaaaatattgttgtgcattgtttacaaagtgatgtttgaaatagaagataacggcgatgaacaagccgttggagataaccttagaacctcaaagtagcttatctggagatggagacggtgttgaaaagatgttgctgccagtgttctcgtatgtgaactccttgtgaacctccactccactgcaatcgaagtttcgatgccttagctgctgtttatcataagcaaggcgatgggatcggcataaaaaa

SEQ ID NO: 9318 - DNA, 1757 bp, Zea mays
taaaaaaaagaagaaagctaaattacagcgggtcattcgtagcatgaaaaggcaacagcggaaatctgtcgaggaaactggttccagtttctattcacccctgacatatttaaaagatgcccagggttttgcggagaagcttttctctcggttgcagaaatgcaatgagcgatttgaggtaaggatgatgatgctaaaagtaatcgcgaggaccattgggctgcatcacttggttttgttgaacttctacccgtatcttcaaagatacgttcaacctcatcaacgagatgtgacgactctactcgctgcagcagttcaggcttgccatgatatggtacctccagatgctgttgaaccactgttcaagcagatagtaaatcagtttgtgcatgaccgttctcgtccagaggctattgctgttggcttaaatgttgtgagagagatctgcatgagaatacctttgatgatgaatgaggatctgctccaagacctcgttttatacaaaaagtcccatgagaaagctgtttccattgctgctcgttcgctgatcacattgttcagagagatctgtccttcattgttagtcaagaaagatcgtggccgtcctgtggatccaaaggctcggcccaaagcatttggagaagtcactgttgctagcaacgttcctggtgccgagttgctagatgaaaatatttcttcagaaggggaaagttcggacgatgagtctgatggttttcactccgatgatgagatggacttgacacctgcccctcctggaacagaagaaaatatggagggttcatctgttgcaaacaaacatgatgccgatggagataccaaagaggaagatgacgcatctgatgatgaagatggtacggatcaagatgactccaacagtgatagtgatgaactagacgatgactctgatgtggatgtgggtactgatatatctgatgaagacgaaggtgacgacggtgaactgaaagaaagcataaatggttcagaggatgaagctttagaccagaatgaagacagcgaagaggaagacaagtcaaaaggcagtggctctaaagcgcagaagaggaagttaaatgattatattggacagctaagttctgctgatgcaagccttcgagttctgaagaggttagcaactgccaagaaggctgaagaaccatctgatgaaactggtaaaattctatccgatgaagatttcaaacgcatcaaagaactcaaggcaaagaaagaggcgaagctggctttggctcagcatggactaatcaagggtgtcgacacaaggtctgtaacctttaagatgccatcatctgaccagctcagcaggaagcgtgtcgatccacttgagcttgaggctcacgtcaggagaaagatgtccaaggaagaaaggttggcgttggtgaaagctggaagagaggatagaggtccttacatggcaagggcggccgtgaaacagaaaaagaccggtggactgagcaataagcagaagcagcacaagaagaggatgcccctggcagcgactagagccaaggcagcacgttcccggcaggagaagaagcagcagcgcaagcgctccgggaatcagttcaggggccgcaaggcgtggaagtgagagagcctgctgccgctttgcgattcatcgtagccgagtggccaaattttttttgttgactctttgtatcttcttctgccagataatgttttccatataatacctcgattctatgagaaggcttttccat

SEQ ID NO: 9319 - DNA, 1127 bp, Zea mays
gccggccgggtcggcttcctgaaccctgtgtcgctcacggaaccacggtcctagcgccgccgcgagagtcgtgacgacacatggcggccgcactcctgccggagacggcgccacggctgctgacgccggagacgctccgcacggcggcgaagcagtcccagggcatccacctcgtccccctctccctccgccgcgccatcaagcgctacctccgcgaccaggacagggcgcacatgaaccgcaaggtgctgctgctctcggcgtccttcgaccgcgccaagggcaccggagccgagctagccgcggccgccactcgcgccgcgctcctcgacgaccccaacgcgccgtcgggcgccgagcagcggtcggcgcgctggaaggtgcggtcggcctacggcgatattggcctccggtaccgcgaggacgagacagttgcctacgtcgcgtcacgcatgccagccatctacgccgcgtgccaccgcgtgctacgcgaggttagacgaaggttgccagagtttgcgcctgccaaggtgttggattttggcgccgggccaagttcagctctttgggcaatgagggcagtgtggccaaaatcaatagaggggctcatcctggtcgagccttccaaggaaatgcaaagagcagggcagagtcttctcgacaatctgaaggggttgccacttattcacagctatgacagcatccaagagttgaaccgcaaaatagaaaaacatgagcgaggccatgatcttgtagtatcatcttatgcacttggcgagattccttctttgagtgaccgaatcacaatagtgcgccagctttgggacctgacgagtgatgttttggttttgttagagcctgggacacctcaaggagcaaagatcataagtcaaatgcgctcttatattctttggatggaaaaaagaaagtgtcgcaaaattgaaaaatcctcaagccgtcctccaagtagcatgaagagtatcgtagcacaaaaagtctcattgaaaaatgggtcttttgtggttgccccttgtcctcatgatggtcgatgtcctttggagaattcagacatgtactgccactttgtccagagattggagaggacgtcatctcaacgtgccttcaag

SEQ ID NO: 9320 - DNA, 2872 bp, Zea mays
gcacgagaccattacctagaaccgcctaatcgcgagagagtgttggtcgcctgtgccaaattccgctgcccggcggcgaatttactcctctcagcctctacttctcgggttcgagctcaacccggcgggccactgctgcgacaaaggactagcaaggtttcattgcgctcaattgctatggctaccacacaagcctcagaagcagctgctgacaaaggattgcctctggcagtggacgctaccatggttgatgagtatgcctcccagtcaaagttgctgcaagaatttgttaaaatcccaactattggcaaggcttggatcttcaattccaaggatgacgacatgtccaaagcagtggtttcgattggcaaatcagatcttttggccaataagaggagacaattccttttgaatactcacatttcaaagagtccctcaaagtctgtcgattttcagtggtcccccttccctactgaaataagtggagtgtcagcaatagttccatctccatctggagaaaaacttcttctagtacgcaattctgaagatgattcccctacaaaactagagatttggggcccatgtcagttagagaatgagatacatattgcaaaatctgttcatggatcactctatactgatgaatggtttgaagggatatcatggaaccaggaagagactttcatagcttatgttgccgaggagcctcctcaaccaaagccagtgtttaatgattatggattcaagaaggaaggtttatcagaaaaggactgcaagagctggaagggacaaggggattgggaggagacctggggagaaacctattccaagaaaaggattcctgcactgttcgtcatcaacatctccagtggtgaagttcgacctgtcaagcaaatacctagatcattaagtgttggccaagtgatttgggctccatcatcttcatatagcttggtttttgttgcatggtcatctgacaatgggttccaagggacaccaaggaagcttggtattaaatactgctacaacagaccatgtgctctgtatgctgctcctgatcctttcggacaagaagctgagaaatcgttaactgagggcaataagggtgaaactacaactatgatcaaattaacagcaaacctgagcagtgcctttttcccacggttcagtccggatgggaagtatcttgtcttcatctcagcgaagagtgctgtagatagtggggcacacaatgccacaaattcattgcatagaatcgaatggtgtacagatggaaaactggatgggagccttggagttgctgacgtggtgcccattgtgctgtgccccaaagataactgttttcctgggctatactgctttggcttgcttagggatccatggcttactgatggacaaactatgattatatcttctgtctggggaagtagggaagtaatactttctgtaaatgttgtgagctgtgaactttcaagagtgagtccccaggactcagattattcatggaatgttcttgcagttgataagaacaacattcttgcagtttccagcagccttattacactccctcagatgtactatgggattaaggtttctcagactgaaagcaattgggagtggcagggagtttcaactcctttcccaaagccatctgataagatcagctccgtactagcagagcataagttcagcatactcaaaatcccaattagcaaccctactgacgaacttgccaatggggctaagcttccttttgaggctatttttgtgtcgcataaggattctgcaagtaatccaacaatcgttgttcttcatggtggaccacactcagtttatccatcaagttattccaaatccttggcttttcttttttcgcagggatataatcttcttgttgtgaactacaggggttcattaggctttggggaagaagcactgcaatcccttcctggcaatattggttctcaggatgtcaatgatgtattgacggcattggaccttgttataaagagaggactaatagatccatccagagttgccgtagttggaggttcacatggaggtttcctgacaacacatttgattggccaggctccagatacatttgttgcagcagctgctcgaaacccagtatgtaacttatcattgatggtgggtacctctgacatccctgattggtgctttgtcgagatttatggaaaagaagggaaaaagtacttctcagagtctccttcagtagacgatctttgtcaattccaccagaagtcaccaatttcacatattgcaaaggtcaagacaccaacactctttcttcttggagcgcaagatctcagagttcctgtttctaatggcctgcagtatgcaagggctttgaaggagaggggaatcgaaacgaaaactattatcttcccagaagatatccatggaattgacaagcctcagtctgatttcgaaagcttcctcaacataggggtttggttcaagaagcacatgggcaaataaacattagtgcttcccattacattcatgatttactttttcattgttactaaatgcctgtaactgggtcaaagtatacgatagcatgatttgcctgtccaatctggtgtttgccaagatggaataattcttgaagacatagaagcccgtgtttgttctagtgtggattctggaataccaactgtagctagtttatgtaataatcttctaataaatgatgtttatgtgttaatgtgaaatggtgggtgcttttgaattgtattcagaaaaaaaaaaaaaagctgaccagatcactgctgtttagttccccctaaaaaaaaaaaaaaaaaaaaaaaaaaaaaaaaaaaaaactcgaggaggccccgcgtaccca

SEQ ID NO: 9321 - DNA, 1048 bp, Zea mays
ttgggtacctcgaggccggccgggccgaaagaagcatgatccaagctagcagctcagctctccactccctctctgtgctgtgctgtgtagtcgttcattcatgcacttggcgttcttgcaattgcagcccccttctcctcctcatccttgtcggggcagttagctaggtgagaatagtgcagtggagctcaacaggccagcgataagcaattaatggaggtagaggcttgctacaactatggcttcctacctgcagacagaggcaggcaccaaccaccacctgcaccacatgccacccttcctcacgctgcagaggatgcaggtgagctgtgggagtacttcccttgccccttttgctacatcgaggtggaggtgcccttcatctgcaaccaccttcaggaggaacattgctttgacaccaggaatgctgtttgccccatctgcgccaacaatctagggaaagacatggctgcacatttcagactgcagcacacgcatcttctcaagaggaggaagccctacaggccaagctcatgccctgcggctgccaccagcccagcaacataccaagtgaactcttactatgaagaggcagaaccacagcagcactacagcaggccatacaaagatcctgcacctgacccactgctctcccagttcatctgcagcgtcgatgcggtccctggtgatgacaacgcccagaaagatgatcagaggctgaagttgaacaacaagggagcgacagcgagcgacgacgatgcatcatccaaactggggctggaggagaggctgcagaggatcgactttctgacggagatactcatgtccaccattctttgatgtcttgttaccgctatctagggtttcttgaggatttgtagcaatggctatcaggatgtgtctccatgtcacgtaagcaaaagcaattccatgtccacatgtacaccatagccttggctacctatatatatatacaatgaagtgccatactttggccatccttgtccgtccaaaaaaaaaaaaaaaacccacaaaggcccctagggcc

SEQ ID NO: 9322 - DNA, 1068 bp, Zea mays
aaggaagaagcatgatccaagctagcagctcagctctccactccctctctgtgctgtgctgtgtagtcgttcattcatgcacttggcgttcttgcagttgcagcccccttctcctcctcatccttgtcggggcagttagctaggtgagaccgtgacagtagtgcagtggagctcaccaggccagcgataagcaattaatggaggtagaggcttgctacaactacggcttcctccctgcagacagaggcaggcaccaaccaccacctccaccacatgcaacccttcctcacgctgcagaggatgcaggtgagctgtgggagtacttcccttgccccttttgctacatcgaggtggaggtgcccttcatctgcaaccaccttcaggaggaacattgctttgacaccaggaatgctgtttgccccatctgcgccaacaatctagggaaagacatggctgcacatttcagactgcagcacacgcatcttctcaagaggaggaagccctacaggccaagctcatgccctgcggctgccaccagcccagcaacataccaagtgaactcttactatgaagaggcagaaccacagcagcactacagcaggccatacaaagatcctgcacctgacccactgctctcccagttcatctgcagcgtcgatgcggtccctggtgatgacaacgcccagaaagatgatcagaggtaattcagatctttttcagagcgctggttgtgccagtaacagtatcactatccagccccagctgggtttttgtttttttttccatcaggctgaagttgaacaacaagggagcgacagcgagcgacgacgatgcatcatccaaactggggctggaggagaggctgcagaggatcgactttctgacggagatactcatgtccaccattctttgatgtcttgttaccgctatctagggtttcttgaggatttgtagcaatggctatcaggatgtgtctccatgtcacgtaagcgaaagcaattccctgtccacatgtacaccatagccttggctacctacatatatacaatgaagtgccatactttggcc

SEQ ID NO: 9323 - DNA, 2425 bp, Zea mays
cgccgccgacatcaaggtgctcgtcttcggctccaagcttgtcggcgctgctgggggcgtccccgccgccgccacgttcgccaaggtgcccgcgctgaacgggatcttccgccaggcggtgcgggcgctgcatgtcttaatgcgcatcgagctcaacgcacccgtcaaattggggaagagggatgctggtgaaaccggtgaggggaaggaggaggcactggtggtgctggccacacagctcgctagagcagtgcaggcactcagcaagctgagcattgcccgggcacggctctgtgcggagagtattgctgatgctgagcttcgggagaagcttactggtggcgttagcgttgatgatttgaaggggatgcttgacaatgttttgattgattcagatgccgtatcagtcttgaagggggtgtacaaccactggctcaagttcagggcactttcttgcctgggaagcagctgtggccatggcagtaattgaagcagacagttcaattgagaagccacaagctgctgttgagaatgaagcagccagtgtaactgaggagccactggctggtggggacaaagcaaagggtgacaagaagagcaagaagaagaaaactttgggtaagggtacttctgctgtgctcatgctgcttagggaccatgtgacaaatggaagtactgttgctgccatgaattctgcgtcggttgcagagtgggcaacctctctgtcattgctatttgatcccaaatgtccaggattggagtcacttgtggagaaggtgaaggagattgttgagagcaatgaagtgaggagattgcctaaaattccaaagggtacacgcgactttggtaaagagcaaatggcgataagggagcgagcattttcaattataactagtgtattcaagatgcatggtgctactgcgcttgatacacccgtatttgagctgagagaaacccttatgggaaaatatggtgaagactcaaagttgatatatgacttagctgatcagggtggtgagctttgctctttgcggtatgatctgactgttccatttgcccgttatgttgccatgaatagcattagtgcattaaagagataccaaatagcgaaagtatataggagagataatccatctaagggaagataccgagaattctaccaatgtgactttgacattgctggtgtatatgaacctatggaaccggattttgaggtcataaaagttctgactgaattgctgaatcagctggatataggcacatatgagataaaattaaatcacagaaagttgcttgatggtatgttggagatttgtggtgtgccccctcaaaagttcagaacagtttgctcgagtattgacaaactggacaagcaaacattcgaacaggtgaagaaggaactggttgatgagaaaggtatatcaaatgaaactgcggatgaaattggcaatttagtgaagactaggggccccccgttggaagttttgatggagttgagaaaggagggcagcaagtttatgaataatgtagggtctgttgctgcactgaatgagctggagatattattcaaagctctggataaagcaaatgcaataagcaagataacttttgatttaagtttggccaggggccttgattactacactggtgtcatatatgaagccgttttcaagggtgcagctcaggttggctccatagcggctggtggtcggtacgacaaccttgtgggtatgtttagtgggaagcaaatccctgctgttggtgtgagccttggaattgagagagtctttgcaatcatggagcagcaggagaaagaaagaaatgagaagatccggcctacagagacagaggtgctggtgtcaattctgggaaaggaccttaccctagctgccgagctcgtgagcgagctgtggaatgctgggataaaggcagagttcaagctcactaccagggtggcgaaccacatcaagtatgccttgcaatcaagcattccgtggatggtgctagtcggcgagtctgagctgcagaaaggaactgtaaagttgaaggacgttgaagccaaccaggaagaagaggttgataggaaggattttgttcgagagttgaagaagagattgagtaaatcctaagaggaaaattttaggcgttgatatcatcttttgacacccatttgacgcaaactcaattagggggagaatgacattacatcattataatttaaactgacgtgaatgtttcagtccggttggcatagggccccttgttatgttcataaggtcattcgaatcccctgagtcccaatgcattatgctgatgaatcaggctgcagacatattgtgaattatattctttttgtactaccttgaggaatgaaaagtttttgtcctcaaaaaaaaaaaaaaaaaaaaaaaaaaaaaaaaaaaaa

SEQ ID NO: 9324 - DNA, 924 bp, Zea mays
aaccgcggggggagagcctaaagagggaatgggggccttgtgtgagggacaagggggcggttcacataaccacttggtgcgaggaaaacaaaggccccaaggggactggggggttttaggggggaggggggggaatttcaaaccaagaagggtttgggggggggggaaaaaggtaaactccctttggggattttatatagggagcaggggcattccctggctgaatttaggggttaagcgctcaaggagggcttggctgcatcgccagaggcgagggagacagttgtgaggtcatgtgacgctgagaaggccaagttcatggcagaaatagagaacctcaggaggaagatagaggaaatccacgccagcaaggaagcggccgagaaagcagcgcgcaacaaagatgcagaggctgacaggctgaaggatgagctggcgaggatccggctctctgtgtcacagctgcaagcgtcctgcgacgaacttgatgccaagcagtcgcgcctgaacgacgagaagaactctgtccagaaagcactagtgtccgagaaggtcgaaggtaacaagctcaagttaaaaatcgaggaactcgagaatcacattgctggcaaggacggtgagaaagggaaactgaaggcggcgttggaggaaaagatgactgagatcaatgctctcagcaaagacaacgcgatgctacatcgcacaattctcgaggcgcaagagaagaataaaggtagcattttatcgttcttgtcaccgtgcggctccaagtaacttggttgtaatgtgttgcattactaatgcaatggtgaaggtaccatgcaatgaaataaaaatttcagtttgctctgtgaatatcaaaaaaaaaagggcggccgctctaaaacacaataaagagggaactgggaggggggaaagtggtct

SEQ ID NO: 9325 - DNA, 847 bp, Zea mays
ttaggcagctcaggcgctcagctagctagcaagcagcagcagcagctctcaaacctttctttctacctcccccgtctctttcgttcgctcccagacattctagccctctcgagtagctagctcgagcggtgcatgcatctgtagctacctagccgacatgggcaaagatgaggagggcgcgcgtgcgctgcttcgtgccctctctggtgttggcgagaggccggcccagcaggcgcgccttccgcgcatggcgggacagagacgaccaaggaacggaggtggcggtgatcgtccaatccgaggctgaaggagctagctaactggtggtgtggtggtggtgctggtgtgtgtagggtctaactcgatcggcgatttcggcggcggcatacatgggaaagccaggcatttttctcgcagtccaacaagtaccctttccgttagctttcctctccatgcagcattgcagcattgcacggtacggtggtggtggttaatcaacagctagtcttagtttcaatgaatccatcgtcgtcgatctaagaacactactgtgtttttttgtttttggcattgttctcttatccctctcttaatttaatttgggatcctttattagggcgtagtaataataagttgaaggagctgctactgctaggttctttttgtagacccaaaatatatagcgggggggtatgtatatctgcattttgcttgatcgaggtgcgatgatacgacttgctgctaaatcaaaggtttctctcttcgtgttctctctctgtcctttttgtaagattattccaacaagtagtaatgcatatgttgtcgagaacgaaaaaaaaaaaaaaaa

SEQ ID NO: 9326 - DNA, 1144 bp, Zea mays
ataccgccgaaccaatccacgtccgcagaaaccacactcccgtcgagggggaggcgtcgacttcccatagtttccactccacttcgatcctatcctatcctccccaaacactccaccaagaaccttttccccctccaatagtccaagttactcggaggaatccatgtgcggcggtgcaatcatcttggactacatcccggcgcggcgccgggtgtccgccgccgacttctggcctgactccgaagccgacgccgaggactccgactcgcacgcccctgaccctgagagagcgccgcgcccgcgcgggaaggcgaagcgtgggcgcaagaaccagtaccgcggcatccggcagcggccgtggggcaagtgggcggcagagatccgcgaccccgtgaagggcgtgcgcgtctggctcggcacctaccccaccgccgaggccgccgcgcgcgcgtacgaccgcgctgccaggcgcatcaggggcgccaaagccaaggtcaacttccccaacgacgcctcctcctccagcgtcaccgcgccgacggcggcatctggggtggcggcacaggccccggccgtttttctcccggcgcccaaggtagaggcgcgcgcacaggtgtccgacgaggtcaaggagctgtccgaggagctaatggcctacgagaactacatgaacttcctcggcgtcccgtacatggagggcgggaatgcagctgtaagtgccaccaccgctgccgctgccgctgccgccgtccccgaagaagcgcaggtgccggcgccagcgccagccgggctgtggagcttcgaggactactactacccgccgtcactgtcgctcttcactgaataatgaacgcggtttgccgtgcctgtgttgttatctcttttgtatctgtggctcgcgagttgaggcatgtaaacaagctttgcagttttttttttaactccggtctgtgcttctcagcagctcgctgcggtgcagaggaatctgtttcattctgttcgtgattgaaactagttttacggttacaacgcgcagatggaggatcggcggacactcggaccattgtaacaaggcttgcataccatttggaagattttaccatactgaattggcgacacgcatcaaaaaaaaaaaaaaaaaaag

SEQ ID NO: 9327 - DNA, 1298 bp, Zea mays
gtcataccgccgaaccaaatccaacgtccacagaaaagaaaacacattcccgtcgactcccctagtttcatcctattcatttctccccccaaacactccagctactagttactcgaggaatccatgtgcggcggcgcaatcatcttcgactacatcccggcgcggcgccgggtgtcgacagccgacttctggcctggttctgaagcagacgccgaggacattcatgcctcgcactccactgacccacagagaggtaagccctgcttccgtctttctctgctctccaggcgacaacacgccatccaggcagcaagctgcaaacggtcaatggtgtgacgccgtgctgccgactgttcgcatgcagcgccgccgccgcgcgcgaaggcgaagcctgggcgccgcaagaaccagtaccgcgggatccggcagcggccgtggggcaagtgggcggcggagatccgcgaccccgtgaagggcgtccgcgtctggctcggcacctaccccaccgctgaggccgccgcgcgcgcgtacgaccgcgccgcgaggcgcatcaggggagccaaagccaaggtgaacttccccagcgacacctcctccagcgtcaccgtgccgacggcggtgtcgaggtctgctgctgctgctgctgcacaggccccggccgttctcccgctgcccaaggtggaggcacagactcaggtgtccgacgaggtcaaggagttgtccgaggagctgatggcctacgagaactacatgaacttcctcggcatcccttacatggagggagggactacagctgcaagtgccaccacagctgccgcctccgcggccgccggcgtcgccgaagaatcgcaggtcccggctccggccgggctgtggagcttcgaagattactactacccgccgtctctgtcgctctttactgaatgatgaacgtgctttgaccgtgcctgttttggtaacacctttgtgaacagatttcctgctcgtcgtagtcggtgtgatgtgatggcatcaatcgagctcctgtcctgtaattttgttgaacccatccattgtttcgtgactactgtgtgtccctgtaactcgcaagttgaggcatcaaagtttccagtttaactcaaaaaaaaaaaaaaaaaaaatactcacccaaaaaaacgaaaaaaaaaaaaaaagtacgtgattgaattggttttacgggtacaacgctgtaacacccggctttaaggaacaatgtcaggtgcatctcatacatgcgccaaaaagacaacatatataataacagagtgtatagagataaa

SEQ ID NO: 9328 - DNA, 1052 bp, Zea mays
gtgggtacctcgaggccggccgggataccgccgaaccaaatccaacgtccacagaaaagaaaacacattcccgtcgactcccctagtttcatcctattcatttctccccccaaacactccagctactagttactcgaggaatccatgtgcggcggcgcaatcatcttcgactacatcccggcgcggcgccgggtgtcgacagccgacttctggcctggttctgaagcagacgccgaggacattcatgcctcgcactccactgacccacagagagcgccgccgccgcgcgcgaaggcgaagcctgggcgccgcaagaaccagtaccgcgggatccggcagcggccgtggggcaagtgggcggcggagatccgcgaccccgtgaagggcgtccgcgtctggctcggcacctaccccaccgctgaggccgccgcgcgcgcgtacgaccgcgccgcgaggcgcatcaggggagccaaagccaaggtgaacttccccagcgacacctcctccagcgtcaccgtgccgacggcggtgtcgaggtctgctgctgctgctgctgcacaggccccggccgttctcccgctgcccaaggtggaggcacagactcaggtgtccgacgaggtcaaggagttgtccgaggagctgatggcctacgagaactacatgaacttcctcggcatcccttacatggagggagggactacagctgcaagtgccaccacagctgccgcctccgccgccgccgccgccggcgtcgccgaagaatcgcaggtcccggctccggccgggctgtggagcttcgaagatactactacccgccgtctctgtcgctctttactgaatgatgaacgtgctttgaccgtgcctgttttggtaacacctttgtgaacagatttcctgctcgtcgtagtcggtgtgatgtgatggcatcaatcgagctcctgtcctgtaattttgttgaacccatccattgtttcgtgactactgtgtgtccctgtaactcgcaagttgaggcatcaaagtttccagtttaactccgggggggccaacacaat

SEQ ID NO: 9329 - DNA, 1405 bp, Zea mays
aaacacccatcttggcattgaaccgcgccgaagagatgacttggaatctcttggatatgtactcatgtacttcctgaggggcagccttccttggcaaggtcttaaagcaggaacaaagaagcaaaagtatgagaaaattagcgagaagaaagttgcaacatcaattgaggctctatgccgtgggtatcctactgagtttgcatcatatttccattattgccgctcactgcggtttgatgacaagcctgactgttcatacctcaagcgattattccgtgaccttttcatccgcgaaggttttcagtttgactatgtctttgactggacaatactgaagtaccaacagtctcaaattgccactgctccaccccgtgcagtaggccatggcgcggggccttctgggttggcacccgtgttacagaatgataggcaatcaggccctgaggaagcaaggactagtggttggtcatcaatggatcggcgtcgtgccccactaccaattacaagtgtggggacattatctaagcagaaagcaccgatagggaatgatgctactgtttctagagatgctgtgatatctggaccaaattttatgggaaggtcaagtggatcttctaggaggcctgttgtttcgagtagccgtgatatggtggccactgacagttccgagccttcacgagcacgtgcaaccgacgcaagcccaggggcgttccgcagagcctcaggtcctcagagaagctcacctgtccattccgcagaacagaagcgctcatcctcaggccggcatccgtctaacgtgaagaactacgattctgctctcaaaggcattgaaggtcttcattttgatggtgacgagagggttcagtactagagccgcaggaaattctacatgcactgtaaaaatcataatcaggtggtaagcatcgtgtttcctgttcgggttttggatcaacaggaaatgaaatgctggaaggaggatctggtcacgggttgtgcggtttcaggtggtcctctgagcaaggtaaataaacggtcctatctgaggcgcttcatgcctagctctcataacgttgtcgttgtgtacgtaaatgcctcttgtagcctgaatgtcaggcgcccggattcatgaatctattttattgttgtattccttacgatgttccatcttgggaactacaatgctgcaactggtagggcttgatttggaacactggaattcgagcatgtagaatttttaaatcggttcattggacgaatttgtctgtaacacgtacctgacttgtaatgtgatatgtcaggacaactgatgttatttgccaatgtgataatcagttcatccaaaaaaaaaaaagaagtgaggaaagagagtgagaaactggaggtagagtggggaagagaaggaaga

SEQ ID NO: 9330 - DNA, 1427 bp, Zea mays
ttttttttttttttttggtaagtatttttttcgagctcgcaagagaagtattgtatttagagattaggaaaaaagagcaaaaaaaagagagacaaatataaccgtacacaatcgcacatcccctacaccagaggtaacatgcgcgggctcaaatcacaggatggtgcagacagacgtggacgaaggcccctccgcggcggccgccttgtcgccggccggggcaacgcccggccaatcgcggcaggcgcagtgctggccctggggaatctggcggtgcacggaggcgacgtggcggccgcagcccgcccacgtggacttgccgcacgacccgcacttcacctggtagcacatggctgatggctcccgctggcttcgcccctctagctgaagcttccccctcgactcgaagtcgaagcgaaggtatctgaagaaatctgggtcgatgtggacgatgtctccgaggccggcggagctggttaccttttgacctcactgcgcagcgccgccctgcgcgggagtggaggcggcggtgccggagtccttcccagcgtcgtcagcggcgctggcggccttcttgacgccggccggggcggtggcggggtcgacgccgggccagtcgcggcaggcgcagtgctggccctccgagatctgcgcgtgcaccgacgcgacgtggcgggcacccggcccacgtggtcttgccgcaggtgccgcacctcacctggtagcacatggcgtcggacggtggcttcgctgagagactctcgactctgcctctgctcctgatggggtccggtccggatgggaagctcgatgggttgtggtggtcaggtgctgtggctgcctgccttgtgggtggatgacggttggaactgatcatttatagaaggcccattgccgtctaccactgctttcgcccctcgctcggtccattgggcccattggcccttttattcctgtttgtaataaaaaaaaggaaagaaaaaggtaaaaggggctcagtactattactccgtagtcctgtactgacattgaggccttgtttcaagttccaagttggtcccgtctccattgaattgaaaccttaccgatgaatggactttgacattgactggaagcagaaggcaaagaaaagtcagcaaacgaagaaccagaattcgttggagcggaggtgcaacgacctccattcccaggcgtttaaaacaccgtcaaaagtcagaagaacattggcttagccctgtttggtttagctttctctagcctctgaccacaaaaagttgatgtagagtgtcaaacgcttagcttttgaaccagcgtatgtacgaatcgatttaataaaaactatccaaaattaaagtaaacacgttgtaatagtaagagtctgtcgttttctagttcctgaatcctatgaacacattcatctttctaat

SEQ ID NO: 9331 - DNA, 4126 bp, Zea mays
  misc_feature (561)..(561): n is a, c, g, or t
  misc_feature (571)..(571): n is a, c, g, or t
gggctccgtgcccctctccacttcgatcgccttcctcgacagttcattgccatcggcagcgcgtggccgccgctcgactcgacttgactccactctgctcgagggttttgctggagtcgagttcggtcggcattgttggattgagctttcggcttgggggaactattgtaaggggtactgacataatcatgaagcttttcatatttcgatgacaggattgtgggatctcatatacgtgttttagaaagagatgaaagtcggcggtctcctgacctctgctggaatcaacatcggtctctgtgtactttttctgtcactgtactccattctaaggaagcagccacagaatgttaaggtctattttggaagaaggattgctcgcgagcacaaccggctccgtgatgcttttatcttggagagatttgtcccttcccctagctggattgtgaaaagtctgcggtgcacagaggaagaaatcttggctactgctgggttggatgctgttgttttcaatagaattctagtattcagcatacgcatcttctccttagctgccattcntttgtgtatnttggtgtccttccgctgaattattttggacaagatatgcatcatgtccggattccttcagcatcattagagacatttacaataggaccatgtggaagaaagatcaagatggctctgggtccattgcgtcgtactgtacatcatctctgctgtagcttgcattcttctatacttggagtacaagcacattgccaggctgaggttatatcacatttctagagcaacaagcaatcctagccattttactatccttgtccgaggaattccaaaatcaagtacagagtcattcagcaggacagttgaaagtttctttaccaagtaccatgcatcaagttacctatctcatcaagtcgtttacaaagttgggaaagttcagaagatagtgagtggtgcaaagaaggtttacaggaagttcagacatttcaagggtgcgacagttgatcggagatgcagacccattagatttcaatgctgtttttggggagcttcttctaattcattccagttgttgcctagtgattacgagcaagagagtgaaaagtctgatgtgaatgaatcaagctcgagcttacctgatgaggaatgtggcgctgcttttgtgtttttcaaaactcggtatgcagcgctagttgtagccaaaattctgcagacatcgaaccctatgagatgggtcactactttggctcctgagcctgatgacatatattggtctaatctttggttaccctacaagcaactctggattcggcacatagtcacacttatgtgttctatcgttttcatggttgtattccttataccagtgacatttatacaaggtttaactcagctggagcaactgcagcaaaggctcccttttctgagaggaatattgaaaaagaaatacatgacccagctgataactggatatctccccagtgtcatcttgcaaatatttttatatactgttcccccgaccatgatgtttttttctactttggaggggcctatctctcacagtgaaagaaagaaaagtgcctgctgtaaagtattatacttcaccatttggaatgtcttctttgtcaatgtcttatcgggttcagcaattagccaactgaatgctttatcaagcccaaaggacattcctatgcagcttgctaaagcagtacctgtgcaggctacattctttactacctatgttcttacttcaggatgggctagtctatcatcagaacttatgcaactctttggtcttacatggaactttttaagaagatatcttctgagaattaaggaggatagtgattttctttactcatttccctatcacactgaaatgccaaaagttctgctgtttggactgctgggtttcacatgctctgtactagcacctctaatcttgccctttttactgctgtacttttttcttggctacgtcgtctaccgcaaccagttcctcaatgtttactgcacaaaatacgacacaggcggtcaatattggccaattgcgcacaatactacaatattctctctaatcctcactcagatcatctgtcttggtgtgtttggccttaaagaatcccctgtagctgctggcttcactgtcccgcttatcatctttactcttctattcaatcagtattgcagaaagcgtcatctcccattgttcaagactttccctgcacaggttggtgcgatctctttaaatctttaatagcttctagtttgcaaatgtaaacagttgaaggattcagaagaataaattttaggagtgtttggttctcttggctgcacttcctagtcttgcaagggtaagaaatccgtactagcgttggagagccagtttggtggcacttacaggagggaaccactgccaaaatcaagtcctcttggtaataatggctagttataagttggcaaaggaaccaagcatcatacccttatatcttgttgctaccttacatttttatttatgctctcgactgtgagttggttgaaattacttgtctagatatgaatcactctgactcgaatattggctgttggtcacgcacagaatttgattgacatggacaaggaagatcagcaatcagacacaacggaggaccttcatgaacgacttcattctgcctactttcagttccctgataccgacgaggtacctttggaaagagttcgcgttagtgtcggcagagacgaagacgggagcggcagttcaggtgaatcaagccgcaaggaaagcgccgaagacgaacacaagagtggcctctcccacccgacgctggatgggctcccggttagtcggttacgcaacgcggtgagatcacttgggtccgttttgagaccgcagaggagacagttaccagtatagcacatttcctttaaccgcccatgtaaattcaaggtcgacagaccacacacacagatcattgatagcgcgtacagggagaggaaggtacacagacagaaatggaagagagtataccacccgtttgcaagggtagaaaattttgatgtgtcaattgatacttgatgaatggcttttcaggtcattccttttcaattgatcgattcttgaaatattcaggctggcccctctggtgatatgtaccccttcgccttttaaaagacttgctggaaacagcggcgatgcaccattattctttcccaccatcacacaacaaaatgataagtatttttttcgagctcgcaagagaagtattgtatttagagattaggaaaaaagagcaaaaaaaagagagacaaatataaccgtacacaatcgcacatcccctacaccagaggtaacatgcgcgggctcaaatcacaggatggtgcagacagacgtggacgaaggcccctccgcggcggccgccttgtcgccggccggggcaacgcccggccaatcgcggcaggcgcagtgctggccctggggaatctggcggtgcacggaggcgacgtggcggccgcagcccgcccacgtggacttgccgcacgacccgcacttcacctggtagcacatggctgatggctcccgctggcttcgcccctctagctgaagcttccccctcgactcgaagtcgaagcgaaggtatctgaagaaatctgggtcgatgtggacgatgtctccgaggccggcggagctggttaccttttgacctgcaaaaccgatgcttggagagggggcctagtcgcctagggaagataacgatccggctggcctatgctgtattgccgtcacatgagatgtgaggcacagctcttcgcttacctcacccaagcagtgagccaaattggcttatctttcattctattatattttagtttctaacttactaaataataaaattaaaatttttgtatttagtaattttaagattaaaatagaatgagatagagaaactaaaaattaaaccctaaaaatcaaacaccgtacccttaccgccgtaaaccttatcgacactcgtgtaagtgcgttgaccttcgaagacaaatggcccgtcctgcgattactgatccgatcaaagtctttcaagtccggcaacctctaccatcgatccatcgtccaaccaaaacg

SEQ ID NO: 9332 - DNA, 536 bp, Zea mays
atcaaaagccaaaatccactcagacccgaaaaacaccgacccaacggggattgattgctcaaacggggcaacgatggatgaccacacgttcgttcgacacggcgggttccgatcctcagggaacagaacaccacgcggtgggcggcgcgaacctcactgcgcagcgccgccctgcgcgggagtggaggcggcggtgccggagtccttcccagcgtcgtcagcggcgctggcggccttcttgacgccggccggggcggtggcggggtcgacgccgggccagtcgcggcaggcgcagtgctggccctccgagatctgcgcgtgcaccgacgcgacgtggcggccgcacccggcccacgtggtcttgccgcaggtgccgcacctcacctggtagcacatggcgtcggacggtggcttcgctgagagactctcgactctgcctctgctcctgatggggtccggtccggatgggaagctcgatgggttgtggtggtcaggtgctgtggctgcctgcctttccggcccggccggcctcgagg

SEQ ID NO: 9333 - DNA, 1233 bp, Zea mays
tcgggagacgccacagcgctagcggcatagccggcgacagaaacaaccgatgccactcctcgccgtctgtccccgccgcgttccgccgctttcgctcgcgcgccgccaccgccgcagcttgtatcgggcccggtccctcgcgctcaaatgcgaggtctcctctcctccgctacttctgacccggaggatgtccgccgctggctcgctgcttgtcgctgtcgtccccgtccccgcgccgtcgccgcaactccccgtcgcctccgcgtcggagttggagacggagacggcggaaggagagagcggagcttctgaggggttagcattggagcgttacaccgaccaggagcagggcttcaccctcctcaagccggcctcctggcccaaggtggagaaggcgggcgcgacggcgctgtttcagcaggagggaaaagggagcaacaatattggggttgtcgtcaaccctgtccggctcaattcgctggcggagttcgggacgccgcagttcgttgcggacagacttctgcaagcagagaagaaaaaggaaagtaccaagtctgccgaggtgatttcagtgggagagaggtcaggtcatggtggcttgacagtgtatgagatcgagtacatgctggacagcacaaggggagggatgaagcggatcttctcgtgtgcgtttgtcgcttcaaggaagctctatctgctcaacatagcatattcagacacccaggagaagcccttggacagggagacaagagccgttctggaaaaagttctccattcttttgattctgtataggtgatattattttttatagccgaggtgtggcaccttttcttattttcggaatttctttcacttgaaaatacagtcgcaagtaattgtttgtctgtaaaatgagtgctgaccaaaatagctgcagtgtccatatgtccaatactgttgcacttgcacctttatcagtgatttcaggttataagtaatttcagttcagataatgagcttcatcttctacagattggtagtatttgtgtcaccaggcagtaaaatcttgtgaccttgattcctagcctggcattactgcatctgtaatatcctggggtggtgacaatgttattccttgaaaaatctgtaacgcctattgaactccctaaagtttatctgaattcaggatcagttcatttaaatgctggtctgtgctgactgctaacttgggcacaatttttgaagcaggggta

SEQ ID NO: 9334 - DNA, 2414 bp, Zea mays
acccctgatacaggaccgtattaaagagcttcgtgagcttgtaccgaatggggcaaaggtatgctcttgcatgaattctctgatgataatttgaaagtttgaatcatatatctgatctacaaactacctacagcagtgtactaacaattgcacatttatgtcaatagtgtagcattgatggtttgttggagaagacggttaagcacatgcttttcttacaaagtgtgacgaagaatgcagacaagctcaaggactctaccgagtctaaggtatgcacgttctttacagtcatgttctggccttctgggttatgaaatgactaagataagatagtgacggtatagcttacctgacaaggatctcaaattattttacttaatcctccatagttgcaaaatgtccttaatacaaagagtcttcttcaaccagatacttggtagtgaaaatggccccctttggaaagactacttcgaaggtggggctacctgggcttttgatgtcggctctcagtctatgacatgtccaatcattgttgaggatcttgaccgacctcgtcagatgcttgtggaggtaatgactatcgtactacttattgtttatggcactatgtttcacctagaacgcatgtgattgtgatgacttggttgcctctacagatgctttgcgaggatagaggaatcttcttggagatagctgatttcatcaaaggactaggactgactatcttgaggggtgtgatggaaatgcgcaaaagtaaaatctgggcacggttcactgttgaggtaatgcagctaaatttaataatcaggattctttcagatcaaaatctgaagtaaaaaacagtaactagaagttcaaaatctgaagtaataaacagtaaccagaatggaaatccaaaggaatgagatgacgctgttccatgcaggcgaaccgggacgtaaccagaatggagatctttctatcgcttgtgcgcttattggagccaaactgtgacggcagtgcagcggcggagaacgctagcaacatgaacatgcctcttggcttggtgcaccaacctgtcatcccagcaacaggcagcatccaatgagactagaggaaaccctgaagcatcttcccaagtgctaagagcaggagctcaactaacttctgcagtgactagcatcgccaatatgccagtgcatcgcctgcttttcctgagacatcttaatccgtgcaaatgtgacatccttcatgagaccaggtcgcagaaatggaagaaggaaaacaacgccaagagtgattgttaggcagtgttttgtttgtatgatcttagtttgtttgttagttagcgctgtttggtcgtatattagcggatttttttggtactgttattcagaatggaaattcttgggttggtttatttcacaccaaaaaagagagatggaataccacctttgttataaatcttctcacatcagaaccagttagcatgactagtggaaaaacacctgagcagatttgtcattgctccgaacagatactgctgctgcctggcaacattcagaggtactagatcactggattctagctgaggccaccaacaaacatctcactggagcagcattatccacaatgtcatctaacagcacatggtgctgccaatgaatcacaatgtgctatgtttacagtaagcaaaacaaatactgaattgctgcagataatactagtaggccaatttctacagcatacactaagtccagttccaatatacccttttcgcatactttactgtataccccccaatccctatgatctacatataaaatcttgtacaatgtttgggtatcaactagttacctatcctcctatacctatatatacatcgccccatgatatatatcccatctttacattcccagcaagacctatgagtccaagcttaactgctttatatacgcaaagcatatttaggcttgaaccctttatttctatacaagctctaaattaattgatcgatggagagatgatttgattaattgcgtggacgactgctatgctatgcgtcctaagggagctaggccacgaagtccctcatgagctgcgccgcgaacgacttggtgctctgcatgttcatgtcgtagctggtggcggcgccgtggctgccgctgtcgccggccgtggtgctgcccatgaggaacgacgcggtctgctcggcgctgcctccggcgccgtgcgggaggccgagcgtcagcgacaccccgccgttcccagcgaacgcgaagggctccgtggtgaactgcccgtacggccccggcgcgaacagcgagtacccgccgccgtcctggtggtggtccctcacgccgccaccgccgccgctctccatgaacttcatgaggagctcccggtggctgacctcctcgtgctgctgcatcgcg

SEQ ID NO: 9335 - DNA, 2528 bp, Zea mays
  misc_feature (1700)..(1700): n is a, c, g, or t
agtcgacctgcagtggttcccatgtagcctgctcggtagtcatgcctccccactggacgagaacatgccaaatgcctcgtcgaagactggcctgtaggaccttgtctggtactggcaataagcgaccctgtgctgttgggggcaattgtggaatctctgttggcggagtgccgtgaaatgcctttaagagtcccacatgaaaaacatcatgtaaacgagcgccggctgggagctgaagtctgtaggctactaacccgactcgttccaaaacttggaaaggacctgcatactttggtgccagcttgctgtgtgctttgtcaaccagggagcgcattggcctatgtaggagtcgaagccagacccagtctcctacctcaaaagtcacttcccggtgatggttgtcataccaacgcttggcatgctgctgtgcttgaagaaggcggtcccgcacctctgccaggaaattgtctcggtcttgtagcaggtcttccacggtttgggattgcgccgtgccctgttggtatggtactagtgccggaggctcacgtccgtataccaatttgaatggtgtagtctgcagcgctgagtggaaggatgtattatagcaatattccgaccatggaagccagtccagccaggaacgaggtcgatctcctgtgatgcatcgcaagtacatatcaattgtgcgattgacgacttccgattgaccatctgtttgggggtggaacgcattgcttatccggaacttggtgccgcacggctagaataataattgatatagtgggccaggggctactgggagcacttcactcacgataaacagggatgtatgcgagtcgggaatgcccattgagagaggttcctcgttgctagtggagcctggtgcagataatgacttgtttgatatgcttggttctgaatttcatcagttctcccacaacgttgggtctgatttggtcacctggagtggtacagagtctcagaattcagatagagatggccctgaatcatcaatatatctcaatagctcaccccttttcagttcgttagacaacgagcttcactattctggtatcttatcactaactgatactgatcaactattggatgctgtcatctcaaatgtcaatccaagtagtaaacagtgtcctgatgatagtgcttcttgcaagactgcattgacggatgttcctagcacatctcatcttggttcaatagacttgaagagatgtgagtcctccggcgttccttcagtgctaattaagcacgaattggcacagcttgttaagcaaccatgtatttttgacaaatctgagaactgtctttcccaaaataatggaatgcacaagtctcagatacgcctttggattgagagtggtcagaacatgaaatgtgaaagtacttcagcttctaacagcaaaggtcttgatacgccaagcaaggcgaatcgcaagagatctcgacccggtgaaagtgctaagccacgacctaaggaccggcagctgatacaggaccgtattaaagagcttcgtgagcttgtaccgaatggggcaaagtgtagcattgatggtttgttggagaagacggttaagcacatgcttttcttacaaagtgtgacgaagaatgcagacaagctcaaggactctaccgagtctaagatacttggtagtgaaaatggccccctttggaaagactacttncgaaggtggggctacctgggcttttgatgtcggctctcagtctatgacatgtccaatcattgttgaggatctttgaccgacctcgtcagatgcttgtggagatgctttgcgaggatagaggaatcttcttggagatagctgatttcatcaaaggactaggactgactatcttgaggggtgtgatggaaatgcgcaaaagtaaaatctgggcacggttcactgttgaggcgaaccgggacgtaaccagaatggagatctttctatcgcttgtgcgcttattggagccaaactgtgacggcagtgcagcggcggagaacgctagcaacatgaacatgcctcttggcttggtgcaccaacctgtcatcccagcaacaggcagcatccaatgagactagaggaaaccctgaagcatcttcccaagtgctaagagcaggagctcaactaacttctgcagtgactagcatcgccaatatgccagtgcatcgcctgcttttcctgagacatcttaatccgtgcaaatgtgacatccttcatgagaccaggtcgcagaaatggaagaaggaaaacaacgccaagagtgattgttaggcagtgttttgtttgtatgatcttagtttgtttgttagttagcgctgtttggtcgtatattagcggatttttttggtactgttattcagaatggaaattcttgggttggtttatttcaccccaaaaaagccagatggaataccccctttgttataaatcttttcacatcagaaccagttagcatgactagtgaaaaaaaaaaaaaaaaaaaaaaaaaaaaaaaaaaaaactcgagagggg

SEQ ID NO: 9336 - DNA, 2137 bp, Zea mays
ccggccgggatcgtaacgttcttgtatcggaagcaaaagcaggccagcacaaaaccactcgatagaaaagcccccctcaaaacccacggcgccgccgcagccgcgttcacgaagcttggggaggcgagcaccccgatccggcgaggtgccgcgagcgaggcagcgatgagaggccgtgcgtcccatctccgcgcgctcctctcgcgagcgctctctccaagccttcctcctcctggtcgcgctctgcctcaggtcactaggcccggtgcgtctccgttcggagctggattcgtggggcgcgcgcgcttcttctccatcgacgcctcggctgcgacgcagggcgggtcgaagccccctgcgccgccgccggcgggtactgcgggcggcgagggagggggtggtggtcagtctgggaaatctgaacaagcggacgccgggaaagccgtccgcggagggccggtgtcttggctcagttttctactcctgcttgtgactggaggagggataatcgtgtactacgacaaagaaaagaagcgtcacattgaagaattgaagaatagaacaagtgctgtgaagcctggacaatcagtaggcactgcagccattggcggtccattcaagcttttgaatcatgatggaaaacctgttactgaaaaggatttcttgggcaaatggacgctgctttattttggatttacacactgtcctgacatttgtccagatgaactccagaaaatggctgcagcgattgacaaaattaaggaaaaggcaaaactggatgttgtgccagtttttattacagttgatcctgaaagagatactgttgagcaggttcgggactatgttaaagagttccatccagatctagtaggcctcacgggcacgacagatgaagtaagacaagttgcacgtgcttatcgagtttactatatgaagacagaggaggagggttctgactaccttgttgatcactcaattgtcatgtacctgatggacccagagatgaagtttgtcaagttttatggcaagaactacgacacagattcccttgctgacggtatcgttaaagaaattaaagagcacaagtaaacagtagttggaatgccactttgcaacgtcagccttgtttctgaatttctcccgagagttttgttaaatcaagcaaaaaccaaatggcacacgagatcatgtggcaatagctgatgacatttgaatctcgcggcggcttttatttcagcagattcgggtgcacatgttgcggttttgtgcacgtttttgtcacggcaaacttctgcgttattagcttgggacgctgttcattgctgaatgtaattttatttgcatagtttcataccagttcaatatgaaacctttttccccttctgctccctctgttttttgaatatttggtttccaataaaataagaacacatcaatttgtggagtttctaaatgaaaatttatcataaatagttagaatgtccccctttattaaaacgaccggatgcgagcactctccttccatctactcttatggctcactaaccaaacaaaaaacggaatgactatgctctattctaatcttaaaccaaacaaaaaataaaataaataaactatattctatttgccaaatgcataatagaacaactcaattctcaaaaactgaaatggagccgtttcattctggttgactctccaaccaaacgcacccagtgatgtgtttggttgaggagaggagaagaatgaagcggttccattactattttctgtatgtttggtttctaataaaacagcagtggcacagctcctagagttagtctttatatgaaaatttatcataaatagttgaaatgtttccgctctagcaaatcgacaagatgtgagcgctcttccgacgtgagtgctctcctcctctctacacttatatagctctccaaccaaataaagaacggagcggctacactctgttctactcttcaatcaaacaaaaactggagcgactctattctgtttatcaaacgtagaatagaatatttccattctaaaaaatagaatgtagccgttccattctagttgactctcgattctctaaccaaacgcatcttaagtactcaaaaattgtcagcaggaacgacag

SEQ ID NO: 9337 - DNA, 2832 bp, Zea mays
aattcggcacgagggatgcaaccacctgacaatggcatctctttgcgcgccctcggcgctcctcgaccacccccatcgccgtcggagacgagcccctgtacctagccgtataaaggcggcagggcttagacaaccgccggcaggcttcccgggcccctagattctctctcgcgcttccgctttccttctcctggtcctggccatggcccacgaacgggagccgctcctgcagcaacgacagaccggcgtcggcaatgcctgcggtgccaaggactcgtcctcggcgccggcgccgtcggctgccgcgctgccgtcgctggctaggaccgtgctcaagttcctgatgtgggcggtgttcctcacctgggccgcggggatcttcctctacccgaccaagcccgtgcaggccgtgttcaggaagtgggtcgggctcaccagggactccatgttcggcatcgccgggggtattttcctgaccttcagcgcgccaattctgatcattgcgcttctcgcatatgtgtacatctccttcttcccgagtgagcatgtggtggagaaaaggaagctgcgctcactgagtttcaggctctggactttccctgttcttgtagacggcccctttggagttgtctctgcagttgagttcatcggaattgtcttgtttatagtttttgttgtctactcaatgacctattatgccgtggaagctgtgagccttgtctcgaaatttgacatcccatcaatgactgagagtgaattgatactggatgtcattggcctccgtttaggggcggttgggttgttctgcatgctcttcctcttcctgccagtcgcccgaggctcggttctcttacggcttatcgatattccatttgagcatgctacaagataccacgtctggttggggcatctcacgatggctctctttacattgcatggcttgttctatgtgatctcatggtccatgcaagggcgcctccgtgaagaactgagacagtggaaggaaattggagtagcaaacctgcctggtgtgatcagcttggcagccggcctacttatgtgggtgacatcacttcacccagtgaggaagaggttcttcgagctcttcttctacacccaccagctctacgtcgtcttcgtcgtgttcttggcgtttcatgttggtgacttcatcttcagtatttgtgccggagctgtgttcctcttcatgctcgaccgctttttgaggttctggcaatcaagggccaaagtcgacatcatttcagccgcctgccgcccgtgtgggacggtggagctagtattctcaaaaccagcaagcctccactacaatgctttgagtttcatcttcattcaagtgcgcgagctatcgttcttgcagtggcacccgttcagtgtatcttcaagtcccatggatgggagataccacatgtcggttctcataaaagtactcggcacgtggactgaaaaactgaggagcatcatcaccgatgtacaggagaagaacgggggtgactctgagctgcaatgcgggcgcatgacagcctgcgtggaaggcccatatgggcatgaatcaccctaccacttgatgtacgagaatctcgtcttggtcgcaggaggcattggaatatcgccattcttggcgatcttgagcgacataatccacaggatcgaggagggcaagcaatgcatgcccaagaacgtgctggtcctttggtcagttaagaagtccaaggagctttctctcctgtccgccgttgatgcccagaccatcagctcatctgtctcggacaggttgcaactggatatccaggccttcgtgactcaagaaccccatcctcctttggaggatggcatcgtcggggacgaccagaaagtccctggcatgttcgtcaagaacggtacagccatgtctgggctggtcggcaccggggacaacttctgggcggccatgtacttcctggcgtccacgctcggcttcctcctggcgtacgccctggtgcaggtgtactacgtgaagccgcacaacgtggtggcgtggtggtacctgggcctcctgttcatgctgtgcatggttgccggcgtcgctctacccggcgggctcgtggtcctcctgtggcatctgtcggagaagcagaggttggaggacgacaagtgggacgcctctcagtcaccgcgcgccgagcagacaggccccttggctgcggcgggtggtggtgacgacgacgctgctcccagcgtcagcctcgccgccctgcggacgacccggtacggctgccggccgaacttcgaagcggagttcgcggcgttcgcggagcgcgccggggacgcggcggacgtgggcgtgctggtgtgcggaccgcaggggctgcagacgagcgtagcgagggagtgcagggcgcggaacctccgccgcggcggcttgggggcggccaagagcaggagcggcgcggtcttccatttcaacagccacagcttcgacctgtaaactacgtacgtctcgtttggtcggttcaacgatcatcagtacatgttgcacagcacacacgcacagacgatagttggatgtacatgttgatccgtcataatttgatatcgtgtatatatatgtatagctgatagttaatatagttaagttatataagagatgtataaatctgtatgcgtatactataggtgtagcatatgcatgcatgatagaagcacgaaggttaaatgctgacgaatcacgtgaaatcatgtcatgtttcgcgtctaatgcgtgaatttgtatttttcttatgcgtttgtgagtacgtcaaaactacgttgcaacgcaagatttatctttgggcg

SEQ ID NO: 9338 - DNA, 1271 bp, Zea mays
ggaattcccgggtcgacccatcgcgtccgccctcgcgtccgcccacgcgtccgcccacgcgtccgggttcgttgtgggcatgcaatgcatgccctagtacgtgctggtccttaggtcagttatgatgtcctaggagctttctctgctgtccgccgttgatgccctgaccatctgctcatctgtctccgacaggctgcaactggatatccaggccttcgtgactcaagaaccccatcctcctttggaggatggcatcgccggggacgtccagaaagtccctggcatgttcgtctagtacgggacggccatgtctgggctggtcggcaccggggactacttctgggcggccatgtacttcctggcgtccacgctcggcttcctcctggcgtacgccctggtgcaggtgtactacgtgaagccgcacaacgtggtggcgtggtggtacctgggcctcctgttcatgctgtgcatggttgcgggcgtcgctctaccgggcgggctcgtggtcctcctgtggcatctgtcggagaagcagaggttggaggacgacaagtgggacgcctctcagtcaccgcgcgccgagcagacaggccccttggctgcggcgggtggtggtgacgacgacgctgctcccagcgtcagcctcgccgccctgcggacgacccggtacggctgccggccgaacttcgaagcggagttcgcggcgttcgcggagcgcgccggggacgcggcggacgtgggcgtgctggtgtgcggaccgcaggggctgcagacgagcgtggcgagggagtgcagggcgcggaacctccgccgcggcggcgtggaggcggccaagagcaggagcggcgcggtcttccatttcaacagccacagcttcgacctgtaaactacgtacgtctcgtttggtcggttcaacgagcacgtacatcatcagtacatgttgcacaccacacacacacagacgatagttggatatacatgttgatccgtcataatttgatatcgtgtatatatatgtatatctgatagttaatatagttaagttatataagagatgtataaatctgtatgcgtatactataggtgtagcatatgcatgcatgatagaagacgaaggttaaaggctgacgaatcacgtgaaatcatgtcatgtttcgcgtctaatgcgtgaatttgtatttttcttatgcgtttgtgagtacgtcaatactacgttgcaacgcaagatttatctttgggcgcgttggtgtgtaaaaaaaaaaaaaaaaaaa

SEQ ID NO: 9339 - DNA, 5488 bp, Zea mays
  misc_feature (1636)..(1636): n is a, c, g, or t
ctgcagaccccgccttaaatgtgaaatccacacctcgccttaccttttccaccaccaatataacaacttcggcaacaacaacaacaaattaagaatgaactgattactcaggtcaccgtctacaactcgagatatacctttggagtcatcctcgccatatcaggcaacataaggagaacacgaggagggtgcaccatcgggccaccgagggctcccacaaaaactcttaattgtcacatatccctagaaccttggcagcctaaagtgggcaccacctaccttcgcacacacaaactcttcaaagattcgcacaaatgctccgccaactctcatagagcatccacccccttgggcgacacctccgtcacggcaccctcccttcacagtcacaaccaccaatagggttagcccttcgcagaaatcactttctgtgcccgacaagctagtcagcttatagtaaaaccaatggcgatgccactgtgcaggccacttgttcctctgcgtagcgtgacagacagacggttgggagctgatgattgaggacgctagcttttagtgttggaccttcattattgggctaacaatttataggggtttgtaagattattgggccaaaaactagggccttagggcttaggcccaggcccacacttggtctctgatattgcatatctatgtggtatctggtatgttttagtgaatgttactatccaccttaactaaggtgtttgatggattgatctttgagaaaactgacactgttgtctatactgctgtgtgcatgtgtgactataaaaaaatggtagacaacactgtatgtttaactgcaagaaatgttccagtattctcgattgttttgtattggtcccatatgatccatgtgcaacttaagaaatctggatagacaactatataagtaatactaaatgtagacaatatatatgtttaggtttgtgtgattggaatgaggcttaatttcaagtaaggatgtcataaacttaatagtacacatagggttaccggagagaaatttatgtgtactatgttgggtaactctgtgcaaggcaatttatgtatattttttgtcattgaatttgtatgacctatgagagttaccagttagaaattattacagttccagtgagatattgtcgttatcggtgatcctagggacaggcttgtacaacatttgatcgatgagtcagtgggcctaaagaaaataaagcagcccaagatgatctccatcatgggaatccgtggctccggcaagaccgcacttgccacagaggtgcatgagaggtatgttggcttgcagttctacaggcgtgggtttcttctactgacaggctctaagaaaggtgcatttctttgaggaaattttaagcatactaccaaactctctttagtattcatggtttgtttaaattgccggctgcatattagcattgcatttctagattgaactacatagtagcattgcatttctagattgaactacataatgtaagctggctggatccaagaagctcctaaagcattgattattctttttcaggcatcttagactatctccagcagcttacccatccccatacccatattcaaactctactctgcgaacagcgcaatctatagnacaaaacagtgcttttgggtaaactatgggtagactgctgcagacggtcttaggacagagaaattcaataactccggacacaatttggataaaatgatgatcaacatggtcaacttttcatctgacagctgcaacctaaaaggtatgtgataatgttgttgcacaaggaccgaccatacccgggtatagggggagggatgaatcacgtttggataagttaaaatcgaaaataggatcaggacatgcagacgaaaatgaactaatacgaatggaatttgacggaaacgaacgggagatagaaacttaattcggaaatagacatccaatagacaaattcaaagctggtatattagataagttggtataatattatacacagttgttgcatacataaattgaagcacatgtcccacttcaccatttgaggtttggagaggggaaactaattgaagcacatgaaatttaaaggaggcgaccatcctcgccatccatgtttggcgaggtcacgtagcacacattagggagggctccagggagctatcgggagtggcacgaatgctaagggcgcaaccatagagcgaagatacggtggtgatggctccctcccaggagcacccgcgcctagggtttccctagggcgctggcggccggcctggcaggctgtgggagctgggctgcatgggctgcttggtggtttgggtcacctgctggctgaggtgaagtctgggctgctgggtcagcgtgtagttgggctggtgggggtggtgggccacagcagggaggaggcagagtgggccaaccgccaagctggctgcaggccggatagagaaggaaggagggtttccttatttttcagctctgttgttttagagaaaacaaactctaacccaaagccaaaacctaatccaaaatacgaatcgaatactcaagcaattacactttgtgaagagcactacctgatttaatagtttcttttgaaaaagatgagagagagagttattaggtttcattttataaataatagaaaatgcttgtgagagttgcatgttgaattcgagtgtaggctcaaatttagacaaagttttttttctcgaaattattttatttttgattcacctttatcatagtgttgacttggtcaacatcactataaggatttgtgttgcaaacgattttgaaattgtggtttgaaagtgagacaaggtggaaaagttaacttatgtttgaccaactgtttacacacattcatgcagttttttcgtgaaagttggtctttttataaaacgacaaaaaccggtatgttacaagaaatttggatgaatgtccatataattcctaatggtaagatcaattttgatgtagtttgatatgcaacagctaatgtttagagcataattgtatatctactgttggaacagtaacttataatatgttaagttggctattgcaagtcaaacatttcttaccactattgcttactttatctgaatattcaaataaaattttgtgatttcaatgtacataatttgaaattgaaattaggcttgcattatatatatatatcttaaataatgacaaccatttctatgatataacttgcctataaagttctttttgctgtgttatgactcgcttgagccatgccagatagaattgtatgagttgcacaccacatgttggttgagtgttgccaaccatttgtacaaccacattacaccaagggaattaaacagttaaatcactcgggtggaaattcacttattaatcataggggttgggtacctgtcttgaatgcagttttacaaatgtgttgtatgtgaagcattccgttgtttgtattgcattccaaataataaatcaagtacagcttaagcaaaattctggatacagctcaccgcaaacgtaaatatttaatgctatctataacctttctggcagaagacaaacgtcaaacgcgtgatatagaccacgcgctacacacagtatcaccaagcccaaaacataccaaaaaaagttgaaccaagtggttgagaattccccttttgctctcatggccatggagaacactgcgccatgcggtgacttcgggaagatcgtggccgatcttgagtctgagaacttggtggctaacgtctctgccgtgaatcaagcctcggcgttgattgctggaggtaaaatccctgaaccccagcttctgtgccgcctgatcgctggtcttgcttccaatctggagaagcctgaccatgactctgccatcaagaggtgtgtttcctttactctaaaggcaatcagggtggccgtcatcaagaaccgcatgaacatggattcctcagctcgtggtgaggctctccatgccatctggtgttgttttatggatcaaggccttcgccgtattcagcgtgattcaaatatggtgaggctgtggacagtccaggatcaactgtctgcagtcaaaatcatatgtactttcttccgtctctcaccggtaaacatcagtgacacaaggtgtgtcacagccttcgcctcactgatgttgtcaccgtacagcactgtggtgtgtgcatgtgcagatgccctgctctctttgccccctgttgttccaggattttcatttgccattgcaagagcctattgccatatgcttgcaacagtgtcaccacaatcaccacttgaggtaagcagcatggttgcgatgcttggtaggctgaagcaagtaagtacgaccatggtccaccacccagggtttagtgaccttgctgtggatgtcctagcagctttatcaaattgcaatcttgctgttcgaaagaatcttctgaacctgatggtgaggctcctcactccaaggaacatcagtgctgtgctattgctccttgataatgagctgaatagggctgctaacatccatatcgagtaccacaagatgctagaggaggcgatcagagaatgccatgctgcttttccggggtgtattgtagaattcacactagatcccaagtacagtgtgttcattgatagtattctgtacatcatagacatcatgaatcccgaccagtcgttgcgaggcccacttctgaaaggtctactaagggcgctccggcatgtgaagtcaccactggtatgcgccgctgctgtttgggccatctcaatgttctctggatcactggaagaggtcagtgatgccattgttgcactttcatgcttcttcaaggacctgcttgatcgacgtaagattgagaagctgatacttggaggcgaagcggagaatcaatacaagctttctactgactattatggtgtcactgccggagatgcaacacagggaaagcaccagcagccatggctgatggagatggaggaactgctgtttgtgcgcatagggctcacacggcaagcaggtgggagctatgccattccttcgagttccaagagcagtgctagttcttcaaacgcgtatcttcctgagccattgggtaatacagacaatctgatcttcctcgtgcattctggagatgccctcttggcagatttcgtggaaatcatgctgtctaacctcaagaagaaggtcaaagagctggagtgatgctgatgagttcatttgatgtaataatttggaggtcaaataactagaaatggagtcgttgaaccttggccaatcgtacctcaatatgcataataatgctgtcttctgtgtgcttattacttctattattactatattatcactgatactttttctattcaacattttgccctctatttgtgtgacttgtgtggtctcatctagcctaccccaatctacatgagatcgaatatactctcatcgtggatggtatatatacacgtacttttggg

SEQ ID NO: 9340 - DNA, 664 bp, Zea mays
aaacgagtacgacgattgccggagtattttttttggcgagcgccagcggcaaacgaaccgtctccatttcattctccacttctccagatcccctccgcaatctaccttcgcgccggtaccgaaagccagcgaccgtggccatgcagtcgccggagctctcctcttcctccccggttctcctcaatatagggggcaagaagtacgcgacaaccgtggagacgctgatgcagcgggagcccgactccatgctcgccgccatgttcagcgggcggcacacgctccatgatcacccaaccacggggaaggggatggtcttcgtggacagggacgggaagcacttccgccacgtgctcaattggctcagggacggcgccatccccgtgctgtccgagtccgactaccagcagctgctgcgagaggcagagtactaccagttgctcggtttagtcgactacataaacgagaggctgggttggaaggaaaccgacaattcggaggctgaattgacacgaaaggacgtgatcaagtgcatacaaacgcaaagagtcaggttccgtggcgtgaatctatctggccttgacctgtctaagcttgacttatcagaggtggacttcagctatgcatgcattaagaacactgatttttcatatgctaacctttacaa

SEQ ID NO: 9341 - DNA, 1218 bp, Zea mays
acttcgtgctcgagcagctggcgagcaacctgaagcggacctccaccatcacccggctgagcgcgtcctacgtgttcaagggtctgagcaggtcttcttctgtcccacctctgagcgcggaggtggccgccgaaggccgtggcgcggacgacgacgccagtggccgcgagcacgagcggcccctggcgtccctggaggacaagatcggccgggtgcgagatgaggccagggaagtcaccgccgccaacgccgccgttgaagggatgaaggacgaaggcatctcggatagtcttctcgtgctggtggtacgatcagttccatggcttgtgcttttcgctcttcttgtgctgtcttgagcgagatcgtttgaacaatgcacgctgttccttctttgcaggggttggtcggtcccgtcggcaagctgcggcccgcgatccagcggataacctcgtgggagcggccgcttgtcactggcagcatccttgccgcagcttcgctgatcatatacaagtgagcctacacacgcatagctagctggtcgtcttgtccatgtgtctaaataaataaatgaatcggaatcagaaacgtaatgccgcatcttcgctgatcatatacaatgaatggttcagttacgtgctagctgcgtccctggtgctggccgccggcgtgatggtctgggcgaggcagaggaagataggggagctatgctcggaggtgatcatcgatgcctcttcgtcgtcgtcgtcggacaagacaacgatggatagcatagtggaggcgcagcgaagcctgcagaaagtgcacaggtacatcgtgaccgcgaacgttgccatcctcaggctgtggtcgattgcgctagcaaggtcgccaaagcacacagagacggtgatctggatgctggccgtgtccgcggcggtggtagccgtggtcccgttcaggtacattctgatcgggctggtggcggggagcttcgcgtcgaacacgagggtcgcgagggccgtgatgaacccgcagggcggccggcggtggagggagtggtgggagtccatacccgccgtccccgttcggacggtgcacagttgacaaaattatattttcctccactacgtaaaatgatcggtgcggtacacagagcagacgctcgcagaaggaacccgttatagaagcctgtttgttcaggaagagtaatgaaaatcatcgaggacctgtttgttcgct

SEQ ID NO: 9342 - DNA, 1424 bp, Zea mays
atattttttggcgagcgccagcggcaaacgaaccgtctccattccgttctccacttctccagatcccctccgcaatctaccttcgcgcggctaccacggcgccggtgctgaagccagcgaccgtggccatgcagtcgccggagccctcctcctcctccccggttctcctcaatatagggggcaagaagtacgcgacaaccgtggagacgctgatgcagcgggagcccgactccatgctcgccgccatgttcagcgggcggcacacgctccatgatcacccaaccacggggaagggagtggtcttcgtggacagggacgggaagcacttccgccacgtgctcaattggctcagggacggcgccatccccgtgctgtccgagtccgactaccagcagctgctgcgagaggcagagtactaccagttgctcggtttagtcgactacataaacgagaggctgggttggaaggaaaccgacaattcggaggctgaattgacacgaaaggacgtgatcaagtgcatacaaacgcaaagagtcaggttccgtggcgtgaatctatctggccttgatctgtctaagcttgacttatcagaggtggacttcagctatgcatgcattaagaacactgatttttcatatgctaacctttacaaagcaaaatttgggcaggtagaagcttcgtcttcatctttccaaaacgcaattttgcgtgagtgtgagtttattggagctaatcttgaagaatctattttggatggagcaaaccttcgaagtgccaatttacaagatgcttgcttaacacgatgtagcctcattttaacagatcttcattctgcccatttacagactgctaatcttacacaagccgacttaagaggagctaatcttgaagcggccaatctcaagggtgccaagttgtcaggtacaaacttgcaaggcgcaaatcttcagagagcttacttgcgagaagttgatttgcgtgacactcaattgactggtgctaagctcggaggtgcaaatcttcttggagctatcagatgatctacagattgttcgtgtagcttcatactgtgtatactgtactacacaaattcattggaggtaatgcggcaggaccatctgcggagttctggtctcaatcatgatcgagaacacaaatattccttctgttcaaaaataaatcagttcctagaatgattctaagtcgaactatcttaagttcgaccaactttataggaaaggatggagtttatgtgctgttctttgtacgccgccctctgattggaagtttagaatctagcatgttagctgtcagagctgaaaccatcacagcaagcacatttgctgggccccgattgcagtggacagatgtacctgtattgctgttgattcaatcttggtgtcattccaaaaaaaaaaaaaaaa

SEQ ID NO: 9343 - DNA, 5759 bp, Zea mays
  misc_feature (2503)..(2503): n is a, c, g, or t
gttttgtttatcatgtttaaagttcttcgtttgttttccttataacaaatctatttggtggacctatatgtgcttgtactcagatgcagtacatgatatgatgtattataatttttttttgttatttttctaccttaacacaaggtggttggtaattattgcccaattttgattactttatgttacaagagtagattacatgagtggccgataagcactgtattttaatatacacggtggatttgttcgatgttaaaacttatgtaaaaattcttaactttaaaagatgataaaaacataaaataaaaaatagatttttttattttaacatatatcttagccaggtacgtacgttcacctagtatgggctatgggccgccttcactgcacactacaatcaatcagccggcttttcctctcttcccctcgacagaagcccccaaatccgataccttcccctatccacctcgagtcccttccttccttagcggcggcgcgaaggcggcggagccatgggcggagtcggcgaaggtgacgcgtgggcggatcaggagcagggcaacggcgggggcagccgtggtgttggcggtggcggcggcgaggcgaagcggtcggagatctacacgtacgaggccgcctggcacatctacgcgatgaactggagcgtgcggcgcgataagaaataccgccttgccatcgccagccttctcgagcaggtcaccaaccgcgtcgaggtcgtccagctcgatgaggcctcgggtgacatcgcccccgtcctcaccttcgaccatcagtacccgcccaccaagaccatgttcatgccggacccgcacgcgctccgccccgacctgctcgccacctccgccgaccacctgcgcatctggcgcatcccgtcctccgacgacgccgaggacggcgccgcctccgccaacaacaacaacggctccgtccgctgcaacggcacccagcagccgggcatcgagctacgctccgagctcaacggcaaccgcaacagcgactactgcgggccgctcacctccttcgactggaacgacgccgatccgcgccgcatcggtacctcctccatcgacaccacctgcacaatctgggacgtcgagcgcgaggccgttgacacccagctcatcgcccacgacaaggaggtctacgacatcgcctggggcggcgcgggggtctttgcctccgtctccgccgacggctctgttcgcgtctttgatttacgggacaaggagcactccacaatcatttatgagtctggttcaggtggcagcagcggcggcggttccaactctggcgccggagatggtgggactgcgtccccgacaccactcgtgaggttgggctggaacaagcaggacccaaggtacatggccaccatcatcatggacagccccaaggtggttgtgcttgatatccgctacccaacactgccagtggtagagctacaccgtcaccatgcccctgtcaatgccattgcgtgggcacctcactcttcttgccacatctgcacagctggggatgacatgcaggcactgatatgggatttgtcgtctatgggaactggtagcaatggcagtggcaatgggaatggtaacacagccgctggagcagcagcagagggcggtcttgatcccattttggcatatacagcaggggcagagattgagcagttgcagtggtcggcgacccagcctgactgggttgcaatcgcattcgccaataagcttcagattctcagggtctgatttcctagttccaccctgtttcagtgaggagtaaaaaatgctaaacttggataatgagctgatgcccggaggataatcttgcaattgctttactgttgcttatttatgttgtggacaactgatattcatggcgggttagttctagaaatagaacagaagactttctagttagaagctgaattgtcaatgaatttggtttgtagagtaaggaactgctctggtgttagcgatggtgataatgggaactgaatttagtttgttctaaaaaaaaaaattctgcacggtagcatgtagattcatatcttaacttgcttattgaaaatgcaatggtcatatgtgccctataactgataatattccccatgtgttatgttttcacttttgtgcctttttctgaatgtgttttgtgtattccacaacatggtgtgttatatctggtcattgaaccagatgttttccttgttatttctgggttgtagagcaagtagctatgcatattttgtcttgttaatagttggaattgggcactgcaactaagttattatttgtgcttgaatgttctgcttggtagcatttgcatgtatataactcttaaggttgcttgttcgaatttgcatccatcttgtatgcattagaagttataaagttgtattatgtattgataagctatttagtttcatgaatttctttggctgccttaattataatacctgtaaacctgtagctacagattacacatnttatatctcatccctttttttcgcttaatttgcatcctataatatatatgtatccttgattttatagcactaaatgctggtgtgttttgatccttgcattcaatatatagctaagctttgttgctgcaacaaaggattttttgttttcaaagaacaatggcataacaaagttcccatgcgtgttacgacgttactttgtaggtttccttttcctttgctgaaattttcaggtgattgtttaccactggactggataggaaggcatggctatgagatgtaagtgttaagctttccttgttgcatgacatggcacgggattcttgtcaaaactcttacatcacttagtcacatgtctgtatctttcttgtggactttgttccttgaaattatgttactctaaaatacagggacatatctctgtgttatgagctgaagcattgccccttcagtgtcttcagttttttaccaaccgtatggttgcataactgcaattctttaattgcgctcttggtttaagtttgcttcccagtcctatttgggcttcgaagttccaaaactgtatgaaccttcgtataactgagccaatgctgaaagccgaaaggttttgttggactcgactgctatcctctagtgtgggtgccacataggtccaaaagctttattctgttatccattgcttttaattgagggatttcctgaaaacaaaaagatgaatccaatattactatatttttgagaaacaaaaaagagagtaccggaattggtctttcatgtttttctagggcttgtttgggagtaaagatacctgagaggatagtaaggagaaaactcccaaacaagcttgtttttttttttgtactctcagttccctccctctgcagaatctgtttttactgtttcccagaggcaagttatgaatagggctgtttttactgtttttttgtactctcatccaacaccagtagacctccacgtttggttgcgggacatatcagctcagctgtggattggactagggtgacaatgagctctaaattttacgctataaatttaaggataggattaagatcagactttatttttatttttttgaactagaaacaatttagggtcctaataaattatgaagaagcatttggatcgtgattcattaccacctctagataggacagactctgattatacgatagactctcactatagggatggaatgttctgaaatggtctctagtcgtgtttggtgacgatcattgtttttgtttggtttggagataggtagggatagattgaccccatcctccgtttggttggagggatggagggggacgtgaggaatagatgcttatgtgtgggatgtgaggagactcagtctttctgggtatggctttgcccccacaattttgagagatagctagacaatatcaattgagaatatttcaacgaggatggtcctgcctgtcctgactctgacacaaaacaacccaatctaagggatcgttttatcttatcctgtcttggcattacaactaaacacactcttacattttatttagtagccatggctacgtcttttgagaacaaggtttggcccctacaatgaatgggaagaggatgagatacttatgtcaaccacttgtgtgccacacgaccaaactgaaagaacaatgtggtgcttttagctcatcttttgaatgaaaattttcctttgttatcttagtttttgtagacatgtctttcacatagaatacttgagttatatcatttgccaaaatgaatggtttatctttatatctaatattattgagatcaatgtttgtcataccatactctagatcatccattatgttgcctgcatttatcttaattaactagcactgaaatagagagatctttaagtaaggtctatagtcaagttcctagatctcctcgtcgtaacaagaatatgtcttcttagtatcatcattggtaatggcatatatacaggcgtcactattttggttgttcttattgtctctgtgcaattgtgtagaatgtatacctatttatcttgtattcttctaatgtaaagatcgagggaagacatacccctaatcaaccatgtcgttgatcatcaatgagtttgcaggttcatagaactactatgcctctgaaaatactctgaaagcacaagaacgttgaagtattatgaaaattcatttgctagtcgaataatcatcttttccttgcttctgttcttattattaaaccgaatcctctaattatagcatctgaaaagacatgaattaatagacctatctatttatcggtgcctatttatatattttgacccaatctacacgacatatcaaagaaacaacacccatagcgctagataaacattcaattgattgattccaccatgcaatcgaactaatcaatcaatccttaaagcaacggtcaacggaccagtgtgtccccgttgccgagtgagggcagtggaggcaacgatatgacgcgagttgcttcttcgtgcagccgtcaagtaggcaagtagcttcaagtcgttcgtcgtggagggcccgcctgggggagcagtgggtgtgccttcgcaccaggcgggggaggggagccgaggaggtgaaggtcgaggcccccaccatgttggacgtcgtcgccgagcctgtcccggacgacgcacccttcttctaccgcgtcgagtcgctcgagcgtggctgcgtgggtccggcttccacctcattctccttggacgggcgctcaaccacgaggactgtcgacttcttgcacgactgcgacgtcttcttctctatcacggttgccgcctcgtctttcttcctccagtcgtcccgcttcttctccagctgcagcttatatgacgcagcctcctcctcccccccacagggcgcgcggggtcggcatcgatgggatcgacagcgggcggagacactggtttggcggcgtcggcagaccggcatctccggtacccgacaccacctcgctggtttggttcggcaggtaggtcctcgcctagttgggtagctcggtgagcgggttggttggcaataccacctcaccgggttgctcgtcaagcgggttggtcggtcgtctcgccccgtcaggttgttcggtgggcgggttggtcggcagatctgccctgccggattgcttgaagtataggtcagtcggttagtggatcatctttgagaggtcttttaggtcttctttgaacagtcggttctcaggtacccgacataaaggt

SEQ ID NO: 9344 - DNA, 1640 bp, Zea mays
accaaaccgccccgccgagcgacccagtccgtcagcgagcacccctgtcgccgaagcccaggcagcagcagcgggcagcggcgtccgtccggtccgcgcgcgttcgttccccacttcccctccccgaccggcagattccccgtccacgcccccgccttaaaacgcccgccactaatcccgtttctcactgcccttccgcggctgtgctgtgctgttctgtgctctgctctgctctgctccccgtctttcctcctctcccggtctttcctcctctccccttcccgcccagcgcgtccccccgaggaaccaaccccgcggcatggggatcgtggaggaggcgcacaacctgcgagtggtgggcgaggggaagcgcggggtcatcgtgctggcgcacggcttcggcaccgaccagtccgtgtggaagcacctggtgccgcacctcgtcgccgactaccgcgtcgtgctcttcgacaccatgggcgccggccccaccaacccggactacttcgacttctcccgctacgccacgctcgagggctacgcgctcgacctcctcgccatcctccaggagctcggcgtccgctcctgcatctacgtcggccactccgtctccgcggtcatcggcgcgctcgcctccatctccaggcctgacctcttcaccaagctcgtgctcctctccgcgtccccaaggtacctcaatgatgtggactactatggcgggtttgagcaagatgagcttgatgagctgtttgaggcgatgcgatcaaactacaaggcctggtgctcaggttttgcgcccctgtgtgttggcggagacatggaatcagtggcagttcaggagtttagcaggacgctcttcaatatacgtccggacattgcgcttagtgttgcccagacgatcttccagagcgacgtgcgcagcctcctcccgcacgtcactgtcccatgccacattgttcagagcaccaaggatctcgcggtgccggtcgtggtgtctgagtacctgcacaggcaccttggtggcgactccatcgtggaggtgatgccctctgaaggccatcttccccagcttagctctccggacattgtaatccctgtcttactccgacacatccagcacgatatcgcagtctaggttggtcaatcgttcctccaagacgatgagcatccgaagctgtctacttgtctgtttgtatcttgcttaattgttcaacgtaggatcgcatctatttgatgttctaataaggtttcaaaggtgttatgtagtgttggcggtggaaagtgtagcatatatgtatgtgttatccattggtcgtctaatgtaggctaccatgttggatgctctgacatctgaagtccttcagaagctcttcaagaaaaaaaaaaaaaaaattttcccgcatgaaattaccatcttgtatatgttggtgtcgatgatcatcatttggggctgtaggatcaatgtgcttgtatagttctgggttctttgcgaagcacatagatcggaccaaattagcaaggaactccttccatgtgtatgaaaaaaaaccccaatgtaattgcaagttattcaaactcagttgtaccaaacgtccaaacctgattgaaacaggttgttatcggtcgctgtgattcgagaa

SEQ ID NO: 9345 - DNA, 1247 bp, Zea mays
ggcagcaggagcagtagcgtccgtccggtccgcgcgcgttcccctccccgaccggcaggttccccgtccacgcccggccattcatccgtttcccactgctcctccgtggctcagctctgctccctgtatctctgggtctgcccctctgctctcccggtctctcctcttcccgtcccgcccagcgcgtccccccaaggaagccccgacgccacggcatggggatcgtggaggaggcgcacaacctgcgcgtggtgggcgaggggaagcgcggggtcatcgtgctggcgcacggtttcggcaccgaccagtccgtctggaagcatctggtgccgcacctcgtcgccgactaccgcgtcgtgctcttcgacaccatgggcgccggccccaccaacccggactacttcgacttctcccgctacgccacgctcgagggctacgcgctcgacctcctcgccatcctccaggagctcggcgtccagtcctgcatctacgtcggccactccgtctccgcgatcatcggcgcgctcgcgtccatctccaggcccgacctcttcaccaagctcgtgctcctctccgcgtccccaaggtacctcaacgatgtggactactatggcgggttcgagcaagatgagctggatgagctgtttgaggcgatgcaatcaaactacaaggcctggtgcttaggttttgcacccctgtgtgttggaggagatatggaatcagtggcagttcaggagtttagcaggacactcttcaatatacgtccggacattgcacttaatgttgcccagacgatcttccagagcgatgtgcgcagcctcctcccgcacgttagtgtcccatgccacattgttcagagcaccaaggatctcgcggtgccagttgtggtgtctgagtacctgcacaggcaccttggtggcgactccatcgtggaggtgatgccctctgaaggccatcttccccagcttagctctccagacattgtaacccctgtcttactccggcacatccagcatgacatcgcagtctaggttggccagtcgttccaacaagacaatgagcactcgaagctgtctactgtctgtttgtatggtatcccgcttaattgttcaacgtaggattgcatctatttgatgctctaagaagatttcaaaggtgttacgtagtgttggctgtggaagttgtagcatatatgaccatgtaatctattgtgcgtctaatgtaggctaccgcgttggttgctctgg

SEQ ID NO: 9346 - DNA, 1309 bp, Zea mays
tttgcacccaaacgcggggagctgaagtattccagagagcacatgaggtgggtggatgagtcgatctggattcgccgcgcagctgagcccgtcgagctcattgaagcggtaatagctgtcctacagagctcttgtgtctggaattcaatttgttcaggtgttccattgaagcggtgatctgaagcttttgagacattgggttttggcctctggtgcgagaaggtgaagaagctgcgaaggcattcgcgagggaagagaagacacgaaaagggctgccgctggagctgaagcagaaagtttcacgggagactctgcagagactgcacgatttgggggaaggttctaataccacggaacaacaagaagctatagaagcatggcgtgttgggaagctcaaggacatgagaagtacatcttctaagaatttatcaaattttggcctcttcagtgaagattcaaggatgttaaagcgagccttggagtttaactggcaaatgctattggaggacattggtctttggatacctcccactatatggtaaaatcatatggattggatctgagatttaagttcgacttgtactcacttgcaggcaaggaaagtgcaagtgtgtatacttcttggtatctcaacgatgtggactactatggcgggttcgagcaagatgagctggatgagctgtttgaggcgatgcaatcaaactacaaggcctggtgcttaggttttgcacccctgtgtgttggaggagatatggaatcagtggcagttcaggagtttagcaggacactcttcaatatacgtccggacattgcacttaatgttgcccagacgatcttccgaggcgatgtgcgcagcctcctcccgcacgttagtgtcccatgccacattgttcagagcaccaaggatctcgcggtgccagttgtggtgtctgagtacctgcacaggcaccttggtggcgactccatcgtggaggtgatgccctctgaaggccatcttccccagcttagctctccagacatcgtaacccctgtcttactccggcacatccagcatgacatcgcagtctaggttggccagtcgttccaacaagacaatgtggaaattgtagcatatatatatgaccatgtaatctattgttcgtctaatgtaggataccgtgttggatgctctgacatcttaagtccttgagaagctcttcatgtcatttgtgttttttccatgaaacagaaactactaccagtatatgttggtgtcgatgatcattttcagctgtagggtttgcttatatatgtgtttctcttcaaaagg

SEQ ID NO: 9347 - DNA, 1161 bp, Zea mays
aacagccagaaggcgccgtcgcctgcggcgacacgcgcacgcaggcatccctctcctgagcgcgcactgctaccgtgccgcagtgtggttacagctcgtcgctcgaggcgaactccggcgtgcggaaccctagcgcaggcgtggagctcaccggcctcggcgccggcgccggtactaggatggctccacccgttacgccatggtgagggccttgcggctcggtggccgcgcggccgccgcagcgaggtggtgcacctgccagcgcgccgccgtcgccctctgcgtggccaacctcgtcgccgcgctgctcgtggcccgcgcgctctacgctcccggctccttcgcatttgcacccaaacgcggggagctgaagtattccagggagcagatgaggtgggtggaggagtcgatccggattcgccgcgcagctgagcccgtcgagctcattgaggcggtgaagaagctgcgcaaggcattcgcgagggaagagaagacacgaaaagggctgccgctggagctgaagcagaaagtttcgcttgagattctgcagagactgcacgatttgggcgaaggttctaataccacggaacaacaagaagctatagaagcatggcgtgttgggaagctcaaggacatgagaagtgcatcttctaagaatttatcaaattttggcctctccaatgaagattcaaggatgttaaagcgagccttggagtttaactggcaaatgctattggaggacattggtctttggatacctcccactatatatcatatcgaacatgatgacaaacctgagaatgaaccagaagatgaagagataatacccggtccacctttgccccctgaatgcaatactgaactgcatactgattatggtggcactgctgttagatggggcttaacacatcacaaagaaagtgccgcagattgctgtcaagcctgtatagatcaggctaagagggccagaccaggagccttaaagtgtaatatttgggtttactgtccgtctgagtatggatgctactcgccagacaaatatgaacacaaacatcaagaatgctggttgaagcaggtattttctgtcgttgtctatgtgtatatttaagtacttaactaatctataagagactatactttagtccaaaaaaaaaaaaaaaa

SEQ ID NO: 9348 - DNA, 917 bp, Zea mays
agcgagcacccctgtcgccgaagcccaggcagcagcagcgggcagcggcgtccgtccggtccgcgcgcgttcgttcccctccccgaccggcagattccccgtccacacccccgccttaaaacgcccgcccctccgcggccggccggggcccttccggcggctgtgctgtgctgtgctgttctgttctgtgctctgctcccggtctctcctctcccggtctctcctcctctccccgtcccgcccagcgcgcccccccgaggaaccaaccccgcggtatggggatcgtggaggaggcgcacaacctgcgcgtggtgggcgaggggaagcgcggggtcatcgtgctggcgcacggcttcggcaccgaccagtccgtgtggaagcacctggtgccgcacctcgtcgccgactaccgcgtcgtgctcttcgacaccatgggcgccggccccaccaacccggactacttcgacttctcccgctacgccacgctcgagggctacgcgctcgacctcctcgccatcctccaggagctcggcgtccgctcctgcatctacgtcggccactccgtctccgcggtcatcggcgcgctcgcctccatctccaggcctgacctcttcaccaagctcgtgctcctctccgcgtccccaaggtacctcaatgatgtggactactatggcgggtttgagcaagatgagcttgacgagctgtttgaggcgatgcgatcaaactacaaggcctggtgctcaggctttgcgcccctgtgtgttggcggagacatggaatcagtggcagttcaggagtttagcaggacgctcttcaatatacgtccggacattgcgcttagtgttgcccagacgatctttccagagcgacgtgcgcagccttcctcccgcacgtcactgtcccatgccacattgttc

SEQ ID NO: 9349 - DNA, 2287 bp, Zea mays
ggatccgtgattccgttcaccttcacggcttcaccagcctgcgctctctcctctcagcgcgacgactgggtgggcggggctaccgccgccgccgccgcccgacaccaggtgccgaggttttcgtcggtctcttcgccggcgacgagctccaaccaggtgctagcgcggtacaattttcgagaatttgtggtgttgaactgaacctccatgacacaagctaaacctgcccctagtggcaagaggaactggagcagtggcgggactgccgctggaaggaagaacaaggaaagaggagatgacaaagcaaaaggaatcagggttgctggttggaacacgggcgacaagaagaaagaagacaaagggcgccaagtaagtgcgggatcgaagaggccgtggagtgagggagtgcccccggttggtgtgaagagggctgtgtctgggtttgacaggaggaagaggaagatcgatgatgactcgtgggatgatgatggtggcaaggatgtttcatcttccaaatcaaagtttaccagaaagtgttcttccacaataagccgtcgaaaggtttctcctggaaaaggtgacagattgaagtctcaaacgttgtatgaggatgactaccgtgcagggaaaaggagtattagcaaagtttctgatgttagtagaggggtcaagagtcgactggtgaattctgtagcatccaaagggaagaagcttggtgcatccgaaggagtcatacgaacaaagaagggtggtgctaaagaagttgatttggatgaggaggctgttaatagcaagaagtcagatgacttggatcttattattgaagaagagaagcctcgccctcgccttactcgagtactggaccagactggtaagaaaataaagcccgctaagaaggttgtagttcctgacaatgaggaacgtgctcctcctaagaagagaaagcgaatgaagctagatccttatgacacttcaaacaaacggattgaagattcttctatccaagatgtttccagtgcagagaaggttctcgtgaattgtacacctgaagaagagactgaaatgtcaataaatgcaaaatttcgtgctatacagccaagttcttcaatcctttcatatgtggaagataatttactaggtcgtaggcgcttaattgagataaaaaatgctggctacaatgtcaagatttctgctcctctggataacgttcccttctcaaccagcacagaacgtgaacgcatagaagacattgcgttcagaaataagctggaattctttgctgctgcaaagatctcttcctcattccccactccaacactcccagagatagcatttgcaggtgtatcgaatgttggtaaatcctcactcctaaattcacttacaagacaatggggtgttgtgcgaacatcagataagcctggacttactcagacaataaatttctttcaacttgcttcaaagttatgtcttgttgatttacctggatatggttttgcttatgcaaaggacgaagttaaggaatcgtgggaggaacttgtgaaagagtatgtttcgaccagagttggcctagaaagggtgtgccttcttgtgcacactaaacgaggaatgaaaccgttggactatgagcttgtagacttaatggaaaggcacaagacgccataccagattgtactgacaaaaactgatttagttttcccaattgatgttgctcgccgtgccatggaaatccaagagagcctgaagaggaataagtcagtggtaaacccagtgatgatggtgagctctaaaacaggagctggcatacgcaacctgagaggcgtgcttggaaagttagctcgcttcatcaaaccgtagcaaagctgcagccaatttcggagtctgcgtctgcgtcggtcgagaccgtgagaggaaactcacaccaggctgtcttaggcaggtgccgcgctacgtcaacgctctaaccagtccaccgccacaagctttgtctgcatcagtttagactatcgaacacttgcagcaagcgttcctagttaggttatgctttggagcctagctgtatcacaggccattccggtaggattgaactgttcaacttttgagtggattatgcgatgctcagattaatccatgaaatatttgagtttccccatttggatatacggaatcgtacatccttaaaaactattatgcatcgttccttgatgtacaatactttttcagtgatgattcatcactcatcagtcattgatgttttatgtgttcttcacgaaaaaggtaaaaaaaaaaa

SEQ ID NO: 9350 - DNA, 1670 bp, Zea mays
attgacgatcgaatctgagccgtccattttattaacactttcggggttcagctctgctgcctcgaagcagggtccagatctctctcccccggctccggcgatggcttcgccttacgccggcggcgtgcagcctccctctcccgctggggcggtgcagcagcagcagcagaaccactctctggcgttccgcgtgatgcggctgtctcgcccctcactccagccagacctggccgctctgctccgcttcgacccacgcgacgtcttcctccctgaggacgcgctcaccggctccgacccgtccgctgccgccaaattcctccacggcctcctccaccctgcggactccgccactgccgtccctggagacttcaccttccgcgaccgcttcctcctccgcgacccagccgacgcgctcgctctgccgggcctcctcgtcctcccccagtcgttcggtgcgatctatctgggcgagaccttctgcagttacatcagcatcaacaatagctccagctttgaggccagggacgtcgtcatcaaggcagaaatacaaacagagagacagagaatacttcttctggatacatcaaaatcccctgttgagtcaattagatctgggggtagatatgatttcattgtggaacatgatgtcaaagaactaggagcacatacgcttgtatgtactgctttatataatgatggtgatggagagcgtaaatatcttccccagttctttaagttctctgtttcaaacccattatctgttaggacaaaggttcgcaccatcaaggacatcacatatctggaagcctgcatagagaaccatacaaaatctaatctttacatggatcaagttgattttgagcctgcccaacaatggagtgctacaagactggaagctgatgaacatccctcaacagtgaagtctgcaataggggatctctgtaaacaaccgatcctcatcagagctgggggaggaatatacaattacctttatcagctaagatcatcatctgatgaagctggtcaaacaaagtctgagggaagcagtatacttggtaaatttcagataacatggcgtacgaacctgggtgaaccaggccgtttgcagactcagaacattcatagcactccgactgcaagcaaagatgttgatctccgtgctgtgaaagttccacctattatatatgtggaaagagcatttatggtcaatctgtgccttacaaatcaaacggacaaaactgtgggcccttttgaagtatttctggctccaagcatgtcgggtgaagacagagctgttctagttaatgggccacagaagttgattttacctttggtggaggcttttgagtctatcaaatttgatctgagcatggtgaccacccagctaggagtgcaaaagatttccggaattacaatgtacgccgtgcaggaaaagaagtactatgaacctttgcccgacatagagatttttgttgatgcagaatagcaacaccatttgacgagctgaagatgcatttgtacttttcattaccatgggaggtctacatagtttacataaaggctaaagcactggctgatgtatattgttcactgaacaactgatacatgcgattgtaattaaatgcatattgatatcaaattgacttctgtcggatgtcactcaacttacc

SEQ ID NO: 9351 - DNA, 4644 bp, Zea mays
  misc_feature (4567)..(4567): n is a, c, g, or t
  misc_feature (4643)..(4643): n is a, c, g, or t
gagtgctcatattgcttgctaacagcagcagttgtggcaacaactgcagctgcagtgacagtggctgcagcagcaacaggcacgtcaaagtttacgtcattggtagataaagcggctgcagcaaccatagaggatgccaccactgcagcagttgcaacagcagcagctgtgacaggcaattgctttgtaagttgggatgaagcttcctgaggaggtgcagaaggttcgtactgagaaacaaacggagatgctatatctctgatatcatgtgggtggtaaatgcccaaaccctcaacaggcttaagtgactccagaggtgctcggtgaggagccacttttggttggagttcatgtccaggatgatgaggcaacaatggatcatgaccacgatctgtgtattcccttgacccaagctcattcatcctccttttcatttcatccttgctttgaaacagggtggtgtcatacacgatgaggtcctttggttcttccattgaatcttctgaaaacaggtcaggtggtgccataacaccattttcaagtaaaacctcatggattttctgaactaattgtggattttccttggcagcattaatcatgtactctgaaatgtccttcactttcattctccggacagctggagcgctgcccatatctggcgtagagggtgaagatgatgaagaatcaacggccgcagtatatttttctttgttttttccaacaataatgtaatctggatttgtagattctttactgacaggcctattttcacttgtgaatgtgctaactgatagtttatcgaatgaatttgaggacatattttgttgattgcttgtcagattagttgtaggtccatcagtatcagaaggaccaacattgcttgaagtggatcttcggtcaagtaactcatactcaaaagaaccatacgctgagctcgatacaccgctaagagaagatcccaacagattggtattatcatcttggccaaagtgttgattatcagagacgaaattcctgtctaattctgtggacaaaacagaaacatctgaaggaataagtgtaccaggatcagacacaagatgttcctgtctaattctgtggacaaaacagaaataggtggttattatatttaatttacaattcatttcttagtgacagcattagaatgaaacaagtttgatgtctacacagaacaaaagtgtgccgtgttgtccaattccaataaggacaggcgggacaagaccaaatggaacaaggcactgccctaggtgcaagaccagcacctaggactgtctgtgtccccttctagtgccatcccctctctcctctactgttccatccttgctgcaggctcgcaaagagctgtcaagtctagaacagttctcaaggccatcaatgagggaagtggggttgctgatacaactgtgctctgtcggttggggttttagtggagtttctagaagtatggaacctattattggaagtggagctgcatgagcaaattgaagataggcatgtttttatgctagctgccaatggacagtacgaggcactcttcattgggtctgtccactttgagtctgctaaccaaatttgcaaatctgggctccggctaagggcgtgtttgaaagcaaagtatttcaaaaccatggttttggaatactacggttttaagatgtcatgtcacaaccgtagtattttttacagcactcttagcaatacgtgtttggagacaaagtatctcaaaccatggtatttagtatacatgtgcaaggctagtcatagacaaaaactttgggttggagtggagttttaaatactccaaaaataccatggtatttaaaaaagagttttttacaatgtagctgaacacctcttgacaaaaaaatactacggtattttccaataccatggttttacctcaaaactccaaaaatactttgcttccaaacaccccttgagagtcgtgagctagtaacacaatcaaccatctgatggatacacagaacctaatattcgtgcaatttcatgctcttcctcttatggtcaagattccttttttaagcatatctcaccttgtttgattgataaattactaatttatgctatttatggatgcttgtaaactgtaaagttttatatgtttttttcaatgataacttgtggacatatttgaagtaaaataatttgcattgatataatcattgcagccaaattttaagttccttactttcatcatatccatattgttttttctcagtgtggatagactagaaaaacgtatgtatttggatgcatttactgcttcttattccaacataaagtttgactcgtaccttacttacactaggcagaaatacaaacagagagacagagaatacttcttctggatacatcaaaatcccctgttgagtcaattagatctgggggtagatatgatttcattgtggaacatgatgtcaaagaactaggagcacatacgtatgttccttttcattttaatattatttgtatactattcctttgctaaaagcaatccttgttgatttgctcatttagtgcttgaatccaggcttgtatgtactgctttatataatgatggtgatggagagcgtaaatatcttccccagttctttaagttctctgtttcaaacccattatctgttaggacaaaggtaacttagttttcattctacattctgttatatcattatcataatctcatacttgatagaagaagcagaacaagattatacaaaagccttatcataatttgtggacgtccttttctttttcaggttcgcaccatcaaggtaggtcacctcttgttgtgcaagggtaaataacaactgtaggttctttggttagttgtagatgccatctttagaagtcttaacaggtgtatattttgtatatagatcattacagcttgacaaatataacttagaaaatgatttgcgattaagtgagtagtttttgtgtttaatatagatgtttatgttttgttgtatgaactaatagctctcccattttttattaataatatttaccaagatttttcttttgtatttcttgccatcccatggaagctgagctaactcaatcggctaagggtgtggatgtacactcagatcacccaggttcaagtccttgtcgaggcgactttgggtgcctgttttcttcttaataaagccacctagctcctccttggctgatctagttttttcttgccatcccatttgttgtgcttctgtagttgtcaatacagtgctttaggctattcatgtatttttttaaatgaaccttcatatttgccttgcctacttgaatttcttaacaaatgcagataagcctcatttcagctttagtttatctgcattctgtttcaacaaattatatttctcataaaaaaacagatatatttcattgttaaaaatcatgtagtgtttgttgtttattcatttgttgcacacctgttaattcaccatggaagtcttcaactctatatagttggccttggcccgcgccgtcaggacatcacatatctggaagcctgcatagagaaccatacaaaatctaatctttacatggatcaagttgattttgagcctgcccaacaatggagtgctacaagactggaagccggcgaccttcccccccccccccagtctgcaataggggatctctgtaaacaaccgatcctcatcagagctgggggaggaatatacaattacctttatcagctaagatcatcatctgatgaagctggtcaaacaaagtctgagggaagcagtatacttggtaaatttcagataacatggcgtacgaacctgggtgaaccaggccgtttgcagactcagaacattcatagcactccgactgcaagcaaagatgttaatctccgtgctgtgaaagttccacctattatatatgtggaaagagcatttatggtcaatctgtgccttacaaatcaaacggacaaaactgtgggcccttttgaagtatttctggctccaagcatgtcgggtgaagacagagctgttctagtcaatgggccacagaagttgattttacctttggtggaggcttttgagtctatcaaatttgatctgagcatggtgaccacccagctaggagtgcaaaagatttccggaattacaatgtacgccgtgcaggaaaagaagtactatgaacctttgcccgacatagagatttttgttgatgcagaatagcaacaccaaattgggacccatttgacgagctgaagatgcatttgtacttttcattaccatgggaggtctacatagtttacataaagcactggctgatgtatattgatacatgcgattgtcatattgatatcaaattgacttctgtcggatgtcactcaaccttggattaccacattctcactcaaccttgagctgcacattgatcatgctctgctaaagactgcacggattacaattcttcaagctgggaaagttttggcccaaaattactgctgaatgtggccggttgctcttgctggttatctcgtgattttctgtcaagtacaaaattatcntggtgtgtaactacgaaatgacgggtgttgacagcattgtagtggtaatcccaaatggcatgtgatgctttgcttng

SEQ ID NO: 9352 - DNA, 3044 bp, Zea mays
agttaagtctcgttcactgcctgtgctgctcagtgctctgctcacacatcctcgtcgccaatggcggctcccgtccgggccatcccgctcccgtcgcccgtcctgtacccccgcatgtccttatggggccgcagcagctgcagccggcgacgtgcccccggagttcgcgcagcagtggaggcggcggagggtgcttcgcgggcgacggagcccgtggaggtggtcggcgtaggcagccggaaggacgccgtcatcgacttctgcctgggctcacgcacgctgtcctccacccccatccgcttctggacagtacatgtgatggataattctaaagttcagttaatacaaaaaggtcatggaactgatgcagtgttcagagacttggaacctcccttatttcttcatccctgcccacctgcggttattcttgtttctagtgcaggacaggatgctgatcatattactgcaatggagttacttagcgttgtcaaatctgctggtaatctggctgcatcaatatttttgaagcccttctgcttcgagggacaaagaaggcaagtagaggcagttgatttgattggcaaacttcaacatgctcaaactttcatattgttattgaagctgattcattgcttgagacggaagtggaaactcttgccgaagctttggaaagtgccaataatgctgtcctgtcaactattagcatgatatctatcatgatgtctggttataataagatgttctggagttcccttaatgcacaaattaaggaagttggtcctgaggaagtagccaagctactcagaagctatggggaagctagagttggctttggtgctggttataacatccagtcagcaattaagcaggctgtctttcactgtccatttcttcgtggtggcataaaggacttgaacaatgtggttttcctctcccttacaactgctcgggtgttgtctgaaagtgacttgatctctattctgcacatcttccgtcgagttactgggttcaccaaagatattatattttctagaaattctgaatctgatttagagccaaaactgatagtagtttctcttctaactgtccgaaaccactatgacggaagtgtttccacagtacaagagggattcctttcaagtttggccttgcattttccttttatatcttctcttatgggaggagatacccctgagcagaaacaaattaggtcgaagcattcctttaatcgactgcctgacaacagatttaattctgtagaacaagacgaattctcgcgactttctaatcggtcatctgatgctactgtttccaaatcatttcctgaagaatttgaggatttggaatctgtgaggaatcagagaataaagccagaatctctggaaggtgatctggcagttactggagaaatgaacaaagatgatgacaacgggcatttagtttcacagcaggaacatcgcttcttgagcaactcccctggttttgatattgcacaatcgtgggctaagtagcgtgtgatggcaagtggaagcagtaaaaatgatgagcttgatgctgtcgctcttcctgttggtgtaaaacttagcaaagttcagtctgatcattctccagatatgcagactgaaactcttggtgctgacacaactgttgctagtggacatgctgcctttggattatctttttctgatgttcgtttggagaaagtaatggacgtatgtagtttctgcgatcacatttctgaggaatagaatggataggcctcgaaagcgtggttcaaactcattatccagccgggctgccctgatgcttgatgcagaaagagaaccagaaaagacatggagccccatagttgaaatacattatgtagggggaacttatagaggtagatgtcaagaaggtgtccctgaaggaaagggacgtctaaccttcagtgacggaagcttttatgatggactctggaggtatggtaagagatctggtttggggactctatttcacagtaacggtgatgtataccatggaacgtggagggatgaccttattcatggaaagggctggtactattttcacagcggtgaccgctggtttgcaaatttttggaagggcaaggctaatggtgagggtagattttatgccaatgatgggagtatcttctttggccatttccgaaatggatggcgccatggggagagcctgttggtagatgcaaacggttcaaggtggatcgaagtttgggctgatggtgtacttatcaacagaactaaaatggagaaataaggttcagatctaaatacattttcctgatgtttctaaaacttggctcctcagatggctacgcttcaaagtctcagatgttgcaaggcactctggtccggagcctctctactgtacacgaagtcgtcctatattcagtcttgaaagtcgtaaataggtgcgctgttgaggtttcgatgccctaatttcaaaggggcagactgcaggcgtttctgtatataccactagactgcaagtatgggaggatgcctttgttcatacggctgatggatcaagctgggaacagctatatacccaactgtacctgaacgtgaagtgtgtttgattagttccactgataacccatagatattttcttgtcaaggttacatggacgaaacaggctctcgtggccgtgctcctttttctccccccccccccccccccaattgagtgcttgagtttccacgaatgtgggcccaaactgtatcctttaccctttttaatgtttccatcaatattatctgcccgttgtatttcgataatatatattggtcaaggttttgctcatttcgtggtactcaataatttgaggctttgtagggatggaaacgagctccgctagtgggtgatccagcttggctcgtgcgctggctcgcgagtcgtgtcctggtaaaacattacattatatactaaattaatattataaatataaaatatataatcattattcaatattatgagtgatttaaactttgaaatgttatatatccatcatcaaacactaagaa

SEQ ID NO: 9353 - DNA, 1177 bp, Zea mays
atggcagcctccgacctccgtctctctccatccccacctcgggcctcctgaccctggttagcttctgctttttactccatgcaaggacgacaatggcgaccgcctccgtcgccacctccctccccttcggcttccttctccctccgcggctattccgtgggaggctggtgaggtggcggcggcagattagggcttcggcgtcgagcaacgcgagtaacgtcgcaggcggggagaggaaattgggggctctcaagggcaagatccagaaaaacattggcccaaattttgttgctggtttctgtgttggcattgcatttttggctgctgttgcaagacagatcaccttaagaagtcgagagcatgataataaaggttctgttgctgatctagtaaggcgtggacagttaaaatcagggcaacgagggactgcaaagccccgcacattcgatgatcctttcaataatccattagtcaagattgatgagggtacatctactgcacaaatgtttggcaaggagtaccgtctggctcctgttaggcttacaaaagaggaacaagaaatgcatcagaagaggagatcacgtgcatatcagtggaaaagcccaaccgtgtttctcagggaaggtgattccttacctccagatgttgatccagatacagttagatggattccagcaaaccatccttttgctgctgcgtcaagtgaagtagacgaggagaccgccaaacaaaatgtctatcaaaaggatggcgtcccatcccgtgttaaggctgagcatgaagctttgcaggcaaggctagaggcttcaaacgatgttaccagactccctccggatccaaggagtatgcagcgtaatgagagacaaatggaattgtcaggcaagccatctgaaaatcttcagggctccaagtttgagaaccaagatagacaactggttatcgagtctggtaaacatagctccgatggaagtttacaatcaaatgagccggaagggcaataaaatttgtgtactcaagcgctttgatgacatttgctttgttgcgtagtgttatcagctttgtggctgtagctgtagatagagaagtgttggaacagtgggcttaccggtttacatagtgagcagttaatatggaagtcgcttgacgtgttgtgaatggacaaaaaaaaaaaaaaaaa

SEQ ID NO: 9354 - DNA, 808 bp, Zea mays
gaccctcgacgctggccgcctcccggcccatccccccgaagcctcctgaccctggttagcttctgttttttactccatgcaaggacgacaatggcgaccgcctccgtcgccacctccctccccttcggcctccttctccctccgcggctattccgtgggaggctggtgaggtggccgcggcagattagggcttcggcgtcgagcaacgcgagtaacgtcgcaggcggggagaggaaattgggggctctcaagggcagggtaggagatctgagggcgcttgtcgcctctatgcctgatgccgttggctcgatccagaaaaacattggcccaaattttgttgctggtttctgtgttggcattgcatttttggctgctgttgcaagacagatcaccttaagaagtcgagagcatgataataaaggttctgttgctgatctagtaaggcgtggacagttaaaatcagggcaacgagggactgcaaagccccgcacattcgatgatcctttcaataatccattagtcaagattgatgagggtacatctactgtgcaaatgtttggcaaggagtaccgtctggctcctgttaggcttacaaaagaggaacaagaaatgcatcagaagaggagatcacgtgcatatcagtggaaaaggccaaccgtgtttctcagggaaggtgattccttacctccagatgttgatccagatacagttagatggattccagcaaaccatccttttgctgccgcgtcaagtgaagtagacgaggagacgccaaacaaatgtctatcaaaaggatggcgtcccatcc

SEQ ID NO: 9355 - DNA, 1263 bp, Zea mays
ctccatccccaatctcgggccttgactccttgagcacagcacaccgagtccaagccccgaagcctcctgaccttggttactgggtagcttctgcttggtactccatgcgaggacgacaatggcgatcgccgccgtccccgcctccctccccttcgtcctcctccctccgaggctgttccgcgggagggcggtgaggtggccgcgcccgattagggcttcggcgtcgaccaacgccggtgacgttgcaggcggagagcggaagtttggggctctggtgagcagggtgggagatctgagggcgctcgtagcctccgtgcctcctgctgttgcttcgatgcagaaaaacattggcccaaattttgttgctggtttctgtgttagcatggcatttgtggctgctgctgcaagacagatctccttaagaagtcgagagcatgttagtaaaggttctgttgctgatcttgtaaggcgtggccagttaaaatcagggcaacgagggattgcaaagctccgtacatacgatgatcctttcaataacccgttagtaaagattgatgagggtacatctactgcacaaatgtttggcaaggagtaccgtttggctcctgttaggcttacgaaagagcagcaagaaatgcaccagaacaggagatcgcgtgcatatcagtggaaaaggccaaccgtgtttctcagggaaggtgattccttacctccagatgttgatccggatacagttagatggattccagcaaaccatcccttttctgctgcttcaagtgaagtggatgaggagaccgccaaacaaaatgtctaccaaaaggatggcatcccatcccgtgtcaaggctgagcatgaagctttgcgggcaaggctagaggcctcaaacgatgttgccagactcccttcggatccaaggagtattcagcgtaatgagagaccaatgagattgtcaggcgagccatctgaacatcttcagagctccaagtttgagaaccaagatagacaactggctactgagtctggtaaacatagctctgatggatgtttacaatcaaacgagccggaagggcaataaaaacgtgtgtatttcagctcttcgaagatatttgctttgttacgtagtgttatcagcttttaggttgtagctgtagatagagaagttttggaacagtgagcttatacggcttactggtttacatagtgagcagttaatatgcgagttgcttgacgtgttgggatcgaatggtaaaaaaaaaaaaaaaa

SEQ ID NO: 9356 - DNA, 971 bp, Zea mays
accgcactccgcacggacacgtgctggcaaagcatgcgtacgtgtcctctccagttcttccccaggaggccaaggacccagtagaacgccgatctgttgtatacggagttacggactggcgccgccgcttagtcaccacccaccaaacttcacggcttcggctatcttcaagagacaagagtggagggcgaagagcagagctgggggggagatgaacagcggcgtggacacgcaggcgcgggcgctcgcggacgaggtgcgcggtagtttagagacgaagaactggatgctggacctcggtcacccgctcctgaaccgcgtcgccgagagcttcgccaaggccgcggggatcggcgcagtgcaggcggtcgccagggaatcgtacttcatggcgactgaaggcgagggaggatctgtgtccggcgcgaccggcgcaaggaaacgctcgttcccggagctcaatgggacgaacagtagcagcatcaagtcggcagaggccatggtgaaaagcgtgagcaaagagtcgttacagtgggggctcgcggctggggtgcactccggcctcacctacggcctcgcgggggtgcgcgggacgcacgactggaggaacagcgccgtggctggcgccatcacgggcgccgcggtcgcgctcacgtcggagcacgcgtcgcacgagcaggtcgtgcagtgcgccatcaccggcgccgcgctctccacggccgccaacgtgctctccggcatattctgagccgccggccgtgccgtgccgctcgatttccgaggattggctgatagttctgtcacccaatcgttcgggtaccgtcgctcttacgcttcagtacgataacttgggagcgttgcattcatgcattcacttgcattgtcattacaacttatgccctactttactgttagccgtataacggttttactataatttacacgctgcttagtcaaaaaaaaaaaaaaaa

SEQ ID NO: 9357 - DNA, 1889 bp, Zea mays
tgcagggtcccgcaccctgcgtagaagtcttttttcccaatgtatcctccattcgacgccgggaacatggtgccgccgcctcccgagtcccgccgaactgccaagcgcgaacgcttcccgtcctctttaaagccaggtgtcgtccagtccaagtgcttgctcccaaccatttctgcgcgtgcgcctccaccgccagaaccccgaagaagagcatccccctccttggagattttcagtaaccgttcctgctcgacgccgacggcatgccgaccgagcgcgtcgatgtcgcggtctcctcacggacgctgctgcgggcgtccgacccgcctccggacttccccgcggtgctccaggcgtccaacctcgacctcatactcggttccttccacatctacctcatcgccatgtaccccgccccggccgcgggcttccccgccgtggtagctgccgcgcgggccgccatgcccgctttcctctctcgcttcttccctttcgctggccgcgtcgtcgccaacgccgacaccggcgtgcccgagatcgcgtgcgacaacaccggcgcggagctcgtggtggcgcgcgctggggtgaggctcgcggacgtcgacttcgcggacgccgaccgctcgctgggccgcatcgcggtgccgttccagcaggacctcgcgctgtcgctgcagctggtgcggttcgcgtgcggcgggttcgcgctgtcgtgggggaccaaccacctgctcgtggacggccacggtctgacggcgctgcccagcgcgtgggcggagctgctccgcaccggcggcctctcgtgggagcctcaccacgagcgggcctcgctcttccggccgcgggacccgccgcggtacagcgcgtcgctggacgccgagttcacgcggtacgcgccggcgggcctcccgaactcgctcctgacggccacgctcgtgcgccgcaactacgtggtgtccgccgcggacgtggaccggctccgcgccgcggccagcacccccgcgcgccgcgccacgcggctcgaggcgctgtcggcgcacgtgtggaagctgctcgcggcggccgtgggcgggctcgacgcgcactgccgcatggcgtggctcgtggacggcaggccgcgcctggacgccgccaggtacgacggggccaccgtgcggcgctacctcggcaacgtgttgacgtacgcgtcgcgggaggcggccgtggaggccgtgtcgtcgtccccgctggccgacgtggcggccatggcgggcgcggccatcgcggaggtgttccggtcggagcggtacgaggagctggtggactggatggaggtgcacaagggggtgttccgggagggcggcaagtggacggaggtggtgggcacgggcatggggagccccgcgctggtggtctctacgttcgtgccgttccgcgtggagggggactttgggttcggccggccgcggttggtgtttccgtgggtgcgcccggggcggctgggttccgcggccatgacggtgtcacggagcccgcgggaggacgggtcgtggctcatcaccgccaggatgtggccgcgacttgccgacgccgtggacgcggacccggacgccgtgctcaagccggccaccaccgcgcggctcgggttcggcgcgcccgatccggcagacgtgatgcagcatgctaccagtcgcatgtgagtcatagagtggtttgccgtgcgcgaggcgagccggtgggcctcagccctcagactcagggtggcacgggcggacagaacagcgcccctgtgggcctgcgtatgacatggcggcatggcgctgacgggagtttcatgtgcgcccatcgatctggtacagttttgtacatgttttatcggcatgatccaagaaaatattttggacattcac

SEQ ID NO: 9358 - DNA, 5442 bp, Zea mays
  misc_feature (1304)..(1304): n is a, c, g, or t
  misc_feature (2329)..(2329): n is a, c, g, or t
aactggcccgatgccccacgcgagggcctttcgccttctagtggacccggggatatctgtccccacaggtcgggtgggatttgatccgtccgtttttaaacctaacggaggcacaataaccgtgtacattattgacttaatagacagtacaaatagtatagataaagaagagagagatgagatggggattggggaatgcgggatgcgtgtgacgcgtggaccccgcacgcaaaccctagatcggaagccgcacccgggcacatgaccgccttatccccgagtcagaccagcggcggccggaaccgggagccccgttgctggccacgcccccaccgctcgcgcgcgtcgagcagcttctcgtcgtagttgagcctacgcttggcgcctaccgccggttccgctgccgggtgtcctcccttcgtgccgctgacaccagagggtaggatccccgcgctttcgaccagcagatcccgccgcgacccaggtaatcgatacacctgttctgtgggagtcaagtgcttcctggggtttgtccgtgacttcttgaattcggcttcattaatcctagtcggccacacggatccgtactactgaaaaccagaacttcgattaggtttttctgtgcccgcttatctgccgcttgctttctcaaagtaatgtatcatggtacactgagcgcctccttgagaaaagaagcaacaagttcaattcttcacttgtatttcatcctggaagatatgtttaaaatgcacatgaatcaaaacatcgctattattcccacaccgagtttatttcaagtttgcttgtggcagaggaaagcctggaatcctccagttactagttttgccattcagtccgctcactaggggcgtgattagttctggtttctactttctaggtagccaggctgacatgtggcagccagggtctctgcatgtaggagcaccttctttggttcatgtttccatccataccatctcatcgcatagcttgattggttggtctctccctactcgccttgtgcaggcgccaagagagcagcagacatgtgacgtgcactgcgtgagctaggctccccagaaacaaaatcccatttcatttcttggcctaatttgcacccacaaatccttgcccatgtggacgtccgtcgaaccaaacatctacctcctgcatgctgcatccaaccagcctgttctgactgcatgcatgaaaccaatcacaccttagatatctagtcatttccataggggcagtaccttctgtttgcacatgaaatcctatatttctacaactatttatgaagntgaactgctgaactactgatgtttgggttgttattaaacattgcatttaaccattggagatgtttgttatcactttaaaattattaatggaaaaagtacaaattactcccctcacctatggacaatgttcacaacttcacatagccccccacagtgtttttagttcattttacacctccattcgtttgagttgatttaatttacccctttacagaatttgtctttttccttgtgtaatagacacacatggagtgtctcaaagaaatcagttagtagcctaattcttgaacttgttgtccctttgtaggaaggagacacttatggggaagggacaaatattagctgttcttcaaataggtggagaattcaacaccgatgaagatggacacatgtcatattctggtggagaggcacatgctatgcatgttcaaagtgactggacttttagtgcatttaagcaagagatatcgtcaacacttaacaatctgaagcttgaccagtttgcattcaagtatttccttccaaagaatgataaaactttgatctctatttccaatgacaaggacctacgacgcatggttgaattccatgcggagtcagattcgacatacatttatgtcatgaagaaagctgacaacaggtacttgtctactgtcctaatttcttgtggtcacattagtaaattgcagaatgacacgcggcatttttttttcagatcaaagaacattgttgctgtcttggacactcccacagatgcctttgcgattgtcccaacaactcaggatgggtctaagagacaaaaggtttgtgcaagttggaagaatgtgataactggagttggccaagtgtttgaaggacctaaggatttccgtgatgccttacataagtatgccattgcacatagattccattatagatttatcaagaatgactcatctcgtgtgactgctgaatgtactggtgaaggttgcccatggcgaatacatgcttctaagtcccctgcaaagaaagaatttatggtcaanaaaatatctgaaagccacacctgtgaatttgaaacagtcaaaagcaaatcggttggcttctcaacgatgggttgctagtgtcataaaagaaaagttgcgtgatagtccaaactacaggccaagagatattgcaaatgatcttcaacgagagtatggactatgcctgaactattcacaggcttggcgtggaagatcaattgctcagaaggaactttatagtacacacgcggcggcctgcagtcagttgccttggttttgtgaaaggattgtagagacaaaccctggaagtgtggcaactgtagtggccttggaagattcaaagtttcgtttttttgttgcattccatgcatcgctccatggttttgagcatgggtgcaggccgctcctttttcttgaagcgataactgcaaagccgaataagcactggaagctactggctgctgcttcagttgatggtgaaggtgatgtgtttccagttgcttttggtgttgtggatgacgagtcgcgtgaaaattggcattggtttcttgagcaactaaaatcttcacttggcacatctcgaaccatcacattcatatcgaatggagaacatggactttgggatgtattatcttcagttttccaagagtgtcatcatggctactgtgtggagtctcttattgaagaatttaagatgcaactggatgatgcatggactgaggaactaaaagattcgatggttgagcatcttaagaaggccataaattcatgcacagctgatgagttcaatcagtatattgagctcatcaaaagtggttctgacaagcttgctgattggctcttggagatcaaacctgagcgatggtcagatgcttttttcaagggatcacgtcatgggcagtattcttgtaatatttttggcactgtgtctgagtggattcccacgagatatgagctttcagttgtgcaattggttgacacgataagatgcaagctgatggagatgatgtacacacgcagagagtcttccaatgcatggactgaggtattaacaccggcagccaatcagaaacttcaggaagaggtgaacaaagcccacaccctcaatgtccttccagcagaaaacggtgaaaatggcaatgtgtttaaggtctgtgatgactcagttaatgttgtcaaccttgacacatgggaatgcacctgccaaaggtggcatatttctgggctgccatgcatgcatgtgattgctgtattggagcgcactgggcaatatgcatatgactactgtgtgaagtacttcacaacagaatgctaccgcttgacctattccttgtcaataaatcccatacctgatgttattgtgccgcctacattaatcgacttagctcagagcccagcaacatacccatgcccactgcgaacccgccgtcgggttggccggccaaaagagaagcctgctgatcctcgcattgcaatcaagagggcagtgcgctgcagcaggtgcaagggttatggacacaacaaggcaacctgcaaagttcctatcagcagtttcagcacgtagtatttactcatcaaatcagttgtgcagtgtgcattagtgtggagagttgttcgtgttattctctgcaatgttagtgttgatgtttcttttgatagtctgtgatacatgctagggatgatcttagcttggctgccaagagaggagtctgctgatcctcgcattgcaattaagagagcagtgcgctgcagaaggtgcaagggttatgggcttatggccaccacaaggcaatctgcaatgttccgatcagcacatagtatttaatcattggatcagttccgcaatgtatattaaggtggagagttgttcgtgttaattctccaaaatgctagttctgatgtttcttcggatagtctgttatacatgcaagggttgatcttagctctaaattgatctgtattttcaccattgcttagactaactgtattcagcttgtgagtaaaacgccgtagcttatactcatgttgctatccactttactcactttcttttccgttgtgtctgctgtgtggcttcctcgccatctcggcaactgcaagactaaaattagctattctcgttccttggagcactacattattttgtttgctgttcatcaacgtcctgaaattacactggttctttcgggattagtttcttattatttttgccagaacactgaacattgaccttttttcttttgccactgtacattctgatgttttgaaatgtttgctgtgatatgcttgccatgctagaaagaggtaatgtttgtgctgttttagcatatttgagtcccataaaaaaacatttcttattgtttgccctttatctttcattcgttctgttctgttctctgatggaagacgagatttgctgcagcctgcattgtataccactttcttggatccatctttgtaaactctgaacaagcggccttttggtgtcaatgccttagcaccaaaacggcatgatgttactctgttgtaataccttcgatctttggagacagttttggtgttatacactccaaagaatgcaccacatgctgtcattacgggtcgtctttggagagcaatgttctttttatcctccttgtagcagaaatgaaccctactagtagttgtaacaacctaaaatcatattctgaataaattagtaaaagttatttcgtgatttaaataaatatgttttcaaatgatagattcttatgtgaactatcctttatgttaaagatcaatttttttttaaaaaaattaaattaaactatctcttaatatagattttatatatctataccttttaaataaatatgtaaagattatagatttattttattgtacttctaaatgtggctataagtttgaattattttccttaataattattattataaaacatcttacaagaactattactattgagtttcatttgcttaaatgaataaattaaataatataaatgttttgcatttaaattgagtttttatttgttgcaatttatactcaaaataaaaaatttaactaagttctaaattagacttgaattttaaatttaaaatagaaagcagaaattagaaatataagttaatata

SEQ ID NO: 9359 - DNA, 6491 bp, Zea mays
ggccgcgcgcagcctgctgcctgcagccagcggcagttttttttgctgcagaaagttacagtagcttctgctgcagagatacttgcttgcagagttgcaatgcaaccagcagccagcgtggcgtgggtgcatctggctgggctcgaccggccagtttcttcccctaccagaatccctcggcgggcgtaggcaacctcgccctcgcccgctcggcgctcgcgcccctgccgccttccgcctgccatgcgtggacgcgggcagcggggctcgggactggggacgagcggcggcgacgtgcgtgcgcggacgtggaccaccgcaaccgcaaccgcaaccgccgtgggagtgctcacagtcacagcatccctaccgcgccgcgcgctccttcgattggcgcaaacggttatagttttacctgcaggcaggatgcaggtacgggttttacgggcgtggtaaataaaacggcatgcatgcatgcagcaggcaacagccactggctcgcgcgctgtcttctgtctcccatgcaggcactggatcgatcggagccgtcacatgtgtatgacgagacagacgagtgcatgcaatgcgacgatggatgaatgatagatgtgtacgtacgtacgcgtcgtgtatccgtatatggaacctaggaggctgctggctgccggaggaggagtagtacatgacaagctatcgtattctcaggatctcaggtacgcgctcgatcggtcgcgaggcatgcatgatggatagatgtgtacgtacgtacgtacccgcgtacaactgctgcttattatatacgcgtgtggaccggggggtccccgtccccggcggggacgactgctgctgctgctgcactgctcccctcgtcatcctcatcctggcaaaagggtggctggcgatgccgactgttggagtggcgccggccggggacttggctcgtcatcagacatcgctctgccactccgtcccagcaggacaggactggactagactggactggatgatgccattggtggcgtgcgcctctctcggtcgtagtaacgcggcacagccagcgacacggggaggagagggacccgtacgtcgacagacagacagacacacggtacgtgggcgcgcgtgccgggtggtgcgcgcgcaggctggctggctggctggcgcgtcacgaattgaaggaaggggtcggcccggctgtccggctggcctggcccgcctctcctcttctcatccccggctccccgccatgcgtatgcgtttcctcctggatcaaaaacccctgtgcgagcgcgcgcgcggtctgacaggcatcacatgcccgcgcacacccacagggccgccgcaatgatcagcccctcacatgggccttgcgatgcagcgggagcatcaggaccagggaggacacacacaccacgccggtgcgcccccctcgccctcggccccctcccttatttcaaccccatcggccggccgcggccatcacacatgcacacccaaacccacacccacatgccagcccgccaagagcgaactgcttccccacctccccacgacgggagcctgcatggccatgacgcccgcaatgataataataacatccctctgaactcgcccgcgcccatcccaaaaccgaacacacagcacaagagaactctgctccgctccgccttccactgcattccgtagtacgtacctacctacctcctgtgcccgcgcgcagaaccgctactcccccgcctctgcctcagctctgaccgttcactgccgtgccccctcctgcccgccacggaaccttctacgcctccggaggaggactctcccgtcggtggcgccgccgcgccggccacaccggtcgtcgcgcctgaatgctgcgatgcgtcctgcaggccgcactacgcctgaccgggccgacagccagctcgcgaagatgcacgccgggacgacgcgcggcgacggcggcacgcggggcctccagcgccgattcggctgcatggccggcattttccagatcttcgaccgccagcggctcatcgccggggccggccgccgcgccgcccggcaggcgcagaagaggctgcctccgccttcttccgctccgccaggtaactaatggcttctcccctcgcgccgtgctttcgctgcgccctgcgcgcgtctctcagctgttatgttcgcgtccgtcactcttggctcaagtatttccgagcaaaccaccttgtttctttatttacccacgcccttcttctttttaactccgtcactaattgcacgtctttgcttctaagaacgcatccggttcctaatgacgcgccttctctaagttgttactagatacgctcgtcctggtatgttgactagagatatgagaaagctaggtgtttttctttttcattttttttacttaacataaaacaaaaacatcgcttccaaatctgatactgctaccttgtagttgatagcaagccctttcatactgctactcaaagtttggtaagatctgacagttggaaacttggaaggttcggcggcaaagaccaacctatcaaaggctcaaagcatttcaaaaaaaaaacccctggttggtaaaccgccctctacacacacaagtccggaaacccggttggcttgcagcgtgggcgagccacgttctgtagggtggaacctgcaaaaaggaaattgccatgttggtactgacaaagaggctcggaggtttgctgtgcaagttacattacgtgctgtgactgtgaggaaaaccatgtgtgtactatagagcagcggttgactctagcaattgtgaccatccataagagcgtttacttaagaatgcactaataaaacgacagcacacatacctttttagcagtagatgagcgcggggcatcggcgcaacggcatccaatgatgagggttcgggtacccggagccggaaatagaatgaggaaaactgttttcgctgactgaggaggacagctcaacagtacagtgtaatttcatctatgtaatcgaactgaataggacatcttaacattttgtatatattttttttaaaggagagacccttctaccaatgccatattaactgaagaggacagcttaccatttactacctttttaaaaacaaatccttctaatgacatattaactgaagaggacagcttaacatttagtagttttttttaaaataaataaataaataaataattcttctaccaatgacagattaaccgaaaatggtagcacagcaatttgattgtagctcgattttctctgcttagatattttactctaaaataataacaatgcctccgtatgttttccaggcaaaactcaacatccaaagagcagcagcgatgttctagttcaaagttcaagtgcgtcgaagatcgttctggtaatattctctactagattgactcaacctattctctctctctctctctctctctctctctctctctctctctctctctctctctctctccggacaggaaactattttactcatgcaacagaattctggaattatgttagaaatgacgtaaacaagttgacactgacctctctgtcgttttttgcaggagaaaacattgagcaaatgcacgaccgagaacagcagcctttccatcgaatcgtcaagcgattcgtcttcctcctctccgtgcacgtccttctcctccctcgatggcaacaaatcagtccaacaggagcttccttacaccagcgaggagctctttgcgcagaggccactgaagagctcgccgagtctgagggaacctgacatgaacgccaagtctggccatcctaatgccggtttcagagacatagtgaaggactgcatcaaccgggactccggaggcctgacggtaaaaacttcggtgcacgaggcaaggagaaatgggcagcacaaggactcaccgaggccactgctgctgtccaaatcaatggatgggacctgtatcattgggatcgataggaccacaaatgttcctgcaaatgtcaatggatctagaaggtgtttgcaggagcagtcacgcttttcttgtgatgaccgaaggctcctgcgaccaactgaaacccaggaaagcaagaggtcttcctcgaggccaaaggagcttcctagattgtccttggacagtaggaaggagtctctgagtccaggctcacgtcagaaggacctcggttacaagagaactgatgatattcttctggatactttgaggcctcaagattcccctagccatagcagagctaacagtgtcattgccaagctgatggggttggaagaagcaacaaatgctacaggagtgctaactgccgatagctgtgaacccacaaggtcaccgagaccagctcaggccactcaacatgggcatccatcacgctcccccagaggcacttgccaggattcctgcagcatgcagctgaagaacgagtcctcatcagtactgaaaaccaagccttccccacgaattctcacagaagcagctccttggaggcagcaggaaagaagtgccaccaatatctgtcgagaagctgaagggaggccaagaattgcatctgtctatgctgatatagagagaagggttgggggcttcgactttttagagtgtaataacaaggacttcagggctctcagaatattgggtgcattgaacgcgagagatgctaagaacaagaatgacagcagtggcagaccaatggctactcacagaacaggatatgacctaaccacctctggaagcttccaggctcctattgtggtcatgaagcctgcaggaaccactgaaaagcatggggtttcacttgcttctgttgcccccatagcaggcctaagaagccttagaaagttgccagctagatattcatctttcactggcacaaatgagaccagcacaaatgagaatattcatcttcggatgtcaagagctcaattgaagtctgaagaaactgtcagcagtgccaactcgccaaggcctacaagctcatcaagtcccagaaatgtgctaaagaatgcagagcctgagaggagatcccgtccacctgtttcaccaaaatctccaagcaagaagtccaatgaagttgtctccccaaaaggaagaacaagatcaaagccttctcaggtgaaaagccaccgtgatgaggtcttacagagtacagggaacagaataagcttagctaagcaggtagatgtcagcattatagactgtccaaagcttccgggtggcaactcaaccttcgttccaccaagcaatgctgctgcaacagcaagtcataaggctccttcaattctggattcagaccaaaacattcattcactggacaacattccaagccctgtctctgtccttgatacgtccttctatcataaaaggatctcagattcattcaaagatgggggagacacattcttcagaggaatgctggaacccaaacagcctgcctgacacaccacagtcaaaagcgagcagtgaagccaaccagattaaaccagaaaatttggaagttctgatccagaagcttgagcagactacagtcaatgaacgaagaagacgcaagtatcaaagaagtcatggcatcagtcactgcaaataaagatcaccagtatatctatgagatactgttggcatctggtcttttgcacaaagaacatagtatcacggcattacctgctcaactccaaccatcaaattatccaatcaatccggagctcttcctcattcttgagcaaacaaaaccagacttagttttcgcattccaagctgtcagtggaactaagaaaacttgtaagccttacacagggaagcttcaccgaagacttgtgtttgacctggtaaacgaaacaatagctcaaaagatgatcatctgcagatctggaagccagccagtaaagtttcttcaatcaaggaagttaagtgggtggcaactattcaaggatttgtgcactgaggttgacaggcaaataaaatgcaccgaggaggaggagaatggaaacatgatatcagatgaggatacagtcaatggaacgaaagactggatgagcttcgacactatgctacatggcatggtttgggagattgaacgatccatcttcaagggtcttatcgacgaggttatcggcggtgagactatagagaagatgcaatttgggcaaaggaaactgcagaggcagctttctttcagtagtataaactgaatatgcgtagcagtcatttccatggagaagcttataacaattagtaaatgtgacagtttctattttttttatgaagactaaactgtacaagtataaatgatcctcaacactagtcttgctgcctgactattgcaattcgagagagttgtgggacatgactattgtttgactctactaccggtcaaggcgattgaattgcacagtaccccgtgtgtgcatggtggacccattatatcaagtgtttataggaatgtcgggtattccacaattgagataaaaaaaaaaccaccacaaaccc

SEQ ID NO: 9360 - DNA, 2940 bp, Zea mays
gcaccaccgcgccgcgccgccccgccgccacccccctttcccgttcgttcccaggacgagtcacagcagccggccagccgcacagagtggtggagcctaggaacagaggaggcgccgagccatctccgcagcctgcgaccggggaacgggcgggaacggactctaacttagagagagcgcgggcgagagaggtcaaccgcagccggaggcgatggaggtggtggcgctggtgagcggcggcaaggacagctgcttcgccatgatgcgatgcatggactacggccacaaggttgtcgctttggctaatcttatccccctcgacgacaccgtcgatgagctcgacagctacatgtaccaaactgtggggcaccagattgtggtgagctacgcgaaatgcatgggcttgcctcttttccggaggcgcattcgcggatccacaagggatcagggtctcaggtacagtgtcacggcaggtgatgaggtagaagatatgtttgctctgttgagcgaggttaaacgtcgaatcccatccatcagtgcggtgtcgtcaggtgcaatcgcatccgattaccagaggctccgggttgagagtgtttgctcgaggctgggcctggtctcgctggcgtatctatggaagcaggatcagactttgctcctagaggaaatgataaggaggggcattgtggcaataattgtgaaggttgctgcactggggctaaaaccttcttcccacttaggtaaagaactggctgaacttaagtgtcatctgctccaaatgaatgagaattatggaatcaatgtctgtggtgaaggtggagaatatgaaacactaactcttgactgccctctatttcgtaatgcaagaattattcttgatgactctgaagtgatactccactctgctgattccattgcttctgttggaattcttcatccacgggcgtttcatcttgagcagaagccagattcatctgatagaattggggatggttctgccgttcaagagagttctagttgtgtatatgaggttgatgaagttaccactcacgatgatgtgggagaaaaacaggccctgggtccagctgttgatgcttacaccaatatagacctatgtatctcaaagacagggaacaatttacgttcaatgagctgttggattcaggatccatccagagcttcggaaggcctgaaggcagaccttatagcagttttgagcagaattgaaaatcagctcaaggaagaagggttaggttgggtgaatgttttgtacgttcacctctacatttcaagcatgaaggaatttggattggccaatgaagtttacgtcagctttattacggaaaagaaatgctacctgggtgttccttcgcgcagtacaattgaattgccactagtgcaggctgggttgggcaaagcatatgtggaagtcctagtttcaaatgaggtggtaaagaaagttctacatgtgcaaagcatctcctgctgggctcctagctgcattggaccttatagccaggcaactctttatgaagagattctctatatggctggtcagctgggccttgaccctcctacgatgaagctctgtcttggaggtccaagagcggaactagaattagcactacaaaacagtgaagctgtggccaatgcctttagctgctcaatctatatctcggcaatacactttctggtgtactgctctgctcagttgacgtccagcgagaaggaagaaattgaacagacattgaagagttcttatattactcgtttggatcgctcaaaaggtggatcatatccaactgttctgtacgtattcgcgtcagaccttccgaaaggggcacgtgtggaggtaaagcctatactgtatgtcccttccactgatgattgggttgctgccgaagagacggagaccggagttccactgccagcaccgagcaaaacctggactgattgtaccgcaccatactctgcgttgcgcgattcgtgttgccaggtccacacaaccggcgggagaatttgttccgccgtggtgtcgatcacagatgacatcgcatcgaagatctgctctgcagctggacagctgcaccacggagaggagaatctgaaaataatggctagattctgtgctttccagatcgcgaagaccctggcagacaacagattttcctgggacagcgtaacgatgttgaggctctactactcggtagatctcgccgtggcggcagatgcagtgtccggagcattttccgaggccttggccgagcttgcccaagacaacccttccatgagaactgacgttcctttctacaacgttgtgcccgtagccggagctggccgctctgcgtgtgcgaacgacataatgacgtgcgagttactggcatccaacgtctccagtgcgaagtccataccagccgaaccgttcgctgtgacgcctgcttgaatgcagctttccttcggaaattggaggtgggcgcacgttggaatttctgccagaggagccggtggccagtcaactgccagttggacgacgacggttgaccagcttctctagggctggcggcggtagcttcgtttctgtgctggcggtcgattaaaaaaaaagaccgtacggtgatcatcacagatgcacccatactgtattattctgtttcagcgtcctatacaaagtatacattgggtctgaattctgattagcctgtgctgatgcttgcaatgacattggttcttctgtgtacagactacggacagagtcccggtcagtaacgtgtgtgtacttgttcttcctctgtgttgacattcttgctcgatggtggaacctgtcgcagttggcggaggtgaagccgcgtagctcacttaggtctgccaaacacttcacttcttagattgtttctgtggaaatcgcttctgatgaatgcaaaatctattaagtcgtccggtttt

SEQ ID NO: 9361 - DNA, 1282 bp, Zea mays
aaggttccagtattccaccacgcggcgtcgcctgccgaaccccgaaccttctcgaggtcgaggcccctcccctttcgccaggagaaaacaatgagcaggcgcaacagccgtaccatctatgtaggcaatctccctggggacatccgtgagagggaggttgaggatctcttctacaagtatggccgtattttggatattgacttgaaaatacctccgagacctcctggatacgcattcgttgagtttgaggatccacgtgatgctgatgatgcaatttatggccgtgatgggtataactttgatggctacaggttgagggttgaattagctcatggtggcagaggccagtcttattcttatgatcgttcaagcagctatagcagtgcatgccgtggaggtgtttctaggcgctctgatttccgtgttatggtcactggtttaccctcatcggcatcgtggcaagatctgaaggaccacatgcggcgcgctggtgatgtctgtttctctgatgtataccgtgaggctggagaaactattggaattgtggattatacaaattatgacgatatgaaatacgcgattaggaagcttgatgactcacagttcaggaatgcattttcaagagcatatatcagggtgagggagtatgatgctagatcacgaagcagaagccgtagccactcgtactctagaagccccagctacagcaggagcaggagtccaaaatctgtttctcagtcaccctcatctgtggatgaaagatcgctatcaagatctcgatccccaatttcttctccttctcatgcaagatatgcgacaagccctaggagcagaagcgcatcccgttctcggtctcctgtgagatccgattgaactttgagagcccttgaagcagtgagcagccccagggagaagaaaggaacttgagagtatgccgtgccatcacaatggtccgagtgattatgctgttgccactgctccctcacatttaagaggtttcctcttatttagacggagcatttaattaacattatcttgctaaagagagacttatgcgtagtctacttgtgtactcgttcgtttgtcctcatgttcttggcttcaggaactctggttttttatcattgtacccatagtaaaacctagatgtagttggggtatgccgtatgcgtctatattcggttggtcgaatgtaaatctggatgcatatatgcatctgtttggtttcatttaggcctttccttggtttcgtgattaatgacaacataagcttattgctgtg

SEQ ID NO: 9362 - DNA, 3354 bp, Zea mays
cgagtcgtccttgtcgctaaacacaagagagatcgaagggacgacgacgacgatgcatctgtttctcttccgcttccccctggccctccgaagcttcccctcatcggtaacgccttctacttcttcgcggcgttgcgtcacaatccgcaccgcgcgttggccgacctagccgagaagtacgggccgatcgtgtccttccggcaaggcacggcgacgagccgcatcatcgtcgtggtgtcgtccccggccgcggcccgcgaagccctaggcaagaacgacatcgcggtcgctgcccggatggtgcccgacagcgcgcgtggcctggcgcacgacgcggggtccgtgttcttcctcccgagctccagcccgctgtggaagcagcaccgcgccacgatcggtgcccgcatgtcctccgggccgagccgcctcggcatgacacggcacatccgggaccgccacgcccggcagctcgccgagctcagcagagcctattctgggcagccgatggcggtcggggaggccgtgtatggcaccatggtcaacaatgtctccaacatcctcttctctagggacctggccgacctgagcatgccgcacccacacgacgacgacgagcagggacgatcacggcgatgggggcaggtgtacagggccatcacaagagcgatcaaccaggactgggccacacccaacatctcggacgccttcccgttcctcgcgccgcttgacctctttggcttgcgtcgcagcggctccagatatatggccgagctctataaggtcttcgaccaagagatggagagccggttagccagaggtcgtcgtacagacgaggaggaggacatgttgggcgtcctcctcgcccggcacgccaggtcggagatcacgcgtgcagacatctccaaactcttagcggtatataagcacatgctgcatgcattatacacacacatttatatatatactaaatgtaaaataaaataatacataaaatatacaggatatctttctcgccggcactgacaccaccaggattgccgtggaatgggctatgaggaggctgcttcgccacccggacaagctggagaaggtgcgcgccgagctcgccgcgagtctaggctccaaggagtttgtggaagagagcgacctggaggagctcccctacctccacgccgtggtgaaggaggtcatgcggctgcacccttccttgccgatgttgccgcgggaggtggtcacagacgacgggatgtcactgggcggtttctgggtgcccaaaggcacatgcattatggtcaacctgttggctctcggaagggacgcaacctcctggccggagccagaggagttcgtgcccgagagattcttgggcggcggcggccggccattgagcttcaggggctcggacttctcctacatcccgttcggtgctgggcgtagagtgtgccccggaatggacttggctgcacggttcgtgccgctggtgttggcctcactcctgtacagggttgagtggaagctgtgcggcgacgacgccatgacgcctgtggacgacgtcctcagagagaagagttccatattacttgaacccgctatgcccctccgtgccatcccgctcttcactccatgaccaacaagtcgatcatctccatatctgcctggaccagcagtttaatttgcatgcatgacgatcgacgacgacaccatttttcttttcttttcttttctttttctttctccttacaataatgaagtgcatgtgacagtatttcaaagtgttatgtcatcttgagaaataaggggaaaatggtgttgccaacaagcttagcgaatgtatatatgtcatcttgaatgctttttttgtcccaaaaatgtgcaaacacgcgtgcacatgccacccacggcaagcagcaacagcaagatccatgacatcattttgatttgtgtttcaatctcttttttctcaagcatggcaagatccacggcattcttttgttagatctatggtgttgtgtgtgtgtgttttttttgggttcatctgtgtgataaatggcaagacctactcgactgtcaggctcaacgggccggcccaagtacgcctaaacagcccagtgccgtgcttgggctgagtgctgagtccataaatgatggcacggcctgcgtaactaattgggagtcgctttggccccgcgcccggcccgcccaaccttccaggaaccagtcctcctccgtctccatcttatcatccgccaataatgctgcgccgcaacccaacccgcatcgagctcacctcctccgaccgcgacgagctcgaagaccacctccgcgccgccgcggcagccaccaccaccaaggatccttccggttacaccactccgtctccagtccttggcccgcagacctccaatcccctgctccaattcctccacccgaagcccggcgccgtgccatccaagtcccaacgcatcggcatcggcctctccaccccgccggctccggccccgaacccgcgaccaccccatccaccccatggaggttgagatcaagctccgcctccccgacgccgccgcgcaccgccgcctgtccgcgttcctcgcgccccgcctccgccgcacccacgcccagcggaacctcttcttcgacgacgccgcgcgcacgctcggagccgccaccgccgcgctccgcgtccgcctctacgacgggcccgacgaccgcgccccctcgcgcgccgtcctcgcgctcaagcgccgcccgcggatcgaggccggcgtcagccgcgtcgaggagatcgaggagcccctcgagcccgcgctcgccgtcgcctgcgccgacgaccccgcccgcctcggcggcctcgactcgccgatcatccgcctcgtcgccgccgagtacggcgtcggcggggacgccgcccccttcctctgcctcggcggcttcgggaacacgcgcgctgtctacgagtacgagcttgaggacggcggcggcggcctcgtgctggagctcgacgagacgcggttcgactttgggaccaggtacgagctcgagtgcgagacggcggagcctgaccgggtcaaggaggtgctggagcgactgctcacggtggccggcgtgccctacgagtactgtcggaacagcaagttcgcctgcttcatgacagggaagctgcttccttgactaggcatagccttgtccgttcttggtatttcccttcttcgtgccattaagctgcatttgaacaacttgaatggaatgtcagtgacgctttgaataatgacaaaaataagtgtggcttctcataaaaaaaaaaaaaaaaaaaaaaaaaaaaaaaaaaccaaaaaaaaaaaaaaaaaagcggcc

SEQ ID NO: 9363 - DNA, 1108 bp, Zea mays
acgcacgagaaaccagcaaccagtcctcctccgtctccatcttatcatccgccaatgctgcgccgcaacccaacccgcatcgagctcacctcctccgaccgcgacgagctcgaagaccacctccgcgccgccgcggcgagctccgcggcagccgccaccaccaaggatccttccggttacaccactccgtctccagtccttggcccgcagacctccaatcccctgctccaattcctccacccgaagcccggcgccgcgccatccaagtcccaacgcatcggcatcggcctctccaccccgccggctccggccccgaacccgcgaccaccccatccaccccatggaggttgagatcaagctccgcctccccgacgccgccgcgcaccgccgcctgtccgcgttcctcgcgccccgcctccgccgcacccacgcccagcggaacctcttcttcgacgacgccgcgcgcacgctcggagccgccaccgccgcgctccgcgtccgcctctacgacgggcccgacgaccgcgccccctcgcgcgccgtcctcgcgctcaagcgccgcgcgcggatcgaggccggcgtcagccgcgtcgaggagatcgaggagcccctcgagcccgcgctcgccgtcgcctgcgccgacgaccccgcccgcctcggcggcctcgactcgccgatcatccgcctcgtcgccgccgagtacggcgtcggcggggacgccgcccccttcctctgcctcggcggcttcgggaacacgcgcgctgtctacgagtacgagctcgaggacggcggcggcggcgtcgtgctggagctcgacgagacgcggttcgactttgggaccaggtacgagctcgagtgcgagacggcggagcctgaccgggtcaaggcggtgctggagcgactgctcacggtggccggcgtgccctacgagtactgtcggagcagcaagttcgcctgctttatgtcagggaagctgcttccttgactaggcatagccttgtccgttcttggtatttcccttcttcgtgccattaagctgcatttgaacaacttgaatggaatgccagtgacgctttgaataatgacaaaaataagtgcggcttctcat

SEQ ID NO: 9364 - DNA, 2457 bp, Zea mays
ggtatccaggctgctgtcctcgctaccatggacgcttgtctcaaggaacttaggcgcaccaacaaggtggatgttgaggacctcaccgtcgacaagggtctcttcaagtccttcgatgagatcgtccggaggcagctcgaccccatctggcacactcttgggaagaagacaaagcagcttgtggctgacctcaggacgctacgcaagctgcttgattacctcgtcaggtatgacgccgttacatacttgaagtaccttgacacattgagagtatcagaaggtgtcagatcagtttggatacttgctgactcaagccataggatatttgagcttgcaaaaaggcgcgtttaccaggcagtgagaacagatggtgttaaggttagcatagataataagggcacaccaacaaagaagaggaaagtggcacataattctaccaagaaaggaaaagtaactgaaaatgaagattccactgtaggtcccaacactcagaaggctaatactgatgtgggcattgtattggaagaggttttggaggaggcaccgaaatggaaagtgttatgggaattgttgcaagagataacagaacaacggatgaagagcagtgccgggaatgtgcatgatgaggacaaaaatgatgaaagtggcatagttttggtatcatgtaaagatgaacgcacatgcttgcagctgcaggaatgcatattaaaaggcccctgtcaggttatgcgagaagagtgggagaagtatctgattggaaaagctgagctgcatggattgaataaggacaagagaaaatctgagcaaccaaaaggtgttggtgtcctggatggtgaagttcaaatgggatctagtgagagtgtgtgtccagttagcattagcaaactcgaaactaatgccttacttgccgctgcctctgaattaagaaatatatcaaatgaagcagatgtcaagagtggctcaaatagcagctgcagcaaggctgggggagcaaaggggaaaccaaagaaaaccatttcaaagagacaaggcagcaatcgaaaaaataaaagtaaggaggcgacagcaacgggcctcggtactggtctggattctgaaggtcaatcaggaaaagcagatgtacaggctgagattgttgcttctaagatgtccgcatatgatgcttccatgtcagcctctacttctaatgttaaatttaaccattcatctgctttcggaaacttggcaaacgccaaaccactacctcctgtgcagtttcatgctctagacagtgaccatcaggttcttgatgtatggaagccatctgtcattattgtttatcatccagatattacctttgtaagagaaattgaagtatacaaggcagaaaactcatcaaggaagttaaaagtttacttccttttttatgaagattccactgaggtgcaaaaatatgagtccagcattcgacgggaaaatgaagcatttgaatctttgatcagacagaagtccctgatgatgatacctgttgatcaggtggtgtttcactctgtcactaaagttttaatttcagtctgaccttcgcaaagtggttactgcatgaatgatgccacacaatgcttagtcaaatggtctttgcacctttctacgaatctatgatggcagttgcattggaccaactgttgcaaatgaaccagagcctcctatatgtcagaactcaattacaagaaaggcaggtggtaaaaaggcgcccgagaaggagatgcaggttattgtagacatgagagagttcatgagcagccttccgaatgtattacatcaaaaaggttgagacaatggcacgttactacaagatcccggttctcctcatcgagttctcacaagataagagcttttcctttcagtctgcaaatgagattggtgatgatgtctctccgaccaacattatctcgaagctttctctgctagtgctgcattttcctcggcttcgcataatctggtcacgcagcttgcatgctacagcagaaatatttatgtcactgaaaacaaaccaggatgaacctgatgagaaaaaagcaacaagagttggcgtgccctccgaggatggtatcgtggaggatgatgtgaggtctgaaaattacaacacatcagccattgagttcttaagaaggcttcctggggtgacggattccaactaccgagcaatcatggatggatgcaatagcttggccgagctggccctgcttccagtggaaaggttggcggagctaatgggtggtcagaaagctgcgcggacgctcaaggagtttctcgatgccaagtgcccaaccatgttgtagccagagtgacgctgtactgtttgtattgtgtcctgtgggatacaaatacttcagttgatgtgccttatatatatattaaaaaaacaaatgttgtacactaccaatgccaatgccaatgcctgtgcatgttgttgtctgg

SEQ ID NO: 9365 - DNA, 2360 bp, Zea mays
ttttttttttttttttacatgaagcagccgaagagcaggatacagtgtgcatctttatgttgtcctccgatgtatgtttcatcgttgacaaggtaccatgtaaatttctccctttcagtaagtgctttcaggacaacttagtttcataatagtataacacatgttcgtacttaaattatgaaacctctaaaataacagcttagaattttgcttgccacataacacaaaactactgcctcatatctcgctccctttctttcaccagatcaccatgtatagattatgtgttaactacaagacatcctatgcaatatgtaagcattctgtaatataaacacgagatgtgcaccgggaaccaccgcagcaaaattgtttccaacatcaccaagtcacatctttaatcctctggagatcaagatgtctccgtacagttcatctcctttccgttccagctgagtaaccttgatgtaatcacaagttgccaaaacagctatttgatagaatagtcgggctgccctggctttggtcattccatgagctaaatgacttaaggattcagattgtgggacacctggggtatcgaaatgaagtttgagatgcgactggattgtttctgtgatcttgtccattggattggagcgcctctcatatggggtttgagtcggttcagtttcttccagtaggtcaggagttggcacataatctgaaagccttctcatcttgaagtccctcacttcctgctccagtggaaaatcttcctcaacagtatcaagattccccaagcttcttgcagatgaatgctgcccccttttggaccttccacttcctgatggcaattgtacttctggatccaattgtataaacgccgatccagagccaccagagcttgaagcagacctgcgacttaacccaggacttccaggagtaacactatggtcactgtgaagaatattgtaagctctgtcatattttgcactcatgtttgccctgagtttttcaatgccatctgttaaatccatcggcagaccacctgtttccatctcatactctcccccagcctgaggtggtgagtttttcggttgtggttcttgtgatgatgatcgctgccctcctgaagaagcttttgtggacttgacctcagtgcagtccttccagagctgcataagtggcttaggataacataattctgagaacaagttgtcatgagatattagagcaaccggggggatgtgcatgagatcacttatcttggttgatcgaataaaattaaaattgctgttaagtttacgcctttttgagacaaggcttgatgcatccttcagccatgtctgatatatgtttcctgggatcatcatctggttattgtccataattactcgtgggacttcccaacgtgctttccgctttgatgctttcggtggttgcttcatcttctgttcctcttggtcctctggtcccccttgttgaggttctccatgaacaggggagggggcagcgtagtacggttcttcttgttgaggaatgtcttcctgcctaggtggtgacggaatcagcgtacttggaacttgtgggtactcatcaggagtgatattgactgtggtctcatcatctgctatgtcaaatctctcaaagtgattgaataaatcagtttctgcaagcccagactcaaaattatcgaccagggttatattcactgctttagcttgatgacgatcatcagcatgagagaagtcatcatcatcaagattgacttgaacatactgttcatccagatcttccaatcccattcgtcggaacttggcaccatcaggctctgagaaaaacatgggctgttccaccaccatattgatctctggcagtgttactgcttcatacttggcttgagttttacccttggggaggacggtggggtctgtgaccggtttgatccgccatgcctcgttgatctcagtcagaagccgagagacatcagtgtagagaagcttcaccttcctctcgtacacgatcaccacgccacccatgaggattccagagagcctcagagccatgggcaccgaggggttcaaaatttcctcacagattttgatgatgtcgagcttgtcgagccgtttgcggttgatcttcgagtggagcgtcgccgccatccatatctggccgagcggcgccttccgcgcgagaagctgatgcgagtagaacattctcgaccgaacgggcagaggaggaggaggaagagggctcggagcggagcggcgcgccgccgcggaggcagcgagaagcgaagtgtgtgttggtatgggggttttggcctcggctaggagaggctggaccgctggaccgctggagagctgggttgtctactt

SEQ ID NO: 9366 - DNA, 1097 bp, Zea mays
  misc_feature (10)..(12): n is a, c, g, or t
gaaaactcannncggaagttaaaagtttacttcctttttttatgaagattccactgaggtgcaaaaatatgagtccagcattcgacgggaaaatgaagcatttgaatctttgatcagacagaagtccctgatgatgatacctgttgatcaggatggcagttgcattggaccaactgttgcaaatgaaccagagcctcctatatgtcagaactcaattacaagaaaggcaggtggtaaaaaggcgcccgagaaggagatgcaggttattgtagacatgagagagttcatgagcagccttccgaatgtattacatcaaaaaggtatccgaatcgtaccggtcacccttgaagttggtgactatgtgctctctcctttgatctgtgttgaacggaaaagtatcgcggacttgttccaaagctttgcttctggtcgtctgtacaatcaggttgagacaatggcacgttactacaagatcccggttctcctcatcgagttctcacaagataagagcttttcctttcagtctgcaaatgagattggtgatgatgtctctccgaccaacattatctcgaagctttctctgctagtgctgcattttcctcggcttcgcataatctggtcacgcagcttgcatgctacagcagaaatatttatgtcactgaaaacaaaccaggatgaacctgatgagaaaaaagcaacaagagttggcgtgccctccgaggatggtatcgtggaggatgatgtgaggtctgaaaattacaacacatcagccattgagttcttaagaaggcttcctggggtgacggattccaactaccgagcaatcatggatggatgcaatagcttggccgagctggccctgcttccagtggaaaggttggcggagctaatgggtggtcagaaagctgcgcggacgctcaaggagtttctcgatgccaagtgcccaaccatgttgtagccagagtgacgctgtactgtttgtattgtgtcctgtgggatacaaatacttcagttgatgtgccttatatatatattaaaaaaacaaatgttgtataatagtaatgccaattccaatgcctccccccgttgttgtttgt

SEQ ID NO: 9367 - DNA, 1689 bp, Zea mays
caccgcgcccccggcggcggcaccgacgcgacgcgctccagtcccctccatcgctgcgtccaccttctgtagtccagttgtagccgcttgccgatggcgcggccggcggcgaaggcgcgggtgccgaagcacttggtggcgctcgccgtcgtcgccatcctcggcctcgtactcgtcgctgactacctctgggcttcgtcctccgcgtcgtcctcggccgtctggtcctccaggcttaatctccacaccggacccgccggttcgacgccgcccgtcgcgaagaagattaaggaggacaagaaatctgtaggttcgactggcataaatgcaacttttgcggacttgccagctccagaactgaaatgggaggagatggctgaagcacctgtggcccgtttggatggcgctgctatacagattaagaatctcttatatgtatttgctgggtatggcaccattaaccatgtgcattctcatgttgatatatacaatttctcggataatacatggggtggaagatttgacatgcccgaagacatggcacattcacatttggggatggttactgatggaagattcatctatgtggtaactggacagtatggtccacaatgtaggggaccaacaactcgaaattttgtattggacacagaaacaaaagaatggcgtggcatgccaccattgccagttcctagatatgctccagcaacacaactttggagaggcagacttcatgtgatgggtggcagcaaggaggataggcatgaacctgcgcttgaacactggagtctcgcggtaaaggatgggaaagcattggagaaagagtggaggagcgagaaaccaataccgcgtggaggtcctcatagggcttgtgtagttgcaaatgataaactccttgttattggtggtcaagaaggtgatttcatggccaagcctgggtctcctatatttaaatgtgttagaagaagtgaggttgtgtatagtaatgtttatatgcttgatgatggaacgacttggaaggaacttccacctatgccaaaaccagattcacatatagaatttgcttgggtgaatgtcaacaattctcttgttattgctggaggaacgacagataagcacccaataactaaaaagatggtgttggttggtgaagtatttcggttcaatctgggtacgctggaatggagtgtgattgggcggttacctttccgaatcaagaccacattggtaggatactgggatggctggctgtatttcacttctgggcaacgagacaaaggaccaaaagacccgtctcctaaaaaggttgttgggtgcatgtggagaactaaattgcacttgtgatttcctttaaaagaactaagccgttctttggttttatggtttacaaaactgtttcaatcccctcatgggcgagttctttcttggttatatatcgtaggtgaaatgggtggcgttggggactgtctgccattgccaccggtgtgttgtatgtttattcttttagttaggatcaccaacttttgcaccattttgtacagagagaatcgatctgtccaggtgctgtcgcaatcttgtaagttgtagcgtgtaccttttttttattgagctcttacactcatcttctaaaattaatcacaacttcaacttgagccaaaaaaaaaaaaaagaaaaaaaaaaaaaaaaggg

SEQ ID NO: 9368 - DNA, 3258 bp, Zea mays
  misc_feature (347)..(347): n is a, c, g, or t
tctattttaaaatattaaatttgtcctaacagtttgaatttccacttccatccctaattttaaccctttccctctctcaaacggtcacttagaccagatgagccttttccttaatcacacgggtcactaagaccctgtaaagaccaccacacacttatgtgtctcttgctagttttacaaagcacttaggatttagaaagagaaaggaagaaggcaatccaagcaacaagagcgcaaatgaacacaaatgatctcctctcaagtttctaagcactagagttgattttggaaacttggagtgcattgaatgctttgaatgtgtctttgaatggttgtctttgctgttntattgaataggaagttcagaatacttggatggctttgaatgaggtggttgagggtatttatagccccaatcacttcctagttgtttgctgtttttgttgtcgatgggcgcaccggacagtccggtggtgcaccggacactgcactgttcattgtccggtacgtgccacatcagctatccgttagggtttggagcagttgaccgttggcgtcttctgtcttcaagcgacacgggacagtccggtggcacaccggacatgtctgatgacctctaactttctgctctgacttctgacttgcattgttcatcgtgacagtcgaccgttggtgcgcagggagccgttgccccgctggctcaccggacagtccggtgaattatagcggagcgtgcctggtgaattcccgagagtggctggttcgtttgtgtctgggcctggtgcaccggacagtgtctggtgcgccacttggcagcacactctcatgtcttgctccaactttaattgtgtccccaactgaatttctttcttggtttatgttgaaccttatacacctgagataattgacatctaggcaaactagttagttcacatggtttgtgttgatcgtcaatcaccaaaatcgattataggaaatgattacgtccattttcctttcagcgacgcgctgccgttgctcaactacgaccaccagagcgtcattgacttcaagatgctcctattgcgctgcgtcggcgatgatggagggaaaacccgacagttgggagaacgaggtttacaaactagccataaaagtagttttcttaaataaaaatcgccttcgtctgctctgaaagagtccaaacgagtgtcctcaatatttttttagtgacgttatttttatttttaaaagttaaattatcaccttggcttcgagtcttcgactgccctgaaactctgaaagagtccaagcgagtgtcctcagtcctctcctcgactgctcccctccttccagagtcacggtgcctcgccgtccttccctgatctgacaacccgtttaccttgcccggccggtccactccgacggctggcccgcccttctttaaccccgccaccccgatccagcccagccgcactccaacacggtagcagcagtcaacagactcccaccgcaatggccgcggcgctcctcttgctgctcgtgccgcccgtcggcctactcgccgcgctcgcattcctcacgcggccccgcgcccggatcgcgctcaaagacagccacgtcttcatcacgggcgggtccagcggcatcgggctcgccatggccacggccgctgcgcgggagggcgcgcgggtctccatcctggcccgcaaccttgcccgcctcgaggaggcgcgcgccgccatccagcgcgactcgggccgcgacgacgtcggcgtccacgcggccgacgtgcgggacgccgacgccgtggcccgtgctctccaggaggccggccccgtcgacgtcctggtctgcaaccacggcgtgttcgtgccgcaggagctcgagaggcaggacatggatgagatcaagtggatggtggacatcaacctcatgggcaccttccacctcattaaggccgcgcttcccgccatgaaggcacgcacccgcgagacgcggctccctgggtccatcgcgatcatgtcctcccaggccggccaggtagacgccgccgcaaatcgctcgctgactcgctgttgcctgccttgcagctaaggtgttcgatgtaatgctgctcgattgggtgattgatattttttattggtgatatctttgctgcaggttggtatttatggttacactgcctactcagcgagcaagtttgctcttcgtggattgggtgaggcgttgcagcatgaggtcgtcggggacaacattcatgtctcgttgatattccctcctgacactgaaactccaggattggaagagggtatgcgttgcttatgaacaggcaaactacatttaagttcatgtctgcttcggtagcaactaaaaagttaaccatgaatatttgagttaccctcttcgatttaatagccaagcttttcaacttggcaaaactgaaaatatcagagctatcttctataaaaatattgtttattattactcacttcagcaactgatctcagcaatcggtaacacttacacttgcctgtaaatcagtactctgtatattaaaactcatagaccaaaacatgttgctagtgaatatttcacactttcatttgtttcattcggtgcatggatcaatagtgtgctctcatttgtttcattagtacaagtttcatagtatcacaaatattttttttgggtgggtgggggagtagaaaaatgtcacttaagtttggcatcctaagttctgaagacacagtcaacatatattgctactgaatgctgagcatgtgttttgcctaatttcagagcataagaggaggccagaattgacaaacatcatagcaggattgtctggtggaatgaaggccgacgatgttgccaagaaggctctggatggtatcaaatctgcaaaattcattgtcccatgcaatttcgagggcacaatgttagctgtagccactgctggtttatccccacagagctccgcattaatggcattcatagaggtgattggcaccggactcatgcggtttgcggcactttgtttccaatggaattggttctctaccatagagagctattatgccaagaacaagaagagccagtgataacacaaaccatacctggaccttaggtcagtcactcagttgcatgtaaataaagtttattatagtcgaccttactatgttgaccacctacaatttgatgtataagattcaaatgaaatttgaataaaattttagttttcctcccaaaacaaatcatacaacaaaattcatagat

SEQ ID NO: 9369 - DNA, 1425 bp, Zea mays
cctcgagacggtcgggccggggcgtaccagagagcgcgaacgccctaggatactttcgcatcgatcacgaccagacagaccttcggctgccctgaaagagccggtccactccgacggcccgcgccacccttctttaaccccgccacccagatccagccgcgccgcactccaccacggcccccacaactccaccgctagcagcagccaacagactcccgtcgggatggccgtggcgctcctcctcctgctggtgacgcccgtcgggctgctcgccgcgctcgcgctcctcacgcggccccgggccgcgcgggtcccgctcaaaggccgccacgtcttcatcacgggcgggtccagcggcatcgggctcgccatggccacggccgcggcgcgggagggcgcgcgggtctccatcctggcccgcaacctcgcccgcctcgaggacgcgcgcgccgccatccagcgcgactcgggcagggacgacgtcggcgtccacgcggccgacgtgcgggacgccggcgccgtcgcgcgcgcgctccaggaggccggccccgtcgacgtcctcgtctgcaaccacggcgtgttcgtgccgcaggagctcgaggggcaggacgtggatgagatcaagtggatggtggacatcaacctcatgggcagcttccacctcatcaaggccgcgcttccggccatgaaggcgcgcacccgcgagacgcgcctccctggctccatcgccatcatgtcctcccaggccggccaggttggtatttatggttacactgcctactcagcgagcaagttcgctcttcgcggattgggtgaggcgttgcagcatgaggtcatcgcggacaacattcatgtctcgttgatattccctcctgacaccgagactccaggattggaagaggagcataagaggaggccggaattgacaaacatcatagcagggtcatccggtggaatgaaggccgacgatgttgccaagaaggctctggacggcatcaaatccgcaaaattcattgtcccctgtaatttcgagggcgcaatgttagccgtagccaccgctggtttatccccgcagagctccccgttaatggcattcctagaagtggttggcgctggactcatgcggtttgcggcaatttgtttccagtggaattggttctccaccatcgagagctattatgccaagaaaaagaagagcgagtgatagcacaaaccacagctggacattattttcctagatcccgtgagagtcaaaagaaacaaataagtcacgtctgacctaatgtaaatgtagcgtggtagtattagagaagttgaagctatcttctttttaatggtttttttcatcagatcatgtctacaatatcagattctgttaaaaacaatggttcgtgagattttgatgacgcaaaaaaaaaaaaaaaa

SEQ ID NO: 9370 - DNA, 1305 bp, Zea mays
taaaaccatcgccctgcccccgtctccgcctccgctgcatcccatggcggctgtgcagcgcctcctccgggcagtcgcccccggtggctcggcagcggcggcggtcaggaggcgcatgacgtcgcttgcgccggagcaggcgccgtctgcagccgccgggttcccattcgcggcggagcagagggcaaggcggccggtggcggcggagaggaacgtgcagtgggtgttcctgggctgccccggcgtgggcaagggcacctacgcgagccgcctgtcgcgcctcctcggcgtgccgcacatcgcgacgggggatcttgttcgcgacgagctcacctccaccgggccacttgctacgcagcttgctgaaattgttaatcaggggaaattagtttctgatgaaattatcatcaatcttttgtccaaaaggcttaagaaaggagaagaccagggagaatcaggatttattcttgatggttttccccgtacagtcggcccggcggaaattcttgatggcgttacagacattgatatggtggttaatctgaaactaagagaagatgttatagtagagaagtgccttggcagaaggatttgcggccaatgtggaaagaacttcaatttggcctgcattgatgttaagggtgaaaatggactcccaccaatctacatggcaccactgttgcccccaaacaactgcatgtcgaagcttattacccgagctgatgataccgaagaggtggtcagaaatcggcttcagatatataatgacatgagtcaacctgtggaaggtttctaccgagagcaggggaagctcttggaatttgacttgcctggtgggatccctgaatcttggccaaagctgctccaggttctaaacctcgaggaccaagaggagttgaggttggctgcagcgtaggtctctgggagaccgacctacatactgggaaaaaagaccataccacatttttttgaataatggagaagaggaaacttactccatagtttagtgcgttatgcagaagtaatggttttcttgtcaaaaagcgatttgttggtttccaccggcgttttgatggtgagccggtactatgtaacttacgatagctgtaagcactaagcagcccattcttgcttgggacacagtttggagcgcatgaagacatgatgtagtgtttttttttaattcataacaaacttgtagtacacatttgtgttcatgataaaacactgaagtagtatgatactacagaacaaaaaaaaaaaaaaaaaaaaaaaaaaaaaaaaaaaaaaaaaaaaaggggggag

SEQ ID NO: 9371 - DNA, 1538 bp, Zea mays
atccgccgccgcagtcgtcgcttcgctaccgtccagtggggccgagtggccgacccatccaccggaccacggtagaccggttgcacgcccccaatcgacccaccttcttctacaagccactctccctccccgtcgaatctcagtatctcactcccagtcgcctccgcacatacaaatacgcgacgggaacggccagggccgaaccctaaaaccatcgccctgcccccgcctccgcctccgcctccgctgcatcccatggcggccgtgcagcgcctcctccgggcagtcgcccccggtggctcggcagcggcggcggtcaggaggcgcatgacgtcgcttgcgccggagcaggcgccgtctgcggccgccgggttcccattcgcggcggagcagagagcaaggcggccggtggcggcggagaggaacgtgcagtgggtgttcctgggctgccccggcgtgggcaagggcacctacgcgagccgcctgtcgcgcctcctcggcgtgccgcacatcgcgacgggggatcttgttcgcgacgagctcgcctccaccgggccacttgctacgcagcttgctgaaattgttaatcaggggaaattagtttctgatgaaattatcatcaatcttttgtccaaaaggcttaagaaaggagaagaccagggagaatcaggatttattcttgatggttttccccgtacagtaaaacaagcggaaattcttgatggcgttacagacattgatatggtggttaatctgaaactaagagaagatgttatagtagagaagtgccttggcagaaggatttgcggccaatgtggaaagaacttcaatttggcctgcattgatgttaagggtgaaaatggactcccaccaatctacatggcaccactgttgcccccaaacaactgcatgtcgaagcttattacccgagctgatgataccgaagaggtggtcagaaatcggcttcagatatataatgacatgagtcaacctgtggaaggtttctaccgagagcaggggaagctcttggaatttgacttgcctggtgggatccctgaatcttggccaaagctgctccaggttctaaacctcgaggaccaagaggagttgaggttggctgcagcgtagccgcgtaggtctctgggagaccgacctacatactgggaaaaagaccataccacattttttttgaataatggagaagaggaaacttactccatagtttagtgcgttatgcagaagtaatggttttcttgtaaaaatcgatttgttggtttccaccggcgttttgatgatgagccggtactatgtaacttacgatagctgtaagcactaagcagcccattcttgcttgggacacagtttggagcgcatgaagacatgctgtagtgtttttttttttaattcataacaaacttgtagtacacatttgtgttcatgataaaacactgaagtagtatgatactacagaacaacacagacctgatgaatgcctaaaaaaaaaaaaaaaaaaaaaaaactcgaggcaatactcgtgc

SEQ ID NO: 9372 - DNA, 2543 bp, Zea mays
atttagccaaacagttttacaatgaatcttagatccaccagtggagctactccaatataaagtcttagattcagattcacatttttattaatgagattgttgcaaataaatctttaaaagtgaaaaaataaaatcttttatatcagtatgtaaatgagaatatagagaaggcacatggagcctagaggatattgttcgagtagcttcttctttgtggctagaaagaaagtcaagtcaatggcgcatgagtcgacacgtcagttgggtggcatgtcccaatcaccatgtccatgtacgcggtgccgacgaggtactccctccctccgctctcttttaaattactgggcgcccgcgtgggtgtcgagcgacgggtccagtagcctgctagctatctatcagtgatccctcgcgaacgatgtgggacgggctggagagcgcggcgaccgtggcgcagctggtcggtctcgacgtcggcggcctcatcaccatgatcgggcaggcggcgcggaaggctcggcagaacaccaaggactgcgagcacctagcccgccgcgtcggcatgctcgcggagctggtcccccacctgcaggacccggaggccaggcgggcggtggccgggctcaaagatgcgctcgtggaggctcaccagctcatcacatcctgccagaggagggggctcacgtcccagctgttctcggcgtccaggcaggccgacaggttcagggacgtcgagcgcaagatcgaaacctgcgtgtccatcatccctgtcatcggctacatcggcataacaagacgcctcgatggttcgcaatcccagtcccagctggtaagtgttcatcgtcgtctatccatcgtcaagtcaactctctttctttctgtgatgcatgtattgtcttggatcagtcggcgggaggggctgaggatcgggagttcacgctggcggagatcgccgtggccaccaacaacttcgccgtcgtgctcagcaacgacgccgacactggcaccaaggtatccaagggaaggctcctgcagaacgggcccgaggtggccgtcaagcgcctcaaccgcgcgcggcggggagcggaggacgccttcttcgcggagcagcacatcctctcgccgctccgccacgaccgcatcgtccgcctcctgggcacctgcgccgacgacggcgagcgcatgctgctcacccagtacatgcccaacggctcgctccacgaccacctgcacgggcaccacctgtcgtcctcgtcggcgtcgccggtgacggcgtcctggaggactcgcgtccaggtgctgcttggcacggcgcgcgccgtcgagcacctccactgccacgccgtgccgctcatcatccacggcaacgtcgcctcctccaacgtcctcctggacgccgcctgggcgccgcgcctggccggcttcggcgcatcggtgtggcgcgcggccggcgtggactcccagcccgtggaggtcgccggcgccgcgtcgtgcggcgggtacgccgacccggagtactgcggcacgggccggatcaggccggcgagcgacgtttacggcctcggcgtgctgatgctcgaggtcctgacggggcaaccaccggtggtcagtgtctgggacgcggcgaagcagggcgtggtggccgtgaccttggcgtcgttcgcgctgccgagcatccaggccggccggcttggggacgtgctcgacaggcgtccggcgccgcagcagctccagccgctgcagctggtggccaacatggcggcgcgttgtctgcatctgcaggggggtagtcgcccggccatatcagacgtcgtcgccaacctcgagcaggcactccgcctcatatgaaagcatgtggacatctttgcttgtacaaaagtgaacttgcttgtcgttcagctagctatgatgctcaaactgtgtctgtgtgtacgtttggtccgtgcgagtcctcctagtagaccatggtagacttgcaacatttgcgcaacatctcctactagagaagcagcagggtgcatcaatgatggtgcccaaatatggctgccagcgtccttgcattgctccaccattacccatgattttcttgattgctttgtctcatgaaataattgtacgagcaattcaataatatggtggatctctctaccgtcgatatgggcgaagacataaaatgacccataaattagccttaaaaagttgacaaagcaactaacattatatgaggaagaagaggctaaagaggaagatgacgaagattagtagtggtgtattatgtgattttatttgcttaattatttatttcgataaaatgacgtgttttatgcaaaagggaaactaatgtgaccacaaggtaatttataggctaaacaaaactagagtgttataataggtataagagttgacggtgattgataataaaatcaataatacggtcagtagctatgtggagtgcagggagatatatttgtcctatagcgcgcgcggtccatgtggctgcctttgagaacacagcagcgataataatgcagggggatcatatagag

SEQ ID NO: 9373 - DNA, 3754 bp, Zea mays
gtcctgtcggtcctgaccgtccgccacatggtggaggcccatcctttgattgcgtggccatgtcataaactagcatactacactgttccattgctttctgatcgtcaatttgcggtctgagaaacccaactgcctttgtatttataactccacactgtcccccttttttcttattactccgctccgtgaagcaaaagtcaaagacggacgatatggtgatattcaaaagctggagattaaaaaatgcggcgcttttcgcgagactgctctagagcccactacttgagttcgctgattagaaaacggaccgtttttgttttcgaaacacagtaaaacagacggctagtttggaaactagatcaagaaaaataaactgttttccttctctagaaacacgtttcgttcatatacttttactgaaatccaggagagaatttagggagtttgttggggtcagccccggtaaaatttataaatcctttagcaggacacttttaaggttaaagaaaaattatatagcataacacacacacggacggacacgatcctttcggccccgacactaataaaagcacactgacgagacagtgacgctgtgttgcatccacgttttcccaatatccgcatccttatccatccattcaggcattcgacggtggcgctcgagcacataacatacacccccatttcgcgcccttttcctggcgccacgaccacgaccgcgaccctttcgcggcaacagctctcgcttgcggctgaacgcagaaccgaatcgaagacgatatccgttttgaccttctgaagccccagccgtgtcgacgcgcacagtcgcgaaaaagctaaacatgacacaggaacgataaacaaatccgaatcggacgatgaccgatcgagctggcgtacaatgcgggatatcgcatcaccgctgacagcgcaaaaaaaaaataaagcgaaagcctgtcaacttgtcgacaagtatcgagcgcgcacgcggaagcagaggagatgcgttatcaccgcctgcggttttatgatgataggaaatgacagggcaagccgcgagcgggcgatcaggtccgccggcgacaggaccaaccccacgactcggcgcgccgcgcccccctgtcaatctgggcgagcgatcggcggggcggattttcgcgcgcggtcgcggatatgactcggcgccgcgtcggacacgacgctgactcggagccgcggcggccgggcgccagccaaagtgggggtaaagcaaaagaaaaggagaactcaaagaaaagaaccacctgcgtgcctcatgccctcatctcgtgctgcgtgcgttgccagtgaccgaacgtgtgtgacggtgtcttccatacacgcggaagcaaaaaaaaagaaccttctccgtggtcatccagaacgtagtggggtggggccggcatgccgcaatggacccttctatactatacctaccctgtttccacctcatccccggcgtcaattgaggtcctgcaacgttgtacgtacgtgtacaactaacttatgagtggcaacgttgattttttctttaagcgcgaacagttaggttggttttgtcccaaaaatattaaggtacatacatccgagtatccgacgaggcgacgactatatcagagccggccttaattagaggcccgtcccgaactgcatgcatacacatgcacgtaacagggttcggtcggtggatatgaatatatacggaccacggcctgcatgcatgcatgcgcgtgtgcgtggatgccactcatggatggcacatgaacacagagtagcagcgggccccttgcacatgctggaggagtgccattacccattaggtacccgtccaactgcaccttggaaatcttcttttatcctccactcctcatggcctcatgggggatgatgactgttccattcaaaagcggcttcggcatcggatagacacccagctttttgatggctgtgaacgtcaaaaaaaaaaatactactacatgtgtatactattgacaggttccccagcttataaaggacaccctcatcttcccatttggagcacggagctcgagcagccagcgacgacaacccacgcgcacaccaaccaacaagccacaccggcccacaggccacagctcaccagctaggctagcaaccacctcgatcgcagaggcagaggccgccggaagctcagccgtgaattcggcaggaaggaaaggaaaaagtcttgggtggtttcaacaagagatagaagatggagaaggcagggcagcacgagcatgtgatcggcatccccgtgaacaacagggcgttcggtatcgaggagccagatttccccagcaatggccccgccaagaacgcagccgccggcgccgggggacggcgccgggtgaccggggacagggtcgcccaaggcctgaaagagcacggtaagttcttctatctccgatccaaccaaaacattcgatgcttctaccgtgcatcctttgtctgtcatctttccagctgcccatccatccgtggattggcacctcctgtatctcgagagactgaactgaacgtgctcttaccgtgtttgcagtgacgctgggcccgaagctgtacgagaccgtgaagggcaagctgtcgctgggggcgaggatcctgcgggcgggcggcgtggggaaggtgttccggcgctggttctcctcccccgtcggcgggggcggcgagcggctgctcagggcgtcgcagtgctacctgtcgaccacggccggcccgatcgccggcatgctgttcgtgtccaccgagagggtcgcgttccggagcgaccgctcgctggcgctgccgctgacgtctccggccggcggcggcagcggcagcggcacgacgacggtgctgcgggtgccgtacaaggtgtccatcccgctgcgcagggtcgcggcggccaggccgggccagaacagggaccggccggagcacaagtacgtgcaggtcgtcacgcgcgacggcttcgacttctggttcatgggcttcgtcaggtaccaggcgtccctgcaggagctggagaaggccgtcgcgcagtcgcagtcgcaatgacctcaggcgatccgccggccggcccggcgattgttgtgctcctgtgtggtctgcttcatctgtgtgcatatgtagtagggtttcggttttcttgatgatggattattgcttggcgtttttggcattggagcaagtccggtatacattatacaggaggaaaaaatgggatattagattgattgcgtaatcggtgatgctgagtaaatcttctacggcgccagcgtaaaagtgtctcggatgaggtttacatgtaacatgtgtcatgaaaaccacaaatgcttgtgcgacgaactagattgtgtgaactgaactctgttcccatcttttacatcgaggcaaccgcgcgtactgatgaatgctatactatctcttattgtaacctgactgctgtgctaaactgaagcactcgtgccgcgcggagaactaatagtacgagtgaggttcaagttaatacaagtgccctttcaagattaccatgaaaatacaacagagaagagggaaagcttcagtatcagcctagtggtttcgagtttcggttccacaaaagcttagaaacccaaccaaagaactgtttcaaactattgcccgactctaccaataaaattccactagtgagaaccaaaaaatctgagtgttccaccagtgagaagccaaaatctcactagcagtcaacagc

SEQ ID NO: 9374 - DNA, 2254 bp, Zea mays
  misc_feature (965)..(965): n is a, c, g, or t
  misc_feature (1189)..(1189): n is a, c, g, or t
atatattaaccgcgagagctatactggcctcccgtttgcccacgtcatcctgtttagcctcagccgcaggatgcctcttcatcggccacggacgcgccccatccacgctatgatgtcgtctgctctgctccttcgtcgggaggattctagactgcacacgaagaaccggttgagaaaaaaggaagttccaatcccacgatagtgacgctgtttgtagtccccggtcaagcgtctccctccctgtgccctcctcgcttgttcgtctcgcagccagagatcagagccgtcctcgaataaaggccctcgcttccccagcggaagcgaggcggcgcgccaggtgatggacgacatcgtgggcgtgggcgccggccggaggaccgtgccttccttcacgggatccataaggagtgtcctgcccatcgagaacgggcacgaccatgccgccctctaggcgctcagccacctccgctaccactccacgtacgtcgttcaactcacccggcttgctcaatgttcgctgctgctctgctcttgtattcggtggtgcaggcggggggtccgttcatgacttgggaaatgaagacctgtactgtacataatcctgcaggctctgggaaaatttaggactgctagcagaagataatgctttggaaagtatttccgtcgaattaaatatgaatctaaaacagaatgtttcggctgtgcggagtagacaccagccatgctttgatgacatttgactttgatagtgaaaaaaaaacaaaggtaacatcatgttcagagaagctgccctaggttcgggatagctgacgagttagatccaaaattaggaacaccaaaatcaactgacataaagagataaaaaacaaagtgaaaactagatcgtcattatttcaagtgtacaatcaatgcttcgactcccaaaccacgaggcttttgcaaatcactgctctcatctattttanacgaaaacaataatgttattgtacagcaaagggagcggaaccacggacaattgaactctctacctattttttataggtccatacagagggatttagacgacgaagtgtccacgattaaatatactgctggtagctttatctgtagagtctgaaggaatgagctgaaacgaggcagcttctgttactcccgcaaccgttggcaccgacggtgcatcagtgagaantggggacttcccaccaatctgatgacagtccagagactccacacacacacacaaaaaaagaaagaaatgccagtttgctgatgggcaccgttattcagtaatgaaagatcgattttccatctgcacacaaatgtcacacgatcaaacatgcaatatgtcgaattgattggttcgtggacctcttggatctatttggttaatccaagaacaaagtaatctaggcctcctggatcaaatttggttaatccaaggacaagagtaagctaatcttggaacaaattgaaactacgcatcttatgattaaaatattaggcaaactaaagatctgtgtaaaagaaagaccaaattattgccacactttgttttgtaattaaagtattaaacttttatttggtgcactatgttttgttgacgtaataaaattgttccaaagctttattaaacttacgatgccactttagacgattaaatcccgagctgtttctatccctctctctctccaaatccacccgtctaatagctggttcagcttcgccagacaatcaattaaacaacatagaaagctataatactattgtcacttatattactaaatattttcaatgcgcacaaggtgcacatcatttactagttctcttaaatgttatgacatttcattaaaaatatgatgtggtacaatattaattgtgtatgaaaccaatattcagaatagcctaagatgagatttatgaattacaaccaaccacttgacgacccagtcattcggctgctcaataactcagctacaattactcggccactcaacaattaaatgtagcaccacgaaaattcactctagaatttttttaacttattctaagttttaaattttctttcaaaaagtatatgtgcgggttaattttaacacagaaaatatagcagtctataattctctctagaagtatataatattttacaaatattttttcaagtgattatcttcaaattatcttcaaaaatattatctaaatattccatcaacacttcttaaaatattttccctcctaataaatacaatcgaaatta

SEQ ID NO: 9375 - DNA, 1783 bp, Zea mays
  misc_feature (1488)..(1488): n is a, c, g, or t
  misc_feature (1608)..(1608): n is a, c, g, or t
  misc_feature (1665)..(1666): n is a, c, g, or t
  misc_feature (1697)..(1697): n is a, c, g, or t
  misc_feature (1710)..(1710): n is a, c, g, or t
gcacgcgttcttctcccgtccaagaccacacgcgcacagaaaaaagcatagctggtcagtggtcctggtcagctgctcccgtacaaaaagcgcaccacaagcggcggccaagccgtccgctgccccccgcatcgccatggctctcgccgtgcgcacgccccgcttccagcctcgaccggcctccatttctgcgcccgcaacacccgcctcgaattccctcgccgccgccgccgccgcgaacgcgaggccccgcacctgcgccggcgccgccgtccgcgcttcgcccttcaccgaggccacctcctcctcgcgctacctccgtgacgcctggtcctacgccaccgattgctcctccaactccgcatcccgttcctccgatgccgccgctgcggcggcggcgctgggccgccgggacgacgagatcgcactgcagctgccggagctgcagaggctcctggacgcgctgagggcgtccagaaggaggggcgcagagggcggaggcggcggcgcccgccggcccgggagggtggcactggtgggtacagggcccggggaccccgagctgctcacgctcaaggcggtccgggccatcgaggcggcggacctggtgctctacgacaggctggtgtctaacgacgtgttggacttggtcggggagggctccaggctgctctatgtcggcaagaccgcgggataccacagccgcacccaggaggagattcacgagctgctgctgagctttgcggaggctggtgccaatgttgtgcgcttgaaaggtggcgatcctctggtttttggaaggggtggagaagagatggatttcttacagcaacagggaatcaaagttgaaattatcccaggaattacctctgcttcaggaattgcagcagaactaggcattccgctaacccatcgaggtgttgctaccagtgtcagatttttaactggacactccagaaatggtgggacagacccactatatgtagctggaaatgcagccgatcctgacactactttggttgtgtacatgggtttgtcaacacttgcatcacttgcaccaaagttaatgaagcacggcctgccaccagatacccctgctgttgcagtagagcgcgggactacacctcaacaacgaatggtgtttgcgttgttaaaggatcttgtggatgaggtcaagtcagccgatcttgtttctccaactctaataattatcgggaaagtggtatccttgtcaccattttgggttgagtcatctgaacatgatgccctgaaaattgagagctcgtatgcaagtgaagccagatgataatacgttttcatgattttagtgatcggacaatacatacttgagtatcgcaatatcccagatatgagcagttccagttggggtccatttaggacatgcgagcacaggttcgacctggtgtacacaacatttcaggaagcatggattctgaatgacggatgatagcttaagcccataacagncctttggggtttgggcagaagcgcacttgggagttgatgagggcatgtctggaggcttcagcttcagtaaatttacggctttcaattcggtgtcttcttcgtcaaagaagactcggtagnatgtatggttttcaattcaatagcacctgcaaactccttttctgactggaggtccannttcgagtgcagggattttacagaattagacnaaaaaagttctgntttttttgggggggattagaaaatctctgcttccaagcgagatactggaaagatttttgttgcatcttaaaaa

SEQ ID NO: 9376 - DNA, 1885 bp, Zea mays
gcacgaggtggcccttcaacactcgccaaggccaggccagccaactagtcaaggccgccagggggcgtctggcttctccttccttgctgcggtcctgctcctcccctccgcccgccccggccctttcgtccctccctccctgcgctttccctccacaccttcgcggacacacacacacaaaattgtcagctgcccccgccccgtataaaaaacgcaccaccagtggcggccaagccatccactgccccccgcgcatcgccatggctctcgccgtccgcacgcctcgcttccagcctcgaccggcctccatttctgcgcccacaacacccgcatcgacctccctcgccgccgggaacgcgaggccccgcccctgcgccggcgccgccgttcgcgcctcgcccttcaccgaggccacctcctcctcgcgctaccgccgcgacgcctggtcatacgccgccgatggctcctccaactccgcatccccgtcctccgctgccgctgctgccgcgggccgtcgggatgacgagatcgcgctgcagctgccggaactgcggaggctcctggacgtgctgagggcgtccagggggaggggcgccgaggagggcggcggacccggggaggtggcactggtgggcacagggcccggggaccccgagctgctcacgctcaaggcggtccgggccatcgaggcggcggacctggtgctctacgacaggctggtgtctaacgacgtgttggacttggtcggggagggcgccaggctgctctatgtcggcaagaccgcgggataccacagccgcacccaggaggagattcacgagctgctgctgagctttgcggaggccggtgccaatgttgtgcgcttgaaaggtggcgatcctctggtttttggaaggggtggagaagagatggatttcttacagcaacagggaattaaagttgaagttatcccaggaattacttctgcttcgggtattgcagcagagctaggcattccgttaacccatagaggtgttgctaccagtgtcagatttttaactggccactccagaaatggtgggacagatccactatatgtagctggaaatgcggctgatccagacactactttggttgtgtatatgggtttgtcaacacttccatcacttgctccaaagttaatgaagcacggcctgccaccagatacccctgctgttgcagtagagcgcgggactacaccccaacaacgaacggtgttcgcctcgttgaaggatcttgtggatgaagtcaagtcagccgatctagtttctccaactctaataattattgggaaagtggtatccttgtcacccttctgggttgagtcatctgaacatgatgcactgaaagttcagagctcgtatgcaaatgaggccagatgacaacagattttcttggtttttagtgactggacaatacttgagaaatgcaagatcccagatatgggagcacaggttcgacctggtgtacacagaaacatctcaggaagcatggatcctgaatggcggatggtagcttaagcttataacagacttggggcagaagcgcacttggactgatcatgcttgattctttggcctaatctacatgagattcacaatttttcgatttagttgagttcgacaatagttgtgtgcttctttgttactagtagccatgtacgtgcggcgcacgcgtgtttacgattctatgccctagcatagtaaggctattccaacgctgccacgttatgattttatgataatgggagtttcgtagcaccatgataatgagaaatagtgctacgaagctcttattatatgacaagtgccataaatcgtagcacttatgattttatgatatggggagcttcgtagagctctttctt

SEQ ID NO: 9377 - DNA, 1421 bp, Zea mays
ttttttttttttttttgtatgcatgccatcaatcgaatcacatcaatagtaaatcataaatccatcaacctgtcaaactcggattcgagttgcgcatgcgtccacggtttaggcgcttcatcgaaccatgcgtcgcgcgaggcgccgcgacaacatctagctgcgattaacatcacttaatggttcaaacattttatcgagcacaaagaatgtgatagcagcaaggatagtaggttttcaccagtatttgacgtcgtagcagctggggctgcacagatccagcgaagcacgcgattcggaggggatccgggacttgctgctgcgtgcaaggtctcggctcggggagcaacgcgagtacaaggccgccgcgggggtcgacgctgtcgcggatggaatgcgcacacccgattcgagcccgacgacgagtgcgacgaggcaactctcgcaacagggagaccatggggacagcagcgccatgggatgttgtcgatggacgatgagggcgccagcgaggtgcttcagaagaggagtgcgctgctcctacagaaggctgggcgctaaagcgccgagcatattcctgcgctctctactgcagagaggaagctgagaggagaagtagtagggagcaggggccaatgccctggttgctagcggccgagagcagagagagaaaaaaatggagcagggaggggcttgtcccgagcaggggaagggaaagctcagccatggctgcacttggggaggcggcgtcgagttcctgcccatggggaagtcgtcctccatggaatcggacaggtgcagagggagacattgcggctactggggatggtgagctgcacaaaaaggggagggatttgcgtgtgccgtagcagagctccgagcagggaggagaaaggagagggggtcggacgccatggatgggggagaggcgccctgggagtaggagctcctgctgctggcgtccatgggaggaggtgatgtgcatccatggaggccgagcaccaaggagggaggagcccggtgtgctagtgaagatttgcaggggcgcgcgccggatctgggcaccatggaggagcagggaagacaccacacgcttggaggagagagggagtggaaccttgagcgctggattagagatggagagctcgggcgttcctggcgtgcgtgcgtcgtctgctgcctggatgaagggggcgcgcccacggggaagaagaacagggagcgccggtggtctgctgttgtggggagggaagcgcggtagagggaggaagttggccggaggtggaagacgagcaggctgcgtacgttagaagcttggcggccaggaaaatgaagaagggagcggcggctggttgatttaacaggaagctgctggcacccgattggccaccgcgggccccggccccccccggccggctgca

SEQ ID NO: 9378 - DNA, 862 bp, Zea mays
agggtcacaacgtcgcgttgggactgctgctgtggacaggcgccggcgaaggagcgccggcgaaggagctcgctgctgcgataatctgagacatgcagctactgtgcatatcaccgaacaagtggtgcgcgagctgcgacgagttggaaactcaactgcgagcagcaaggcaaaggatggcgagagggcacgctcggcgtggggaaatgacagctggggcatgcactagagagggaggtgacgagctgctgggcagccatagtcggcaaggaaggctagagacaagacttggactcgtcggccctggcaacagcagggagatggccacgccatgggaggtgctcaccggcgcgagcttggcgcctccagcgcccagggggaatttctgcagggcaaaaagaaacgccaggggagcttgaaattgaggggaacagagagagggtcggattccaacctttggggtgtcgagctccatcttggaggtagcagcgccatgggagaagcttggttggggagagctgccgaacctagggcagaggaggccggcgttgagggagcgtacgtgcaggaagcaaacaaggagcccaagccaaggggacgagctcggaccctgagaaatgccctgcatgctggattagagatggagagctcgggcgttcctggcgtgcgtgcgtcgtctgctgcctggatgaagggggcgcgcccacggggaagaagaacagggagcgccggtggtctgctgctgtggggagggaagcgcggtagagggaggaagatggccggaggtggaagacgagcaggctgcgtacgttggaagcttggcggccaggaaatcccggccccgcccggccccgaggtaccc

SEQ ID NO: 9379 - DNA, 2195 bp, Zea mays
gcacgagaccattacctagaacatcctaatcgagacgtgttctgtgcgtgtctgcgtgagcagcgacgtgccgacagccgaagcgcccgagccatcccatcctcccctccccccaaaggccaaacccattcgattcctccgccccgccggccgaaaccaagtttctccgcggccgcccggatccccgacccccggccccgagcgttccatgggctcgccttccgcatcgaggcattagcaagcctcgcgccgcactgccgagcccccgacgcctgcctttgcctcactggttttggaaggaatccaagatgggtgtaatcagcacagtgctgggtttctctggttttggctttgggttctcggctggcattgttattggttacttcctcttcatctacgtccagccaactgatgtcaaggatgtcaaggttcgcccgcttgtagaatatgattcaaaatccttggagggcatccttcctgaaattcctttatgggtcaagaatcctgactatgatagaattgattggctgaataggttcttggagttgatgtggccttatcttaacaaggctatctgcagaactgcacaggatatcgcgaagccaattattgctgagaacactgcaaagtataagatagactctgttgagtttgaatcacttactttgggtagcttaccacccacctttcaagggatgaaagtctatgtcacagaggagcaagagctgataatggaaccatctcttaaatgggctgcaaacccaaatattactgttgctgtaaaagcctatggtttgaaagctactatccagattgtggatctacaagtctttgcatcacctcgcattactctgaagccattggtgcctacatttccttgctttgcaaaaatccttgtctcactcatggagaagccacatgttgactttgggctaaaacttcttggagcagatgtaatggctattcctggtctttacagatttgttcaggagaccatcaagaaacaagtagcaagcatgtatttgtggccgaagacactagaagtacctataatggatccctcaaaagcatcaaaaaggcctgttggaattctacttgtgaaggttgtgagagcccaaaatctgcggaagaaggatctgctgggtaaatctgacccatacgtgaaacttaagatgtcagatgataaacttccatccaagaagacaactgtaaagcgcagcaatctcaatccagagtggggtgaagacttcaagtttgttgtgacagatccagaaaaccaggctcttgaagttaatgtcttcgactgggaacaggttgggaaacatgaaaagatgggaatgaacatgatcccacttagagaactcctaccagaggggactaaagttactaccctcaacttgcttaagaccatggacccaaacgatgtacaaaatgagaagtctcgtggtgagcttactctagagctcacatacaagcctttcaaggaagaagatatagagaaagaagatacacagggtgctgatgtgatagagaaagctccagatggcactccagctggtggtggcttgctttatgttgttgttcatgaagcccaagatcttgaggggaagcaccatacaaacccatatgcaaaaataattttcaaaggcgaggagaagaaaactaaggtcatcaagaagaatagggatccaagatgggaggatgagtttgagttcgtgtgtgaggagcctcctgtgaatgataaactgcatgttgaagtcataagtaaagccccgaaggcagggctgatacatggcaaggaaactttgggctacattgatattagccttgcagacgtgatcagcaacaagcggattaatgaaaagtaccatctcatagactcgaaaaatggtcagatccagatcgagttgcagtggagaacttcctagacaggaaggagccagaatgccttgatgttcctctattcagtttgcgtatatctgtgattgagattgaggtcatgtagatatttcttttttttatagacatctgttgttcggatcttctcttaatcgatcaagtttccgacaagaactatgcagacatgttacagaccctgagaatggaactgaacaaatgacacgtcatacaattacactcggcattctggcatactgagaatcgaaaaaaaaagggggcggccgccccctagggcc

SEQ ID NO: 9380 - DNA, 800 bp, Zea mays
  misc_feature (752)..(752): n is a, c, g, or t
gtcgtcgcaagctcccccccccggcctccgccccgccggccaaaccaattctgaaatctgaaaacaaagcttttccgctgccgaccgagcactccgttccatggcgtcgccttcctcgtgggactagcaagcctcgcctcgctggagaccatcaagaagcaagtggcaatcatgtatttgtggccgaaggcgctagaagtacctataatggacccctcaaaagcatcaaaaaagcctgttggaattctacttgtgaaggtcgtaagagcccaaaatttgcgaaagaaggatctgctgggtaaatcagacccatatgtgaaacttaaaatgtcagatgataaacttccatccaagaagactactgtaaagcgcagcaatctcaatccagagtgggatgaagaatttaagtttgttgtgactgatccagaaagccagtctcttgaagttaatgtcttcgactgggaacaggttgggaaacatgaaaagatgggaatgaacatggtcccactgaaagacctcccgccagaggagactaaatttactacccttaacttgctcaagaccatggatccaaatgatgtacaaaatgagaagtctcgtggccagcttactctagaggtcacatacaagcctttcaaggaagcagatgtggagacagaagatacagagggtaccaatgtgatagaaaaagctccaggtggtacttccaagccggtggtggattgcttttatggtattgttcatgaaagcanagatctttgagggaagcaccatacaaacccctatgcaaaataattttc

SEQ ID NO: 9381 - DNA, 1234 bp, Zea mays
cccaaaacataatccgcattttgtaacttagtttttcgcatcaaacaacgcattgcatatttttttatcaaaatataaaaacatacgagtttctttgtacttcgtcttctttctctacccacgtccattcatacaattatattttcacgcacatattcacgccatcgactgaatcataaataaaaacgaaatcacaatttttctaaagcgaacaacctggccgactcgtgtcgcgcatgtccgcatgctgtccacagcttggggctttcgtcgagcatggaatgcgcgaggcatgacgacaagggcacgggtcgacgacgatgtggctgctctcgtcgagctggaacaagtcgtggcgctgtggttcttgctgcgcatgacaagcacgacatcgacggcaagcccaatactcgacgatagcaagctgcgggctgggacaaagctcgatccagcggctaggacagcaaggtgcctcaccaagggtcacagtgtcgcgtcgggactgctgttgtggacaggcgccggcgaaggagctcgctgctgcgataatctgagacatgcagctactgtgcataacgtcgaacaggtggtgcgcgagctgcgacgagtaggaaactcagctgcgagcagcaaggcaaaggatggcgagagggcacgctcggcgtggggaaatgacagccggggcatgcactagagagggaggtgacgagctgctgggcagccatagtcggcaaggaaggctagagacaagacttggactcgtcggccctggcaacagcagggagatggccacgccatgggagttgctcaccggcgcgagcttggcgcctccagcgcccagggggaatttctgcagggcaaaaagaaacgccaggggagcttgaaattgaggggaacagagagagggtcggattccaacctttggggtgtcgagctccatcctggaggtagcagcgccatgggagaagcttggttggggagggctgccggacctgctcgagctcggaccctgagaaatgccctgcgcgctggattagagatggagagctcgggcgttcctggcgtgcgtgtgtcgtctgctgcctggatgaagggggggcgcccacggggaagaagaacagggagcgccggtggtctgctgctgtggggagggaagctcggtagagggaggaagatggccggaggtggaagacgagcaggctgcgtacgttggaagcttggcccccgggcaatg

SEQ ID NO: 9382 - DNA, 2184 bp, Zea mays
acctgtccgcattccacttccaccgcgccgcgtcaccttcttccttcagcgttgagcggaatcgcgaattgaaaacggaagttaccaattcacccgactcgatagacacaccggctctgctctaagcgagaatccgaggagcgctgccaagcgcctccgcgacgggatcgacgcgacttgattcgcgagtttcaacgtcgcgaggagagcagaaaattacgcaggcagagcggctgccggctgggtgttgaagctagagcggctaggagcaggttcggagcgctaccaaacaggcccttaacctaagcgctcctgcccttcggatccggaagttggaggcgcgcgaggaggcgaggcttgcaaggtctcccttgctagacggcaacggggtgacgatggcgcacgagcggggcgccgccgcatccgcccacccagcggctccaacctccgaggaagacgcgctgtttattgatttattacatgaagcgcccctgtctggtcaccgggagcctagaagcatagttggtgggaccttgtactgtatcttattggtaggttttgctgctgttgccatttcagctccatggatatttcttttcgcgccagatatgatctctccattgctatgtagctccaatgctatcctcctcgttcttacaggcatttttcaacaatattgggttcaccaggtcaggaaagtgagattgcagggctattacgattttagccagaaactgaagcgtattgctcgacttccatttgctactattgcttgtgggactgctttgatgctcttaatcatggtctggcaacctcttttacaaatactatcagtttcactgcttctcaggattgccattgtagttgaagtcacgtgtgctggatgttttatgggcttatatttatggcacatccacaaatacaactctttgaatgggcagcctgatattttgcggtcattatattctgcactccaaccatctaatactttggaagatcgaagatatcatgatgcccgtctttctgatcagcagatggcgttacttcagtaccaaagagagaatatccattatctgagtgaggaggttctccgcttgcaagaatgcttaagcaaataccagagaactgctggaaccactcctcaggttgatcttgcccatcttttagcaactcgtgatcaagaactccgagcactcactgctgagatgaatcaagtgcactccgaacttcaacatgcccgtggtttgatcgatgaaaaggattcagagctccagcgtatccgtctgagcaacaaccagtatgttgaagaaaacgataggctcagagctattctcggtgagtggagtgctcgagccgcaaagcttgaacgtgcattggaggcagagcgggtgtcaaacgtcgaattgaggaaaaatattgcaaagtttagaggtcatttgtacaaagagcaggaggcctgacttcggtatgttatagctggttccagaattttacctaaggcacctgactaaaggcacaatttttggatatagaagggtatctcggtctggatccattcgaactgggattgattacgagattggcacgtaattgtagaatgcgtagtttgatgtacatgtgttcgtaggtttgagcatgtagagtatggtatccctcgaaaaaaaaggaatatggtattcatgtggttgaagactgctgagtagtgtgaacatggtagtgtcctgtggggtgtggttcgcaggagccaaggggaggaggttgcagcactggtcgttcttgtaggtgtgcggcagataggattatgcgtcctaactgaagaggcagctaggaaagaatcttaacgcaaacaagaacaacaggatcccccctccgtctccaatcaatagagttcctttccgataaacgacgccgtccaatgaaatgtacccccttcattcccagacccaattgggcccgcccttgaagcttcatgggccactcgcccctgaacccagttgcccctatagttttcttcgtcggatttgtttgttttttcattctatggtctattttattctgtgggactcttttctttcctttggtgtttagagacatttggtaataattcagattagttcatgtcaaaaaaaaaaaaaagaaaaaaaaaaaaaaaaaaaaaagaaaaaaaaaaaaaaaaaggcccct

SEQ ID NO: 9383 - DNA, 2407 bp, Zea mays
ctcgtaggcccgcccgggaatactatcagtttcactgcttctcaggattgccattgtagttgaagtcacgtgtgctggatgttttatgggcttatatttatggcacatccacaaatacaactctttgaatgggcagcctgatattttgcggtcattatattctgcactccaaccatctaatactttggaagatcgaagatatcatgatgcccgtctttctgatcagcagatggcgttacttcagtaccaaagagagaatatccattatctgagtgaggaggttctccgcttgcaagaatgcttaagcaaataccagagaactgctggaaccactcctcaggttgatcttgcccatcttttagcaactcgtgatcaagaactccgagcactcactgctgagatgaatcaagtgcactccgaacttcaacatgcccgtggtttgatcgatgaaaaggattcagagctccagcgtatccgtctgagcaacaaccagtatgttgaagaaaacgataggctcagagctattctcggtgagtggagtgctcgagccgcaaagcttgaacgtgcattggaggcagagcgggtgtcaaacgtcgaattgaggaaaaatattgcaaagtttagaggtcatttgtacaaagagcaggaggcctgacttcggtatgttatagctggttccagaattttacctaagacacctgactaaaggcacaatttttgatatagaagggtatctcggtctggatccattcgaactgagattggcacgtgattgttcgatgacgcatggaatatgcgtctagtggtttgtagaatgcgtagtttgatgtacatgttttcgtaggtttgagcatgtagagtatggtatccctcgggaaaaaaaaaggagtatggtattcatgtggttgaagactgctgagtattgtgaacatggtagtgtcttgtggggtgtggttcgcaggagacaagaggaggaggttgcagcactggtcgttcttgtaggtgtgcggcagataggattatgcgtactaactgaagaggcagctaggcaagaatcttaacacaaacaagaagaacaggatcgcccctccgactctaatcaatagagttcattacagataagcgacgcagtgcgatgaaatgtaccacctacattcacagacccagttgggcgtaccgttgaagcctcatgggccactcgcgcctgaacccagttgccactatagttttcttcttcggatttgtttgttttttcattctattttctattctattctgtgtgactttcttttctttgttgtttagggctcatttggtaataattcagattggttcatatcaatgttctctaaaaaaacgttccagatgacgaatcggaattgcttaaccatttgactgaaaaaaaaaaaaaaaatggacccgtttctagcagaaatgtttcacgtttatgctgtttggcataaactttttggttccagacaagaatccggaaaacgactcagctaagggcttgttcggttagctcccaatccacatggattgagtgggattggatgggtttaaatcccaactaagtcaaactctttcttaattttttccaatcccatccaatccatgggtaacgggattaaccgaacaaggcctaatctggtatcctctacgtaggtcttcgtaacttgttacctgttataggatattcctgtgcttaccttaaagactgacgagtggtcacgttattgcgtttatttacttccaatgaatccagaggcagcaattaattcgcgtcgacagtctagaatggacacgtccacgcaggagatgcttgcccatggatcaatcagtacggacagaaattcgattccagaatcagggaacacgaaatggaaacgaagtcgacgttttgtggcttgtggctacagtttcggtgccgggagaacagacgctttgccaatggctttggcttctctcgttttcccacaccacaggtggaggcgtaaagccagacacggacagatcattactgcagctaaggaagggatctccatgggaatattttggtaagggccagtttggcagccgcggttattttagcacaggagaaaacttcagcggtgggttttatcctacattcatttttcagtgggtaaaaaacccggataggataatttaaccggtggtcgtttggaaggagcaactgccatccagtttagtacaaaactgaatgcatacatgaacgcatactggtgacatttttctgtatgtcattcagtttggggcagattgcatacacaaacgcatacaagaacagtcaccatgcatacacggcatacaagaatgcatacataagccaccaggtttttaaacagaatgcatacagaatgcataccagaaaagtcaccatggtttt

SEQ ID NO: 9384 - DNA, 2696 bp, Zea mays
gcacgagaccattacctagaacatcctaatcaaaaaattacataaaaacacctctcggccacctccaccgcaccccgccccgactcctacccagatgccggccacggccagcggcggcgcgcggccggaggaggtgtcgcccgcaccatcggcgtcggcgtctgcgtcgagctgcatggggacgagggcggaggagctgacggcgaggctggcggccgcggggccctccccgggcgccggtgccggcggagaggaggtggagcacgagcgcgtccgcgcgctgcgcgagatcaagaaccagatcatcggaaaccggaccaagaagctgctctacctccgcctgggcgccgtgcccgcagtcgtggcggcgttggcggatcccggagcctcgccggcggcgctcgtgcaggcggcggccgcggcagggagcttcgcgtgcggcgtcgaagactgcgcgcgcgccgtgctggccgccggcgctgtggggtacctcactcggctcctcgctcaccccgacgagaaggttgtggatgcaagtgcacgtgctcttagaatgatatatcaatcaagattagctccaaagtttgatgttaatagggggaaaaacatgaattttgttctttctcttttggacagtgagaatgagaatgtcacagagctggctgctgctattatatctcactcttgtaagagtagtgcagaacaattggcactatgcagtgctggagttccacaaaaacttgttagcctttttggaggttctgtgaatctacgggatgcttgtttaggttctgtcactgtagtcgttcagaataaccaagatgttgcttccagatttgtaacaacggttcatggaaaatgttttcgttcagtagttgggttaatacatgatcggaatccaagcacaagactacttgcttgccgatgcttgattgcacttgggcatgcttctcctggccattttcaggacaaacagattaagaccaagttgattatggttttacttgagctaatcgaagaacctggtcacatcggagatgaagctcccttggcattaaccaccatgattaaagatagcttcgaactgcagaaacaagctcttgcaacgaacgcagttgagaagctcagcaaccatctgctagcgaaaccattggagacaaggcaagcagtggccatattgcttgcgttatctgaactttgctcaaaacttgaagagtcaagatctcaaatgatgtcagatgaggtatcaaccttactccttgatgcattgaaacatgattgggctgatatccgcgttgcagcatgttcgtgtctgaagaatatctccaggtcaccaaaggtacttagtggaggtcgattatcctgcgatacagttattggtcctctagtccagcttttaaacgactcgtgtacttcggtccaggttgctgcccttggtgccatttgcaatattgccattaatttgacacccaggaaatcagttcttcttaactctggggtcgtctcacatcttgttcatttgtcaaagtccatggatccaattttgaggctaaaatctgtatgggctctcaggaatattatgtttcttcttagtcctaaggataaagacttcattgttaaggagttgaccttatctactctttcaagcctcatatgcgattctgaacattttgttcaagaacaaaccctggcacttgtgcgcaatcttgttgatggatatgtggactctgctaattttgtcattggtgaagatggaataattatgaatgctattgcaagacaactgaacaatgcgtctgccccgggagtattcgttcagggtatgtatgtgcttgcaaacattgcggctggaaacgaattgaacaaggaagctgtgatgaatgttcttctgcctcacagagcagatcgcatcaaaccattgtttgcggtgaactttctgcaaagcaaggataaacaattgcgagttgccacgctgtggtgccttctgaacttgatttacccaaaatgtgaagcctcatctggtagggctgtcagactgcaaaatgctggagtgatccaacaagtgaaaaacatgataaacgaccactgcttggattgcaagcttagagcacgtatggtgcttcaacactgcgtgaacaatgcggatgattgtttcatgtgagcaaccagtatttcatcttggcaaccaaagtttatggaaccatattcagatcaggaaagaggaaaccagtgtgcttcagatctaatatattccctgaacagtggaacatgagcacctgcaggaagctttggctggtctctacaggtcttcaagagcacattttcgcaccatgataacctgacaaccggtatctgttgtgcatgttgtccattaccttgttgcgaccgtgctgtctggagaacttgagctgcctgctcgcccactgaaaggctctgggcgctagatccagaaatcccatttttcacagtgcctgccgaacctggtgcatatttttgcgatgttgactacttgagtatataattgagggactgctgttgctgttgtcggtgttgtacaaaaaattatatttctgatccaataaggcccgtttttcatgcactatgggttatacgttgtccatgaattcccatgtttcgctgaaaataaagaagacgcacgtttctatgcgaaaaaaaaaaaaaaaaagcggccggcc

SEQ ID NO: 9385 - DNA, 2236 bp, Zea mays
ggcggggagcttcgcgtgcggcgtggacgatggcgcgcgcgccgtgctggccgccggcgctgtcggccacatcactcgcctcctcgctcaccccgacgagaaggttgtggatgcatgcgcacgtgctcttagaatgatatatcaatcaagattagctccaaagtttgatggttatagtggggaaaacgtggattttgttctttcccttttggacagtgagaacgagaatgtcacagagctggctgctgctattgtatctcactcttgtgagagtggtgcagaacaattgtcactatgcagtgctggagttccacagaaacttgttagtctttttggatgttctatgaatctacgagatgcttgtttaggttctatcattgcagttattcaaaataaccaagatgttgcttcaagatttgcatcaacggaccatggaaaaggttttcgttcagtagttgggttaatacatgatcggagtccacgcacaagattacttgcttgcctctgcttgattgcacttgggcatgcttctcctgatcattttcaggacaatcagattaagaccaagttgattatggttttacttgagctaattgaagaacctggtcatgtaggagatgaagctcccttggcattaaccaccctgattaaagacagcttcgaactgcagagacaagctcttacaacgaacgcagttgagaagctcagcaaccatctactagcaaatccattggggacaaggcgagcagtgaccatattacttgcgctatctgaactttgctcaaaacttgaagagtcaagatctcaactgatgtcggttgaggtatcaaccttactccttgaggcattgaaacatgattgggctgatatccgtgttgcagcatgttcatgtctgaagaatatctccaggtcaccaaagatactcagtggaggtcgattatcctgcgatacagttatcggtcccctggtccagcttttaaatgactcatctacttcagtccaggttgctgcccttggtgccatttgcaatattgccgttaatttgacacccaggaaatcagttcttcttcactccggggttgtctcacaacttgttcatttgtcaaagtccatggatccaatgttgaggctaaaatctgtatgtgctctcaggaatattatgttccttcttagtcctaaggataaagacttcattgttaaggagttgaccttatctactctttcaagcctcatatgtgattctgaacattttgttcaagaacaaacattggcacttgtgcacaatcttgttgatggatatgtggtctctgctaattatgtcattggtgaagatggaatggttatggatgctattgcaagacaactgaacaatgcatctgctccgggagtatgcattcagggtatgtatgtgcttgcaaacattgctgcgggaaacgagtggaacaaggaagctgtgatgaatgttcttctgcctcacagagcagatcgcatcaaaccgtcgtttgcagtgaactttctgaaaagcaaggatagacagttgcgagttgccacactgtggtgcgttctaaacttgatatacccaaaatgtgaagcctcatctggtagagccgtcagactacaaagtgctggagtgatcctacaagtgaaaagaatgataaatgacccctgcttggattgcaagcttagagttcgtatggtgcttgaccactgcttggacaacgctgatgattgtttcatgtgaacaacctgtatttcaccgtggcaacccaagtttacggaactatattcagatcaggaaagaggaaaccagtgtgcttcagatccaaatatatgccactgaacagtggacatgagcacctgcagaaagcttttgctgatctctgcgggtcttcaagaaccagctgccttttttgcaccatgagaacctgacaaccggcatctgttgtgcatattgtccattaccttgttgtgaccgatgttgtctagtgaacttgggctgcctgctcgcagtctgaaaggctttaggcgctatggatccagaaatcccatttttcccagtgcctgccgaacctggtgcatgcttttgaagttgagtctgtaaatgagtgactgctgtcactgttgtacaaaatttgtatttctgttccaataaggccgtatttaacatgcacctatgggttagatgtccatggattcccatgttctatgaaaataaagaagatgcaagtttctatgc

SEQ ID NO: 9386 - DNA, 1172 bp, Zea mays
ctaatcgaaaaaccaaaacccaccttggcaacaaagcagacgagcacgcaggacgtcgtacgagagggagtcggtagagcgcggcgcgcacgccacacagcaggagaagcgagaaccaaccatcgcatggcgatgcggcggcggcggtgctcgctgccgtcatggcggccgccgccgcgcaggcggcggaggtgcgctgggaggtggcgtacctcaccgtggagcccctcggacgaccgcagaaggtgattgcgataaacaaccagttcccgggtcctctgctgaacgtgacgacgaaccagaacgtgagggtgaacgtccagaacaaccttgacgagcccctcctcatcacctgggacggaatccagatgaggatgaactcgtggcaggacggcgtcacgggcaccaactgccccatccctcccggatggaactggacctacgagttccagctcaaggaccagatcggcagcttcttctacttcccgtcgctcggccttcagcgagctgccggcgggttcggccccatcaccgtcaacaaccgcgccaccgtgcccgtccccttcgaccagcctcatggcgacatcaccctgttcatcggggactggtacaccaagggccacgttgaactgaggaacatgctagatgatggtcaggacctaggggcaccagatgctattctaatcaatggaagggcaccttacagatatgacagtgcgctggttccggatggccttccctacgaaatcgttggagttgagccaggcgaaacatatcgcttccgcgtccacaacgttggcgtctcaacaagcctcaacttcaggatccagaaccacaacatgcgtctggtggagaccgaagggacctacaccaaccagcagaactacaccgacctggacatccacgtgggacagtcctactctttcttggtgaccatggatcagaacgccagctccgacggtacggcattctcgcgaagcccgtagggttcgtaggcaatcctcgatggcacgaagtggctggtgtggccgtccttcagtactccaactccaagggtagggcttctggcagcctccctgatgctccagatgatcactacgacaagtaccactccatgaaccaggcaggtccatcagaatgaacacgagcgccggcgctgcccgtccaaaccc

SEQ ID NO: 9387 - DNA, 745 bp, Zea mays
  misc_feature (654)..(654): n is a, c, g, or t
aattgacgccaatttttattctcaccctttggcaaccgaactggtttggtgtgcccacctctctctcttccatgggatatggcagggatggaatccagatgaggatgaactcgtggcaggacggcgtcacgggcaccaactgccccatccctcccggatggaactggacctacgagttccagctcaaggaccagatcggcagcttcttctacttcccgtcgctcggcctccagcgagctgccggcgggttcggccccatcaccgtcaacaaccgcgccaccgtgcccgtccccttcgaccagcctcatggcgacatcaccctgttcatcggggactggtacaccaagggccacgttgaactgaggaacatgctagatgatggtcaggacctaggggcaccagatgctattctaatcaatggaagggcaccttacagatatgacagtgcgctggttccggatggccttccctacgaaatcgttggagttgagccaggcgaaacatatcgcttccgcgtccacaacgttggcgtctcaacaagcctcaacttcaggatccagaaccacaacatgcgtctggtggagaccgaagggacctacaccaaccagcagaactacaccgacctggacatccacgtgggacagtcctactctntcttggtcaccatggatcagaacgcgagcaccgactactacattgtggcgagcccgaggttcgtaggcaatcctcgatggcacgaagtggc

SEQ ID NO: 9388 - DNA, 3734 bp, Zea mays
  misc_feature (1499)..(1499): n is a, c, g, or t
  misc_feature (1502)..(1502): n is a, c, g, or t
gtttggaacccaacaactatttttagtagctaactattagttttagaggttccaaacagggtcttaaactatctccaacaaactacatatccaacacctcattatacttgctctaaggggtgtttggttctcttgattaaagtttatttcgtgtcacattaaatgtttgaatactaactgtgagtattaaatatatgcttaattatgtttaatatttttgtcacatctcttagtcttcatttggataattaattttataataatactatatttaatatctgtaattatgatttaaatatttaatgtgacaatgaccaaaaatttggttagatcgcatgtgctaaactttagaagagtgttaaagtttaacacatcatgaagagctaaaccagcttttagcccttctgtttgcatctccaaatactaaagtcatgtttatttaccttccaatttaaataagttaaaagataatcaaacaacctttactaggtggcattttaggtacctatattataataatcaataacagatcttatataatatatcaactgaattatataattatataaacaaataaatatgactaaagtttaactaaaggtgtactagtgtttaactttagcaatataatccaaacatgctctaaacttcatgggtcatgggtggaactcgaaccaaacgacccctagatctatttcggcgttttgcgtgtccctttacctagagaaagccaagtaccaaaacctcttcccggcggccaaatctgatgtccccgattcaaattcccaccccggcgaccgccggccttgttcgcacccttacaacgccgccgtcagccttccaatctaccacccacgcgccgtctctcagcggtgtcattaacagcgctgcagcccgcagctgccgcaagcgccgctacgccgatgcccacgagggcgcctcctcaccttgccgccgccgccgccgcttcctcctcgtccccaactcgttcctggccggccggtccttcgctctccgtactctcgctagcgccccccacaagcgccgccacgacgccgccacctcctcggctcgcccctccagtcgccgcctccgccttctaagccccgtccttttccccgccctccggccgcttagcccccgcgtttcgctagccaccgccccgcgtagccaccgcaagcttcacgtcgacgacgcccgccgcgccgtctctactccctgtcgccgccgcagccgtagcagtctgcttcccagggtcagacacttccgcccattcgcactccgtttcctcctcacgtccagtgcattaagccctcaccgtcgccggaaacccgccgaggtagacatgggcaacctcatctcacagtttctgtggaggagcaccagggacggtgtatcagaggcgcacacgaagcggctcgatgggtcgccggaagtggtggatctcacagtggagccagagcttgaaaataacgatgccgtggggaggatgtttgganacnggagcgtccctgcactggggtcatcaaagtcgccggagaagaaggcaacgttctacgaggagccgcacggtagaagattacaggagtcaggattcaagaagctcaagcttgccgagctgcctgatccgctggacaatacgtctaaggaggttactattttaaactcattctcacgaagtttactgaacaatctatacatgaccatttgttttttatttgaatggtaaaacatgggtattgcggttgttgtttttggaacttcaattccttgaaatacagaacctgttgaaaatggctaattgtgagcttttcaaacataacaggagtagaaatcttctctaagcctaaattctctgtaagcgcactaatgcaaaaaaatgaaccattgctttggtacgtttcattagtagtttagtacatgctccctctgtttctaagtatatgacatttatgacaaggtaattagttaaattctttttttactaattacttagcttgtcctaaacgtcatatattttaaaacttagtaaattagttcagtagcttattaattttctgttgtttggattgttataacagcttttcatgtgtataatataatatcagtgatgtataatatatcttaaaacttgattattgcaggatctatctgaactattcacacctctaagtgacaaagacgaaagagaagtcaatgctctgttgtgtagtagtgatgacaggtatacttagcatatcctcatgttatggaacatttttcttcatattgctagcacaatcaaaggatattctggtttctcttatttttgtagtgataaaatcgtagtgatacatacgccttctaacatcgagattactaaagagaaacttcaatgcttgaggcctcgtgggtggttgaatgatgaggtaaatatctatatttagtatccatttttcttaaatgatcacagcaaacatatgtgatgctaggatccctactgctatctcatattatgtttttcactgcttgcaggtcattaatctgtacattgaactgttaaaggagagggaaaaaagggaacccaacaggtttttgaaatgccatttcttcaatacattcttctacaagaggcttacttgcggaatagctggttatgattaccagtctgttaggagatggacaacattcaagaggctgggttatggacttgtcgagtgtgagaaaatctttgttccagtgcatagaaatgcacattggtgtttggcactaataaacatgaaggataaaacattgcagtatcttgaatctcttgttggttggggccgtgatgtactggacatactggctagatacatcgtggatgaattgaaggacaagagtaacatagaggtagaacctagttcgtggactgtagtgtcagagtctttgcccttgcagcagaacgggtgggactgtggcatgtttatgcttaaatacattgactgccttgcctgaggtttctctccatcttgctcgcaggaacacatgatgtattttaggaaacgaatagcaaaagagatcatggcattaagagccgactgaagagcaccattctgacattgtctcaagtcaggtatttgctttcaaatagcagagatgtgattcttctaaggctgtcggtgtgaattcaagtccatgtcgccacaccttttgtaggcttggatttttttaggacctgattttggtagggaaaagaggggtaaggtaaaacaatgaaaaacgtaggagttcggaagtagttcggcaaaattgcattgaaactgactaaagctagtgcaaggaactgacacttagttttgttttgtgtttatttcaactcatatgttgtcgtgaaaactaaagctagtgattgcacgactccccagtattaacatttcgtgagcgtttttatgtatttgagaagtttttggttgcagatggataaacaactgtgaacctatgagcaacttcaaacatttcaggttcaaatcataaagctgtaccgagctgcacttgaacaacaaaccaccaccgctacagtttctctatttctctagttagctaggagcacaaggcagaacattgaatgctgatagagggtagatcacctcatttcaaaaaacttgtggcaatccaatacaatcttaaacaatcgatcatcttcccacagtagaaagtgactgactggcctactaggtgcctaaaaatgctctgcactgtaactcccaatgctc

SEQ ID NO: 9389 - DNA, 1028 bp, Zea mays
  misc_feature (42)..(44): n is a, c, g, or t
ttgggaccctcgaggccggccgggctattgtttgtgcgtccnnnaaaaaaaaacctctctctcttaccatgggatatggcagggacggaatccagatgaggatgaactcgtggcaggacggcgtcacgggcaccaactgccccatccctcccggatggaactggacctacgagttccagctcaaggaccagatcggcagcttcttctacttcccgtcgctcggcctccagcgagctgccggcgggttcggccccatcaccgtcaacaaccgcgccaccgtgcccgtccccttcgaccagcctcatggcgacatcaccctgttcatcggggactggtacaccaagggccacgttgaactgaggaacatgctagatgatggtcaggatctaggggcaccagatgctattctaatcaatggaagggcaccttacagatatgacagtgcgctggttccggatggccttccctacgaaatcgttggagttgagccaggcgaaacatatcgcttccgcgtccacaacgttggcgtctcaacaagcctcaacttcaggatccagaaccacaacatgcgtctggtggagaccgaagggacctacaccaaccagcagaactacaccgacctggacatccacgtgggacagtcctactctttcttggtcaccatggatcagaacgcgagcaccgactactacattgtggcgagcccgaggttcgtaggcaatcctcgatggcacgaagtggctggtgtggccgtccttcagtactccaactccaagggtagggcttctggcagcctccctgatgctccagatgatcactacgacaagtaccactccatgaaccaggcaaggtccatcagaatgaacacgagcgccggcgctgcccgtccaaacccgcagggatcattccactacggatcgatcaacgtcacgcagaccttcgtcctcaagaacgagcagcccctgagcatcggcgggaagcgccggaggacgatcaacagggtgtcctactcgcctccggagacgccg

SEQ ID NO: 9390 - DNA, 4038 bp, Zea mays
ttgaaacatgttagtattattgtaaatgcaaatgtggtctaattaggtgcaccaacaaacaaattagtgacaagaataggaacacataattataaatgtttttggaaaggtgaagctcccaccacttttaaaattcattaaactaattgtttctttcctaacttgttagccaatcattaacaaatcattgataagtatgaacctttctgtaatttacatccacattgcaaacttatgtccatgcttgtgtagtgaatagtgcagctcaggggtttcttattgtgctgccctactgctaacattaattgtgtatatgaaatttctcctgtaccttgtggaaaatagaaatgatgtcaaaatgtggatggtatatgatcctgaattttggctcagggggtccctgcatttctgtcaccaagggggttgtatctagagttgaaccaacacaatatgcccatggtgctacacagcttatggctatacaaatagatgcagctataaatccaggtaatagtggagggcctgccattatgggtgataaagtagccggagttgctttccagaatttgtcaggagcggaaaacattgggtgggtcctaaatgttctcttttgcatcaaatgaacctgttgcttttactagaatttatttcttattcctatcttcttcttttggcagttatatcataccagtgcctgtaattaagcgtttcatttctggagtagaagagagtggtaaatattctgggttttgtactcttggtgtatcttgccaggctactgaaaatattcagttaagagagtgctttgggatgcggcctgaaatgactggagttttagttagtagaataaaccctctatctgatgcttacaaggttttgaagaaggatgacatccttcttgagtttgatggtgtgcctatcgcaaatgatggcacaggtgagattataagtttctacatatgcactacttcaatatgcattaacaactttataccacatattttgtttatttccttacctccagtcaacagtatttgacacaccaactattgtggactggacggagtatttgttatggaatctagcacacaattattgtttgaacagatgcacatccatgcccttggtgcatgttttgcatactgcttttgtgcaaatcaatgaatctgtttatgaactattttgagacatgtggcatctcagaatcaactactgaagattgtccattatttaatacctccagttccattccggaatagagagagaatcacctttgatcatctggtgtccatgaaaaaacctgaagaaacagctgttctcaaagtattacgagatggtaaagagcaagaattgggagtaacacttagaccctgtgagtccttgcaatctcattacatttgatttcaatctgtatttttgataatatgggtacaattttaggaccgcttgttggttagcaaatataatagcgatattctgttgttatttctagttcatcttcacaccaattttcgccatatagagttctagacctggtacagactcaacctgcccatcagccagcctcaatatggcaatacttactatcagttccataactcaccccacagataattgtaagtttgtaatttactgaattcattacattagtaagtggacctatatctaagtagtcgaaagggtgcagagttgaagtcctctcttatgtaggtcgtagtagtacacaaaagtagaccaaattgtattctacacagctctcacagacctcgtctttgcagtttacacacatgattttttcccatagctggtgaactcaaattccattacttataagtaactaaatgacaaagtttcacctgtttaccactgcttcttacctaataccatatctaattaaactcaagcacccagggcttgagcttaaaccagtcacctgtggaccatattacagagtttagatcttcaacaatacaaaaacaggaagaagttagagccacacagaactaaatacggattagaacaaagatgccactagcgaaaaatggcaacatcattggtgagataaaaaacagcattcgtgttacagtcgcaatcttcaagacttcaattgatcccagtatcccaccatctttgaccaccgggttctcctggacttctttctgctggccttgttgatgacactacagtgccaaagtcttgagtacttctgctcctctgctcaagctcattacagctctctggattatgcagtcctgcccaatataaaatgaacaaacggagtgaactgatgacctcagtaggagatttcgtccttttctttacagaacaaacattattccaccctttccatagagcacagaaaactgcagttagtcccactatttctatcttatgatagagccatagagcttattgaaattggaagttggaactgatcttttatggatttgtgttgtttattatgcagctgcaacctttagtcccagtccatcaatttgataaattaccaagctactacatatttgctggttttgtttttatcccacttacccagccctatctccatgaatttggagaagactggtataatgcctcaccacgccggttatgtgaacgggcactaagagagcttccaaagaagactggtgaacagttagttatcctatctcaggtattgttccattaattcgccaccctcttacatttctatttaccctttcagtattcgatctgaaacaatttgcatatgctgtttctattagcttgagatagatttgtctttatactgaatatttgtgtttcaggttctaatggatgatatcaatgtcggttatgaaaggcttgctgaactacaggtatgctacttcaatttatcccctggtatccagttacccactactcagcctatcttgcatatgtcctgggtaatcaagctgcctaatatcacatgttcaggtaaagaaggtaaatggtgtggaggttgaaaacctgaagcacctgtgcagcctcgtggaaggctgcaccgaagaaaacttaaggtttgacttggacgatgaaagagtcattgtcctgaagtaccagaacgcaaggcttgccacatcccgggtcctcaaacggcacaggataccgtcagccatatcgagcgaccttgtcgaagatcaagtaactgatggcgaggttgagacgtcatgcaccagctaatgctagactcttttttagacctaattgggagttccctgctgtagctcagctcaagaagcgagctgcattgttggcgaggcaagcgcacctgcctgcctgcctgcctggagtacatggtatcacttcctccctttagggcggctttagttttgacataaggaggagtgtctttagaaaataagattatgagctccggggcttttcagtctgaatgtaacggtaacataaccattctttactagaacatttattttttccgtcattgacaaagcaccccacatggtctgtatcatcaggaaacatatacatcgtataaaaaacatcagaaaaaggaaagatttgcagttcaatgtttgttggccagtgtgattaaagtcccgttacaaacctctgtagctgattgttagctagctaataagttattagctatttaagaggtagaactaacaattagttggtctattaaccgttctgttctaaaattttcaactaattttagctgaactattaattttagagatttggaacaaggtctaagtcatccgattaatcgtgattagcgattcaattcgctgctctgaacttgactaggagttacattatgatctaactagaatgattagttttctgcttgtccgatgactaaggggcttgtacaactctgagccattggatcagttttctaagtgcgtgagatagatagttaagaggttagacagttaaaagattgtacgatataattgagtgtttttataaccagttacataaaatgtagctaaaagactgtatcacgagtcgtatagagagggattctctgtgaagagatagtctctgtat

SEQ ID NO: 9391 - DNA, 1889 bp, Zea mays
gggacactgaacgataatgtatcaaaacaaaagggtgcatctattcggggggaatcgtggggacggtttgggttgtgtatcagtgtatgggcctacggggtttgggctttcgtgtggggtttcctggtggaccctgtatggtcctgctcccgatcatgggctgggcagccactttgatgatgggtctcggtcggtcgatttgcagtgctgccttgacccttccaggcagctaccataccgtgaagccgtgaaggagcgtttgtggtaaaggagcaaaaggaaaacgaaattacctagtcttggtggcttggtgcatgtcgacttcacaccaactcacatcttcagcgctcgtcaacatcaacaacaccatgacgcggcagcaaggcaagcttatgttttttttctctctccctctctagaattaatagcataacttttcgggaaaaatatatttacacggttaaccctttctatttagtgacggctgtgacgctggtactcagtactcacggtccacggcctcgcgggggcgtaacgaacaaacgggcgaagagttagggacagatcaatctgtatgacctgctgctacgtacgccgctgctagacgaatagtgttaaagctgatgtatgggagcaggtgcatgcaatgcaagagcaaggctcttccacttgatcacagctagctaacgaagcagctttccagcccatgcttcgtcaagaaactccaactccacgtctagagaaaggcacacggaggcatggacgaatatcctctgaatactccaaagcgaagcgaagcaaagcatggaacaggaaaaaggggggaggggggagaggttttccatgtgctcgagaatatgccaaggaagataccctcattttggcccgtgaaaactgaaaattaaaggcagtcgtccaccacctaagcctccactcgccggaacaagcctgcctcaaactctctcgatctatatatgcgtcctcatccaacaccttccagggaagacccatcgtcaccagcagggtgtcccggccctctctagtttgtaccccccaacattggcctgatgctgctgccatgtagcccatatatgcagcgctcccccctcggcttcaccggcggcggcaacgacggtgaaaactacatcgggtgctagctccgacggtggtgcgtgccctgttgacgatagggcgcgcggggcgcgggcagcttgtaggcgttcgatcggccatgtagggcaactatacatctttggcaggtctccatcatcctccgtgggagagaagatgcatggtaatggagtgcgtgtgtatgtatgtgtatgcccatggcgcgcgcgcgcggctctgggcgagtcacagtagagatgcaatatcatgtatccagtatctttcttacaacacaaacagtgagaaattattagtaaagtgtgcattgtggtgcagccactgttccatgtccgtagcgacaggtcacggcccgttgcctttcggagcttcccggtcccggcatgcgctccaaccgtaagggcaaggcgtcaggagcgacaggtgcaaggcggcggatcggaagaactcggcagtcggcactgggtgcggccgtggagggaaggggatggtcgccgattttatgccaatttactcgcgccccacgccgcgagtctttgatcgatgtgtttgtacagtcgaaagagcattgctttacataggaccatcaatatatatatatggatacatacgcataagagtagctgaattatctgtgtacagaaaattgtttgtagtagtagaataattcggtctgcaaatgtagcaccaatagttcattgggcgtcctcgtgcgagggcgaatcacattggggtgtttggtttaaagaattactacatct

SEQ ID NO: 9392 - DNA, 871 bp, Zea mays
actcgccggccggaaaagcctgcctcaagctctctcgatctatatatgcgtcctcccccaacacctggcatggcggcccgtcgtcaccgtcgtcaccagcagggtgtcccggccctctctagtttctaccccggcccccaacattggcctgatgctgctgccatgtagcccagcgctcccccctcggcttcaccggcggcggcggcaacgacggtgaaaactacatcgggtgctagctccgacggtggtgcgtgccctgttgacgatagggcacgcggggcgcgggcagcttgtaagcgttcgatcggccatgtagggcaactatacatctttggcaggtctccaactctccatcatcctccgtgggagagaagatggtaatggagtgcgtgtgtatgtatgtgtatgcccagggcgcgcgcgcgcggctctgggcgagtcacagtagagatgcaatatcatgtatccagtatctttcttacaacacaaacagtgagaaattattagtaaagtgtgcattgtggtgcggccactgttccatgtccgtagcgacaggtcacggcccgttgcctttcggagcttcccggtcccggcatgcgctccaaccgtaagggcaaggcgtcaggagcgacaggtgcaaggcggcggatcggaagaactcggcagtcggcactgggtgcggccgtggagggaaggggatggtcgccgattttatgccaatttactcgcgccccacgccgcgagtctttgatcgatgtgtttgtacagtcgaaagagcattgctttacataggaccatcaatatatatatatggatacatacgcataagagtagctgaattatctgtgtacagaaaattgtttgtagtagt

SEQ ID NO: 9393 - DNA, 826 bp, Zea mays
  misc_feature (13)..(13): n is a, c, g, or t
  misc_feature (33)..(33): n is a, c, g, or t
  misc_feature (43)..(43): n is a, c, g, or t
  misc_feature (675)..(675): n is a, c, g, or t
  misc_feature (757)..(757): n is a, c, g, or t
aagcctccactcnccggccggaacaagcctgcntcaagctctntcgataccggtccgggcccccaccggcaacgccggccttggcggacccgtcgtcaccagcagcagggtgtcccggccctctctagtttctaccccggcccccaacattggcctgatgctgctgccatgtagcccagcgctcccccctcggcttcaccggcggcggcggcaacgacggtgaaaactacatcgggtgctagctccgacggtggtgcgtgccctgttgacgatagggcacgcggggcgcgggcagcttgtaagcgttcgatcggccatgtagggcaactatacatctttggcaggtctccatcatcctccgtgggagagaagatggtaatggagtgcgtgtgtatgtatgtgtatgcccagggcgcgcgcgcgcggctctgggcgagtcacagtagagatgcaatatcatgtatccagtatctttcttacaacacaaacagtgagaaattattagtaaagtgtgcattgtggtgcagccattgttccatgtccgtagcgacaggtcacggcccgttgcctttcggagcttcccggtcccggcatgcgctccaaccgtaagggcaagggcgtcaggagcgacaggtgcaaggcggcggatcggaagactccggcagtcggcactgngtgcggccgtggagggagggggaatggccgcccactttatgcccatttactcgcgccccagccgcgagtctttgaatcgagngggttggacagtccggaaagcattgccttacatagggacatcaatatatatatatgggttacatacgcg

SEQ ID NO: 9394 - DNA, 560 bp, Zea mays
  misc_feature (514)..(514): n is a, c, g, or t
  misc_feature (520)..(520): n is a, c, g, or t
aagcctccactcgccggccggaacaagcctgcctcaagctctctcgatctatatatgcgtcctcatccaacaccttccatggaggacccgtcgtcaccagcagggtgtgtcccggccggccctctctagtttctaccccggcccccaacattggcctgatgctgctgccatgtagcccagcgctcccccctcggcttcaccggcggcggcggcaacgacggtgaaaactacatcgggtgctagctccgacggtggtgcgtgccctgttgacgatagggcgcgcggggcgcgggcagcttgtaggcgttcgatcggccatgtagggcaactatacatctttggcaggtctccatcatcctccgtgggagagaagatgcatggtaatggagtgcgtgtgtatgtatgtgtatgcccatggcgcgcgcgcgcggctctggggcgagtcacagtagagatgcaatatcatgtatccagtatctttcttacaacccaaaaaaaatttaaaaaaaaaaanaaaaanaaaaaaaaaaaaaaaagtactctgcgttgttaccactgct

SEQ ID NO: 9395 - DNA, 2060 bp, Zea mays
tgtatttatatacgtggtatggtgcttgcaatgcgtgtaaaattaatcgcacatttatagcaaaatgatatttttttttccgttgcatcgacgtacgtagaagaggagagagatccaaaaacgcatttgtaccccaggaaaagaagaacagaagagtacgtacgtagtggagcaatggtgcgtgctcagcgggaggccagtgcagtatatagtaggtagggttcgtgggtggatggcgctgctgcatgcacatcagcgtatgcctgcttgcctttgtggatcggaactacccagatgcgcatgagccacatgacatacctaactccatggatgcatatgattatgcacgccgccggccatgccgtcattgcgattaatccgcccatcatccatgtccattatatactatactccctagctagctcctagcaggcagagcagcgagctagctgtgtaagaagaagaggaggactggaggaggaagaagactatcgatcgatcgatccatccatccatcgaattaatggcggcgacaacaccgtacaagcccaagaggatcctgatcacgggcgccgcggggttcatcgcgtcccacgtggcgatccgcatcgtgaacaggtaccctgagtacaaggtggtggtgctggacaagcttgactactgctccaacctcaagaacctcctccccgtcatgggctccggcggcaacaacttcaagttcgtcaagggcgacatcgccagcgccgacctcgtcagcttcatcctggccaccgagggcatcgacaccgtgatgcacttcgcggcgcagacccacgtggacaactccttcggcaactccttggagttcaccaagaacaacatctacggcacccacgtcctcctcgagtcctgccgcaccgccgccgcccagatccgccgcttcatccacgtcagcaccgacgaggtgtacggcgagactgacggcgacgccgtggtgggcaaccacgaggcgtcgcagctgctgcccaccaacccgtacgcggccaccaaggccggggccgagatgctggtgatggcgtacggccggagctacggcctccccgtcatcaccacgcgcgggaacaacgtgtacgggcccaaccagttcccggagaagctcatccccaagttcatgctgctggccatgaggggccagcgcctgcccatccacggcgacggctccaacgtccgcagctacctctactgcgacgacgtggccgaggcgttcgaggtcgtcctccaccgcggcgaggtgggccacgtctacaacatcggcaccaagaaggagcgcacggtgatggacgtggccagggacatcagcggcctcttcggcctgcgcccggaggaggccatccagttcgtcgacaacaggcccttcaacgaccagaggtacttcctcgacgacgagaagctcaaggggctcggctggcgcgagaggacgcgctgggaggatggcctcaggaagaccatggagtggtacgtggccaaccccgactactggggggacgtgtccggggcgctgctgccgcatcccaaggcgggaggcgtcagcgtcagcgtcacgacggaccacggcgcccggggatcgtcggagatgctcgacgatcgtttcatttccatcccctcttctccgggagcggcgacggttgcaggagacgacgatgacggcgcaccagctgcaatgccgtacagcaatggcggcgccaccaatggaaccaccaccgtgcattgattgcatgcctgcctgcctgggtcgtcgtttcggcatatcacatcacatccacacctgaacaattataattgttttttcaagctatatattgtattatttgctactactactagatcgagtattattgttatgtagtatgttgtttgagtccgcacgtgccgttgtattccgctgttttgttggatccacacatcacctcccgttggattaaaatgagtatttaaactgtaaggacaaatttattattttaaaatagatatctatgaaatttgttgttgaccaggaaaaaaaaaaaaaaaaaaggccccta

SEQ ID NO: 9396 - DNA, 1332 bp, Zea mays
gggtacctcgaggccggccgggggctcctgctcctgggctgggcggagaaaaaattaaacgttttatatataaattaaaacgtagggagcaagatatttcggcaagttttgtggcttgatgcattttagcgaagtcaggtcggcgtatgccaaatgtctcgttaagacaccgctgcagtgcagactgtagagtgcagactcgccgagtacgactcctcacgaactagtccgtttccgtgcgctgctgctgacgagggagtgggagggatcatggtggcgccggacgtgaaggcggagacgatgaagctgatggatcagcggggtgccctagaggcggagatggacgccatcatcgcccgcctcactgcggcaggcggaccgggcatcaccggaggcctcgtcgacgccgagggtttcccaaggtccgacatcgacatcccgaacgtcctcgcccagcgccggaggcttgctgaattgcgaaatgaccacaaggatgttacaaacaaaattggtaaaaatcttgaggttttacactcagcaaagttatcaaggaatgaacaatcaacctcaaggagatctgatacaacagatccttcacactttggatcatctcaaagtgaacctatggaagaggaccatgtgactggacttccttttgccatgattgatgaaatcgctgatggttctcctgcttctgtggatggtttgcaacttggagatgagattgtaaagtttgggaatgtggaagctggtgatcagttgcaggaaaggctcatgtctgaagctctttccaatgaggacagtcaagtatctttagtcatcattcgccagggatcagtggtgaatttaacaattacaccaaggaagtggcatggaagaggacttctggggtgccatttccgaatgctatgaagagcccatcgttcttcagcaggatcgttggtctatcgatgtcatttcagcagcaaagtgaactgatttaaccgaatgtgtgacatcttccaaaatactggttgcgtgtacttaacttgagcgcttgaaacatactggtgtaccaggcggtgttgagacattttacttgtacacatggtcagttttcgttcttcctcgcgtgcgtatcggtatcgcacaccaacttgaaaaccgtcaacgttcttctagttcatacggtcaggacccagagtaggttgcatcaatcaacagcttaaaaagggccatatgctagcgatgcaagtttgaatccatgagcagattagggaacctttggtatcagctctacaccttctgtaagggtgtttctgtcacgcttgagaattaatataggatgctaac

SEQ ID NO: 9397 - DNA, 1045 bp, Zea mays
tggcgaagtcaggtgtcggcgtatgccaaatgtctcgttgagacaccgctgcagtgcagactcgccgaaaacgactcctcacgaactagtccgtttccgtgcgccgctgctgacgagggagtgggagggatcatggtggcgccggatgtgaaggcggagacgatgaagctgatggatcagcggggtgccctagaggcggagatggacgccatcatcgcccgcctcactgcggcaggcggaccgggcatcaccggcggcctcgtcgacgccgagggtttcccaaggtccgacatcgacataccgaacgtcctcgcccagcgccggaggcttgctgaattgcgaaatgaccacaaggatattacaaacaaaattggtaaaaatcttgaggttttacactcagcaaagttatcaaggaatgaacaatcaacctcaaggagatctgatacaacagatccttcacactttggatcatctcaaagtgaacctatggaagaggaccatgtgactggacttccttttgccatgattgatgaaatcgctgatggttctcctgcttctgtggatggtttgcaacttggagatgagattgtaaagtttgggaatgtggaagctggtgatcagttgcaggaaaggctcatgtctgaagctctttccaatgaggacagtcaagtatctttagtcatcattcgccagggatcagcggtgaatttaacaattacaccaaggaagtggcatggaagaggacttctggggtgccatttcagaatgctatgaagagtccgtcgttcttcagcaggatgcgttggtctatcatgcttgcactcgtggagagtggagacggctctagcgatgccatttcagccgcaaagtgaactgatttaaccgaatgtgtgacatcttccaaaatactggttgcgtgtacttaacttgtggagcgcttgaaacatactagtgtaccaggctgcctgtgttgagacattttacttgtacaaaaaaaaaaaaaaaaaaaaaaaaaaattgcgtatcggtatcgcacaccaacttg

SEQ ID NO: 9398 - DNA, 1528 bp, Zea mays
gcaaatgccaaatgtgcaacctggccggcccggccgtctgcccgtctgccttcggcgtgcagatctccccaactccaggaccagaaaacccacgcgaagaccagagcagcgggtggactcggcaccggccatcgggaccgcgacgatggccgccgcctggcctctctccgccatcgccggcatcctgccggcctccctctcgctgaccctcctcctcgccaccctcgtatccatcctggtgctgggcgcagcggcgttcttcttcgagcacatccgcaagataggatgcatgcactcgctggagaggtccgccgtctcggacgccttcttcgaggaccccaactcgctcaagaaggtgccctgcccgtcggttttggatcctcctgagaaatatatttcgttgatagttcctgcctacaatgaggagtatcgactccccgaggctcttacagaaacactcaactacttgaagcggagatcaggtgctgacaagtccttttcatatgaggtattgattgtcgatgatggtagcactgatgggacctctaaagtcgctttcagttttgtaaagaaacacaagattgataatgttagagttcttctacttggaagaaatcatgggaaaggtgaagcagtccgaaaaggaatgcttcattcacgtggtgaactattactcatgcttgatgctgatggtgcaactaaagtgaccgatttggaaaagcttgaagctcaggttcatgcattggctaagaaagctaagtctagcccagggacatctactagttcatctcagaatctatctgatgttgaagttgctgtttttggttcccgggctcatctagagaagcaggctcttgcaacaaggaaatggtatagaaactttcttatgaaaggtttccatttggtagttttgttgactgctggtcccgggatcaaagatacacagtgtgggtttaagatgttcacacgagcagctgcaaggaagcttttcacaaatatcagattgaagaggtggtgtttcgatgttgaacttgtatacctgtgcaagcgcctcaggatcccaatggtagaagtatccgttaattggaccgagatacctggatccaaagtgcgcatgacgagcatcatgcacatggtattcgagctcctgctgatcaaagtaggttatggactggggatatggaaaatcggctcgtagatccttgacattctatgctgactagtttctgcaactcagtttatcaccactgtagcctaccgcaaaacctagttggtcgccagcaaatccatttggaggaatactgtacaattttccgagattttcaaatcgagagcatcaattcacatgtaccctagtgtttgatcatagagacgttgacagatgtaggccaaatttgttgtcccagctatatccttttactgatttgttatacaggaactcaaactgtgtctggccttgattatcacagaagagggccaaacgtgttgctactggctttggatccaaaaaaaaaaaaaaaaggcggcc

SEQ ID NO: 9399 - DNA, 2645 bp, Zea mays
ctgcaggccgctgtcggagcggcggttccgtcaggccgtcagtccgtcacgctcacgcagcacaaaagcctagcccagggtcacataaaaacagccactggactactggagtaggattatactacggctggactggactcgaacggaacaggagaattttcagccggagtggcggacaccgatgatggggtgtcgcgctcgcatcgtcttcctcctcctcgccttcctcctcgcgcgcgccgccgccgcacccgccggcagcaggcaccttacgaaggacgagcggtggatgaaccagcgcctcgaccacttctcccccaccgtgagtcatcagtcaactccctccccggctccctgtcgcgcacgccacggcgcacccgtactgggaggagggaggattcttgtttgagagccgtcgctcacgccgatcgcggcttttcaggaccaccggcaattcaagcagcgctacttcgagttcctcgactaccatcgggcccccggcggcccggtcttcctgcgcatctgcggcgagtccgcctgcgacggcatccccaacgattacctggccgtgctcgccaagaagttcggcgccgcggtggtgacgccggagcaccggtactacgggaagagttctccattcaagcagctgaccaccgagaacctgaggttcctgtcgtcgaagcaggccctgttcgacctggccgtcttccggcagtactatcaggaatcgctgaatgcccggtacaaccgatcaggtttcgacaacccctggttcgtcatcggggtctcctactccggcgctctcagcgcctggttcaggctcaagttcccccatttgacatgtgggagcctcgcgagctcaggggtggttcttgcagtgtacaactacaccgactttgacaagcaggttggagagtcagctggccctgagtgcaaagctgtccttcaggaaataactgaactcgttgacgaacagctccggctggagagtcactcggtgaaggctctatttggagcacagacggtttcgacaacccctggttcgtcatcggggtctcctactccggcgctctcagcgcctggttcaggctcaagttcccccatttgacatgtgggagcctcgcgagctcaggggtggttcttgcagtgtacaactacaccgactttgacaagcaggttggagagtcagctggccctgagtgcaaagctgtccttcaggaaataactgaactcgttgacgaacagctccggctggagagtcactcggtgaaggctctatttggagcacagacgctgaaaaatgatggcgacttcctcttcttcctggcggatgcggcagcgacaaccttccaatacgggaacccagatgccttgtgccctccactaataaaggcaaagaagaagaggaaaaacttggtggaagcatatgctcaatttgtgaaagattattacattaaaaaaatggagacaccaccatcctcgtatgaccgagaatatctgaaggaaacaactccacatgattctagttctaggctctggtggttccaagtttgcagtgaggttgcctactttcaagtggcacccaaaaatgacagcgttcgttctgcaaggatcaatacgaggtaccatttggacctatgcagacatgtctttggggaaggcgtttatcccgatgtgttgatgacgaacttgtattatggaggcacaagaatcgctgcttctaaaatacaggttcgtccgcccgccccggacccatggcgccatgcctccaagcagaaatcatcgaaagacatgccgtcgtacataatgaaatgcagaaactgcggacatgggactgatctgaggggctgtccgcagtggcctttcaggatcgaaggggacgcttcgaactgctcgtctctcgctgtagtcaataccgcaagggagaggatcgccaagcacatcgacctgtggctgtcgcaatgcagcaaaccatcagtaggagcctggtaaccgcggactagtggttcatccactcgggctcgggaagagtggaaagaggtttggattggatgtcctggagcaaacttgtgtcgggacttggattacgtgtttgtgcactttgaaaagcagataaagctgatggtgtaaagcagcagtgcccggtaccccaccagggtacgtgatgcaggcaggggtggtgctgtctgtgtcgatgccgtcgtccttttctggcgtggcgctgcagatgaccgacgtgtcacggcgcgtttgggtgcgcggcgcgcgcgcgtcaaaacgtaacaagtactactactacgtgccgtgccaggtgttgcgtcaaaacgtaacaagtttctcccttccgttcttttgtccgagcgagtttacaagtactatactaccaaaggcgaaagcgaacccgcaattttcctatgtactactagtggactgcaccaacatccggtccacgtaaaccatgtgccttttccgacgtgtatgttttatttaatggcatgtgttcccctgtgcctctttttagccgggtcttcttttgtccacccgtccgcgcccgcgcactaaaagccaaaggagctttcgctatcccatctactacgtacagtactagctagtaaaaaggacgtaacggcgcgtaaccccccccc

SEQ ID NO: 9400 - DNA, 1281 bp, Zea mays
gcacgagaccattacctagaacatcctaatcgaaaaaaaggaaaaccacacaccggccaaaccacgactgcaggaggcgggtagtagcaagagaaaggaaacgctctcccagccccaaagaaaaaggcagcacaccaactcaccaagaaagtgtggagctgctcctgcctgcagcctcctgctcatcgaccctttcgccccacaagctcgattcctcgctcggccatggctgcacccgcggaggagacgcttgccgccgaggatacggcgtcgccaccgccgccggcgaggtctgcggggttctggttccttggcgaggataagtctgtccacaaggctctcggcgggggtaaaactgctgatgtacttttgtggaaagacaagaagacctctgctgcggtagttggtggtgcaactgtcctatgggttctgttcgaaattgtagaataccatctcctgaccctggtttctcatgtgctgatcgctgcactgaccatcttgttcctgtggtccaatgcgactgtctttatcaaaaagagtcctcctgatgttcctgaagtgcagatatctgaagaccttgctgtaaacattgcgctagcattgcgtgctgacatcaacaaggcacttgccctgcttcgggagattgctctgggccataacctgatgaagttcctaggcgtggtcgtcgccctttggattctttcagagatcggggagctatgtgatctcctgagattgatgtacattgtggtcttgatcctccacacagtgccgatactgtaccacaagtatcaggaccaggtggacaatttcgctgcaaaggcgcacagggagctctgcaagcaatacgcggtcctggatgccaaagttctgagcaagattccaagagctccaccaaaagataagaaacagaactagaacgtggaggatgacaagcgccttgttttcggcttgggcgacgagagtttgtagccaatggtctgatgtggttcgtgggctttgtgtaggtgcacagtttcacgtatatgttctggtcgtgtaatctatatgtttatataaacctgtaggggtgttgatgaccatcgaaagtgtcgtaaatattcagtagtatatgtagcttagggcttaacggttgtgtttataaggtcattgtcgttgtcgatgggaagtattatcatgttattttcaggactcaggagtataaaatgaaataaaatgtgaattcatctgaagctgaaacccaaaaaagcggcaaaaaaaaaaaaaaaaaaaaaaaaaaaa

SEQ ID NO: 9401 - DNA, 2899 bp, Zea mays
  misc_feature (1496)..(1496): n is a, c, g, or t
ttgaagtctcagcgataccatgtcctgtggtgaaaaaaaaggggaataaacgaagaaataaaaaatctgatacaccatgttataaatgattttcatgaggaaacaaccacaacagaattatgttaatgaaaatgttactcatatttatggttgcataatctagattgttatcctgatgccattccatcttctcatctgtatgcctctgtgaagctgctgatgtacttttgtggaaagacaagaagacctctgctgcggtagttggtggtgcaactgtcctatgggttctgttcgaaattgtagaataccatctcctgaccctggtttctcatgtgctgatcgctgcactgaccatcttgttcctgtggtccaatgcgactgtctttatcaaaaagtaaggaagagatacatagattcatatgcacttcgcgctgaccaaatttcttaaacatcaagtatttcactttcaggagtcctcctgatgttcctgaagtgcagatatctgaagaccttgctgtaaacattgcgctagcattgcgtgctgacatcaacaaggcacttgccctgcttcgggagattgctctgggccataacctgatgaagttcctaggcgtataaatctcagagaagagaaccatttgtttattttccttttcagtgacagcttgcaaggttgcactgaccaaattccaatgtttcaggtggtcgtcgccctttggattctttcagagatcggggagctatgtgatctcctgagattgatgtacattggtatgggtttttacgctccaaaaactgtgttttagtgattctttgaacaaccactttagttagcttaaccttagttctccaaacagtggtcttgatcctccacacagtgccgatactgtaccacaagtatcaggaccaggtggacaatttcgctgcaaaggcgcacagggagctctgcaagcaatacgcggtcctggatgccaaagttctgagcaagattccaagagctccaccaaaagataagaaacagaactagaacgtggaggatgacaagcgccttgttttcggcttgggcgacgagagtttgtagccaatggtctgatgtggttcgtgggctttgtgtaggtgcacagtttcacgtatatgttctggtcgtgtaatctatatgtttatataaacctgtaggggtgttgatgaccatcgaaagtgtcgtaaatattcaatagtatatgtagcttagggcttaagcggttgtgtttataaggtcattgtcgttgtcgatgggaagtattatcatgttattttcaggactcaggagtataaaatgaaataaaatgtgaattcatctgaagctgaaacccaaactaagagagttttatcatcatgaaacttacatctttttctctcttactaaaacgattgttatatcaacaaaatatttgtatgatattctattagttatagatgatactccataaaaataccactaaaactgactaaagttntcatagtaaaaaagcaatgtttagtgaaaaggttatcaaaaaattcaattgtcaacgttgaaagaaaagcaatgcacaatcaaaaaatgcatagtcaaaagaaatattagaagagtgtaccagagtaagattttattagtgttcctacaaaattataatatacctaatcaaatggtctttaaaaccgccggctttgaatatttcaagaagcggtagaatacctctatggggatggagtaatactccttccaatgggagacatacatataaattatattcatagattaattaatgaatacatatctaatataaaatgaattatattttgggacggagagagtaggatatatcatatgaaattatatattttatgcgatcacgtaatcaaccatatcattgattgcaaatcataagttgataatattttacaaataatcttttgtttggtgtattcgaagtgagctgatgaatatgaaccatgaactttttaaggacctcgatcacgaaatcgtggcaaggcaggcgaagaccagtagcaaacaaactttcggagactaggacttcgtcatctggcatgagaacagtctccgatcccaacgactccatctcattcaccctccgccacaaaaagtcttcaactggccgcccaccggattggaggccccttcgctcatggacccctcgtcgacagtcgcccctatagaatcaaagacccctttgcagtgaccctaagtatggttagtataagacaaaaattatggccttcgctctgtgatcgaggctgtgttcagtctccgcccaacagtacccctcgaggaattggttcatcctgatgggcattcctgaagttacttggtttttaaggtaacgaacggtgccctcgatcatctggtgaaccgcctgggggtggcgccggatgtgactgttggtgaattcgatgtcgttactgtggcgacccgtgcccggctatatatatgaaggttcgcatgggggccgctagactccagcttgtcgctttctggtctaggttaaatcatcgctcggtcgttgctactttcttaccggtgacgttgttacgcagacggtgagctcgttgtcgagctgcggaacgctggcccgcctgaagaccgctgatcagcgtcgtcttcggtacaccgccatgcttcctcctccgagtggtggcggtcctgcctccgctaatacgccaactgaaggaattccctgatttgaccaagcagagaagggagccacaatgtgagggctcctaagcgccaaagctacgaatcgaccccatgcatcatcggcccaccaaaagccatctctaggggcccacgtgtcagtgtggcatgtcgatggtgtatggtgtgcgtcgtctgatgtatgaccgtactttggaatattcc

SEQ ID NO: 9402 - DNA, 1163 bp, Zea mays
  misc_feature (25)..(25): n is a, c, g, or t
attggtacctcgagccggccggganaagtacttcgagcaccccaactcaccaagaaagtgtggagctgctcctgcctgcagcctcctgctcatcgaccctttcgccccacaagctcgattcctcgctcggccatggctgcacccgcggaggagacgcttgccgccgaggatacggcgtcgccaccgccgccggcgaggtctgcggggttctggttccttggcgaggataagtctgtccacaaggctctcggcgggggtaaaactgctgatgtacttttgtggaaagacaagaagacctctgctgcggtagttggtggtgcaactgtcctatgggttctgttcgaaattgtagaataccatctcctgaccctggtttctcatgtgctgatcgctgcactgaccatcttgttcctgtggtccaatgcgactgtctttatcaaaaagagtcctcctgatgttcctgaagtgcagatatctgaagacgttgctgtaaacattgcgctagcattgcgtgctgacatcaacaaggcacttgccctgcttcgggagattgctctgggccataacctgatgaagttcctaaggcgtggtcgttgccctttggattctttcagagatcggggagctatgtgatctcctgagattgaggtacattggtggtcttgatcctccacacagtgccgatactgtaccacaagtatcaggaccacgtggacgatttcgccgcaaaggcacacagggagctctgcaagcaatacgcggtcctggatgccaaagttctgagcaagatcccaagagctccaccaaaagataagaaacagaactagaacgtggaggatgacaagcgccttggtttcggcttgggcgacgagagtttgtagccaatggtctgatgtggttcgtgggctttgcgtaggtgcacagtttcacgtatatgttctgagtcgtgtaatctatatgtttatataaacctgtaggggtgttgatgaccatcgaaagtgtcgtgaatattcagtagtatatgtagcttagggctatagcggatgtgtttataaggtcattgccgttgtcgagggaagtatatcatgtttttttaggactaagagttttaatgaataaatgggattcattgaaaaaaaaaaaaaaaaaaaaaaagggggcgt

SEQ ID NO: 9403 - DNA, 910 bp, Zea mays
cttaaagatgtgaagctatggcagattcataccctccttaaagggttggaaaaaatagctgttagtgcagacatcccaatgttggtctgtggagattttaattcaactcctggaagtacgtcacatgggcttcttgcaaggggcaaagttgatcatttgcatccagatctagcaatagatcctcttggaattttgcgcccactaagcaagctgacacaccagcttcctctggtcagtgcatactcatcattcgtgagtatggctggtgttggctatgatttggatcaccagcgaaggaggatggaccctgggacaaatgagccattgttcacaaattgcacaagggattttactggtaccctagattacatattttacacagcggattcattgactgtagagtcattattggagctgttggatgaggatagcttgagaaaagacacggctcttccttctcctgaatggtcatcggatcatatagcgctcctagcagaattccggtgcaagcttagagttagacgatgatactttaggaggagctgtaggggagggattcttgacaatcgcatgagatgatgagaatgtaccctggcgaaggcaggaacgagaagcctaagggaaagaggcttgttatgttcctcacccttttacatttccgcctcgatgttctctagtggcactagttggaatgcgacttcctacagaagatatattatcaatgcaaagagaaatgatttaatagattcgtgtgccgtttttagttttccatcctcacattgtcgcccccccttccccttcatcctcttcaatgtgagttcactgtccacatttttgttccctaccatgaatgtgctctagttcttacaaactaaaaatggccccttccatagtgtatgtatgtctcttg

SEQ ID NO: 9404 - DNA, 2622 bp, Zea mays
catcggcgagcctgcagtcagacttaccaccaagtggacgcagcagctttaaccccccaaagcctcgacgccgcgagcacagctccgccgccaccgcccccttctcatccgcggtctcctccgcctgctgcatctctatcgatctagcgggactggctccttcccgtgctgggtccttcgtcaatcgtcagcgcgcaagatcggcacttgtgtacatctgagcagtttccggtgccctaattcaggcgcgggcgttgttgggttttcgataattttgggggttcacctgaaccctcatgacccaggtgaagcccgcccctgggggaaggatgctgaccgtgctgcgggtgcacctcccgtcggagatcccgatcgtcggctgtgagatcacgccgtatgtgctcctgcggcgccccgacggaggcgtcttcaccgacgacgtgtctgagaccgcgcccgtggatgggtacttcatgcgctacaagtggtaccgcatacaaagtgatcgtagagctgctatctgcagtgtacacccaacagaacaagcaacacttcagtgcatagggtgtctgaagtcaaaaatacctgttgctaagagctaccattgttcttctaagtgcttctccgatgcttggcaacaccacaaggttttgcatgaccgtgctataagtgctttaaatgaaaacggaaccgaagatgatgagttgtttggcagatttggtagcggcagttcgagctcaggggttattagtgctgcgttgtctggttcaacatcaaacctttcactgagctcaggtgttaataatggacctacacctgtgtatccaacaggcactgagaagagttctggtgaaacttggtttgaagtgggatggtcacgaacatatacggcaactactgatgatattggacatgtgctaagatttgaatgtatagttgtggatgtggaaacacgggggactgtgagagctcctacttcagtcatgacatcccgtgtaatcccagcaccgaccccgacaccacgccgcttgatccctgttaatgcagctgatgcaatggtccacttcgatttagatagccggacttcttcttttgggacatttactgtgctgtcctacaatattcttgctgatacatatgcaacaagtgatacatacagctattgtccaacttgggcacttacatgggcttatagaaggcaaaatttgttgcgtgaaattattggttaccatgctgatattatctgccttcaggaggtacaaagtaatcactttgaagattttttttcaccggagcttgataaacatgggtaccaacctctatataagaaaaggacgacagaggtgtacagcggaactcctcaagcaattgatggttgcgctactttctttcgtcgggacagattttcgcatgtcaaaaaatatgaggtcgagttcaataaggctgcacagtctttaactgatgcaattattcctgccgctcaaaaaaagttagctctaaatcgtttggttaaggataatattgcgctaattgcagttttagaagctaaatttagtaaccatggaactgaaaaccctagtaaaaggcaacttctctgtgtggctaatacacatataaatatccacaatgaccttaaagatgtgaagctatggcagattcataccctcctaaaagggttggaaaaaatagctgttagtgcagacattccaatgttggtctgtggagattaatcatgtggttcatgtagtacgtcacatgggcttcttgcaaggggcaaagttgatcatttgcatccagatctagcaatagatcctcttggaattttgcgcccactaagcaagctgacacaccagcttcctctggtcagtgcatactcatcattcgtgagtatggctggtgttggctatgatttggatcaccagcgaaggaggatggaccctgggacaaatgagccattgttcacaaattgcacaagggattttaccggtaccctagattacatattttacacagcggattcattgactgtagagtcattattggagctgttggatgaggatagcttgagaaaagacacggctcttccttctcctgaatggtcatcggatcatatagcgctcctagcagaattccggtgcaagcttagagttagacgatgatactttaggaggagctgtaggggagggattctcgacaatcgcatgagaatgtaccctggcgaaggcaggaacgagaagcctaagggaaagaggcttgttatgttcctcacccttttcatttccgcctcgatgttctctagtggcactagttggaatgcgacttcctatagaagatatattatcaatgcaaagagaaatgatttaatagattcgtgtgccgtttttagttttccatcctcacattgtcgcccccccttccccttcatcctcttcaatgtgagttcactgtccacatttttgttccctaccatgaatgtgctctagttcttacaaactaaaaatggccccttccatagtgtatgtatgtctcttgagcggggatcagctttggcgtagtttactgtgttgaagatgcttagttgaaaagtgatgttgggttatctatgatggatattgaacgaat

SEQ ID NO: 9405 - DNA, 954 bp, Zea mays
ccggccggggaaatccgaatgaggatgggtatgagatgagttttgtacccaacgcggggatggagatgggtatggagatgaatcaaacatgatatggatggagatgagatgctataacccggtggagaattcccattgacatctctaaccacacctcttacctaaaataagaaagaaaactagaacctaaaaaccagcgacgccgagcggatctacagccaccttggtcaccggcggcgatggcgagttccaagtccggcatccctatcaaggcagaacaagattcggatggctcggcacaaagcacagctgatatgacggcttttgtgcaaaaccttcttatgcagatgcaaaccaggttccaagctatgtcggagaacatcatttcaaagatagatgaaatgggtgcgagaattgatgaattggaacagagcctcaatgacctcaaggctgagataggcggtgaaggcatgtcgacgccatctaagatgaaggaagagtcaagaccttcagacagctccgcttgagtgcagcagaagcagcgtgactcgtttcagaggccgttgctgtgtcttgggcgttcattactaacaaatactcccccgttcttttttatttgtcgcgttttagttcaaaaatgaactagcgagcgacaaatattcgagaacggaggttagtacctgtttaaggtctcatttgagcagagattgtaacccctgctacttgtgttttgctgaatggtttgccataaactgtacgtcttcgttctgtgtagacctacccgtggttatgcgctgagcatgtagtgacagctgctagagtgctagcaccccaactactaagaattcaggattcgcaagcataatttactttgcttctgtgttagttttatcacttacatggatagtagtgtacatatttttaattgggcaaaaaaaaaaaaaaaaagcgggc

SEQ ID NO: 9406 - DNA, 1590 bp, Zea mays
actcctatgggcgattgggaccctcgaggccggccggggacatctctaaccacacctcttacctaaaataagaaagaaaactagaacctaaaaaccagcgacgccgagcggatctacagccaccttggtcaccggcggcgatggcgagttccaagtccggcatccctatcaaggcagaacaagattcggatggctcggcacaaagcacagctgatatgacggcttttgtgcaaaaccttcttatgcagatgcaaaccaggttccaagctatgtcggagaacatcatttcaaagatagatgaaatgggtgcgagaattgatgaattggaacagagcctcaatgacctcaaggctgagataggcggtgaaggcatgtcgacgccatctaagatgaaggaagagtcaagaccttcagacagctccgcatgagtgcagcagaagcagcatgactcgtttcagaggccgttgctgtgtcttgggcgttcatcactaacaaatacgtacctgttttaaggtctcatttgagcaagagattgtaacccgtgctacttgtgttttgctgaatggtttgccataaattgtacccgtcttcgttctgtgtagacctacccgtggttatgcgctgagcatgtagtgacagctgctagaatgctagcaccccaattactaagaattcgggattcgcaagcataatttactttgcttctgtgttagttttatcacttacatggatagtagtgtatatatttttaattggcttacatattaaattcatgttcgcaacgtaatttactttgcttctttaaaaaactcttgacttgcaaaaaaactaaaccttactggtacacactgacaccctgtgttccgtctttgcacacgtcctaccaggtaggagcaggtactcgaaccataaatggccgttgccatcgggaggcttgcagtgctactgtcgtcgcgtcgttcgacgcggcgcaggacgacgagctcctcgcgcttgacgcgccctccagtcccatgtcgccgacacctctatatcacgctcgcctcgtttgcatagatatatgatagtttattcatgaagatccgatccatttacaaggtgcactgttcatcagacttgcagtcatacaccaatcgtttttggcacagtagatttctttattcatgtaaagggcataggccagccgtgtagaatttgcagatgtgactgtatctatgatattgaggatattgctgaaggaatggagtcctcaacaagtatccctcccaactctccttgtgcagaagatagagaagcaacttgcgacaactttcattttttctatctcaggctggcagactgcaaatggtcaacgatgtttttcctccttaccaacgtattatatgtgcactctcaaactcccgaaatcggtgattaaacatattgacgaaatcagaaggcactgtctttgaagaggagcagacatcaatgcaaagaaacctccacaagttgcatgaaaatcagtttgtaagccaaaagctcatgggggacttggagtaatcaatatagaattgcaaaacaaagctctcctaatgaaaaaccttcacaaat

SEQ ID NO: 9407 - DNA, 794 bp, Zea mays
gccggccgggccgccacacctcttacctaaaataagaaagaaaactagaacctaaaaaccagcgacgccgagcggatctacagccaccttggtcaccggcggcgatggcgagttccaagtccggcatccctatcaaggcagaacaagattcggatggctcggcacaaagcacagctgatatgacggcttttgtgcaaaaccttcttatgcagatgcaaaccaggttccaagctatgtcggagaacatcatttcaaagatagatgaaatgggtgcgagaattgatgaattggaacagagcctcaatgacctcaaggctgagataggcggtgaaggcatgtcgacgccatctaagatgaaggaagagtcaagaccttcggacagctccgcatgagtgcagcagaagcagcatgactcgtttcagaggccgttgctgtgtcttgcgtttattactaacaaatactcctccgttcttttttatttgttgcgttttagttcaaaaatgaactagcgagcgacaaatatttgagaacggagattagtacctgtttaaggtctcatttgagcagagattgtaacctgtgctacttgtgttttgctgaatggtttgccataaactatatccgtcttcgttctgtgtagacctacccgtggttatggttatgcgctgagcatgtagtgacagctgctagagtgctaggaccccaactactaagaattcaggattcgcaagcataatttactttgcttctgtgttagttttgtcacttacatggatagtgccccttatattttt

SEQ ID NO: 9408 - DNA, 2187 bp, Zea mays
gagatacgggtttcatcttcatatatagcatataacagtaaacaagacttatatgcctaaattgaccgctaaatgtctaaagtggaagtcaatcttaacattaaatccggttttccggcaaaaaatggtggtttaccggtctaaaataacggtttaccggtccaaaaaacggtttaccggcggttttcagggtttatgatttttttaaaattttttgaattagaacaaattttaaaaaacggtggttatctgaaactgtatcaaggcggtttcgataaaccgaccggtaccgagcagggagctggattgaagaacaagaagaacaagagaacaacatgaagctggcagggtaggtttcgtaattcaggcttgtttggatgctgcctgccaggcaatagccagctacccatccatgcagggttccggatcctggttcctgactcagtccaacgaaactgtgcgtctgggggttggggttgcttgccagacagaatccgagtacttgaagaaaacaggctaacttctgttgtacatggctacatgctgaacccccatccagatcaaagatctctatattaaagatgcctaatagctgcaacttataaattggaaccgagtgagtgattaattaattagttgaatctggatgtactttttttaaaaaaaaattggatgtacatgtgctagtctgctacgtactcgctactctgcgtctgaatttctaacgtgatccttttgtaaggcccacgtagacagaccaggcttttccgcagcagcgaagcagcccacgcgcaaaacaggcccggaacccggcaccgacgccgccgcgaccgggctccccactcctacggcgctgctcctcttcctgtgtctctctcgtcgcccaacgacgcgattggcgattccatttctaccccgagacctccagccgtccgcccctgaaccctcagccttctccgtcccgcctcggcactcgacggccgccggcacacaccgcgcagtctcgagacaggtaacccgctcccctctccgctgaactcctctcccaacaaggggccagcctcacccccaacgcccatctaagccaagtgcacggtgctgctagatcccgatctcgttctgccaaccgccgagggagggttgcgctcgccggatcccgcccgagtcacgtgcggctttgattcgctgcacctgtcgtgcaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagagccagcgcaagaagcgcgacttcgtcaacggggccgtcggcgcgttcgttgccggagcctctgtctgcggctacagaggttagaaactcgaaccctttctaacaagggaacaaatgcacctgggaagccttggctttagtttctggtcgcttctgatgccctaaatttcttacttattgatgatactggcatgcagacatgtagaggttaactgggaagtgggaattgagattgttactcactgccatatatttgacatgatgtgatggtataagtcagctaggttatgggggtgattggtgggggtctaattagtgaagcttgagctcaaatcataaaggagtagtttctggggttttgggatcaaatttgatgcatagtttagttgtatctttttctgagtcactggaaatgttgtttattcatgtcactgaataggcataacccttgtagcaattaaaagaaagctcttgtaccattgtacattgctttgtcaatagtcccatgaacataacgtccatagttaacagttttttgttagcttgcacattgtgtctgtagatcagtgcacacattgtgtcggtaaattgcaaagagaaatatgtgatttgaaattattactctttgggtgtctggagcattttggattggttcaccctaaatatggatgacggcatagtttgtgctcctatatctagtgacttctggtgactacacagtaagagttattgtgtggacagat

SEQ ID NO: 9409 - DNA, 1031 bp, Zea mays
tcgcgatctaggtccccccgacggcgaccgggctccccactcctacggcgctgctcctcttcctgtgtctctctcgtctcccaacgacgcgattggcgattccatttctaccccgagacctccagccgtccgcccctgaaccctcagccttctccgtcccgcctcggcactcgacggccgccggcacacaccgcgcagtctcgagacaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagagccagcgcaagaagcgcgacttcgtcaacggggccgtcggcgcgttcgttgccggagcctctgtctgcggctacagaggaaagagtattcagtcagccctcatcggaggctcctgtctggctttcacatctgctgtgctggacattggcggcaatacgaccagagttgacaacggcaaagagtactatgcctacacaactgagaagaagcctgcaaattgattccaagtctgcacttctagcaaacaatcttgcacgccatcaactcagtgaatttgaagctgatgtgcagttttatgtttgttttgctgatgcaattagttcttaagcaaatccatggcaacttgtttatcgctgatgcttgagggatggaaatgacactcagaataaatctttgatttgctttcttgtgatcgttgatcacattaaacgcagtggcgcgatatactgtgtaattgtctattttcccgtagtaagtattgataggaacgttgacctgataaaatagataatcgaaaattggattaaaaaatggtctctatttttctagttaaaatctaataaaagactatcttatacg

SEQ ID NO: 9410 - DNA, 1077 bp, Zea mays
cctcgaggccggccgggccgggaattcaggcccggaacccggcaccgacgccgccgcgaccgggctccccactcctacggcgctgctcctcttcctctgtctctctcgtctcccaacgacgcgattggcgattccatttctaccccgagacctccagccgtccgcccctgaaccctcagccttctccgtcccgcctcggcactcgacggccgccggcacacaccgcgcagtctcgagacagatcccgatctcgttctgccaaccgccgagggagggttgcgctcgccggatcccgcccgagtcacgtgcggctttgattcgctgcacctgtcgtgcaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagagccagcgcaagaagcgcgacttcgtcaacggggccgtcggcgcgttcgttgccggagcctctgtctgcggctacagaggaaagagtattcagtcagccctcatcggaggctcctgtctggctttcacatctgctgtgctggacattggcggcaatacgaccagagttgacaacggcaaagagtactatgcctacacaactgagaagaagcctgcaaattgattccaagtctgcacttctagcaaacaatcttgcacgccatcaactcagtgaatttgaagctgatgtgcagttttatgtttgttttgctgatgcaattagttcttaagcaaatccatggcaacttgtttatcgctgatgcttgagggatggaaatgacactcagaataaatctttgatttgctttcttgtgatcgttgatcacattaaacgcagtggcgcgatatactgtgtaaaaaaaaaaaaaaaaaaaagtactctgcgttgttaccactgct

SEQ ID NO: 9411 - DNA, 1041 bp, Zea mays
ccggccgggaacgacgcgattggcgattccatttctaccccgagacctccagccgtccgcccctgaaccctcagccttctccgtcccgcctcggcactcgacggccgccggcacacaccgcgcagtctcgagacaggtaacccgctcccctctccgctgaactcctctcccaacaaggggccagcctcacccccaacgcccatctaagccaagtgcacggtgctgctagatcccgatctcgttctgccaaccgccgagggagggttgcgctcgccggatcccgcccgagtcacgtgcggctttgattcgctgcacctgtcgtgcaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagagccagcgcaagaagcgcgacttcgtcaacggggccgtcggcgcgttcgttgccggagcctctgtctgcggctacagaggaaagagtattcagtcagccctcatcggaggctcctgtctggctttcacatctgctgtgctggacattggcggcaatacgaccagagttgacaacggcaaagagtactatgcctacacaactgagaagaagcctgcaaattgattccaagtctgcacttctagcaaacaatcttgcacgccatcaactcagtgaatttgaagctgatgtgcagttttatgtttgttttgctgatgcaattagttcttaagcaaatccatggcaacttgtttatcgctgatgcttgagggatggaaatgacactcagaataaatctttgatttgctttcttgtgatcgttgatcacattaaacgcagtggcgcgatatactgtgtaaaaaaaaaaaaaaaaaaaa

SEQ ID NO: 9412 - DNA, 538 bp, Zea mays
  misc_feature (516)..(516): n is a, c, g, or t
ttttttttttttttttgcaacaattgtacagcttagaaattattgaatcacatgaacatgcacctcgtaactgcagtgaggtctcagttaaaaccaccccccacttccgcagctacatatttacatcattcgctgtagtaaccctagctagctaggtacactgccaatgccaattccatgagccatacaatttgcctccaccacacaaagctatactagcactgacctctagctcagcgattcactaacctcaccatatgcaaacacagcacacaacagggcggcggtacgcagcttcctgcaaacaacacccatggtccaaaattgtgtttcgccactctggcatcctatcctaactggtgtgtcccaacccatcgcccaggatggctatgaagctcgttttgtcatgatggtcggctgaagacatctccatctccctcttcagtgctgggtgtcctagcgccagcaaggggaagcattctgacccatcttcttatgcctcctcatgacaagggngtagagaagctcgttccaggca

SEQ ID NO: 9413 - DNA, 669 bp, Zea mays
cctcgagccggccgggccggcaaaggggagcttttcttcagaatcattcgtcctcgtcaactcgtgctcagctcgtccttcccttccttcggcaagttcatactaatcttctgatccagagccgggtgttggcacagatcaggcggccgccatggcggatcagttcgcggattcggcgaacaacgtgatcatcgaggaggtgaacaagggcctgaacccaggaatggtggttctgctcgtggttgccagcttcctgctgctcttcttcgccgggaactacgcgctgtatgtgtacgcgcagaagacgctcccgccgaagaagaagaagccggtctccaagaagaagctgaagagggaaaagctgaagcagggggtctcggcgccaggggagtgaacagacagggatgccgccgatcggcccgtcctgagcccgccccctatttacatgattgtcgaagaaaaaagatacacctgctggagccccggtgttcgtagtaattttgttctgtagatgctttttgttgtcttcgatggtagtgcatttgtattggacaccttgtttcagagcctaaaccgagctactcctttgttcctgtaaactacaagtaattcaaacgacgctggtgatggtgaacctcagtaaaattggcgagtcccagctcccgcctg

SEQ ID NO: 9414 - DNA, 642 bp, Zea mays
ggtaccctccgggcccgccgggccgggggaaggggggatatctgaaaaaaacgcaaggtaccagcagcgcaaagagccgggtgttggcacagatcaggcggccgccatggcggatcagttcgcggattcggcgaacaacgtgatcatcgaggaggtgaacaagggcctgaacccaggaatggtggttctgctcgtggttgccagcttcctgctgctcttcttcgccgggaactacgcgctgtatgtgtacgcgcagaagacgctcccgcccaagaagaagaagccggtctccaagaagaagctgaagagggaaaagctgaagcagggggtctccgctccaggggagtgaacagacagggatgccgccgatcggcccgtcctgagcccgccccctatttacatgattgtcgaagaaaaaagatacacctgctggagccgcggtgttcgtagtaattttgttctgtagatgccttttgttgtcttcgatggtagtgcatttgtattggacaccttgtttcagcaactgatgaatctttagcctaaaccaagctactcttttgttcctgtaaactacaagtactaaaaagttcaaacgacgcttggtgatggtgaacctgagtaaaaattggcgccccccgggcc

SEQ ID NO: 9415 - DNA, 491 bp, Zea mays
gaagagggaaggggggatatcggggaaaaaaacacaaggtaccagcagcgcaaagagccgggtgttggcacagatcaggcggccgcatggcggatcagttcgcggattcggcgaacaacgtgatcatcgaggaggtgaacaagggcctgaacccaggaatggtggttctgctcgtggttgccagcttcctgctgctcttcttcgccgggaactacgcgctgtatgtgtacgcgcagaagacgctcccgccgaagaagaagaagccggtctccaagaagaagctgaagagggaaaagctgaagcagggggtctcggcgccaggggagtgaacagacagggatgccgccgatcggcccgtcctgagcccgccccctatttacatgattgtcgaagaaaaaagatacacctgctggagccgcggtgttcgtagtaattttgttctgtagatgctttttgttgtcttcgatggtagtgcatttgtattggacacc

SEQ ID NO: 9416 - DNA, 735 bp, Zea mays
agagggaaggggggatatcctaatagaaaaacaaggtaccagcagcgcaaaggtgagcttttcttcagaatcattcgtcctcgtcaactcgtgctcagctcgtccttcccttccttcggcaaattcatactaatcttctgatccagagccgggtgttggcacagatcaggcggccgccatggcggatcagttcgcggattcggcgaacaacgtgatcatcgaggaggtgaacaagggcctgaacccaggaatggtggttctgctcgtggttgccagcttcctgctgctcttcttcgccgggaactacgcgctgtatgtgtacgcgcagaagacgctcccgccgaagaagaagaagccggtctccaagaagaagctgaagagggaaaagctgaagcagggggtctccgcgccaggggagtgaacagacagggatgccgccgatcggcccgtcctgagcccgccccctatttacatgattgtcgaagaaaaaagatacacctgctggagccgcggtgttcgtagtaattttgttctgtagatgctttttgttgtcttcgatggtagtgcatttgtattggacaccttgtttcagcaactgatgaatctttagcctaaaccgagttactcttttgttcctgtaaactacaagtacttcaaatgacgctggtgatggtgaacctgagtaaaattggcgagtcccaaaaaaaaaaaaaaaaaaaaaaaaaaaggccccta

SEQ ID NO: 9417 - DNA, 3992 bp, Zea mays
ttttttttttttttttttagaatgaagcttgctctgacttaaagctccgagtgggttacagccatacactgagtcctctgtggttaacaagccattccctaatcttgtttacaagatccatacaaatatacaatcatcttaagatcctagacaaaaaataggaaacacattattatttgttggcaactgcaggcctcgattcagtacatcctgacgattaatatatatattacacctgagtgcattcaatgtagagaatgcacccaggccgaacctacgcgccatgtccgagccaaccgtcccacataggccgtcttcgtctctcccgcacgtcttcgtcgctcccgcacgctcccgacagaaccttttcattttcccgcccacgcccctctttctccacgaacgactcaacctctgaggaggcggagtgaccgaggcgacgacatgctcggagactctaggccagagaaggcgacgtgctcaggcgactccagcctctaggcgagaggagcggcggcaggcgagcggaggcgacaacgtcaagcgactctaggtgagcgaaggtggcagcgtgctcaggcgagcggaagcggggcgtcggcgtgctcgagcgactccgagcgagaggcgagaggagacgtggcgtgctcgagaagtggaaagtcgcccgacgtccgaaggccggacgcgtttccacgcggaaatttgccttaggatgggcagatatccgcacgaagctgtcttccaaacagactgaatctctgtccccgtggaaatttcacagtgggctgccggcacaaggaaatgacgaggttccctgccgccaggaaatgggctaccaaacgagcccttaagaagatcttaatttccatatattaaaagatttgtttttaggatcacttggagacgctctaacaatattagaattcatgttctaaaatatatgttaagagatatgtaaaagataaacatttatcaatttttaattcttcgtattgaatagaacttaaactataatcatcggtaaagtatatctaaactttttcggtagtttgattatacggtgattgcaagaatatttaattgcacaacaatttaacctttgaaatagagccaaaccaactaaattcaagtaaataattgttatttatataaacactatgcgatagattacactttcatgctacaacgcgtagacatatttcttaaaataacacaaaatctaaaagatatacctcatgataaacactcttgcgaactgatctcgctggaaacaaaaatgatgcacgtacacgtatatacataaacaaccaaaatcaaagaaaaatggtggactagatacttccagatcgaaccccccataaagccacaacccggaaacgcgcaaagcgaagagggaaggggggatatcggggaaaaaaacgcaaggttccaccgtaccagcagcgcaaaggtgagcttttcttcagaatcattcgtcctcgtcaactcgtgctcagctcatccttcccttccttcggcaaattcatactaatcttctgatccagagccgggtgttggcacagatcaggcggccgccatggcggatcagttcgcggattcggcggtaagcctcgaattcttccttccttaatcatgtggcgtgggagaccaaagcaagttcgagtttgaatgtacagggtcagaagcggcacagccgcatcgtctctctgggcgactccgccgccgccgccgccgaaaaccaccaattgccccctctcccggccgtcgcctgtcggcaccaccttttctccctcctctatcactctttttctccatcttgcgattgaacctctggcagcgtcggcgccgtccggtcggcggctgtgtggatccggggcccccaggtgtggatccgctcgtaccttccccggatctggtgtcctgtcgcccgggtgtgctcctgatgctctgcccggctctctggtgtcgtgcacgggcaggttccacttattctcgcgcgagacaccttgggctaagcagtctgtgtggacgggtttactcgtgaggcggcggcagctgtttgttccgatgttttggcttgtagaagtaagcgctccatggccggagctgcagttgattttggtgcatccgatttgaatttgatgtgtggaggactggatctgtagaatttgggcaagacttctacgtgatcattaggtcatgcgataaactgataattgtgtttgtttgaaaaaggcatgtttcaattgtgtcctagaaaagagattgcagactgcttttatcttgtacgtgagctttgatatcatacactagtaatttgcataagcttgataactgttagtacaaccttacaggtctggagctttctggctatcatatactccctccgtttctttttagttgtcgctggatagttcaattttgcactatccagcgacaactaaaacgaaacggagggagtatgtgtttcatgtttggccaatatggtgttcagtgtttcggttatgcttatgcccaattctctagataccagaagttatctgttataataacctgattagtttgatgtctttaaatcttgtgcattttataaatttattacagggttaccagcagactatgtcccaccccacccccaccaccacaaacacactctttgatgcacacttaccgggctaactggtgttcatatgtgtaatccgataccttctagatgatgctgagtggctgcagtttgattattttcgagctgctactgctattagttgttctccgtgctaagtgctaactaatctgcatatttgattctaaacggtgactgtagtctgtatgcgtatcacttcactacacctcccctatggacctatttgtgaagattctgtaagactgccaattgccttactgatagattcaaattaggcttcatctgtttgttgtgactagtctctgcaattgtggacaacagttagcacaagcgctctataatagagatatggcttgtatctttatggcgctgtccagttagcatttggtctgccaatttgtacaggatatatacgtgttcatctgttgttcgatcatcctaaccttcaacgcatcatcttgcattgcaaggcccgtgcacctagtctactgttctcgccttcagtatcctgtttaattttctcgtgacatacacccgcttatgtcgccgaacaacgtgatcatcgaggaggtgaacaagggactgaacccaggaatggtggttctgctcgtggttgccagcttcctgctgctcttctttgccgggaactacgcgctgtatgtgtacgcgcagaagacgctcccgccgaagaagaagaagccggtctccaagaagaagctgaagagggaaaagctgaagcagggggtctccgcgccaggggagtgaacagacagggatgccgccgatcggcccgtcctgagcccgccccctatttacatgattgtcgaagaaaaaagatacacctgctggagccgcggtgttcgtagtaattttgttctgtagatgctttttgttgtcttcgatggtagtgcatttgtattggacaccttgtttcagcaactgatgaatctttagcctaaaccgagctactcttttgttcctgtaaactacaagtaattcaaatgacgctggtgatggtgaacctgagtaaaattggcgagtcccagctcccgcctactcttctgcggttggttttttttttttgcgtcagcaaaagattaggtcttagcttaggtaagcagaggaaaactttgttattccactgaggtcgagccacacccacacgtcctgcagctgccttttctgctgtgccgtgtgttggctgctgctactctctgccggctggacctctggtatctccctctctaggaccgatgccccgtctcagttgtcaatccattccagtggcgactgactaagaccaactccagcagtgtgcctctccgtatccctaaaacgcgcggcc

SEQ ID NO: 9418 - DNA, 837 bp, Zea mays
  misc_feature (787)..(788): n is a, c, g, or t
gccggccgggtctgggtgactcgaacggccgtcgagcccaaacctagcgatcgcagagagttgcgcccggaccccggaccgcgccgacccggctcgcaaactcctccacaaccctcgtcgccgccggctgctccacccccgccaccgccatgggacgatggtgtcgcagctggtgaagcacgagcgcatcgagaccaccgttgccaaggcgaaggaggttcggcggaaggcggatcagatggtgcagctagggaaggagggtactcagcatgcagcaagacgtgctgctgcctttgttcggggtgatgatgtcgttcataagctatttactgagctggccttccgctacagagatcgagctgggggctacacaagaatgttaagaaccaggatacgtgttggtgatgctgctccaatggcatacatcgagttcgtggatagggagaatgagcttcgagaggccaaacctgcaacgccgccgcctcctcaacgagtccctcttgatccatgggccaagtcacgtgctagccaacagtgggcaggacctaaaatcaccaagacctcggaatcggacggcttatgagctagtatacctatgttccatagaaagtttcagttattttgcttaagagatttttttatctagagataactgccgatagaataattcaaactttattgtcattttgtatgcttctaattcaccgagtgaagattgcaaggctgtgtccacacaggagggaagtttggaacgagagagatgtatctctgctttgcttattggagnntgtacagatctaactacatgatcaaattcgtctatgcatcggtctgcca

SEQ ID NO: 9419 - DNA, 986 bp, Zea mays
aaaatccctcgaccggccgtcgagcccaaacctagcgatcgcagagagttgcgcccggaccccggaccgcgccggctcgcaaactccccacaaccctcgtcgccgccggctgctccacccccgccaccgccatgggtaaattccgcaagcttggccgcaattactcccaacgcctctgcatgctcaggacgatggtgtcgcagctggtgaagcacgagcgcatcgagaccaccgttgccaaggcgaaggaggttcggcggaaggcggatcagatggtgcagctagggaaggagggtactcagcatgcagcaagacgtgctgctgcctttgttcggggtgatgatgtcgttcataagctatttactgagctggccttccgctacagagatcgagctgggggctacacaagaatgttaagaaccaggatacgtgttggtgatgctgctccaatggcatacatcgagttcgtggatagggagaatgagcttcgagaggccaaacctgcaacgccgccgcctcctcaacgagcccctcttgatccatgggccaagtcacgtgctagccaacagtgggcaggacctaaaatcaccaagacctcggaatcagacggcttatgagctagtatacctatgttccatagaaagtttcagttattttgcttaagagatttttttatctagagataactgccgatagaataattcaaactttattgtcattttgtatgcttctaattcaccaagtgaagattgcaaggctgtccacacaggaggaagtttggaacgagagagatgtatctctgctttgcttattggagttgtaacagatctaactacatgatcaaattcgtgtatgcatcggtctaccagtcctgtgtggctgtgtccgtgcatcgttatgacaaaaaagtttctgatgatggggcggcccaccgtttgcctgttctgaaccaaaagaatgttatagcaatcagaaaaaaaactcac

SEQ ID NO: 9420 - DNA, 991 bp, Zea mays
ggccggccggaaagcgatcgcagagagttgcgcccggaccccggaccgcgccgacccggctcgcaaactcctccacaaccctcgtcgccgccggctgctccacccccgccaccgccatgggtaaattccgcaagcttggccgcgattactcccaacgcatctgcatgctcaggacgatggtgtcgcagctggtgaagcacgagcgcatcgagaccaccgttgccaaggcgaaggaggttcggcggaaggcggatcagatggtgcagctagggaaggagggtactcagcatgcagcaagacgtgctgctgcctttgttcggggtgatgatgtcgttcataagctatttactgagctggcctttcgctacagagatcgagctgggggctacacaagaatgttaagaaccaggatacgtgttggtgatgctgctccaatggcatacatcgagttcgtggatagggagaatgagcttcgagaggccaaacctgcaacgccgccgcctcctcaacgagtccctcttgatccatgggccaagtcacgtgctagccaacagtgggcaggacctaaaatcaccaagagctcggaaacggacggcttatgagctagtatacctatgttccatagaaagtttcagttattttgcttaagagatttttttatctagagatatctgccgatagaataattcaaactttattgtcattttgtatgcttctaattcaccgagtgaagattgcaaggctgtgtccaaacaggaggaagtttggaacgagagagatgtatctctgctttgcttattggagttgtaacagatccaactacatgatcaaattcgtgtatgcatcagtctgccagtcctgtgtggctgtgtccgtggatcgttatgtcagattagtttctgatgaaataaaacaataaaatataaaaaaaaaaagggggggccccccaattagaaacctcttccccccggaatttatttggggcgggacc

SEQ ID NO: 9421 - DNA, 1924 bp, Zea mays
cgacctgcaggcgcaacgggcgtccacacgttgcaaccgcacaaaataattggtgtagctagattacatcaccaccacaaaatcctccaccatccaaaacaccaatccccagttatcctcagaatattatcaaaagaaaaaaaagatcgcagccgaaaggaaggggaaaaaaggaccaaataaacaatccactgtctcctacctccgcggaagcatcaaacaaatcaccctgccgatcgccatggacgaacagcaggcggaggagggcgaaagcgcgcgcgtcaagaggacgccggaggaggggtcgtcgccgctgtccgctctggcggatgacgtgctgctacagatcctgggacggctcgaggcggacccgcgggactgggcgcgggcctcctgcgcgtccccgcgcctcgccgctctgctccgggcggcctgcctcccgccgcgactgtcgcgggcgctccccgccgagctcctccccgcgccgtcaccggacggggcgcccgcggcctgggcggcgctccacaagctctccgtctgttgcccggggctcctccgcgccggggtgctcctcgagcccaccgacgatttcgggctcgatctcgacatcgggcctgacgtccccatctacgcccgcaccgacgcctcctccgccgaggggttcgaggccacggccacctcccgccacagcggaaccatcgtcgcggccgggagcgcgccccgcgccggcgaatctgccaacgtcgccgcgtggtcgctctacgacgacctgtacctggacgcggcatacgactgctcgtccgagctgcagatcccgcctgccgctgcggctgtggaacccgccccgcccgcgcccgtggcggcgatccgcgacgtggaggaagcaacgaccacaaatgctgtctcatgcggcgtcgcccggcgcggcgtggtggccgggagccgactgcatccgcggcggtggctgggcaccgtcggcgcgcacctggcatcggggtcctggacgctgagccgtgagcaggggaacaagctccttgccagccgcttccgcggcgaccggctatacctctgcgactggcccgggtgcgtgcacaaggaggagcgacgcaagtacatggtcttccgcggcgtgttccacaacttcgcccggtctcaggtccggcgcgcgctcagggacacgcgccgccccaccgtcgccatcgagtgcgccttctgcggctgcaaagagacctgggacctctactcggctttctgcctccgcagtttctacggctaccacgacgacggcgagcctgtggtgcgcgcctacgtctgcgagaacggccacgtcgcgggcgcctggaccgaccgcccactctactcctgatcttggagtggacactccgactgacatggtattgcatcaaagactgcaccctgccattgccagatgctcgctcctaccacttgagctgtttctagacataattatgcgtgcctgcatatagcaatccggattttcgtcatgttctgatacacgtgggatgtgtattctttatttctttcttcttgctgttgctgttgtttgtgagaatggttgagtagaataaggatgccggttgatttgcagcataggatataaagagatttgcttaaaattgtaaacctgatgctacgagaaattggaaccgctgttttattgccaaaaaaaaaaaaaaaatgggtacctttttttgttctactgaagcggcccgagctcttgtatctggattaaaggattcttacgggtctaaacaaatcctgctcacggcgtgtttggaagcaaagtaggttttgaagaaacaaatcctgctcacggcgtgttttgaagaatattacggttttaagatatcatagcacaaccgtagtatttttttacatctctttgtaatatatgtttgaagac

SEQ ID NO: 9422 - DNA, 1923 bp, Zea mays
  misc_feature (495)..(495): n is a, c, g, or t
aaaatataacaagcaacaagagatgatagatctaaaatgaatggtgatgatttaatatgtgcaacatatacactaatctttcatatacataagatatgttctttgagttcgtttggataattaaaaaaacaaaatatacaatataactattttaagcataattttagatagtaaaatggtttcgaataaaaagttatcgattaaaagttgtaggtctcactaaaatcaataactccagttaggttatttttctatatgggttcattcaaataatttaaagattttgcagtagtcgctgtttgcacattttccacagttttctgaagagagatcctagaggcttcaccgaaattgtgctccaaagactcgaaggtcagagctgaaaggcaatcatcaaagactcgaagtttgccgagcttgtgctccaagcagagacctttggagcaaagcgcgccacgatgcacagacaacctcgtccacacacaaagtctcttntgccgcttcccatggcctacgccgcgccccggccggcaggcaaagcgccactactcacagacagtcacagacacatccaacgagcccgaccgccagagctcgccgccgtcctccgcagacaatccaccatggcgatggtgctgaggatggtgctggggaagatcccggtggagacgcccaagcacgaggtcctccacaccggcgccggctacgagatccgcaagtacccgcccagcatcgccgcggagttgacctacgatcccaaggagatgagaggagaccctgatggcgggttcaccgtcctcgccaactacatcggggtcctcggaaagccgcagaacaccaagcccgagaagatcgccatgacggctcccgtcatcaccaccggcagcggcagcggcggcgacggcgagaagatcgccatgacggcccccgtcatcaccaccggcggcggcgagcccgagcccatcgcgatgaccgcgccggtgattacggacgaccagcaggcgccgggcaaggtgacaatgcagttcctgctgccgtccaagtacaccagggtggaggaggcgccgcggccgacggacgagcgggtggtgatccgcgaggtgccagagaggaagttcggcgtggcgaggttcagcggggtggccacggacaggacggtgagggagaaggcgaagggacttaaggccgccctggagaaggacgggtacaccatcaagggcccgttcgtgctggcgcggtacaacccgtcgttcacgctcccgccgctgcgcaccaacgaggtcatgttccccgtcgagtgatccggcaaggcgccggccaccgcccagctaccggccgcggttcttctgtgaaatgacggcttgaggttcaggaggaactgtgtttgtattttgtatctgtatttctcttgaagttgttgtaaaatatgctttatgcaacgagttatggataaattttactactcttcgatcaatgaagaactaaaccctggtgtggatccgtatttcagacagtttttagttataaggtataaagcaatttacatttatattataaagtactatctcggactctcagttattgaatatttacgcttgctagtttatctttaaactaaatcacgataaataaaaagcggaggaaacctgtttgttcatgaacttaaatcaacgagaccctggttcgaactcgaacgtcgaagcccttgagctcgtccacgatcctctggtcggaaaagtcagagtagttgtgataggaccactaaaatccctcaaactgctaggtttcaggtcaaaacatttacttatttattcgtactaatataaacaaatataatataaatataattagcattacatcgaacagaaaaataaactgtagaagataattctacgtcgagacaaatctataggttagagaacc

SEQ ID NO: 9423 - DNA, 2501 bp, Zea mays
tcgacaaagacttctttgccgagtactttttctcgggcactcggcgagtgtcagggagcactcggcaaagaaaagcgaccgttacggcgccggttgacggagacggcggctttgccgagtgtcaacggtgacactcggcaacgaagatatctttgccgagtgtccgcctggcagcactcggcaaagccgccttctttgccgagtgccacttgggacactcggcaaagagcccgccagggagggtccccatgtcaggctctttgccgagtgtcccaattggcactcggcaaagccgacctctttgccgagtgccagcgacacaacactcggcaaagaacctaagccggtgcccaggtctgtgctctttgccgagtgttatgacccagacactcggcaaagagcctctttgccgagtgttacactcggcaaagtgaccagtatgtaccttttttatttgttttttgttttccatccacacaaacagaagatatcacatatatatcacatatatacatcacagatatcatcacagacataaatagccaacacaaacataaaaccgtgaccacaaacataaatatccatcacaaacataagtgttcaacacaagtattaaacacaaacataagtctcaaacgtcgcaagctctcacataagtatcaaacagaaacataagtattatacataagttctgaagtctaaaacaatgactcatggaggtgggcggtttggccggggttgcgttgggctgaacccttccggagggttgttggatgccgccccagattggccctgcacagagaagagatagcatgtgttataccagatgcattacaaacatctaactacaattttgatactcacaggagtgtggaagagagtagggtcaactggggggaacaatggaggtggcggagcgatgccctgtgcggcgccaaggctctgcatgtactggaacatctccgccatcctctgatcagccgccgcccgctccgccattatcctcgcctccatctcttctagttgggtctgtaatattacaagccaacgttatagtaactcaaagactaggtatataactaaaggaaggacgagttacagaagcactaacctcgagttgctgtaatgcgatgctgtgagctgtcgtgccgaggtcgaatggctgggctcgagcccgtgctccttgctctcacctgagacagagtgggagtggaggacgagtcgattgccccgtcggcaatccagtaccgcccatgtctcttgcctcctccgaccctcatgagcacatcggggtcgataggctcggtgctcggatcatagtctgggccatggacctcctgcgccatggcggtgtagtcatggaggcggctgtagacggcggggttggtgtaggcctcgggcccgtcatccgggttgtaggtgacgtcggacgtcgccttacccttatgggccatagcataggccgagaaggtggaacaaggcctgccaccatgtgacgccgactgcaacgaaaaccaacgagatagttagaaataatatctaacttagtgctatatatcgaaataaaaaaggtggcgtacccatgcttcggcatattggcccaggctccggctgccttggtggtgcgagggcccttgcatctgcaaacgccgttcccggctagctgtgtgcacctcgtcccactcagccgaacaccacctatccaccatctgctcccagcacagaggatgtgcggcgcaccaatgtggaatcacctgcaaagtaaacacataaagtgcatatcagaagataaaataaaattcatgcatggagtactggtaccaaacatgcatgactttacctgcaggtactgctccctggtcaacgacatggttcgggcttgaggtttggtcaccttctccccaaggacggagccgtggtaggtgatgatggcctggatgcgggcctcatagtgcatgtccacgacgagcttcttacagcacgtggtggccaccacatccgccctagcctcgtatccagcatcgcatctgaagaaatcctgcatacaaaaacgatgtatccatacattatttcaagaatttgcaacgaatgcgacatattttatattatactaagacttacccacagctcttgcttcacccgctccgccttgttattgaattccctgccgtcccggtctactgcatcgggggcgacggcgtagtggtcgaaggtgaaggctgggcccgtcactccggcgtactccacaagtccagggaagtgttccctgcacagcaggccgaggatgttgttgggggggcgggggcgacgatgacccccagcataatccaaaaccgtccaagacctgtccaagtgataaataaaaagtattagtttatattatgattttgaacacataatatgaacaagaatgaagaacataaagttacatacctctccccttccggccgaatcaacggccgtctgtcccgaagtatgggacgcggcgggagactcgcggg

SEQ ID NO: 9424 - DNA, 1012 bp, Zea mays
gatcaattttttttttttttttacgcgtgccgagttttattcaagtaatgctaaacatctacggtgtatcactgctaatgcgcttactatgtttagtacctatgctacatacaaagtttcaggatcaagctagtgcgcttcataacctatacatcttctatatatacatgcaagcctcttataaaatgctgtaggcaaggttcaagagaaagcatttgatgttatcgttcgcctataaaatatagtagttcaaagagaaaccacttgatgttttagttttcgtcttcaatgtggctgacctcgacgacgtaatccctcatgagctttgtgttggcctcatcaaccatcttgaaggataattccttcaaattgtcccactcgaactcgttcttcacatatgcagatcggacctccagaatcctcaaggctgtttgtttccaagagacgaaaccacacatgcctcagtaatttcatacactgtttcatcaaaggatcaagaaagtaaaacagtgtgtggttaaaaaagaactagacttgcctagtcccttgagccttggagactcgcgcatgagcttttcgcagaaaatctcggcgtcgttcagggaggtgcggctgatgaactccttcagctccaagtacgcttccctattgtaactctcaagctgtgctaggacaatgctgacagcgatgtagttaaagaagtgctggaggttgatcgccgccttccgctccggtgaaccctccccaaagccgggaacgtacatcttgctgcacctcgccggcgccgcggaactcgcgagccggcgccgccgctccgtcgccctcctgctcctcaagaacgaccgtacccgcacttgcacggggaggaggacgcgcccaaccccggcgccctggagcggaaggacgacggcaccgcgctccatgaccaagaaccgcacgctcactctgctctagcgcccgctcttcaccgatgccagataggcgccgcgcggatatcccggccggcctcgag

SEQ ID NO: 9425 - DNA, 2695 bp, Zea mays
ctcggcaaggctttgccgagtgtaacactcggcaaagaaggctcggcaaacagtgcatcggcaaagacttctttgcccagtactttttctcgggcactcggcaaatttctttgccgagtgtcagggagcactcggcaaagaaaagcgacggttacggcgccgggtgacggagacggcggctttgccgagtgtcccaagtggccggtgcccaggtctgtgctctttgccgagtgttatgacctggacactcggcaaagagcctctttgccgagtgtaacactcggcaaagtgaccagtatataccttttttatttgttttttgtattccatccacacaaacataagatatcacatatatatcacatatatacatcacagatatcatcacagacataaatagccaacacaaacataaaaccgtcgccacaaacataaatatccatcacaaacataagtgttcaacacaagtatcaaacacaaacataagtctcaaacgtcgcaaggtctcacataagtatcaaacacagacataagtattatacataagttctgaagtctaaaacaatgaaaacacaacactcatggaggtgggcggtgcttgaccggggctgcgttgggctgaacccttccggagggttgttggatgccgccccagattggccctgcacagagaagagattgcatgtgttataccagatgcattacaaacatctaactacaattttgatactcacaggagtgtggaagagagcagggtcaactggagggaacaatggaggtggcggagcgatgccctgtgcggcgccaaggctctgcatgtactggaacatctccgccatcctctgatgatctgcccggcgctccgcctcccgctccgccatcatcctcgcctccatctcgtgacgttccctcctctcttcttctagttgggtctgtaatattacaagccaacgttatagtaactcaaagagtaggtatataactcaaggaaggacgagttacagaagcactaacctcgagttgctgtatgcgatgctgtgagctgtcgtgccgaggtcgtatggctggactcgagcccgtgctccttgctctcacctgagacagagtgggagtggaggacgagtcgattgccccgtcggcaatccagtaccgcccatgtctcttgcctcctccgaccctcatgagcacatcggggtcgatcggctcggtgctcggatcatagtctgggccatggacctcctgcgccatggcggtgtagtcatggaggcggctgtagacggcggggttggtgtaggcctcgggcccgtcatctgggttgtaggtgacgtcggacgtcgccttacccttatgggccatagcataggccgagaaggtggagcaaggccggccaccatgtgacgccgactgcaaagaaaaccaacgagatagttagaaataatatctaactcagtgctatatatctaaataaaaaagagggcgtacccatgcttcggcatattggcccaggctccggctgccttggtggtgggaggggccttgcatcatcaaacgtcgttcccggctagcggtgtgcgcctcgtcccactcagccgaacaccacctatccaccatctgctcccagcacagaggatgtgcggcgcaccaatgtggaatcatctacaaagtaaacacgtaaagtgcatatcagaagataaaataaaattcatgcatggagtaccggtaccaaacatgcatgactttacctgcaggtactgctccctggtcaacgacatggttcgggcttgaggtttggtcaccctctccccaaggacggagccgtggtaggtgatgatggcctggatgcgggcctcatagtgcatgtccacgacgagcttcttacagctcgtggtggccaccacatccgccctagcctcgtatccagcatcgcatctgaagaaatcctgcatacaaaaacgatgtatccatacattatttcaagaatttgcaacgaatgcgacatattttacattatactaagacttacccacagctcttgcttcacccgctccgccttgttattgaattccctgccgtcccggtctactgcatcgggggcgacggcgtagtggtcgaaggtgaaggctgggcccgtcactccggcgtactccacaagtccagggaagtgttccctgcacagcaggccgaggatgccattggggggggggcaacgatgacccccagcataatccaaaaccatccaagacctgtccaagtgataaataaaaagtattagtttatattatgattttgaacacataatatgaacaagaatgaagaacataaagttacatacctctccccttccgaccgaatcagcggtcgcctgtcccgaagtatgggacgctgagggagactcgcggggcctcgcaggtagatgctcctcgaactagagccgcctgaacctgaggcgtcctgctgctggtcgtcgtcgtcctgctgctggtcgtcgtcgtcctgaggcgccgcctgctgctgtgctgcctgctctgcctcgtcctgctgcgctgcctgctctgcctcgtccgccgtcctacgcctcctccccctcctcctactcagccaaccgcccaccatatttgtccaacaacctgcaattaagagtaaacaaataagcacatataaaagatgtatttaaaaataggtgcgaaataaaaag

SEQ ID NO: 9426 - DNA, 1554 bp, Zea mays
ccggccggcatctttttactgctctacgatcccctacgggctatggccctatttctaccgccacgcccgttcttctccccgcgtgttcgagtccatcttcttgtgccatccaacccctcgtccgtagatcgatcgctgctacgcgcctgcatgctgacggttcggcgccgctgatgcgatgaagctctcgtagcccgacgttagcgagaagacgggatcgcacaagtactgaggtctcggccaggtgtcgatttggttcaaccgagggagcacctgtgcattgctataacaacaatgctggatcgggttgccatgtcagctgaggattctgccctggctgaagatttgcaggttgaagaggttctccggttctcaattcagtcggggaaggcctgtgcagtttgcaaagaaggcatccgatcattggatgcctcgtggaaacctgaaaattgtgaccatgtcatctgcattgcctgcttctgccagtatgcacctgagactgaggccactggactgcccaggtgcgcggtggcatcttgtgattctttgtgcaatacagagacacatcagggcaccaatgtgcctcggtgcacttcgatctcgattgaagacatggaccggaaagggaagaaaccactaggtagtagtacaattcaagagcttggtcaatgctctcgaggtgcgagcacaaatatcagcagtgagttatactgtgccatctgcatggagacagtgcacatcggagagtcctttcccgtggatggatgtacgcacacattctgcatcagttgtgtgagccagtgcattgctgcgaaggttgaggagaatgtgctgtctatcggctgccctgccccggggtgcaaggatggtgtgttgcacccagatgcatgccgcgacgtgatcccggcgcagctgttccagagatggggtgctgcgctctgtgactcgtcattggggtcactcaaattctactgccccttcaaggaatgctctgctctgttggttgatgatcctgggcacggtgaggaggtgataacaaacgtggagtgcccacactgctgccggatgttctgtgcccagtgcaaggttccatggcacgccggtgtcacttgcgcggagttccaacgactggggaaggatgagcggggcagggaggacctactgctgaggaaggtcgcgcaagagagcaagtggcagaggtgccccaagtgcaagatatatgtggagaggatcgagggctgtgtattcatcatctgcaggtgcgggcactgcttctgctacctttgtgcatccccaatgtctagggacaaccattgttgcaaaacctgcaaccgaacctggtgaatgacttgaaaccgccaagctctacctgaaggaaagaaactctcaataactagtatttatgtatttatgtgtgaactgctaagttctacccgtagaaaagaaatccttaactagtagtatgtgtttagatgataagttgctgttatgactgtttcagttggcactggcttgttgcactagtagcaaattggtattccacgttgatgttcg

SEQ ID NO: 9427 - DNA, 922 bp, Zea mays
ataaagaagacggaggtggaagggaccgagagagtatagcgtctgtttcgcaccaaccgaatagtcacagaaaattccgtttgcccaaacctagagctacctccgccgccgccgccggcaatcaagacagctgatggatcctatgcagtcatcggtgagaggccgcaggtcttcgttgcatgctgatgctgtcataactattggaggagtccgacctgcaccacccccacaaacatccacacaacatgtatgtcaagatgaggcaatggtcagcagcggggatccctcttggatgtctggttacagcactgattcctgccggggtggttattacacttctgcactcaacctggagggtgcatcaattagagaactgaagctgaaatatcagaagctgaaatatcggaataaacctaacaattgtaatgcggacgatcatgtcaatgctgaaagatcacccggaagaaaagctgaggagaaaaaagtgctggcgagaaagcatgaagattgtgatgatgaccctttcattgaagaagttaaaaagacgagagaagcacatcaagaaatagagagagatcgaaaggcccgtgatgataagttctatgagctagagaagattaagcttgacttgaagcgagaccgactggatacaatgataatgcaaactgacacgagcgcaatggacagtgaagcaaaacaatactttaagctgatgaaagaagagattttggctcgtcgattcaagagtaggaaagcataggtgtttccatttaatggattttagactgaagttgtttttcgttctttttaatggagttagtatttggtttgtatcttcaataatgctataatacttgtggatgctctgcattagggccagaaaaaaagctcgagctggctcgggctcgtagcagttcggccc

SEQ ID NO: 9428 - DNA, 2477 bp, Zea mays
gttccgcaccccacggcaggcgcttgagagtacttgactactaccctcccacctgcgagactgcaacgccgttgcttcaactcgactccagcatccctcgtccccgcatcaccgcgccgccgacactccgctcgctttcgctcccgagacccgggcctgccgagccgccgccatggacgaggagtacgacgtgatcgttctgggcacggggctcaaggagtgcatcctcagcggtctcctctctgtcgacggcctcaaggttctacacatggatagaaatgattactacggaggagattccacctccctaaacctgaaccagctctggaagaggtttaggggggaagacaagccaccggcacatctaggtgcaagcagagattacaatgtagacatggttccaaagtttatgatggcaaacgggactttggttcgcactctcattcacactgatgtgacaaaatatttgtcattcaaagctgttgatggaagctatgtcttcagcaaacggaagattcacaaggttcctgccaccgatatggaggctctaaaatctcctttgatgggtctatttgagaaacgtagagcaaggaacttttttgtttacgtccaaaattacaatgaagctgatccagtgacacatcaggggttggacctcacaaggattacaactagagaattgattttgaaacatggattgagtgatgacactgtggattttattggccatgcactcgctctgcacagggatgatcgttacctaaatgaacctgcccttgatactgtaaaaaggatgaagctttacgctgagtctcttgcacgttttcaaggaggctcgccttatatttatccattatatgggttgggtgagctgccacaggcttttgcacgtctaagtgctgtttatggtggtacatatatgttaaataaaccagagtgcaaggttgaatttgatatcgaagggaaagtgtgtggtgttacttcagaaggtgaaacggcgaaatgcaaaaaggttgtctgtgatccttcttacttgcctagcaaggtaaggaagattggaaaagttgcacgtgcaatcgctattatgagccacccaattccaaacacaaatgagtcccactcgattcagattattttgccgcagaagcaacttgggcgcaagtcagacatgtatgttttctgttgctcatatacacataatgttgcgccaaaagggaagttcattgcatttgtgtctgcggaagctgagaccgataatccacagtccgaactaaagcctggaattgatctacttggtcaagtagatgaactgttttttgatatgtatgacagatacaaacctgtcaatgaaccatctcttgataattgctttgtttcaatgagttatgatgctactacacactttgagacaactgtgacagatgttctcagtatgtacacagcaattactggaaagaccgttgatctcagtgtggacctgagcgctgccagcgcagctgaagaatactagagattttcctattagagataccatactctaaagaagaacggtgttaacacaggccctgcctggtggcttgccaggtttagatctatgctgcagctgcagccaattaaacggacagaacatatcaccctatagcatttacatggcgtttaaacacaagaccgtttaggatgatggtggtggttcctttgttccttgcattattgatcggatggttaacttttaactgtgctcacgtttgctacaacctgctcgttcttgtcagtgatgcattgtgatcgcttttcagatatgcaagaaaaaaataacggaaattccgtttcttgctcgctgctaaaatgcctcggtagttgttaatatgaggggggacccaaagcacccttgttccgcttcccgaattttttgcattttggccctttctcggaaaaaaaatcacgtttagaccctagaaaattttaatgtcattttttgactctttgctcggcgtcatagctgagataacatagctcggcgccataggctatggcgctgaggtacatgctgcgttggcacaaatgaacgtcgtggcgccgacgtgatacagagctcggcgccaagatctatggcgctgagctcggttgtgtaaacacaaaacctgtctagcttagtcggtagagtgcaaggcttttaaccttgtggtcatgagtttgagccccacggtgagtgtttttaatattttttgtctttgttactgatttgttttttttccagatttttcgtttatgtggtcataagttaaacatgaacaatgaaaaaaataccccatctatttcccaatacaattcgttttagcatgtgtttttatgtctatatttaaatagaagacgacgaatatatatataatgcattaaatgtttataaattcactaattttttaaaaacaaattttaatttgtacaacttttcaccattgcctgtattgcacagggtc

SEQ ID NO: 9429 - DNA, 1560 bp, Zea mays
  misc_feature (829)..(829): n is a, c, g, or t
ggcccactgcaggatttttctttttctttttatttttcccttgcttttccttctcttttaatttctagaattcaaatttgaatccaattttaaatgtgaatttatattcattttaaatgtacaatttgagcctaataattcggaagatccaattattttatacatatttctttattttgtatagcattttcctctcttctccaattatagaatttcctttagaatttaaattccaatttgggtaccaacatatattttttttacatatttttttttatattgtcacaaaatgcacacaaagaaaaacctcagcatgatgcatattccattttagtatcttttattttaactaatcacccttaattataggtatgctcttgttatgatgaatatatggcacacaatataaggagatttactatatcctcctcgtatacatttttgggtattacacgcaccactaaggaagcgacgacttgatccttgctcacttgacaccgcatccagatcggggctggcgtcccggtccttgcccatttaacaccatacccgggttccgatatggcgcgtcgctaagagggttacactctaatggttttctattaggtttcatcttcattttgagtggctaagtttttatagctagctcgccacgtctaacacaaccctcctccttgtacgtgtaattggaatcaggatatgatgcaccaacatatgctgagacaacataggcgaagttcttcagcatactcctattatcctatatagtaaaaatatagtataacaatatcttcctaataatattatacaaatatatttcgcacgtaantacgtaaccatagcttaattgatttttacttaaattattattattagaaggaaattcaatttcacgatctagatgggggcgtaaagaaaaatctaaaaagaagaaaaaaagaaaaagcagaaaaagtttcacttgttgctgtccgctccaaactcccattcactcctcgcgcctcgtgatcccatccaaatcccgatcagtcgccgcccaagcctagcagatccgccggcgagcgcgcgggggcaatgggtgtcgtctcggcagcggcggacgcgattgtcgcggttttctccctcaccatcgtcgtcgcggcgccgctactcgacgcgcagtccgtcctcccgcataccctctacccggcgccgctcctggaactcaagcgctggtacgccgccgagtttggcgactacctcgtggcccagtcccccggcttcttccgtggccttgtttgcctcgagctcgccttccaatggccgctcgccgtcgccacactctacggcatcctcacccgccgccgctgggctgccaccacctccctcatggccggcgttggcaccctcacctccatgtctgcaattcttggtgagatgttaggttcaggcaaatcaacaccaaagttgcttcagatgtatgttccttatgctgtttttgctgtcattgctattctacgtggactttgctcatgctctgggtaaagccgtgtttcccttctcccttgtagtggagtcacg

SEQ ID NO: 9430 - DNA, 1484 bp, Zea mays
gcacgagaccattacctagaacatcctaatcgaaaacccgatcagtcgccgcccaagcctagcagatccgccggcgagcgcgcgggggcaatgggtgtcgtctcggcagcggcggacgcgattgtcgcggttttctccctcaccatcgtcgtcgcggcgccgctactcgacgcgcagtccgtcctcccgcataccctctacccggcgccgctcctggaactcaagcgctggtacgccgccgagtttggcgactacctcgtggcccagtcccccggcttcttccgtggccttgtttgcctcgagctcgccttccaatggccgctcgccgtcgccacactctacggcatcctcacccgccgccgctgggctgccaccacctccctcatggccggcgttggcaccctcacctccatggtaaagccgtgtttcccttctcccttgtagtggagtcacgattgtaatgcattatgcatgcatgtctggaatttcgtgagaccagtgtctcaccgctgcagctctgcccctgtgccccagatccaaaacactaccatggtggatgcacaattgtacacttaaaagtcagttcagttgatgtggaatccaaacatagtttctcatgtgcttattttgttatgattggctgattgttcaaatgaaatcgtgctggaaaaggttttgtagacccatgggattcagagttacttccatattgtcttggcataccaattgcatttcctgttggtgatgattcccagaatgtcaagctattgccaacatttttagttttgttctctgaaccatggttccttttgacctcaaatgtgctatggataggtgacgttgttcaggttaaatctcaaccgcactgtctcgtattaaatgataggagggaaaaaaatttcttgtcacaatatcagatatcaaatcatcgcaaaaattgagtactgactacctgttatgctagattctgcaattcttggtgagatgttaggttcaggcaaatcaacaccaaagttgcttcagatgtatgttccttatgctgtttttgctgtcattgctattctacgtggactttgctcatgctctggacgcactactgctggttcatcacttgggccttctgcccggaagaagagggtctagatcagcagtgacacttggagaattttcggtttgagacagtggcgccagagcactaatgctggtcagaagacgattatctggatcaggtttctatccctggtatttagcacggatgttgaaaaatccagatagtgttagtggctgtttctctaggatttggtgttcgttttccctgaaatgtgatattcatcttgcctttatttccattttaccctttgattatatgtcttgctaactaagacattgttttgtttactggatgagctgattcaactctggcattgttctggcgaataagtttcataaatccttgtcttggtaaaacaaaaaaaaaaaaaaaa

SEQ ID NO: 9431 - DNA, 1018 bp, Zea mays
cattgggtacctccgggcccggccgggactcccattcactcctcgcgcctcgagatcccatccaaatcccgatcagtcgccgcccaagcctagcagatccgccggcgagcgcgcgggggcaatgggtgtcgtctcggcagcggcggacgcgattgtcgcggttttctccctcaccatcgtcgtcgcggcgccgctactcgacgcgcagtccgtcctcccgcataccctctacccggcgccgctcctggaactcaagcgctggtacgccgccgagtttggcgactacctcgtggcccagtcccccggcttcttccgtggccttgtttgcctcgagctcgccttccaatggccgctcgccgtcgccacactctacggcatcctcacccgccgccgctgggctgccaccacctccctcatggccggcgttggcaccctcacctccatgtctgcaattcttggtgagatgttaggttcaggcaaatcaacaccaaagttgcttcagatgtatgttccttatgctgtttttgctgtcattgctattctacgtggactttgctcatgctctggacgcactactgctggttcatcacttgggccttctgcccggaagaagagggtctagatcagcagtgacacttggagaattttcggtttgagacagtggcgccagagcactaatgctggtcagaagacgattatctggatcaggtttctatccctggtatttagcacggatgttgaaaaatccagatagtgttagtggctgtttctctaggatttggtgttcgttttccctgaaatgtgatattcatcttgcctttatttccattttaccctttgattatatgtcttgctaactaagacattgttttgtttactggatgagctgattcaactctggcattgttctggcgaataagtttcataaatccttgtcttggtagtcccattgcagaaaatctaggtttttcggagtggcatatatttttttagataacggatctttattttgagatga

SEQ ID NO: 9432 - DNA, 801 bp, Zea mays
caaaaactcaactggtaatttgcctatcttgaaccaaaccagtgtgctccattccgctgggttcctgggttccgaaaattggtgatctgaacagtcgtccattggctatgttgcgacctaatgcatcacttagctctgcccttaacatgttggttcaagctggagtaagctcaataccaattgtggatgacaacgactccctgcttgacacttactctagaagtgacatcacagccctagcaaaagacaaggtctacacacatgttcggctggatgagatgaccattcaccaggctttgcagcttggacaagatgccaatacaccttttggattctttaacggccagagatgccagatgtgcctccggtctgatcctttgctgaaggtgatggagcgactggctaatcctggggtgcggcgggtgttcattgtggaagctgggagcaaacgtgtggagggcatcatatcactaagtgacattttcaagttcttgctgagcttgtgaggagagaggagcatggcggagttttttttaacagtagcaaccctctgggcctttgggtccttgcggataattggctatcgtcagggactcagggttcatggtctgtaaagttccttttttttttgtttcgttttttaccatttggccctcccgttgttaacaaaacatacatcaggtgatttttatctattggattgtttccttgcttggccctttgtcgctcgagaggatcggccgtcggagctctcaactcttacattgcatacactgatgttgccttccatttcccatgcaa

SEQ ID NO: 9433 - DNA, 2354 bp, Zea mays
ccggactcttcccttctcctgcctgcctccctccctccctccttctccatctccgctttccctcctcgcctaggcctagcctagccgcccccgcacgccacgccacattcgcatctctggatccccctcccttcgccctctcccattacccgccgccgccgcctcgcgcccgcgacccacccggcctcccacttcgatcccgccccgttcgctgcccccgccccgattccgattcgtcactgtatcgcgcgcgcgcgggtggtaagacagcgatggctcgtggcgggggcctctcgccccgccgcgggtgatctctcctctagcggggagccttcccgcgtgcccaagcggaggatcccgtcgcagctggtgcctcacctatccctctccttcgcatctccgccgtgctctctcgcgcaccccctcgaccctaggtttgctccttccctcccttcctcgccacccgattcgatctcgctccctccggcctccggctaggctgctccgtctctcctccgccatgttctcgcacggcgctgattccgcccacgacgccggggccgtcggcgtcagcagcggcggggctaccgtccccacccgcttcgtctggccctatggtgggaagagggtcttcgtctcaggctccttcaccaggtggtcggaacatttgccgatgtctcctatcgaaggctgccccactgtatttcaggctatttgcagtctgtctcctgggattcacgagtacaaattctttgtggacggggaatggcggcatgatgagcgtcaacctaccatatctggggagtttggcatagttaacacactttacttgacaagggaatataaccaaataaacaccttatcaagtccaagcacacctggaagcaggatgaacatggatgtggataatgaaaattttcaacgtacggttacgttgtcagatggtaccgtttcagaaggtactctgagagtttcagaggctgcaatacaaatatctaggtgtcgtgtttctgaatatctgagtttgcatacatgctatgatttactcccagattctggcaaggttattgccctagacattaatttacctgtgaagcaatcattccatattctccatgaacaggggattcctgtagctcctctctgggactcattcagaggtcaatttgttggtctccttagcccattggatttcatactcatattgcgggagctagaaactcatggctcgaacttgacagaagagcagcttgaaacacacactatatctgcatggaaagaggctaagcggcaaactaatggaagaaatgatggtcagtggcgaccgcaacagcatctagtgcatgccaccccttatgagtccttgagggacattgcagtaaagcttttgcaaaatggcatttctacagtgccagttatttattcatcatcatcagatggatcattcccgcagttattgcatcttgcatcactttctggaattttgaaatgtatttgtagatacttcaaaaactcaactggtaatttgcctattctgaaccaaccagtgtgctccattccgctgggttcctgggttccgaaaattggtgatctgaacagtcgtccattggctatgttgcgacctaatgcatcacttagctctgcccttaacatgttggttcaagctggagtaagctcaataccaattgtggatgacaacgactccctgcttgacacttactctagaagtgacatcacagccctagcaaaagacaaggtctacacacatgttcggctggatgagatgaccattcaccaggctttgcagcttggacaagatgccaatacaccttttggattctttaacggccagagatgccagatgtgcctccggtctgatcctttgctgaaggtgatggagcgactggctaatcctggggtgcggcgggtgttcattgtggaagctgggagcaaacgtgtggagggcatcatatcactaagtgacattttcaagttcttgctgagcttgtgaggagagaggagcatggcggagttttttttaacagtagcaaccctctgggcctttgggtccttgcggataattggctatcgtcagggttcatggtctgtaaagttccttttttttgtttcgttttttaccatttggcccctcccgttgttaacaaaacatacatcaggtgatttttatttattggattgtttccttgcttggccaaaaaaagctcgagaggatcggccgtcggagctctcaactcttgcttggccctgtgatgatagaccgcatggtgtagggtttccatacccttaggggcccgcttgtataacctcaattaatataatggcaaccttcattt

SEQ ID NO: 9434 - DNA, 2417 bp, Zea mays
tgggtacacctcgcgggccggccggggagtttctctccctttggcttcccccatctcctttcctcttccgtctcggcgtttccgtctccatctccgcctccgccttccctcctcgcctcgcctcgccacgccgcatttgcatttccggatcccctcctctcgcactccccattcccctccgccgccgtctcacgcgcccgcgacccacccggactcccgcttcgatctcgccccgattcccccgctcgcgcccccaacccgattcgtccctctcacgcgcgcgcgggtgggaagacagcgatggcttggggcgggggcctctctccccgccgcgggtgacctctcctcgcgcggggagccctcccgcgtgcccacgcggaggatcccgtcgcggctggtgcactaccacctcctctccattcgccactcccccgtgctctctcgcgcgtcccctcgaccatagatagggtttgctcccttccttcctcgccgcccgatttgatctcgtcccttccgggctccggctaggctgctccgtctctcctcctccgccatgttctcgcacggcgctgattccgcccacgacgccgggaccgttggcgtcagcagcggcgtcggggccaccgtccccgcccgcttcgtctggccctacggtgggaagagggtcttcgtctcaggctccttcaccaggtggtcggaacatttgccgatgtctcctgtcgaaggctgccccactgtatttcaggctatttgcagcctgtctccagggattcatgagtacaagttctatgtggacggggagtggcgtcatgatgagcgccaacctactatatctggggagttcggtatagttaacacactatacttgacaagggaatttaatcaaataaatgccttattaaatccaagcacacctggaagcaggatgaacatggatgtggataatgaaaattttcaacatacggttacattgtcggatggtaccattccagaaggtactgtgagagtttcagaggctgcaatacaaatctcaaggtgccgcgtttctgagtatctcaatttgcatacatgctatgatttactcccggattcgggcaaggttattgctctggacattaatttacctgtgaagcaatcttttcatattctgcatgaacaggggattcctgtagctcctctctgggactcattcagaggtcaatttgtcggccttctgagcccattggatttcatacttatattgcgggagctagaaactcatggctcgaacttgacagaagatcagcttgaaacacacactatatctgcatggaaagaggctaagcggcaaacttgtggaagaaatgatggtcagtggcgagcacatcagcatctagtgcatgccaccccttatgagtccttgagggacattgcagtaaagcttttgctaaatgacatttctacagtgccagttatttattcatcatcatcagatggatcattccctcagttattgcaccttgcatccctttctggaattttgaaatgtatttttaggtattttaaaaactcaactggtaatttgcctattctgaaccaaccggtgtgctccattccgctgggttcctgggttccgaaaatcggtgatccaaacagtcgtccattggctatgttgcgacctaatgcatcacttagctctgcccttaacatgttggttcaagctggagtgagctcaataccaattgtggatgaaaacgactccctgcttgacacttactctagaagtgacatcacagccctagctaaagacaaggtctacacacatgttcgcctggatgagatgaccattcatcaggctttacagcttggacaagatgccaatacgccttttggattttttaacggtcagagatgccagatgtgcctccggtctgatcctttgctgaaggtgatggagcgactggctaatccgggggtgcggcgggtgttcatagtagaagctgggagcaaacgtgtggagggtattatatcactgagtgatattttcaagttcttgctgagcttgtgataagagaagaggagcatgacggacatttgtttgtgatcaatagtaagaaaacagcagggtatgtgaagcaagctgccatggatctcgcatttcccctccccctccggcctttggtcaagtaaggcaggattgaaggtggcgggctttgtctttgctgataatggctgttggaattcatggtctgtaaagttctttttttcccctttgtttttcgttttaaccattttgtgcctcccgttgttaccaaaaatatctggtgattattattattatttttggattgtttcccccctaaaaaaaaaaaaaaaaaaaagaaaacgagggggggcggccacccgggaattaattccggaccggtacctgcaggcgt

SEQ ID NO: 9435 - DNA, 1251 bp, Zea mays
gcacgagaccattacctagaacatcctaatcgaaaaatcatcatcgactccacctggaactcgctcactggcaatggctaccattaccaagctcgtggcccttggcttggccgtcctcgtgagcgttgggttctccgatgcagcgagggtagttaggcttgggagctatgcgtctgccggaggaggcggcggcggtggaggcggcggctccggatcgaccggggctgctgggtacggcggtgggtctggcggtggcggtggctacggcataggcaagggtggcggggactggtggaacaatttcgtctccagcgtagcgggcggtggtggtgggggacagggcggagggggtggcaccaacggtggatccgggtccggcggtgggtcgggctatggttctggcaccagttccaccgcagcctctggccccagcagtggcaactacgccaacgctgagggcaagggcgccggtgggggcatgggcggcggtgccgatggcgcctacggttctggtgccggtggaggcgttggcaagggccagggcgagagtggcgtcgcattggcaccgtcgtccgatggctactacaatggcggcgccgctgatgctaccggtggtggttccggcgctggcggtggacatggcggtggcgcagccggagctccaagctacgggactggaggtggccttggcggaggcaagggcgaggccggcagcgacgggtcctggggttcaggttacgcggcgggaatcggtgctggcactggcggcggcggtggcggcggatcgcaaggcggctctggtggtggcggtggctctgggtccggatccggcagcggtggaatccactgagtttccctgcggcatgcagctggacggagcgctcggcgttagtgtcagtccattttggagtcggttcgtgtacctgagttttccttgaggagatgctggttttcgctttctttgttgcaagaattattagtcaggaataatgggcttcgttcgtgattgtagttcgagtaggtaggtagtccagcatgcaactgacatgtaatggctacaggctactacgagtatatgcttgcatcgccatcttttgatgtgccccttgttgttactctcatcgatctttagaggtcgttgccaaaaaaaaaaaaaaaacaaaacacaaaatatactgggacgactcttgcagtctcttgctactgttgaatgtgactattgactagctatagtagtatttaaaaaaaaaa

SEQ ID NO: 9436 - DNA, 957 bp, Zea mays
gggtaccccctcgaggcccggccgggaagatcgggaatcggcaacacccctcggggccctcgccctacaccgcggttttctcagtcaagtcgcctccccctactgtaggccgctgctgctcctctcctcccatctcaccacacaccgcagccccagcaagatcgcgcggaggccatggcgaagcccaagccttcctccgccggcgccaagccgaccgcggctgcgccaccggttacagtgcactcggcgctggtcacctacacctccatgctcgcgctcctctccctctgcccgcccttcgtcatcctcctgtggtacacgatggtgcacgcggacggatcggtggtgcggacttacgagcacctcagggatcacggcgtgctcgaggggctcaaggccatctggcccatgcccaccctcgtcgcgtggaagatcatcttcggcttcgggctcttcgaggccgtcctacagctgctgctccctgggaagcgcttcgaagggcccatctcgcctgccgggaacgtgccggtctacaaggcaaatggcttacaagcatatgcagtgaccttgataacttaccttggtttgtggtggttcggtatatttaaccctgcaatagtgtatgatcacttgggggagatatactctgctcttgtttttggaagctttgtgttctgtatttttctctacataaagggccatgtatttccatcttcatctgactctggatcctctgggaatgtgataattgacttctactggggtatggagctgtaccctcggattggcaagtactttgatatcaaagtattcaccaactgtcgtttcggtatgatgtcctgggctgttcttgccgtaacctattgcataaagcagtatgaaatgaatggcagagttgctgattctatgcttggtgatactgcacttatgttgatctatatcactaagttcttttgg

SEQ ID NO: 9437 - DNA, 903 bp, Zea mays
ctcgaccccccccgccccgggttttcccagtcaagtcgcctccccctactgtaggccgctgctgctcctctcctcccatctcaccacacaccgcagccccagcaagatcgcgcggaggccatggcgaagcccaagccttcctccgccggcgccaagccgaccgcggctgccactgcgcctgcgccgccggttacagtgcactcggcgctggtcacctacacctccatgctcgcgctcctctccctctgcccgcccttcgtcatcctcctgtggtacacgatggtgcacgcggacggatcggtggtgcggacttacgagcacctcagggatcacggcgtactcgaggggctaaaggccatctggcccatgcccaccctcgtcgcgtggaagatcatcttcggcttcgggctcttcgaggccgtcctacagctgctgctccctgggaagcgcttcgaagggcccatctcgcctgccgggaacgtgccggtctacaaggcaaatggcttacaagcatatgcagtgaccttgataacttaccttggtttgtggtggttcggtatatttaaccctgcaatagtgtatgatcacttgggggagatatactctgctcttgtttttggaagctttgtattctgtatttttctctacataaagggccatgtatttccatcttcatctgactctggatcctctgggaatgtgataattgacttctactggggtatggagctgtaccctcggattggcaagtactttgatatcaaagtcttcaccaactgtcgtttcggtatgatgtcctgggctgttcttgccgtaacctattgcataaagcagtatgaaatgaatggcagagttgctgattctatgcttgtgcatactgcacttatggtgatctatatcact

SEQ ID NO: 9438 - DNA, 1887 bp, Zea mays
gcacgagaccattacctagaacatcctaatcgaaaactactgtagccgctgctgctcctctcctcccatctcaccacacaccgcagccccagcaagatcgcgcggaggccatggcgaagcccaagccttcctccgccggcgccaagccgaccgcggctgcgccaccggttacagtgcactcggcgctggtcacctacacctccatgctcgcgctcctctccctctgcccgcccttcgtcatcctcctgtggtacacgatggtgcacgcggacggatcggtggtgcggacttacgagcacctcagggatcacggcgtgctcgaggggctaaaggccatctggcccatgcccaccctcgtcgcgtggaagatcatcttcggcttcgggctcttcgaggccgtcctacagctgctgctccctgggaagcgcttcgaagggcccatctcgcctgccgggaacgtgccggtctacaaggcaaatggcttacaagcatatgcagtgaccttgataacttaccttggtttgtggtggttcggtatatttaaccctgcaatagtgtatgatcacttgggggagatatactctgctcttgtttttggaagctttgtattctgtatttttctctacataaagggccatgtatttccatcttcatctgactctggatcctctgggaatgtgataattgacttctactggggtatggagctgtaccctcggattggcaagtactttgatatcaaagtcttcaccaactgtcgtttcggtatgatgtcctgggctgttcttgccgtaacctattgcataaagcagtatgaaatgaatggcagagttgctgattctatgcttgtgaatactgcacttatgttgatctatatcactaagttcttttggtgggaatctggatattggtgtactatggacattgctcatgatagagctggtttctatatctgctggggatgcttggtatgggttccatccatatatacttcccctggaatgtaccttgtaaaccaccctttgaatttgggcccccagctagcactctcaattcttctagctggaatgttgtgcatatacataaactatgattgtgaccgtcagcgccaagaatttcgacggacgaatgggaaatgctcggtctggggcaaggctccatctaagattgttgcctcttatcagactacaaagggagaaactaaaaccagtcttctcttgacttctggatggtggggcttgtcacgtcacttccactatgtcccagagatactatctgcatttttctggactgttccagctcttttcaatcacttcctaccatacttctacgtgatctttctgactatattattgtttgaccgagcaaagagggatgatgaccggtgctcatcaaagtacgggaagtactggaagatttactgcaacaaagtaccatacagagtcattcctggcatttactgagcatctcgagttctggacgactcttgatattaagctcaacagatgccacgatatccagtcttcataccgatttgctactgattgtgtaatgtcgctggtaggcttgggctgtacgcagtattaggtgtaggcaacttggcttttggcatttaccttgtatgtgtcgtgtatctagggctggggcttgctccttcagttgttagacagtagggggtaatctcaggggtgcaatgtactccctccgtcctaaaataaaagcatatctagtatttaaattttgttccaaataaaaatgcacaatgaactatcatatcgtgtaacgatgtctttgattgtgggacaaactagctggagatgggatggtggatttgaaggatatgaaaggatcatgatgctgaagaggaagggtgaattgagcccccct

SEQ ID NO: 9439 - DNA, 630 bp, Zea mays
aacacgatgttggcagtctcatttttgtaataacctttacctactggccataaccttggccttctccagcctctctcagttgcgaacaacctgatggcgaagaagaaaggctcggccgccgccgccgccatggcggatgagacggacgtctcgagtcctcagggctccgcccccggcagcgagggaggtggggagaaggagggcgcctttcttcttggggagccaacctgggaggacgctggcggcgggcggtggcggtgcgcggagacggggcacgagctgccggagcgggagaaggaggcctacgcgcggtcccgcgcttgccgcctcgcgctcattgaccacgccgtcgcgcagaagaagccgccgctcaacgccttcaagccccaccccgagcacaaatcgaagctggtatgcaagattacaggggatacaattaacaagttggaggatcacatatggaagcacatcaacgggaagagatttcttaacaagctagaaagggtagaagaccggatggcttctggtgagatgcctgatggagaacctgtgatgtcaaatgaagtggcaaagaagagcaagtcaagcaagaaggacaagaagaaagctaatgttgccagcacttctttg

SEQ ID NO: 9440 - DNA, 877 bp, Zea mays
aagttgtgggctgactctcctaatttccttcccgtttttcttcctgtggtcgctcgttgagtgcggaaattccacgaacgtgagctcaacatggagccggcgacccctccggcacccgccgccggcgtcacggctaccgtcgacctctcctcagtcgcagccgacctcggtggggcgcacctcctgccctgcggcatcaggcagaacggcggcgcccccgtatccgactacttcaagcctagggccacaggtgtggaggtggagggggtgaagatggaagaggccttctttcgtgggaggaaactgcagggcactaccctagctctcccggatggctaccgaggttatgtattggagaagagtcgcggacagaattcagatgctgaagtcagcaattttacatcccgagctgaattccagagcataacctactggaatcacgatacagcgccatcagcagaggattccctcccgaggtgcttccattggctaaccgtcgctaatgcgatgcatagagcagtgactgctgaagacctgactaacatggcagcaatgcagaatcaggacaagtagattcgttctataacgaagccatgcaatttcgatttggtgaaccatctcgacaaaggatcttgtaacaaccaacatgttatttgaacgcatccagtaggtaatgtttaggctttggggtaagatgcttcaggagatccttgttcagtagcatctgaaaatgtctgggtaatttagattgggacctgtatcagactatcagttatctccaatattgtgaaagagtgccggtgttgcctttgtgttaaaaaaaaaaaaaaaaaaaaaaatttctggtcttggtgagaaaaaaaactcgagggggggc

SEQ ID NO: 9441 - DNA, 1866 bp, Zea mays
cctccgaagaaaactgttgccattcccgaagcaaaaactgaaatttctgatactaaggctccagagcaagaaactgaagctgaagctgggccttcagagcccacgaaggtaaaattcttggaaactgaggaggaaaaaataacagagccaactgaagaaatcagtgctattgcccccgaagcatcccccaaagtccttgattatattgttcgtcatgcttcggggaaaaaattatcagaaaaagaaaagcaagaggcccagcgctacgcccaaaaactgaagtatccaaagggggcgttaatattcaatggcagtggagaagaagactttttgtattgtctccctgacagcaaggagatttctgtctgtcgggagatgagcaagagcttcggattcccaacactagaagacgggctctcggtgctgtcgaagaacgatctggccgacagcctggcatataatagcttaaaggtgcaacaaatgggatctttgtattttttgttgagaccaaaatttttcgtttgcttaaatctaatgacgtacacatatttttctttgcagggcctgatacttagcaatgccctcagggcccaaaaagatgctgaagaggaagggtgtgctatagccctgagcaaccttcgttccgaagtaattgaactgaggaacgaaggtctcgaaaaagataaaatattacattcattaataaatagaataaaggaagacgaagctacttttaaaggtcaagctgaagctcagaagcgcgaaattgaagatcttcgaaaacaactggccagagcccaagaggaacgcatgcttgaagaaacgaagcgagaacttagcgaccaatgggcaaatcatttagagagaactgttgaagagctttgttcatccaagaaaagatgttataacaaatctatagagtgtgtcaagaagttgaaagctagcttcgccagtgtcggcgcattctcgagcgaagaaaactttacaagaggcaaccccgaaggccctatcgaatggatcgatcacgaagctgaggccttcgaggaaattttaaatagccgcggagacatatgtgctttctcaggtgccaggggaattgccaccattttggagaaaaagggctgcgagcatgtaaagattttagcgcaatccgaagctgccttgtccttcgaagatgcaagagatccttcggccgaagctagtatggttggtggaaaatttttcaccgatgtctgggataatggtggccgagaaatggcccgagaaattattcgaaaaagcgaaaagggcattcacgacgctagagaagtagctgaggctgctgaaaaaagcgcagagcctgaagggcaaataggtattaactaatggtttttattgtgttgtagttttcgattttaaactttgttcgcaatttgtaatagcaatgtagccatatcctgccctccttcagatcctactaaagcgtctccgggccctcacccgaaaggagacgacgaaattaaaaagatggctgaaactatcatggatgaagttgttaatcggctcctgaacgaggctgcagaggttgttttgagagaagattaagcactcgtgtaaaaacttctgaactgtaatatgtgtaacattttgtaaccctgaatgtaatatacctgtttttactgctcaattctttacgatgcatgaaattttacacacgtaccgtttttgagtctttgacgaaaaaacacccttcccttctttcatgcttcgtgaaagagaatttttatttgtcaccacgatatccatagtgtactgatgaaatatatccagcttcgtgaaatattttccgagctgcacttcgaaagatcatagtgtatttccttgtaa

SEQ ID NO: 9442 - DNA, 2013 bp, Zea mays
gagatttctgtctgccgggagatgagcaagaagcttcggattcccaactttagaagacgggctctcggtgctgtcgaagaacgatctggccgacagcctggcctataatagcttaaaggtgcgacaaatgggatccttgtattttttgttgagaccaaaatttttcgtttgtttaaatttattgacacacacacatatttcgctttgcagggtctgatacttagcaatgccctcagggcacagaaagatgctgaagacgaagggtgtgctatagccctgagcaaccttcgttccgaagtaattgaactgaggaacgaaggcctcgaaaaagataaaatattacactcattgataaataaaataaaggaagacgaagcttcttttaagggtcaagctgaagctcagaagcgcgaaattgaagatcttcagaaacaactggccagagccaaggaagaacgcatacttgaagaaacaaggcgagaactcagcgaccaatgggcagatcacttagaagtaactgttgaagagcttcgttcgtccaagaagagatgctataacaaatctatagagtgtgttaagaagttaaaagctagcttcgccagggtcggcgccttctcaagcgaagaaaactttacgagaggcaatcccgaaggtcccatcgaatggatcgaccacgaagctgaggccttcgaagaaattttaaatagtcgtggagatatatgtgctttctctggtgccagaggaattgccaccattttagagaagaagggctgcggacatgtaaaaattttagcacaatccgaagctgctttgtcctttgaagatgcaagagatccttcggccgaagctagcacgatcggtggaaaatttttcaccgatatctgggataatggtggccgagaaatggccggagaaattattcaaaaaagtgaaaagggcattcacgatgctagagaagtggctgaggctgctgaaaagagcgcagaacccgaaggtcaattaggtattaattaatagtttgtattgtgttgtaatttttggttttaagcttcgtttgccatttgtaatagcaacggagccgtatcctgtcctacttcagatcctgccaaagcgtctccgggccctcaaccgaaaggagacgacgaaattaaaaagatggctgaagccattatggacgaagtcgtcaatcggctcctgaatgaggctgcagaagttggttctgagagaagattaaatactattgtaaattaaacttctgaaatgtaatatgtgtgacatcttgtagccctgaatgtaatatacctgcttttatcatttaattctttacgatgcatgaaaattttacatacgtaccgtttttgagtctttgacgaaaaaaacaccttcccttcttttcatgcttcgtgaagaataatttccatttgtcaccacaatattcgtggtgctctgatgaataatatccaagcttcgtgaaaatgttctccgaagctacttagcatgattttcccctttcaaaacattcttccgaagatcgatgtcatgtccccttcttgtgccatatgcagcatgatgtatgatgcttatgctatgcaaaatgatgcgatgatgttatgctgtgtaagatgttgtttattccgaagatacacacattcctgcgacaaaacacataatcttttgaatcagcattgtcttttttctataagcctcccttaggagcttcttcgccttttacttcagcggaatcagcgtttatttttcgctgtaagcctcccttaggagcttcttcgccttttactttcagcggtattcgcgttgacttttctcgcttcgccttttacttaggcggtatcagcgttgacttttcgctgtatgctctgcattccctttggaacgactttggagcagaaaacttacactgcgctccctttggaacgacttttttgtgactttcggcaacttactctgcgttccttagaacgactttttggtgcttcgaagaattttcgatagttc

SEQ ID NO: 9443 - DNA, 2060 bp, Zea mays
tgcaaaagaagaagctgaaactgctcctagcgagccagaaccgaaaagaaagaagataaaggtcctcacacatcggccgcgttatattgaaccagcttcggtgcctgagtttaccgggaaaacttcttcggccaccgaggctaaaaggccaaccaaaccaaccttgctgccagtagttgcagaaatggccgaaacgccaaaaaggatagaattggaagaaccgaagattttgctaccagaaaccgaaaaaatggccgaagcgccgtccacagaaaaaatggaagaagtgaaaaaaccatctgaagaaaaagcaccagaagttgtgagccctgcaccaaatgttgagacagtaaaaatcaaaaagtgccagcagtgactccgaaaagaaagagaatggctaatgtgctagatgtactggaaacaatcaaatcttcaagcacacctccgaagaaggctgctgccactcctgaaagcaacaactgaaatttctgatactaaagctccagagcaagaaactgaagccgaagctggggccccagagcccgcgaagataaaatccttggaaactgaggaagaaaaaataacaaagccaacttttgctgaagaaatcggcgtcgttgcccccgaagcatcctccaaagttcgtgattatattgttcgtcatgcttcggggaaaaaactatcagaaaaagaagagcaagaggcccggcgctacgcccaaaaactgaagtatccaaagggggcgttaatattcaatggtagtggagaagaagactttttgtattgtctccctgacagcaaggagatttctgtctgccgggagatgagcaagagcttcggattcccaactttagaagacgggctctcggtgctgtcgaagaacgatctggccgacagcctggcctataatagcttaaaggtgcgacaaatgggatccttgtattttttgttgagaccaaaatttttcgtttgtttaaatctattgacacacacatatttctctttgcagggcctgatacttagcaatgccctcagggcacagaaggatgctgaagacgaagggtgtgctatagccctgagcaaccttcgttccgaagtaattgaactgaggaacgaaggcctcgaaaaagataaaatattacactcattgataaataaaataaaggaagacgaagctgtttttaaaggtcaagctgaagctcagaagcgcgaaattgaagatcttcggaaacaactggccagagccaaggaagaacgcatacttgaagaaacaaggcgagaactcagcgaccaatgggcagatcacttagaaggaactgttgaagagcttcgttcgtccaagaagagatgctataacaaatctatagagtgtgttaagaagttaaaagctagcttcgccaaagtcggcgcattctcaagcgaagagaacttcacaagaggcaatcccgaaggtcccatcgagtggatcgaccacgaagctgaggccttcgaggaaattttaaatagccatggagatatatgtgctttctcgggtgccagagggattgccaccattttagagaaaaagggctgcgaacacgtaaagattctagcgcaatccgaagctgctttgtccttcgaagatgcaagggatccttcggccaaagctagcatggttggtggaaaatttttcaccgatatctgggataatggtggtcgagaaatggcccgagaaattattcgaaaaagtgaaaagggcatccacgacgctagagaagtagctgagactgctgagaagagcgcagagcccgaagggcaattaggtattaactaataatttttattgtgttgtaatttttggttttaagcttcgtttgccatttgtaatagcaatgtagccgtatcctgtcctacttcagatccagctaaagcgtctccgggccctcagccgaaaggagacgacgaaattaaaaagatggctgaagccattatggacgaagtcgtcattcggctcctgaatgaggctaccgacagcaactgtgagagaagattaagtatttattgtaacaacttctaaaatg

SEQ ID NO: 9444 - DNA, 1144 bp, Zea mays
ctgaagcctttgttgctgaagcttcgaagcaacaatttgaaactgaagctgggccttcagagccaaccaaggtaaaacctttggaaaccgaagaaacgaaagttgcaaaggcagccgaaaaaataaaaatgtcagagccaattttagttgaagaaattgacactgctgcccccgaagcaccttccaaaatatacgattatattgtgcgacacgcttcggggaagaaattatccgaagaagagatttttgaagctaatcactacgccagagaactgaaatatccgaagggggcactagtgttcaatgggacagacgaagatgacttcctatactgcctcccagacaacaaagaattatctgtctgccgggagatggctagaagcatggggtttccgaagcttgaagctggactctgcgctatgacgaaggacgatcttgcggatagccttgcatataatagtctgaaggtgtgagaattgtatatttggaaatttacaatttttgaatcattcttttattcttatagtaattcttttttcatatagggtttaatactgagcaacgctttgagagcgcaaaagaatgctgaagacgagagctataatattgctttcaacaacctacgagcagaggttatcaagctgaggaacgaagctttggaaaaagataaaattctgcttacactagtggataaaataaaggaagacgaagctacctctaaggctcaagctgaagcccaaaaacgcgaaattcaggatcttcagaaacaactggccagagctaaagaagaacgcatactagaagaaacaaaacgagaacttagtgatcaatgggcaaatcatttggaaataaatgttgaagagcttcgtgcttccaagaaaaggtactatgataaatccatagagtgtgttaagaagataaaatccagcttcgccagcgttggcgcattctctagcgaagaaaatttcacaagggggaatccagaaggcccgattgaatggatcagtcacgaagctgaggccttcgaggaaatcttgaatagccgcggagacatatgtgctttttcaggcgccagggggattgctactgttttggaaagaaaaggctgtaatcatgtgaaatctttagcaccaaccgaacccgc

SEQ ID NO: 9445 - DNA, 1916 bp, Zea mays
ctgagttaccgagaaacttcttcgccaccgaagctgaaaaaccagccgagccaccttgttgccagagtcgcagaaacgcgaaagtgcaacaaagatagaattggacatcaaagattttgttatcagaaacgaaagagaaggccgaagcgccgtccacagaaaaaatggaagaggtaaaagaagcaactgagggatccaaaacatcagaggttttgagtcctgcagcaaacattgagagagtaaaaaatcaaaaagtgccagcagtgactccgaaaagaaagagaatggctaatgtgctagatgtactgggaaacgatcaaatcttcaagcacacctccgaagagggttgctgtcatttctgaaacaacaactgaaatttctggttctaaagctcccgggcaagagactgaagccgaagctgggccctcagagcctgcaaagataaaatccttggaaagtgaggcagaaaaaataacaaagccaacttttgttgaagaaaccggtgtcattgcccccgaagcatcccccaaagttcgtgattatattgttcgtcatgcttcggggaaaaaactatcagaaaaagaagagcaagaggcccagcactacgcccaaaaactgaaatatccaaagggggcgttaatattcaatggcagtggagaagaagacttcttgtattgtctccccgacagcaaggaaatttctgtctgtcgggagatgagcaggagcttcggattcccaactttagaagacgggctctcggtgctgtcgaagaacgatctggccgacagcctagcttacaatagcttaaaggtgcgacaaatgaaatccttgtattttttgttgagtccaaaatttttcgtttgtttaaacctattgacgcacacatatttctctttgcagggcctgatacttagcaatgccctcagggcacagaaagatgctgaagacgaagggtgttctatagccctgagcaaccttcgttccgaagttattgaactgaggaacgaaggtctcgaaaaagataaaatattgcactcattgataaataaaataaaggaagacgaagctgcttttaaaggtcaagctgaagctcagaagcgggaaattgaagatcttcggaaacaactggccagagccaaggaagaacgcatacttgaagaaacaaagcgagaactcagcgaccaatgggccgatcacctagaaataactgttgaagagcttcgttcgtccagaaagagatgctataacaaatctatagagtgtgttaagaagttaaaagctagcttcgccagggttggcgccttctcaagcgaagaaaactttacgagaggcaatcccgaaggtcccatcgaatggatcgaccacgaagctgaggccttcgaagaaattttaaatagccgaggagatatatgtgccttctctggtgccagagggattgccaccatcttagagaagaagggctgcgaacatgtaaaaattttagcacagtccgaagctgctttgtcctttgaagatgcaagagatccttcggccgaagctagtataattggtggaaaattttttaccgatatctgggataatggtggccgagaaatggccggagaaattattcgaagaagtgaaaagggcattcacgatgctagagaagtagctgaggctgctgaaaagagcgcagaggccgaaggtcaattaggtattaactaatagtttttattgtgttgtaatctttagcctttaagatttgtttgcgatttgtaatagcaatgtagccgtatcctgtcttacttcagatcctgctaaaacgtcttcgggccctcagccgaaaggagacgacgaaattaaaaagatggctgaagatattatggacgaagtcgtcaatcggctcctgaacgaggctgcagaagtcgttttgagag

SEQ ID NO: 9446 - DNA, 10670 bp, Zea mays
taaaaataaagattatagggacttacactgatcgatcctctttgaaaggaacatgcctagactagcacttctacttatgtatgaaggtggatctgactccattcttttgattcccctcctctaacctctcctctttaaagataaagcgaaaagctattatattaggaggcttgggtcaaagagctactacttgacaaaagcgctaccccaacaactacttattcggtctgctttcggtttaaagttctttagttagaactttttgggcacgcacaaagatcacgtgaactcaatggtgtgcgtagggtaactaaagaagcactaaaagaaggcaagagcatgcctcactcactgagcacaatgccctacctaccatctcgattctcaacgaattggatgctcaccacatatttagtatatgggtgtatgctcgcgaaacctacttcactcccacccacctctgattgcattagcctgctgattgatcccggcaaggaaggcaaaggataatttcaatattatttctttggatttactttttatgaaagcgatgattccatctaattttcattctcccttccttttttttcagacttagactagaagctagcgctttttggcatcacttaaataaaatatccgacatcatcttttggacaagatcctcttcgttcttcttccgggttaaagggcgaaagaaaaagggcaaaggaaaaggccacctcatcaatatcaggatactctgagggttgcaagttttgatgcacccgagccaaatctgacttttttgagtaaagccttatgatgttttcaattttattaagggaaggggcttctttgcaaagaaaagggatagcgctaggaatatcaatagcgtacggatagcattattccattccattgctattttccttcgtttcgtaaagtatcgtaaagtaaagtaaactcagggtttcccgtactcggatggttgcttctacgtcaattcatggaaagctgccaccatggggcgaaatcaaacacatacccttgcttttcattacgatctatattgattagaagttgcagtgaaggtggctgtaacggtcgcctctagtccgtactactgcttcatccctcgctcgcaaatatgaggtgggcagtctcgatagaacagttttctagctaggagaatgcgcagtagggcctatggattggtcttcgttcgtattgctctctcgtttctagtaaagtaaaagtaaaagtaagtagtattggaaactctagatcgtgcagaagctaagtggaccagacgacttcacaatctcgaacggtagcatccaaatacctgactgtctacttcgtccattgcaatatccgggtaaaagaaagagcaactccgagttgagactcgtgattcataaccgagaaatactacttgaaaacgtgaaccagttggttaggcacacatgaaaaaggttccgtgggtttatgcggatagggtgtaagcgaggcccagaggaggctagtaataagtattttactatgcccggctccggactagttcgttgaatagacctatggttctaaggaatgtgttttctggtctgggtaagttttctgtcttcgtataacctttaaaggacaggttcttaggtttagcattctttcttgccttggctctaacctttagggttctcttttctgtcttcataggtttcccttgcttgagaggtagtattcattaccttggtggaagccgtttcttggtaagggttctctctttactgataggcttttctttcctatttctttattccaccctgacacacccattattggcttccttccctggagaccgctcgggcgaaggcagagcatggaatgcaataaagattcacgctttctgacacagaagccggttagggacataggttatggatagtcttttccaatgcgaaaaaataaaacgacatcgtgtctatttttcttggctaaaggaaaggggtatcgagatgtgctagtctagtatactgaatcatccttctgtttcttacagccgaagattgggaatcaggatctctttccgtggttctgacggtttatgtttccattcctgcttcttcctgttatttgatatggtttgatacggtttccgggtctatggtttccagttacaagacaagcaagcaaggttaaggtttctctttatgtaggcgtatactagaacctgaaaagaaaagagaagagaatagtttcttacttcctttgattggcaatccagatatcttagcttgtttctaacggttcattcatacctttttcttgttgcatttgattccattccttggttcaaatccggatctctagccttggtactagtaagggtaatggttcttcctgtttgggtttttgagaagtttgttaggtatcctggtaacctatatgtgttcgaagaattcctttgtatactattccgttgtaaatacacgatctttactacgtacgttgtccattggttgacatctttcctcggctcggatagccaagctcagctcacaccagcgagctaaagaaaggacaagattcctgcttctgcctcacttcccccataagttcgggtatctctttgactagggttttaattaaactcgagtggaggcttttcaacccgcttggtggggctccccttaggaaacccaaagctcttctccttaccagatgttggaagaaccaaaaatttatcttatcctctttcgggtcagcctgtaaggcgtagaataagtagagcctgatgcgctcccttacccttagtaatcgaagcgccgttggtcagattgaattccagcccttctttctgtaaccgacccagagctactgtgagccggtttccccaacgtcgaaggggaattccaatgttcaattgccccttttcttcgttcaaagcaacaagtagacccagcacttggagcaggagtctgcttagtggcgctcctcccccgtccctggacgtaaattccagtctgaacccactaaaggtatgaaccagggtttctctgagcagtttcaccacctctaagatctccccgaatcctaaccccaccagtggcaccccagtcagaaactgataacacgcatggcacgccgagaacccctctgataagactgcaatccctaatagcgaagatacgccataccttggaaagaaggcaccgcgtaatactaaaataaaaaggcagccacaaagttccatgcataacagtcttaaatgccaagctttaatctcatctttgacactccagagaaatcacagtcggacggtgcaagcaaagatgcgggcgcagatggtgatgatcaagtccaattcattgggtctcgacgtgcatcacccaccactgtaacaagcctagaggagggggtttcactttgctgacgggagggctagttatgttctcaccgagccaccttacccggtagtattcaaacggagaacaggagaatagagccacaagatgagcattttcgttgatctggatgccagaggacacaatcaagggtaattaaacaatgtgcttatgaagcgaggaatgaggttagctgtgaggtctctcagtacctagattcgtgggtggagccgacctttttttttttttttttttttttttttttgcgcgaggaagcggaaaagacaaaaccctctcttggagaaagccagtccggttggtaattccactataacttgataactttatggaataaatacctccctgtggagcccctgttgatggattctggcaagcaaaaagaagacctaaacccgactctaaaagcttcagttgcctccctctctccgccaatggctaggttagctatctctctctctcgctacgcccctgacccttataagaaatgacacatgccatcccgatttgaaacatataagagtcgtggcattctccgcattaccttgccctatcttcacgcactcaaggatgaatctgtgagagtatactttatacccaaaatctggaatctaatctttaatgacgtgaatatgtgctagtataccttttatctggaatctattctttcatgacgtgaatatgtttggtgttagtggactgacagagtgagcagtaaaggtagaaaaaaaaagatccatctgcgagtggttcggctttttccttaagcaaggacggagccgtcgagtgaggattggctgagcgtgctttcgctgctcgtggtggagtacctgcccgggcgttcgctctattattgcctcaggatgtgatcgggattaagccgcgtgtcgatacccgggggccttatcaagggattcattcttttttgcactaatggagggctctcttatgttctacacaaatgagtaacgtataacgtgtagaatctacgttactcacttgctcgcattcattatctctttctagcgcgaaagctaaagcgcatccgttttcttactctgaacaggcaggatttcttgatagctatcaagccgttgcggcgcatcctcttgctgggtgccgggcaaattatctatgttacagtctattaaaaaaaggacttctaataagaaattcttccgctaaagaataggctcgcctataaatagaagcttcggcgcactctccattttgcgggacaagtgccgagtcaaagcgatggatatcgcagcaagactcgccataatacctcaggaacagcaggctctagaaaacgataagcttgcattactgcaaagaaagtttagatttccttcaggaccccctgtttctctattccgtcgatccacaactttggatgcccaatgcacaactttggatacacaatcatacacaggatgttcggaggcaaatccgcattcttgaaatgcggaagagggcgctgctggaagaacagcaatcgctcatcgtgaaggctgccctccgcggtgaccgtagatcctgaaaaatagaaaaaagtagttactcgtctatctcaacgtaaatgaacgaagtcacttaagtcttcctactactgctccttcttacttattttcgttttttcaggatctaaagaagaagaggttttcttagcgggcgtgaatccggtagcttctacttctgttctgttgtagcgtgcgcgcggacctggtacttcctgatcaagagtgtagtgagcataagtattgtattgttcagtattttcttttcaggtgtggtgtgtagagatattgcctttatgaataatacttatgtattgcctcttcttcttgtttatgaataatacttatgtattgcctcttcttcttgttgtagaagaatactgatgtattgcaaagacctgttgttgttttatttctttatttcttccttttctcgaatagtagttgttagctttgtctctagcatgttggtttgcttctagcatttagtagaataagttgcattagcaagttcatcatttaatagaagatcaagaaaatgaaagatcaatgagatacctgtccggatagttgggagagtgagctctgcccttaagacaatcagagactgagtgatgccgcggagaatagagatatgtcagttgggtagagaaggattcagaggtatagtaaagtagccaagcaagctatcgtgagcaggaatcaatcctgaaagagagatgagagtaagcatcccgcagtccaccgtgcttggaactgagtcccgccgaaagaggttattctttttggcttgaactgctttgaactaccggttttatttctattcacgagagtacttcgcctgtgctgcttcccgtaagcgaaagtcactctcgcttaacgatatgagttctttcttttctgtagtcaacacaagagtagtaggctttctttcttttcatagtagaggagaggaaagtaggtaacttaggtctggtatatacgcatcctgctaagcaagcaggtaaggaggtaaagtagcttataatatctctctatgagttctttcttcttctatatctgttgttgaagcgacgctagtcgtttttgctgccggactaagatctactatcgtatgttttgagtttggaaatgcaacgtcaagaaagatggtactagtctgagctacctgctatagggtttgaaaaacggataggtatcaaagtggaactatgagatagatgactgtctttagtaatgtctatgcttaggaactagggaagcatattggagtttaaactgagatagggctggacagtggggataaattcgaatatgaagaaatggcaatagaggtataaaaaaccacctatatatgagaagagtagtagggcaaggagtatagagatgagtttcttatgaaggaattttaagtgagaaaataaaatctatttttctacgttgaattgctattgtaaggtcttgcttcttttgtcttgtattgtagtaaattcactcatttaagttaagtcaattccccggcaggtaagagtaggaaaagaagaaagtattccctaagttggagaatctagtaatgaactgatcgactatgccaaaattacccactatatatttacaagcaagccaggtcgcccaggaaagagctctaaggaaggaatactccgctcggattcagaaagaaaagaccattatgaaagtcaaaaagagtatattctataaaatctattagaaaatgcaaggtactattctttcagtcagtatggggcctcgaaactccaatctttctcacgaagtttatatgtaaaactagtagttggaaatgaggctaacacactccgctaagtagtgagtgctcttctgtgaaaatgcaccagagtcaaactctgcccgtgctgctaataaatactcgttcgtgtggaggtaattccctaaccaaccgaggccctaacccaccaataaaaggaaattgataagtccaatgaacccggtctatatatattattaaatgggcggttcttaggtcaagcttatttgagatgagacccgaaccaataccaccccgatactgatatcacgatacgtattttctgaacaggcactagggaggtcttgccaaaacgctttccaaccaactagtcgataccagggtgttaacctctgctcttgttgattgccatttatccttatcctatcatccttccgtccattaagggcatcacgaactccattctttctgttcttgaggtgccggttgccgtttctggttcaaggaaaggggaagtgttcagttgataaaaggggggtttcactcatcggcgtaattcccttgcattggtgtgtgagaattggtgcctaaggctagcttgatgcattatggaagatcgggttggggcgtacccccggtggagcatgtaggtagtgaacgaggatttccttccgttaagctatgactactgagcaagctgatcaagagttctttacggcgcagatgtgtgttaggtttcctaaaggttctcattgatagtggggcatctctaggagggaggcttatttctattctcaacaaatggatatccattctatctagccgagggaaacagccttcctgaaggtagcaagtttctttccttccggccaaggagaaagagcaaagtttccacctcatccgactcagagctctcagtgacttcccccatagcaacgggagattatcaccccataaccctaaaggaaaaggaaagagtagtcgttttaaaaatagtaagtaagatgccgggataagaactgtgtgatttcagccttagaaaatatctgtcaaatgggtcaaatgtagaattagatgtgtaagcaaagctctgattcagaaaggaaaggtatgtgggtagacattgagttagagattgaatgaaggggcacactagataaaaccaaggacaagtagctagttgactaacgctttcgagcacgtacgctggcgctctttgatagagcattatctacaaccctgaagcgaactattcaaaatcaatctagcagtctcttccagcaatgaattgtagcagggcttggtctcgaaaggtatagataccaccagaagcttggaaagaagaaggaatgtcgacctaccgcgtagtgggcttttcaccttgcttttctgtcaaattcacagacgctatagctgtgtaaaaacagtactcgatttctcactagaaaaaacaactgtctttattgttgtgtgcatattagtcactgattatagctttgaataggacaaactactttagtaactcttgactattgcttgaaacaagcgttgaagcaatggaaagaagcgaacgggtaagcgattgggttagaatgcagcaagtgtccaaaaataagatatgcccggtgaaaattataaacaaggctgaggaaggatttcgtactgccacaatgctcttgatagaaggaagcatgaataccgaaggcctacctagttgaaataggaacagctatagcaacagcactcttcctatgcagcatatcattctattgaagtattacactacatctggaacaaaataattaataaattatgcttgcatgtttgtttcatgacatctcctgacaagtaccaatttgaccaccttggtcatcgggtaattatcatcttatcacacaattactattttattgaataggaaatcaaatgaactgaggaatcatatcatctaaactgcaaatacaaactacaagtaggcagacaccatcacaattcaaccgcatttattttatatgagcattttacaataacagatcactcatacgttgagatatcaattaagctactggttctcttatattagcttgttttccagcatagtgtaacttgaattctgagacttatagccaatcatagcgatacacttatccacctagcaatttattaaggctttatcaagcaagtaatgaaagctatatacattggtttcacagcaggatgaaaatggaaaaccatgcaaggcaaataaaggtacggggcaagtccagcaagcaactagaaacgaactgaaatgaatgaaactaacgaaggaaacactacatacgctagagcatgcaaaatacatggagccatggagattgcgtctcacctcgatgaagttggagcagagccgtccgccgactccgcgaccgatagaattctgatccagccggtgtgtcttctcgaatgtgtagaaccgactttaaaacccgcgtcctcgctgaggagtgcctacgtactttcttcatagaagaaaaatcagggtaacgtagttctttttttattatattattcgtatttcgttcccatcgacccacaattagcttggcttgattcaattcatccaatttggctattgtaagatcctcaagtttcaacttagtggattttgcattttccatggtatgaaccctctcatttaagaattttttatagtagtcactatttagcccatatctttgcaaactgcgccggatcatatccaacgtattcggctgatactccttaccgctttgggggtttcggatggtatggtatcccagccatcttgccaaagtattgggccattaaccgggccatttaaacgctccagctcccgcaggatttggctcttcttataaaaaattgtttccgttaattccgttgcttcctttgggtccatggacccacgtaaaattgttaagttgttgtatattgagctttttgcacttagaatcataggctcaatatcttgatgaattggagctgcaggcggggccgctggaacctgaggaagggcgggctgtcccgaggttttgctccatggctccaaacagctcatcctgaggaacaccgggaagcgcagcgacatttagagcctcaatggccccctgctgaacttcctccccgggttccgccggtgccgcggcggcctccaaagcagaaccaaccccttggaaaaacgacgaggagggggtagaggccacagcagggttaagggagggcccgctacctgaagctgctggaaagccagaggagtgaactaaagagccccgacccatcatattctcatttaaagcatcactcatgaaagtcggattgcaagcaacccaatcctccacatacccggtcagcgagtaacaagaaggtggcacaattgagggtaggggggcctcttgtggggctggcgttggcgtcccctgaactacttgggctgcccccccttgtggctgcggtactgcaccttcgctataaatttgcaagtagttggccactacagggagaagttcagatcctaactccgcccaagaagaaacttctctggagtggattattattccagcggcggacttctccgtacaagaagataaatgggaacgaggtgttctgttctttgcagtgattcttttccgttcaagaatcacagttttcgtgatcgaattacgaaatagatatacgagccgcataggatcattcgcagggatggaataattgattcttttatctaatttccatgggatcgtagaatcaactaaggatgcaataggtatttgtgatcgatcagcttccagtatgaccgatgactttctatctggatgaagaataaccacacaatcaggttgtcggttcaacccaaaatagattttattgtttcttgaacggaatttcttaggattagcataagaattggtaaaaaaagccccgatcttccattgagaatcattgatacagctccacatttttgcc

SEQ ID NO: 9447 - DNA, 2976 bp, Zea mays
ctgagcaactttgtcgtagaggtgctgaaaatatttgaagtctatcttcaccaacttacccctgaagcaatcataaggctgaatatcttcgtgtgggccgtgagaagccaaggtctggaacctgatgcaaaaagtttctgcaacatacacgaattatcatacgagacaaaaccttggggtaaggaacagtatcacaataattttggctgctacagtttcgtttctcggtctgggtcaagctgtcccgtgccaacctttcggaagagatggcccggcgactggatgacagaatggttttatgtgaagaatgacctgaaaacacgggaaaatattaaaggtataatcatgcgccctatttggcaaagcttcggcctgcggaggccaaaggttgaaatgaatgaagctaccgaagaatgccagagagccttcggagttatttgttcttttattggaacgagagatttggtccaagagcatattgccttcagagtatggccgctcgcggaaaaatgggaaatgccgcaagagaccataaaggaggctgacgaaggtggacttatcaggctgaagtatactttcaagttcggagataaattcgttgagccagatgatgactggctaaaaagcattgaaaatttaagtgatgaactacttggggcttactcgaaggccgaagatactgcattgtcagcagccttcggaggccggaaaaagaaaagactgaaccgagtgtttgacgcaatcgggttcgtctaccctgactatcgttatcccattcgagggcagaaaagaaaaggcacgacctctgcgaaagaagaagctgcagctgctcctagtgagccagcaccgaaaagaaaaaggataaaggtcctcacacatcggccacgctatattgaaccagcctcggtgcctgagttcaccggagagacctcttcggccaccgaggctgaacagccaaccttgctgccagaaatcgcagaaatggccgaagcgccaacaagaacagaattggaagaaccaaagattttgttatcagaaaccaaagagatggccgaagcgccatcgacagaaaaaatggaagaagcaaaaggatcagccgagggatcaaaaatatcagaagttttaagtccttcagcaaatgttgagacaataaaaatccaaaaggggccagcggtaactccgaaaagaaaaagaatggccaatgtgctagatgttctggagacaattaagtcctcaagcacaactccgaagaagactgttgaaacttccgaagcgaaaactgaaatttttgatactaaggctccagagcaagaaactgaggctgaagctgggccctcagagcccacgaaggtaaaatccttggaaaccgaggaagaaaaaatgacgaagccaattcttgttgaagaaatcagtgctgttgcccccgaagcatcccccaaagtccttgattatattgttcgtcatgcttcggggaaaaaattatcagaaaaagaaaagcaagaggcccagctttacgcccaaaaactgaagtatccaaacggggcgttaatattcaacggcagtggagaagaagactttttgtattgtctccctgacagcaaggagatttctgtctgtcgggagatgagcaagagcttcggattcccaacactagaagacgggctctcggtgctgtcgaaaaacgaactggccgacagcctggcatacaatagcttaatggtgcaaaaaatgagatctttgtattttttcttgagaccaaaatttttcgtttgcttaaatctattgacgcacacacatttttctttgcagggccttatacttagcaatgccctcagggcccaaaaagatgccgaagacgaagggtgcgctatagccctgagcaaccttcgttccgaagtaattgaactgaggaacgaaggtctcggaaaagataaaatattacattcattgataaatagaataaaagaagacgaagctacttttaaaggtcaagctgaggctcagaagcgtgaaattgaagatcttcgaaaacaactggccagagccaaagaggaacacatacttgaagaaacgaagcgagaacttagcgaccaatgggcaaatcatttagagggaactgttgaagagcttcgttcatccaagaaaagatgttataacaaatctatagagtgtgccacgaagttgaaagctagcttcgccagcgtcggcgcgttctcgagcgaagagaactttacaagaggcaaccccgaaggtcccatcgaatggatcgctcacgaagctgaggccttcgaggaaattttaaatagccgcggagacatatgtgctttctcgggtgccagaggaattgccaccattttggagaaaaagggctgcgagcatgtaaagattttagcgcaatccgaagctgccttgtccttcgaagatgcaagagatccttcggccgaagctagcatggttggtggaaaatttttcaccgatgtctgggataatggtggccgagaaatggcccgagaaattatccagaccaagcgagaagggcattcacgacgctagagaagtagctaaggccgctgaaaaaagctcagagcccgaagggcaaataggtattaactaatggtttttattgtgttgtaatttttggttttaaacttcgttcgcaatttgtgatagcaatgtggccgtatcctgtcctccttcagatcctactaaagcgtctccggtccctcacccgaaaggagacgaggaaattaaaaagatggccgaagctatcatggatcaggttgtcgatcgactgctgaacgaagctgcagagatagtacttagggaagactaagtgctattgcaaaaaacatttgatatatgatttgtgtaatattctgtaatcctgtatgtaatatacttgttttatgattcaattctttacgatgcatgaaactttaaacacgtaccatttttgagtcttcgacgaaaaaacac

SEQ ID NO: 9448 - DNA, 3030 bp, Zea mays
taggctgaaattgggtctgttgataattttttcgtgctcacaaccagatttcaggaacgcagcagcggtgccccgagaagctaccagggcacaaaagtcgccgtgtccagcaataacatcatcgagatcatcaatctcaccttcgatgtgtcgaaagctcctggtagatcttcagccgaaggaataaaattttcactactggccccgactgaataaaacaccttcttcagtcgttgaacacattgattgctgaattttaaacatttgttctgaaggtctatcaatgattttttcaaaattaaaccattctggatttcagcctcaattttttcattaagcttcagcttttcttgttcgaaaccttctgactgatggagaagcttcgtattcagttctgttattttagcttcgacttctgctagtaaaccttcagttgtttggagttcgaactcttttttctcaaaagcagttgtttgatcttttattttgttttctaagttttcaattataacctcgtgctttttgtcttctaaatcctgttgcatcctcaaagctttgctcaataacatactttgtacacgaacaaccttcgttagaaatcgccttttatggaaataagaagttagagggtgattgtttaccttgaaattggaataaaacaaactaccgacgatgtgctgtcgtcggtagcggctaatatcggcttcgagcttcgggaaaccgatactctttgatagagtaccgataacctttgctccggtctgatctcggatgcagcctagcttctcatcatcaacacctccgaagagaagtgcccctggccgatagccgcaagaaatggcatactcttttaattcttctttttcggcttttgttaattcttgaccaaccaagttttgaaaattgaaaatttcatcctccagcgtttcttcggcaatttctttctttttctcggcctctggggccgaagcctcttcggtggcttcagcagcttcttctgcggccatgtctagcagaattttatctatattaagagccacactttccaaattgatatcttcggctctggtagcttcggcatctgtggcctccgaaggtgcagcttcagtagctgttgtgctttcaatagcaggcaccttcggagctgaagccctgggtggtgttgcttcaatcacttctgtcatagtaacaatcctttgcctctttggcctaggtgcctttgtttttgtgggctccttttccttatgaaaaagcttcgtcagatgaagccccaatggacttagtttgacaggcaaagtttcagtcattacctttaggatttcctctatttcagcagcagaagttgtcgcagaagtcttctcttcctcatcaattgatttttgctttggggtcgaggcctttcttttcttcgaagcaactgctttcgcctcagattcttgtttcttcttctttgattgatcttcgtcgtctttattcaaagcactagccactctttttcttttttgcccttcggcacccttgtccagtcgctcatagtcaggatattcaaagcctatagcatccatcactctgtttagccttcgtttcggacgggtgccgaaggccgctgtcatcaattgatcttcttttttagaataatttccaagaatttcgttgcacattacttcgattgtatccagccattcttggcagggtactttgaaatgtttcttgaacttgtagtggtaagacaaccgaacaagctcccctttcttcttttccccctctagtttcggcatttcccactccttcaaagtcggaaatactctgaaggccaaaaattcctgcaccaagtctctagtgccaatatgatctgcaattactcgaaattcagccaaggcaatctggctcgggctcccccgtatcatgttgcacgggggtcttgtttctccgaaggtcagttctaacggactctggaccaatttatcttcatcttcgtcaactctgacataaaaccattcagatttccaccctgctggccatttgcttcggtagctaatcactgggaactttgtagttttgcggtaagcgaagttgtagcagccaaaattttcatgcaaaccatcccccctagccttggtttggtagtgcagttcgtgtactcggcagaaaccttcggagaatggttccaccccctggcttcggagggcccagatataaacactcagcctaacgatagcgttaggcatcaactgatgaaggtagatcccatatttcttcaatacaccagcaatcatcttgttcagaggaaatcttaaaccaactttaaaaagacttttgaaaaccaccacttcattgtttctcggcttcgggatagtttcctctccaccgaaatgaatcaattccttctttgcttcactaagatagcccaacttcaccatcttaggaaaatcagcttcggatatggtggactttccgaagtccaggtggctaggtttgcttggcactgcgctactgtagtcatcttcggaatcagtttcttcaacagcagtccattctgtttcggcagcagggatgtcttcggcagcagggatgtcttcggctgcaggcatgtcctccggtgttaccaacccagagcgcttcattgcttccgaaataggaacagtgtcagcagcttcggtctcgtctccctcacgatcgacccgagcagtagagagaactctggccattttgattatgacttacttgaagtttttggtgttgacttttttgttttctccgaagcccttactcttgttccaaagcagaaacacaagcgaagtttcgtttgagcacgatgattaagcttcggctatgactaaaaatttggcagcaaaacagtgtgatagcaatgaatgatgtggtaacttcacacctacccgtctgtttatatagcgccgcaggtgggaaggtgaatcggcaagatccccagcaccgaacaagtagtcacccgcactcactgaatggtgggccacaaagtccgagaaggtgaatcgctggcgcgcgcgtaat

SEQ ID NO: 9449 - DNA, 2347 bp, Zea mays
gcacacctccgaaggagactgttgttatccccgaagaaaaaactgaagtctctgatactaaagctccagagcaagaaactgaagccgaagctgggtcctcagaacctacgaaaataaaatccctggaattcgaggaagaaaaaatttcagagccaacttttgttgaagaaatcagtgctgctgcacccgaagcatcccccaaagtccttgattatattattcgccatgcttcggggaaacaactatcagaaaaagaaaaacaagaggcccaactttacgccaaaaaactgaagtatccaaagggggcattaatattcaatggcagtggagaagaagactttttgtattgtctccctgacagcaaagagatttctgtctgtcgggagatgagcaagagcttcggattcccaacactggaagacgggctctcagtgctatcgaaaaatgatttggccgacagcctggcatataatagcttgaaggtgcaacaaatggaatctttgcattttttgttgagaccaaaatttttcgtttgtttaaacctattgacacacacatatttctctttgcagggcctgatacttagcaatgccctcagggcacagaaagatgctgaagacgaagggtgtactatagccctgagcaaccttcgttccgaagtaattgaactgaggaacgaaggtctcgagaaagataaaatattacactcattgataaataaaataaaggaagacgaagctgcttttaaaggtcaagctgaagctcataaacgcgaacttgaagatcttcggaaacaactggccagagccaaggaagaacgtatacttgaagaaacaaagcgagaactcagcgaccaatgggcagatcacctagaaggaactgttgaagagcttcggtcgtccaagaagagatgctataacaaatctatagaatgtgttaagaagctaaaggctagcttcgccaaggtcggcgcattctcaagtgaggaaaactttacgagaggcaatcccgaaggtcccatcgaatggatcgaccacgaagctgaagccttcgaagaaattttaaatagccgtggagatatatgtgccttctcgggtgccagaggaattgccaccattttagagaaaaaaggctgcgaacatgtaaagattctagcgcaatccgaaggtgctttttccttcgaagatgcaagggatccatcggccgaagctagcatggttggtggaaaatttttcaccgatatctgggataatggtggccgagaaatggcccgagagattattcaaagaagcgaaaagggcattcacgatgctagagaagtagctgaggctgctgagaagagcgcagagcccgaaggtcaattaggtattatctaatagtttttattgtgctgtaattttaggttttaagattcgtttgcaatttgtcatagcaatgtggccgtatcctgttctacttcagattctgctaaagccccttcggaccctcagccgaaaggagacgacgaaataaaaaagatggctgaagctattatggacgaagtcgtcaatcgactcctaaacgaggctgcagaagtcgtcttgagagaggattaagtattattgtaaaaacttctgaaatgtaatatattgtaacattttgtaaccctgaatgtaatatacctgtttttcttgcttaattctttacgatgcatgaaactttacacgtaccgcttttgagtctttgacgaaaaaacaccttcccttcttttcatgcttcgtgaagaagaatttttcaacaatatccagcgttctgatgaataatatccaggcttcgtgaaaatattttccgaagccacacctccgaagatcgataatgtatctccttgtgacattatgatttttccctttctttcaaaacgttcttctgtagattgatattgcgtccacctcttgtgtcatatgcaacatgatgtatgatgcttatgctatgcgaaatgatgcgatgatgttatgttatgtgatgcaatgcgtattccgaagatgcacacgcatccctgcaataaaacatacaattttttacaagcctcccttaggagcttcttcgccttttactttagcggaatcagcgtttatttttcgctgtaagcctcccttaggagcttcttcgccttttactttcagcggtattcgcgttgacttttcgcgcttcgccttttacttaggcggtatcagcgttgacttttcgctgtatgctctgcattccctttagaacgactttggagcagaaaacttacactgcgctccctctggagcggctttttgtgacttcggcaaacttactctacgttccttagaacgactttttg

SEQ ID NO: 9450 - DNA, 2853 bp, Zea mays
agtatcacaataattttggctgctacagtttcgtttctcggtctgggtccagctgtcccgtgccaacctttcggaagagatggcccggcgactggatgacagaatggttttacgtgaagaatgacctgaaagtacgggaagatatcaaaggtataattatgcgccctatttggcaaagcttcggcctgcggaggccgaaggttgaaatgaatgaagctgccgaagaatgccagagagccttcggtgttatttgttcttttattggaacgagagatttggtacaagagcatattgccttcagagtatggccgctcgcggaaaaatgggaaatgccgcaagaaaccataaaggaggctgacgaaggtggacttatcaggctgaagtatactttcaagttcggagataaattcgttgagccagatgatgactggctaaaaagcattgaaaatttaagtgatgaactgcttggggcttactcgaaggccgaagatactgcattgtcagcagccttcggaggccgaaaaaagaaaagactgaaccgggtgtttgacgcaatcgggttcgtctaccctgactatcgttatcccattcgagggcagaaaagaaaaagcacaacctctgcgaaagaagaagctgcaactgctcctagtgagccagcaccgaaaagaaaaaggataaaggtcctcacacatcggccacgctatattgaaccagcctcggtgcctgagttcgccggagagacctcttcggccaccgaagctgaaaagccaatcaagccaaccttgctgccagaagtcgcagaaatggccgaagcgccaacaaaaacagaattggaagaaccaaagattttgttatcagaaaccaaagagatggccgaagcgccatcgtcagaaaaaatggaagaagcaaaaggatcagctgaaggatcaaaaatatcagaagttttaagtccttcagcaaatgttgagacaacaaaaatccaaaaggggccagcggtgactccaaaaagaaagagaatggtcaatgtgttagatgttctggaaacaattaagtcttcaagcacaactccgaagaagactgttgcaacttccgaagcgaaaactgaaatttctgatactaaggctccagagcaagaaactgaagctgaagctgggccctcagagcccacgaaagtaaaatccttggaaaccgaggaagaaaaaataacggagccaattcttgttgaagaaatcagtgctgttgcccccgaagcatcccccaaagtccttgattatattgttcgtcatgcttcggggaaaaaattatcagaaaaagaaaagcaagaggcccagctttacgcccaaaaactgaagtatccaaagggggcgttaatattcaacggcagtggagaagaagactttttgtattgtctccctgacagcaaggagatttctgtctgtcgggagatgagcaagagcttcggattcccaacactagaagacgggctctcggtgctgtcgaaaaacgatctggccgacagcctggcatacaatagcttaaaggtgcaaaaaatgagatctttgtattttttcttgagaccaaaatttttcgtttgcttaaatctattgacgcacacacatttttctttgcagggccttatacttagcaatgccctcagggcccaaaaagatgccgaagacgaagggtgcgctatagccctgagcaaccttcgttccgaagtaattgaactgaggaacgaaggtctcgaaaaagataaaatattacattcattgataaatagaataaaagaagacgaagctacttttaaaggtcaagctgaggctcagaagcgtgaaattgaagatcttcgaaaacaactggccagagccaaagaggaacgcatacttgaagaaacgaagcgagaacttagcgaccaatgggcaaatcatttagagggaactgttgaagagcttcgttcgtccaagaaaagatgctataacaaatctatggagtgtgtcaagaagttgaaagctagcttcgccagcgtcggcgcattctcgagcgaagaaaactttacaagaggcaaccccgaaggtcccatcgaatggattaatcacgaagctgaggccttcgaggaaattttaaatagccgcggagacatatgtgctttctcgggtgccagggggattgccaccattttggagaaaaagggctgcgagcatgtaaagattttagcgcaatccgaagctgccttgtccttcgaagatgcaagagatccttcagccgaagctagcatggttggtggaaaatttttcaccgatgtctgggataatggtggccgagaaatggcccgagaaattatccagaaaagcgagaagggcattcacgatgctagagaagtagctgaggctgctgagaaaagcgcagagcccgaagggcaaataggtattaactaatggtttttattgtgttgtaatttttggttttaaacttcgttcgcaatttgtaatagcaatgtagccgtatcctgtcctccttcagatcctactaaagcgtctccgggccctcacccgaaaggagatgacgaaattaaaaagatggctgaagccatcatggatgaagttgtcaatcggctcctgaacgaggctgcagaagttgttctgagagaagattaagtactattgtaaaaacttctgaaatgtaatatgtgtgacatcttgtagccctgaatgtaatatacctgcttttattgtttaattctttacgatgcatgaaattttacatacgtaccgtttttgagtctttgacgaaaaaacaccttcccttcttttcatgcttcgtgaagaagaattttcatttgtcacaacaatatcc

SEQ ID NO: 9451 - DNA, 2426 bp, Zea mays
gtttggagaaaattcgttgagccagatgatgactggttaaaaagcattgaaaatttaagcgatgaactgcttggggcttattcgaaggccgaagatactgcactgtcagcagccttcggaggccgaaaaaagaagaggctgaatcgggtgtttgatgcaatcgggttcgtctaccctgactatcgttatcccattcgagggcaaaaaagaaaaaacacaacctttgcgaaagaagaagctgcaactgctcctagcgagccagaaccgaaaagaaagaggataaaggtcctcacacatcggccgcgctatattgaaccagcttcggtgcctgagtttaccggggaaacctcttcggccatcgaagctgaaaaaccaaccgagccaaccttgctgccagaagtcgcagaaacggccgaagcgccaacgaggatagaattggaagaaccgaagattttgttaccagaaacgaaagagaaggccgaagcgccgtccacagaaaaaatggaagaagtgaaagaagcaactgagggatcaaaaacatcaaaagttttgagtcctgcagcaaatattgaatcaataaaaaaccaaaagggcccagcggtgaccccaaaaaggaaaagaatggtcactgtgctagatgttctggagacgattgagtcttcgaacacaactccgaagaaaactgctgaaacatccgtaacagaaactaaagtcttcgacgccgaagccccaaggcaacaggctgagaccgaaactgggccttcaaagcccacgaaagaagaaaaaatgtcagagccaattcctgttgaagaaatcagtgctgttgcccccgaagcatcccctgcggtccctgaatatattgttcgacatgcttcgggaaaaaagttgtctgaaaaagaaaaacaagaggcccagttttatgcccagaaactaaaatatcaaaagggggcgttgatattcaacggcagcggagaagaagacttcttgtactgtctcccggacagcaaggagatttctgtctgccgggagatgagcaagagcttcggattcccaactctagaagacgggctctcggtgctgtcgaaagacgagctggccgacagcttggcgtacaatagcttaaaggtgcaaaatttgaggccttcgtattttttcttgagaccaaaatttttcgtttgcttaaatttattgacgcacacacatttttctttgcagggccttatacttagcaatgccctcagggcccaaaaagatgccgaagacgaagggtgtgttatggccctgagcaaccttcgttccgaagtaattgaactaaggaacgaaggtctcgaaaaagataaaatattgcattcattgataaatagaataaaagaagacgaagctacttttaaaggtcaagctgaggctcagaagcgtgaaattgaagatcttcgaaaacaactagccagagctaaagaggaacgcatacttgaagaaacgaggcgagaacttagcgaccaatgggcaaatcatttagaaggaactgttgaagagcttcgttcgtccaagaaaagatgctacgacaaatctatggagtgtgttaagaaaatgaaagctagcttcgccagcgttggcgcattttcgagcgaagaaaactttacaagaggcaaccccgaagatcccatcgaatggattaatcacgaagctgaggccttcgaggaaattttaaatagccgtggggacatatgtgctttttcgggtgccagggggattgccaccattttggagaaaaagggctgcgagcatgtaaagattttagcgcaatccgaagctaccttgtccttcgaagatgcaaaagatccttcagccgaagctagcatggttggtggaaaatttttcaccgatgtctgggacaatggtggtcgagaaatggcccgagaaattatccaaaaaagcgaaaagggcatccatgatgctagaaaagtagcagaggctgctgagaaaagcgcagagcccgaagggcaaataggtattaactaatggtttttattgtgttgtaatttttgattttaaacttcgttcgcaatttgtaatagcaatgtagctgtatcctgtcctccctcagatcctactaaagcgtctccgggccctcccccgaaagatgacgatgaaattaaaaagatggctgaagctatcatggatcaagttgttaatcaactcctgaatgaagctgcggaagtagtacttagggaagactaggtgctattgtaaaaacatctgaaatataatatgtataatatcttgtaatcctgaatgtaatatacttgtcttttttttatggttcaattctttacgatgcatgaaattttacatacgtaccgtttttgagtctttgacgaaaaaacaccttcccttcttttcatgcttcgtgaagaagaattttcatt

SEQ ID NO: 9452 - DNA, 1895 bp, Zea mays
cgaagtgccaataaagtcaaaattggaacaatcaaaaattttgttatcaggaacagaagaaaaggccgaagcgccgtgcacagaaaaaatggaagaggtaaaggaagcaactgagggctccaaaacatcagaagttttgagtcctgcagcaaacattgggacaacaaaaaatgaaaaagtgccagccgtaactccaagaagaaagagaatggctaatgtgctagatgtactggaaacaatcaaatcttcaagcacacctccgaagaaggttgctgtcactcctgaaacagcaactgaaattcctggttctacagccccagagcaaggggctgaagccgaagctgggccctcagagcccgcgaagggaaaacccttggaaagtgaggcagaaaaaataacaaagccaacttttgttgaagaaaccggtgtcgttgcccccgaagcatcccccaaaattcgtgattatattttccgtcatgcttcggggaaaaaattatcagaaaaagaagaacaagaggcccagcattatgcccaaaaactgaaatatccaaagggggcgttaatatttaatggcagtggagaagaagacttcttgtattgtcttcccgacagcaaggaaatttctgtctgccgggagatgagcaagagcttcggattcccgactttagaagacgggctctcagtgctgtcgaagaacgatctggccgacagcctggcttacaatagcttaaaggtacgatatatgaaatccttgtatttttccgttcgtttaaacccactgacacacacacatatttctttttgcagggcttgatacttagcaatgctcttagagcacagaaagatgctgaagacgaagggtgtacaatagccctgagcaaccttcgttccgaagtaattgaactgaggaacgaaggtctcgaaaaagacaaaatattatactcattgataaataaaataaaagaggacgaagctgcttttaaaattcaagctgaagctcagaaacgcgaaattgaagaccttcggaaacaactggccagagccaaggaagaacgcatacttgaagaaacaaagcgtgaactcagcgatcaatgggcagatcacctagaagtgactgttgaagagcttcgttcgtccaaaaagagatgctacaacaaatctatagattgtgtcaagaaattaaaggctagcttcgccaaggtcggcgcattctcaagtgaggaaaacttttcaagaggcaatcccgaaggtgtcatcgaatggattaaccacgaagccgaagccttcgaagaaattttaaatagccgaggagatatatgtgccttctctggcgccagagggattgccaccatcttagagaaggagggctgcgaacatgtaaaaattttagcacagtccgaagctgccttgtcctttgaagatacaagagatccttcggccgaagctagcataattggtggaaagttttttaccgatatctgggataatggtggccgagagatggccggagaaattattcgaagaagtgaaaagggcatccacgatgctagagaagtagctgaggctgctgaaaagagcgcagaggccgaaggtcaattaggtatcaactaatagtttttatcgtgttgtaatcttaggctttaagatttgtttgcgatttgtaatagcaaagtagccgtgtcctgtccttcctcagatcctactgaagtatctccgggtgcacggcctaagggtgacgacgagattaaaaagatggctgaagctattatggatgaagttgtcgatcgactgttgaacgaagctgcagaagtggtacttagggaagactagatgctattgtaaaaccttttaaatgtaaacagtgtaatatcctgtaatcctgtatgtaacatatt

SEQ ID NO: 9453 - DNA, 3341 bp, Zea mays
ccctgactattgctatcccattcgaaggcagaagagaaaaaacacaacctctgcaaaagaagaagctgcaactgctcctagcgagccagaaccgaaaagaaagaagataaaggtcctcacacatcggccgcgctatattgaaccagcttcggtgcctgagtttaccggagaaacttcttcggccaccgaagctgaaaaaccaaccgagccaaccttgatgcccgaagtcgcagaaacggccgaagtgccaacaaagatagaattggaacaatcaaagattttgtttatcagaagcgaaagagaaggccgaagcgccgtccacagaaaaaatggaagaggtaaaagaagcaactgagggatccaaaacatcagaagttttgagtcccgcagcaaacattgagacagtaaaaaatccaaaagtgccagcagtgactccgaaaagaaagagaatggctaatgtgctagatgtactggaaacgatcaaatcttcaagcacacctccgaagagggctgctgtcattcctgaaacaacaactgaaatttctggttctaaagctccagagcaagaaactgaagccgaagctgggtcctcagagccgcaaagataaaatccttggaaagtgaggcggaaaaaataacaaagccaacttttgttgaagaaatcggtgtcattgcccccgaagcatcccccaaaattcgtgattatattgttcgtcatgcttcggggaaaaaactatcagaaaaagaagagcaagaggcccagcgctatgcccaaaaactgaagtatccaaagggggcgttaatattcaatggcagtggagaagaagactttttgtattgtctccctgacagcaaggagatttctgtctgtcgggagatgagcaagagcttcggattcccaactttagaagacgggctctcggtgctgtcgaagaacgatctggccgacagcctggcttacaatagcttaaaggtgcgacaaatgagatccttgtattttttgttgagtccaaaatttttcgtttgtttaaacctattgacgcacacatatttctctttgcagggtctgatacttagcaatgccctcagagcacagaaagatgctgaagacgaagggtgttctatagccctgagcaaccttcgttccgaagttattgaactgaggaacgaaggtcttgaaaaagataaaatattacactcattgataaataaaataaaggaagacgaagctgcttttaaaggtcaagctgaagctcagaagcgggaaattgaagatcttcggaaacaactggccagagccaaggaagaacgcatacttgaagaaacaaagcgagaactcagcgaccaatgggcagatcacctagaaagaactgttgaagagcttcggtcgtccaaaaagagatgttataacaaatctatagaatgtgttaaaaagctgaaggctagcttcgccaaggtcggcgcattttcaagtgaggaaaactttacgagaggcaatcccgaaggtcccatcgagtggatcgaccacgaagctgaagccttcgaagagattttaaatagccgtggagatatatgtgccttctctggcgccagaggacttgccaccatcttagagaagaaaggctgcgaacatgtaaaaattttagcacaatccgaagctgctttgtcttttgaagatgcaagagatccttcggccgaagctagtataattggtggaaaattttttaccgatatctgggataatggtggccgagaaatggccggggaaattattcgaagaagtgaaaagggcattcacgatgctagagaagtagctgaggctgctgaaaagagcgcagaggccgaaggtcaattaggtattaactaatagtttttattgtgttgtaatcttaggctttaagatttgtttgcgatttgtaatagcaatgtagccgtatcctgtcttacttcagatcctgctaaagcgtcttcgggccctcagccgaaaggagacgacgaaattaaaaagatggctgaagatattatggacgaagtcgtcaatcggctcctgaacgaggctgcagaagtcgttttgagagaagattaagtatttttgtgaaaacttctgaaatgtaatatactgtaacattttgtaaccccaaatgtaatatacctatttttgttagtcaattctttacgatgcatgaaactttacacgtaccgcttttgagtctttgacgaaaaaacaccttcccttcttttcatgcttcgtgaagaagaatttttcattgtcacaacaatatccaatgttctgatgaataatatccaggcttcgtgaaaatattttccgaagctacccttccgaagatcaatgatgtatctttttgtgactatgatttctctcttttttcaaagcgttcttccgtagattgataatgtgtccacctcttgtgccatgtgcaaaatgatgtatgatgcttatgctatgcgaaatgatgcgatgatgttatgttatgtgagatgatgtttactccgaagatacatacgcatccctgcaataaaacacaatcttttataagcctcccttaggagcttcttcgccttttacttcagcggaatcagcgtttatttttcgctgtaagcctcccttaggagcttcttcgccttttactttcagcggtattcgcgttgacttttcgcgcttcgccttttacttaggcggtatcagcgttgacttttcgctgtatgctctgcattccctttggaacgactttggagcagaaaacttacactgcgctccctttggaacgacttttttgtgacttcggtaaacttactctgcgttccttagaacgactttttgttgcttcgaagaattttcgatagttcgaaggtcgtctttgtcatcacgtctcgttgaattttaatcaatatatgcctgtgaagaaaatatattttccttgtaggaatcaacgaaactaattacatgaaacctaaacaatgtcctttattacagaaaataaaactgaatgaaaaagattgctattaaggtaggatatttgtcaatagatgtgctttgactctggcacagtgctattgactgtacgagcttcggactgctctctgaagtccctctggtgtggagcatactggctcccttctggctgctggccttgttgcaacggaggtggaggcggaggctgttgccaggaagcttgaggctgacttgccgaagcaacagaaactgcaggatgattgcccacatattctgggatgtagggcgaatgatacgaagctgtatgcatgacctgcttcggctgagcttgttgtgctgctgcttcagctatttcctttgcttctga

SEQ ID NO: 9454 - DNA, 1745 bp, Zea mays
aaggttctcacacaccggccacgctacattgaaccagctacagtgcctgagttcaccggtgaaacctcttcggccaccgaaattaaagaaccaactttagtgccgaagatcgaagaaaaagctgaagcaccctcagcagagaaagcagaaaaactgagaactgaaggaacaaaaatattggaaattttaagtccttcaacaagtgttgagacaataaaaaaccaaaaaggcccggcaatgaccccgaagagaaaaagaatggtcaatgtgctagatgtactggagacaattaagtcctcaagcacgactccgaagaagactgttgaaacttccgaagcggaaactgaaatctttgatgctgaagctccaaagcaacaaactgagactgaagctgggccttcagagcccacgaaggtaaaatccttggaaaccgaggaggaagaaatgacagagccaattcttgttgaagaaaccagtgctgttgcccccgaagcatcccccaaagtccttgattatattgttcgacatgcttcggggaaaaagttgtctgaaaaagaaaagcaagaggcccagttttacgcccaaaaactgaaatatccaaagggggcgttgatattcaacggcagcggagaagaagacttcttgtattgtctccctgacagcaaggagatttctgtctgtcgggagatgagcaagagcttcggattcccaacactagaagacgggctctcagtgttgtcgaaaaacgagctggccgacagcttggcgtacaatagcttaaaggtgcaaaaaatgaggtctttgtattttttcttgagaccaaaatttttcgtttgcttaaatttattgacgcacacacatttttctttgcagggccttatacttagcaatgccctcagggcccaaaaagatgccgaagacgaagggtgtgttatggccctgagcaaccttcgttccgaagtaattgaactaaggaacgaaggtctcgaaaaagataaaatattacattcattgataaatagaataaaagaagacgaagctacttttaaaggtcaagctgaggctcagaagcgtgaaattgaagatcttcgaaaacaactagccagagctaaagaggaacgcatacttgaagaaacgaagcgagaacttagcgaccaatgggcaaatcatttagaaggaactgttgaagagcttcgttcgtccaagaaaagatgctatgacaaatctatggagtgtgttaagaaaatgaaagctagcttcgccagcgttggcgcattctcgagcgaagaaaactttacaagaggcaaccccgaaggtcccatcgaatggattaatcacgaagctgaggcctttgaggaaattttaaatagccgcggagacatatgcgctttttcgggtgccagggggattgccaccattttggagagaaagggctgcgagcatgtaaagattttagcgcaatccgaagctaccttgtccttcgaagatgcaaaagatccttcagccgaagctagcatggttggtggaaaatttttcaccgatgtctgggacaatggtggtcgagaaatggcccgagaaattatccaaaaaagcgaaaagggcatccatgatgctagagaagtagcagaggctgctgagaaaagcgcagagcccgaagggcaaataggtattaactaatggttttttttgtgttgtaatttttgatttttaaacttcgttcgcaatttataatagcaatgtagttg

SEQ ID NO: 9455 - DNA, 1431 bp, Zea mays
aacatcctaatcgaaaaactcggagtcggaggcgccacgcgcgcgtgtataaataactgcgcctcactgctgcggtgcacggtgtccccctccctccccgctgtctgtggctgcaggccacccccatagcccccgagctctgtgtgcgatggactactcgggcaccaaggagtcgcctcctgccggggcttggtggtcgagggagacggtggccgtggtgaccggcgcgaaccgcggcatcggccacgcgctcgccgcccgcctggccgagcacggcctcaccgtggtgctcaccgcgcgggacggcgagcgcggggaggccgccgcggcgccgctcctcgcgcgcgggctcgcagtcgtcttccgcaggctcgacgtctccgaccccgcctccgtcgccgagttcgccgcgtggatccgcgacgccctcggcggcctcgacatcctggtgaacaacgcagccgtgtcgtttaacgagatcgacaccaactccgtggagcacgccgaggctgtcctcaggaccaacttctacggggccaagatgctcaccgaagcgctcctgccgctgttccggcagtcgtcggcgaccagcaggatcctcaacgtcagctcccagcttggccttctcaacaaggtgagcgacccgtcgctgagggcgctgctgctggacgaggacgggctgacggaggcggggatagaggcgatggtgtcgcggttcctggcgcaggtgaaggacgggacgtggggcgggcagggttggcccaaggtgtggacggactactcggtctccaagctggccctgaacgcctactcgcggctgctggcgcggcggctgcaggcgcgcggcgcgcgcgtgagcgtcaactgcttctgccccgggttcacgcgcacgggcatgaccaagggctgggggaagcgcaccgccgaggaggcggccgacgtcgccgcgcggctcgcgctgctggcgcccgccgagctccccacggggaccttcttcaagtggtgcacgccgcagctctactccaagctgtgactgtgactggatagctacgcctaccgtcgtcggcagtgtgtgcgtgcgctccgtgaacgctggagtatatatatatagttcggttcctttagctactctgctcagaagtcagaaacgggagtgtcgatctgccaaggtgctttcggttgaacacagctcgtttgtgacctctccgcaatgtaccatgtacctagttgtctaagatctaggtcaactttctgtgcactggttgaatggttgccttgcctctgcatctgcatctcccttaccgttttgcccgttcgtaaaaagtctgttccttaccggatggatggtagttggctagcttttccttccacacgagatttctggccgtgggatgtgaagtgtgattggagaagtgggccgcgtgggcttta

SEQ ID NO: 9456 - DNA, 931 bp, Zea mays
  misc_feature (6)..(8): n is a, c, g, or t
  misc_feature (13)..(13): n is a, c, g, or t
aaaaannnttttnaaaaaaagaacactgccgggcccccgagcggaagacacaacagcgcctcaccagccagccaccaccgcgctccatttcctttctctctctctctcggctcctccgctctcttgcccgagtcgctagcttccctgccccgcctcctcccgtccccgtggacagacagctccccccacctccgcttccatagcatccgagctaaggtcaactcctccgtcggcggagcgagagcggggaagagacgggagggtcccggatccgagccgagctgcgctccccgcgcgaccgacacccaggtctcgtcgtcccatgcagatctgctcctcctcctgagatctaaaccgaagcttgagctccggttgttggtggttggtcggcggcggcaggggaggctgcgaagatgtcgtcgagcacgatccgcaaggccctgggcgcggtgaaggaccagaccagcatcggcctcgccaaggtcaccagcaacatcgcgcccgagctggacgtgctcatcgtcaaggccacgagccacgacgacgagccggccgaggagcgccacatccgcgagatcctccacctcacatccggatcccgcgcccacgtcgctgctgccgtggcaggctgctcccgcaggctctcccgcacccgcgactacgtggtcgcgctcaagtcgctcatgctcgtgcaccgcctcctggccgatggcgacccgtccttccaccgcgagctcctccacgccacacgccggggcacccgcctgctcaacctctccgattttcgggacgaggcgcactctgggtcctgggatcactctgcctttgtgcgcacctacgcgctctaccttgaccagcgcctcgagttcttccctcatgagcgcaagcaggggtcaaatgctggcagcagcagcagcgctaatggtccatc

SEQ ID NO: 9457 - DNA, 3156 bp, Zea mays
cgctcgggacctcgaggccggccgggctttccggcctatctctatctatccctcctcggctcctcgccctttcccctcttgcccgagtcgctagcctccctgcccctgcccctgccccgcctcctcccgtggaccacttcctccaccttcgcttccatagcaggctagcagctgagcgaggtcaactcttccgccggcggagagagagggagggagcggggaagagacgggagggtctccgcgcacctgccatcagccaccacccgatacccaggtcttgtcgtcccgcgcagatctgctgctgcccttgagatctaaatcaaagcttccgctccggttgttgtcggttggtcggtacctgggcggcggcggcacgggaggacagcgaacatgtcgtcgagcacgatccggaaggccctgggcgcggtgaaggaccagaccagcatcagcctcgccaaggtcactagcaacatcgcgcccgatctggacgtgctcatcgtcaaggccaccagccacgacgacgagccggccgaggagcgccacatccgcgagatcctccaccttacgtccggatcccgcgcccacgttgccgctgccgtggcagggtgctcccgcaggctctcccgcacccgcgactatgtggtcgcgctcaagtcgctcatgctcgtgcaccgcctccttgtcgatggcgacccgtccttccaccgcgagctcctacatggcacacggcggggcacccgcctgctgaacctctctgattttcgggacgaggcgcactctggatcgtgggatcactctgcctttgtgcgcacctatgcgctctaccttgaccagcgcctcgagttcttcctccatgagcgcaagcaggggttaaatgctggcagcagcagcagtgctaatggcccatcaccacgggaccgtgatcgctggggttcgcctgatccctatggccgccgctctccctcctactcgtcaccccctgggtatggaggatatgatgattaccgcgagaggaatggtgggaacaatgatgacaagaggccaccgaccccggtgagggatatgaagcctgagcgtgtccttgctcgtatgcaccacctacagcagctgcttgacaggttccttgcttgccgccccactggtggtgcaaagcaaagcaggatggtgctggttgcgctgtatcagattgtgagagagagcttccagctctactctgatatctgcgaggtgctggcggtgctgctggacaggttctttgacatggagtatgcggaatgcgtgaaggcttttgaggcatatgctagtgctgcaaagcagattgatgagctctctgcattctattcatggtgtaaagatactggagttgcaaggtcatctgagtacccagaggtgcagcgtgtcactgataagttgctggagacgctagaagagttcatgagggaccgggcaaagaggcctaagagcccaccacgggagcctgaacctgagcctgttaaggaagaacctgagccggatatgaacagcatcaaagcgcttccagcaccagaagattataaggagcctgaacctgtgaaggtggaggaagaggtgaagccggagccacccccacagccacagggtgacttggtggatctcagagaagatactgttagtgcagatgagcaaggtaataggcttgctctagcactcttccagggaccgcccgctgctggtggaaacaatggttcatgggaggctttcccttcaaatggtggcaacgaggtgacttcggcatggcagaatcctgcagctgaacctgggaaggctgattgggagcttgccctcgtagagacagcaagcaacttgtccatgcagaagccagcaatgtcaggtggtatggacccgctgctgctgaatggtatgtatgaccagggtgttgtgcgtcagcacgttagtgcacaggtgaccaccgggagtgccagcagcgtcgccctgcctgctcctggacagaagactcagatgcttgctctgcccgcaccggatggttcaatgcagactgttggtggtgacccctttgcagcgtcccttgccgtcccaccaccatcctatgtgcagatggcagatttggagaagaagcaacagctcttgtcgcaggagcagattatgtggcaacagtaccagagggacggcatgcaagggcaatcgagcctgaacaagctcgaccaggcttaccacaatggtttcgcgcccaacccgggcatgccctatgggatgcccgcggcgtacaacactgggtattactaccctacttactgaggaagcctattctttattcatccttacagttgctgtgaatttttgttctgtgttgtgatcttactcccagccctggggttgtgtccagcatcagctgttgttcccctgtctctggatcaaaccttttggtctgatatatgtaatgtaattttatttgtttggaaccaaatgcggcatccgagagtagctatagtatattacataatctcaattgatctgtacactgtttctgctaaacttctgcatgttatcacttcccttcacttgatgttgcagtgcgtttgttgcgtgtcacacaccgatgttggatcgccatgtttgttggaagagcttgctggttgttggcattaagggtgtcatgtttggtggtataactatttttgttgtgacttcacttttactaaaggtgggctctgttcagacgacggctttaccattgattggatccttgaccttttacacggataagagtttttttgtccttataaaaaatataatttatttattatgatttgtgctaacatggacaacagttttatttttgtacttctatagaaaaattgtaatttgtaacatggacagcagttttatttttgtacttctatagaaaaattgtaatttatttttgtacttttatagaaaaattgtaattatttttgtacttctatagaaaaatttgtaatttgtcatactgcatcagatttgaaccgttggagatctctagcaagctttttataggcacctgaaatatagcatattccttctctgaaatagcatattcaaaattttccaaactctcctctgtctgggctcaccggacagtccggtgtgcaccggacactgcactgtgcaatgtccggt

SEQ ID NO: 9458 - DNA, 3584 bp, Zea mays
  misc_feature (42)..(42): n is a, c, g, or t
  misc_feature (141)..(141): n is a, c, g, or t
  misc_feature (144)..(144): n is a, c, g, or t
  misc_feature (192)..(192): n is a, c, g, or t
tttttttttttttttggaaaaaaaatctaatttctatagacncatcatgtgatacccttttgtgttcagatctaaaccgaagcttgagctccggttgttggtggttggtcggcggcggcggcggcggcaggggaggctgcnaanatgtcgtcgagcactatccgcaaggccctgggcgcggtgaaggaccanaccagcatcggcctcgccaaggtcaccagcaacatcgcgccagagctggacgtgctcatcgtcaaggccaccagccacgacgacgagacggccgaggagcgccacatccgcgagatcctccacctcacatccggatcccgcgcccacgtcgctgctgccgtggcaggctgctcccgcaggctctcccgcacccgcgactacgtggtcgcgctcaagtcgctcatgctcgtgcaccgcctcctggccgatggcgacccgtccttccaccgcgagctcctccacgccacacgccggggcacccgcctgctcaacctctccgattttcgggacgaggcgcactctgggtcctgggaccactccgcctttgtgcgcacctacgcgctctaccttgaccagcgcctcgagttcttcctccatgagcgcaagcaggggtcaaatgccggcagcagcagcgctaatggtccatcaccacgggaccgtgaccgctggggttcacctgatccctatggccgccgctctccctcctactcgtcaccccctgggtatggcggatatgatgattaccgcgagagaaatggtggaaacaatgatgacaagaggccgcccaccccagtgagagatatgaagccagagcaggtccttgctcgtatgcaccacctacagcagctgcttgacaggttccttgcttgccgccccaccggtggggcgaagcacagcaggatggtgctggttgcgctgtatcagattgtgagggagagcttccagctctacgccgatatctgcgaggtgctggcggtgctgctggacaggttctttgacatggagtatgctgagtgcgtgaaggcttttgaggcttatgctagtgctgcaaagcagatcgatgagctctgtgcattctatgcatggtgtaaagataccggagttgcaaggtcatctgagtacccagaggtgcagcgtgtcaccgataagttgctggagacgctggaagaatttatgagggaccgggcaaagaggcccaagagcccatcaccggagcctgaacctgagcctgtcaaggaagaacctgagccagatatgaacagcatcaaggcgcttccagcaccagaagattataaggagcctgaacctgagaaggtggaggaagaggtgaagccagagccacccctgcagccacagggtgacttggtggatctcagagaagatactgttagtgcagatgagcaaggtaacaggcttgctctagctctcttccaggggccaccagctgctggtggaagcaacggttcatgggaggctttcccttcaaatggtggcaaccaggtgacttcggcctggcagaaccctgcagctgaacctgggaaggctgattgggagcttgcccttgtagagacagcaagcaacttgtccaatcagaagccagcaatgtcaggtggcatggacccgctgctgctgaatggtatgtatgaccagggtgttgtgcgccagcatgtcggtgcacaggtgaccaccgggagtgccagcagtgtcgcgctgcctgctcctggacagaagactcagatgcttgctctgcccgcaccggatggttcgatgcagactgttggtggtgatcccttcgcggcgtcccttgccgtgccaccgccgtcctatgtgcagatggcagatttggagaagaagcaacagctcttgacgcaggagcaaattatgtggcagcagtaccagagagacggcatgcaagggcaatcgagcctgaacaggctcgaccgcgcccccaacccggccatgccctacgggatgcccatggcatacaacacgaaccccatgccaatggcttacaccgggaacactgggtattactaccctacttactgaggaggcctgttctttaatcatccttacagttgctgtgaatttttgttctgtgttgtgatcttccccgccctgcggttgtgtccagcatcagctgttgttcccctgtccctggatcaaaccttttggtctgatatatgtaatgtaattttctttgtttggaaccaaatgcagcatccgagggtggtggctatagttgattacataatctcatattgatctttacactgtttttactgatcctccgcatgttatcacttctcttcacacgattttttgtcacctgcttgtagatgttcctgagagagtggtactgagtgtctctcacctatgaatacatgatctacttgctgtggttagaaatggcctgtttctcagatctagatcgccatgtttgttggaaaagcttgctggttgttggcatgaagggtgtcatgttcggtggtaatcagctattggtatttttgttgtggccaatacttttcagaaatagacttgagagttgagaggccctacttcttagcatgtctggtgtgtggatctcttggactacaatggcgataattattcttgatgagaatacacttttgaaatcaacaaggacgaaaagggtccgaaactgttttcaaattggttgaaaacgacaactttttatgttttgctgagctcgaaaaatgtataaaaacgatctggtgcggtatgggaatttctcttactcgtctggagtcagtattttactggcgattttcgctagataaaatattcaccattcaataaatcacggtgacctaattggtccgtcactgactttagtctttatatctaatccgttagggaggaggcaggtgtagtgcttgccggacatggacaccttttggagtgtgacaagtaaacgggtcaaaagaacctggaaatggttcatcacgtagcgggaagcactaaattgagaggagtttcggccgattcggggcgttgcagagcgtgcgctttccgggcacggcacgctcgccagacggtgaccaccggcaggataacaagaacgtcgccgtcgactcggggcttggatggtatctacaactcgtcaaggcactatgccatacccttcttttatatgcgaattgatggtgttccgtgtgccgtgtggcgaggattatcacagcgagaacaagggcttttcaccatttatcagaaatagaaagccctcggatatcatgctctgaattctgaagacgaatcctgcatggacgcaaccgtatgggcccggcaacggtgaggcaagcacaacgacgacatggcgattgactaaaatcgttgagtttttttttgattaatttcctgtagggaaagcccacacagggtaaattatgtacattttttgccggaggtattacatcaaggggggattggggggtgggggggtctatggtcttttgtagccaggtccctgatagaggccgctacagtgtgctttgctctataacataggagtgtcgtctcctccttgagcatgcttctgcaggcatgca

SEQ ID NO: 9459 - DNA, 3184 bp, Zea mays
  misc_feature (1606)..(1606): n is a, c, g, or t
  misc_feature (1766)..(1766): n is a, c, g, or t
ggtaccctcgcaggcccgccaggccctctcgatctaatctatccctcctcggctcctcggcctttcccctcttgcccgagtcgctagcctccctgccccgcctcctcccgtggaccacttcctccaccttcgcttccatagcaggctagcagctgagcgaggtcaactcttccgccagcggagagagagggagggagcggggaagagacgggagggtctccgcgcacctgccatcagccaccacccgatacccaggtcttgtcccgcgcagatctgctgctgcccttgagatctaaatcaaagcttccgctccggttgttgtcgattggtcggtacctgggcggcggcggcggcggcggcacgggaggacagcgaacatgtcgtcgagcacgatccggaaggccctgggcgcggtgaaggaccagaccagcatcagcctcgccaaggtcactagcaacatcgcgcccgatctggacgtgctcatcgtcaaggccaccagccacgacgacgagccggccgaggagcgccacatccgcgagatcctccaccttacgtccggatcccgcgcccacgttgctgctgccgtggcagggtgctcccgcaggctctcccgcacccgcgactatgtggtcgcgctcaagtcgctcatgctcgtgcaccgcctccttgtcgatggcgacccgtccttccaccgcgagctcctccatggcacacggcggggcacccgcctgctgaacctctccgattttcgggacgaggcgcactctggatcgtgggatcactctgcctttgtgcgcacctatgcgctctaccttgaccagcgcctcgagttcttcctccatgagcgcaagcaggggttaaatgccggcagcagcagcagcactcctacagcagctgcttgacaggttccttgcttgccgccccactggtggcgcaaagcaaagcaggatggtgctggttgcgctgtatcagattgtgagagaaagcttccagctctactctgatatctgcgaggtgctggcggtgctgctggacaggttctttgacatggagtatgcggagtgcgtgaaggcttttgaggcatatgctagtgctgcgaagcagattgatgagctctctgcattctatgcatggtgtaaagatactggagttgcaaggtcatctgagtacctagaggtgcagcgtgtcactgataagttgctagagacgctagaaaagttcatgatggaccgggcaaagaggcctaagagcccaccacgggagcctgaacctgagcctgttaaggaagaacctgagccggatatgaacagcatcaaggcgcttccagcaccagaagattataaggagcctgaacctgtgaaggtggaggaagaggtgaagccagagccacccccacaaccacagggtgacttggtggatctcagagaacatactgttagtgcagatgagcaaggtaataggcttgctctagcactctttcaagggccacccgctgctggtggaaacaatggttcatgggaggctttcccttcaaatggtggcaacgaggtgacttcagcatggcagaatcctgcagctgaacctgggaaggctgattgggagcttncccctcgtagagacagcaagcaacttgtccatgcagaagccagcaatgtcaagtggtatggacccgctgctgcttaagatgcatttcattgttgtcactctctttaatatctcttatcataggataaaatagaacttaaaatttaatataacagtagaanagataattaaatgaaacctgcttggacgcattcctgcatttcactttcttttgatgttcttgtttgttcttagctttggaacattttcttttcgatccacagcacaagcagcatgactttggccagcagttacatgtcttgctaggaggttttgttgcagttggggcatcataaccatacaaagcatgtcttctgaaaacataaccagtcccaacatatattggtccttggatcccatcaagacctttcatgttaatctgcaaagagaagtagataatatgcagaaacttgttcagaatactatcttcaatgtctttcggataatgcagaaacttgttcagaatactgttcggatagtgagtagtcgaattctgtccaaatctggacagaatttacgtttagcactgtttgacctttctaaaggtcgaatcttgttatgatgataatacaaaagttatagaggactttataagctttctacaaagtcctagtttactatttttggatgctcctgctcgtggcctaattttctctgtgtgtgtgcaactgctcctgctcctgtattatgctcctgctgctgctttactgctgctgcacaaatcacacggcagcaggtccatctgtcacggttaccggacgaccagacagagagagtttccttgttggcctggcttgcttccatctgcacgtacgcacgtagttgctgctggatgcggatgatgatccatgctttggcgtcacctttttttcttttcttttttttggctgcgcaaataaccttcttacacctgggctgggctgggctggtggcttgcggatcttttcccaacaaaaaacagttctgttttatttatcccgtgttgtagctttcgctctgctactgatgccggtgctttcagagcagaggagacagttaactgtattccaaaagtctgaaccaaaagagttcagtttaatttttaatacacatgttatatgcgtagccacggcgcaaagaatgtttcacttcttcagaaccagaagcaaagagacttgtcaaaagtgttgtgtcataacgaggagcggaaaagtcagacgatgtcacgatgctgagaagtgagaacttcacatctcatctacgttaaaaatgtgtggtcctgacagcgcccctgagaaatatctgaccacgagtggacccccaagtgctcactatatatgctaggttgcttcttgcttggaaggaggaggcagcaagcgaccgacctgctaagcttcagccttcaggagagagtcgcaagaaagcgccatggtggtgttgccgcatgttttttaattgtaatcgttccttgtaatttgtgctttatttggtttgtggaatagaataagttgatctattaccatcatatttctcatagaccaataattagtaataaaatgag

SEQ ID NO: 9460 - DNA, 3022 bp, Zea mays
ggcctctttcacccagcccggcgaccccgccgcgctcctgcctcgcctcgcctcgccgtcggcgaccgaccccacgtctgcccggcgatgtcctcctccgtatccattgcggcagagtgggatctcctctccgatcgcttctaccgccggctcacactctactcacctctcccatggtccaccccagccgcggccggcgcgacctcgtcctcctccggcgtcagcggtgctgtgatcggtcgccttgacctgtccacccacatcgtcgccgccgcgccctttggaggcccgatcgccgccgtccgcgacgactctaagatcgtgcagctccactccgagccatcccgccgccgcgtcctcctcttctcctcctccggccacccaattgcctccgcgccctggccaccccttctcccacgcctccactcgctcggtttctccagctccctcagcctcctcgcacttctctccgacggctcgctcctccgcttccgcctccccgatctgcaacccagcccttgctccagtcccgttcccctgctcccgccggcctccggcggcgtcgccgacgctctattctggggcggcggtgtagccatcctcacggaagacaaccgcgtcgtggtggccactgacatcgaggtcgacgatcctcacccccgtcacctcgccgacccaggcatcggtgatgaggaacatgttctgtgtatggccgtggtggaggcacagtttgtcatgtcagggagcccagaagtgctgcttgctgttggcgaccgggtcattgcggttgacgaggatggcgtacaagtgcttggggaagagctggagattggacccgtgcagaagatggcagtttcacccaatggcaagctcctcgcagcatttgcacatgatggtcgccttctcgttattcccaccgatttctctaggatcatattcgagtatgagtgcgaatctgcattgccaccagagcaaatagcttggtgtggactagacagtgtactcgtctactggcctgaagtgcttttgatggttggtccaaatggagatcctgtccaatacaattatgatgaacccataaaactgattcctgagtgcgatggtgtaaggatcctatctaactcaagtatggaatttctacaccgagtctcagactctaccacgtcaatttttggcattggaagcatgtccccagcggcattactgtatgatgctcgtgatcactatgacaggcaaagtgcaaaggcttatgacaactatcaattaatatcatcttcattgcctgaggcaattgaggcttgcatcgacgctgctggccatgagtttgatgtttcacgccagcgcacattgctgagagctgctacatatggcctagctttctgcagtcgatttccacatgaacgctttcaagaaatgtgcaaaatgttgagagttctaaatgctgttcgtgatcctgagattgggatgccactgaccattcatcagtacaagctgcttactacatcggtgctcattggacgtctcattaatgctaatcagcaccttttggcccttcgcatctctgagtaccttaacctgaacccggaggttgtgataatgcattgggcatgtgagaagataacagcatcaacaactcttccagatacagtccttcttgatggtctgcttgataagctcaggctatgtaaagggatatcatatgctgcagtggcagctcatgcagataacagtggtcgacgaaggttggctgcaatgctcgttgatcatgagtcacagtcctctaagcagatccccttgttgctcagcatcgatgaacaagacaaagcattatcaaaggcaattgaaagtggcgataccgatcttgtgtaccttgtgctattccatatttggcagaaggtagctgtagagaagaaagctcctttggatttttttggtgttataaatgcaaggcctgtggctagagatttgtttatggcatatgcaagacattctaagcatgaagaattgaaggacttctttttatcgactgggagacttcaagatgccgcctttcttttgttgaaggaatcatgggaattggagaagaaccccatggcaagcaaggggtctcctctccatggtccacaagtgaggctcattgagcaggcccatagactttttgctgaaaccaaggaacatgtttttgagtccaaagcttctgaagagcatgccaaattgctaagatcacagcatgaacttgaagtttccacaaagcagccaatatttgtgggttctagtgttagtgatacaataaaaacctgtattgcaatgggaaacgagcgtgctgcactcagagtgaagtccgaattcaaggttcctgataagaggtggtactggcttaaaacgtgcgctttagccacagttggaaactgggatggtttggaaaaattttcaagggagaaaaggccaccgggaggctataaaccttttgtggaagcatgcattgatgctggtcaaaaaaatgaagctgtcaaatatattccaaagttaacagatcctcgtgaaagatctgaggcatatgctcggatgggcatggcgaaggaggcccaagatgcagcctcacaagctaaagatagtgatgagctatttggccgcctaaagattacacttgcacagagcagtgctgccgcctccattttcgatacattgcgggatcggctatcctttcaaggagcatattgatcaacgtgattttgtcgtaggcccggatgtgcacctcgatgttttgaacagaccggcaatttatttatttatttgttttctgctctgttgtatgtatgaagaattaacctcagtgtgaatacatgtccatggaaatttacggtcacagaactgtgcagccagtgcacgtgtggttcacctgtgacattttggatttctagggtatatggggacacgaagtggagtagctctgccctgtctgtggtgcttgagtgggaggtgcatctgaatagaacctcctctcccatccctctcactagcg

SEQ ID NO: 9461 - DNA, 2132 bp, Zea mays
  misc_feature (848)..(848): n is a, c, g, or t
gcttgcatgcctgcagcagcaggaggggggggggggggggggcattccaatctcagcaaacagttcctaccagtttcagatccagatgccaaagaacaaggcccccaaaccggacgctctattttctagtttctacagcatagtactgccgaaacaacacgcatcactggaacttcctgatcgacgacccaggcggatcaagagaggtgccctcgtccgcatcaacgccgatcttacccatttcagcggtaggagctatacggttcttctctcgctaagagctacagggctcttcgctcgcttttgcaacaggctcaaaatttatagcgttgatgcccccggggactattctactccatctgagggctcctttggataatgaatacccgcagggatcccagcccaatccacgggggaatgaggcccgtgtgcttttcttccctggttatcccagactaccatttgcatgctacacaggccaaaattgtcacgggtctttttcacctcatccctgttaatccacggggaaacaaaaaaactgctctggcctcgtgtttaccgttcccgtctctctgctagtctgtctctatcgcagcagccatggcggctagggtttacgccgccggcttccatccgtaggaaaaacctcctcatccagtcgttgccctccatccccacatgcccacgctgctcgtcgcccctctccaccaccaggaatcattcagttcacctaatccagcgcatcgcatctgcaaccttgcgtccagttcctgctttgctcagctgacgcggtctctgcagtagatcaggcctgagataatggcccctagtgacaagattatggcacnatcgaaaggataaaattaggagattcatgcaattacaacaaaaagaagacgatgaattattttttgtaatagttcctgccatacttcagtgccttaatgatgagaaaagaccagttcatacttctgaatatactggtgctaaaaagatgaaggaaattctagaggggcatgagagttggtgtaagtcagagtttcgtatggagccagagatttttaaggcaacgtgcaactatctaaggcgggaggggttgttgcgtgacacgcggagagttaccattgaggagcagctaggaatgtttctattcatgatttcacacaatgctagcaatgaaaggctgaagaaaacatttcaacatagtggggaaacagtccataggcacataaaggcgattttcaatataattccaactctcacccacaaatttttgaagcttcctagttccaaccaaactcaccccaagattgcaacagatcctcctttctgccctgtgtgaaaggaagcattgctacaggtgatttaaacttcacatcagctgaaccagcaccccaaccaactgaacatgttagcactattgatattgatgctcatgattctcaccttaaccctttccttgcaaatgtggatgatcacatgacatctagtggacccatagacatagatgagatagaaacaccatcttcatcttgctctaaaaattttgaaaataggattgggaagaaaagaaagctcagtattgctggagttttacaaaactatgtggacattagggcaaatgaaacaaaaatatttatgaatgaactcaatgagacaactaaggaagcagatgactattctatcaagcggtgtctagatcttttagaatcaattgaagaactttcagatgaggaaaaggcgcaagcaacaaatgtgctgaagtgtgaggtcaacagagaaattttcatgaacttcaagattccaaaggttcgtttgttatgggtcaaaggcgaaatctctcccaaggtctaatctacattgtatcgtggttgctggtggtgtttacaagctgatggctgcatatggtgcttcatttttggcttctttgtatctggttttgagacattgtagtgaaggttgacatgagaaactcttgtatgaactttggaatggttatctttggagtgccttgtgacaatttacctttttatgtacttcggatctgtatggaatattttcctttgatgcatgtacttcggatttgtatgaatatttttatccttgctaataattttgtgtattgccgcaac

SEQ ID NO: 9462 - DNA, 919 bp, Zea mays
tttttttttttttttttttttttttttttttttttgaaaactgaaacacggaccagaaggttacaagttcagttcagaaacagagactaaaaggttacaagttcagaaagaccagattcctaaactatacaaacactatcttcccgtcaccattttcatctgactaacaagcaccgtcttctcatcgttttttcagtttgatcaatctccatccccctcaatcttcggccacccgttctgggcttgcgacttgacaaacgaagctaggatcttgatgtcgtcttccgatagccgggggccgaaggtgcactgtcctcttggggtgcatttctctccaaaaccgggcattcttcctttcccatagtatgtgatgttatacagttcctcctccgtggcaactccgtttctctcgaggtccttcaggaaaagagtggctcctggctgtagaatgtttcctcccatgtcatggcaaccaatacaagccttccggaacagcgctgcgccttctgaaactggctgtgcaaatgctggtgagatagcagcaggcaggccagggggtgccgctacaaggacgagcgccgcagccaagagcggcgcggcctgacgcgcggcgacggtggaaggggcggcagcacttcggcctgggcgcgactgctttaggctggagcagcatgccgacgctgccttcgcccgaacaacggaggaagaggcgcagggagacggtagcagcggtcgcgcggccggaggaagcccggacatcgcgcgtggcgagcgctagccgtccttggcttggctcccgcagggcacggcaagccaaggcaaatcttggagagctggagcgtacaatccgacgacgagggatgacgaagctgccgattggcgattgctctacagagtggttcaagtgccggcctcgagg

SEQ ID NO: 9463 - DNA, 1233 bp, Zea mays
aaccgaacgagccctgtgttcaacgaagccacactaggggcctgttcggtttactcggaacgatgacctggaacgagtcgtagctggattgattgtataatttacataagctttgatcagatggaactattcctggatagaatccccgacaaccgaacagggcctagaaggggaagaataccgcccccccacgccgtccgtgaccgtcgcatccaatccaacggcattctggttctagggagcccgcaggaaggcacctctgcggcgaccagcgtgaagaaaggggatcggaacgcctccatctcaaaccccacgaaggcacgaaccctctcttcctaggttcatcgttcctcctccgcgtccttccttccctccgcagcgcggcgcggcgcggcgcgatgatacagctgctcttcacgctgctagcggcggagggcgccgtggcggcggtgctactcttcaagacgccgctgcggaggctggccgtgctcgcgctcgaccacctcaagcggggccgcgggcccgtcatggtgcgcaccatcgcggccaccgtgcttgtcgtgctcgcatccagtctccacagcatggccaagatccgcggccacgccgagggggagctcgacggctccggggtcgtggggctcacccccaccgaccaggtccttcttgcgcgacacctcctcgaggcgtcactcatgggatactccttattccttgctttagtcattgaccggctgcacaactatgtcaaagaaaatcgaaggctcaggaagaaattggaagaggtgttgaaacagaataaggcactagaagaagcaacaaatggaaagctagaagagaacaggcctgaccagaaagacctttcccatgccaaggataattaacaatgacatgcgctcaagaaactccctgccatcactgcctatgcctgaataggatgccggtcactgatgttctccctgttgagaattagcattggtaaatgaatgctcggttacaacgtgctaaatcctttgcatctggccaaatttgtaaataagcactgggtgatgcccatcagtaaacacatgatgctactgctgttaaactaaatgtggcaaatttcataatgctaggtattgttctcggtatctaaggtgttgtttggttgctaagtatggtggaacgaagtcgctctgctctcattcaattaaaaaaaaaagctctcaaaaaaaaaaaaaaaaaaactcgtgc

SEQ ID NO: 9464 - DNA, 2072 bp, Zea mays
  misc_feature (684)..(684): n is a, c, g, or t
gaacggaacccagaggaacagagcagacgacgcgaggcgatttctgcgggtttgcttgctccatctgtagaccttaggccgccgccgggcgaccgtgcgcgtgcggtgctcacgccccaccccgctcaggtgaaggcacttcaagatgggcgaggtacacgaagctgacaagaacattgagatctggagggtgaagaagttaatcaaggcacttgatgctgcaaggggcaatggaactagcatgatttctctcatcatgccacctcgtgatcagatttcacgcgtcactaagatgctgggtgatgagtacggaactgcctcaaacatcaagagcagagtcaacagacagtctgtgttggctgccataacctcggctcaacagaggttgaagctttacagtcgagttccccccaatggtttggtgctctatactggtaccattgtcaccgatgatggcaaggagaagaaggttacctttgacttcgagccatttaggcccattaatgcttccctgtatctctgtgacaacaagttccacactgaggccctgaacgagcttctgacgtctgatgacaagtttggtttcataatcatcgatggcaatggtacactgtatggtacactgagcggaaacagcagggaggttctgtacaagttcagtgttgatcttccaaagaagcatgnggcgaggagggcaatcagcagtccgctttgcccgcctgcgcatggagaggcgacacaattacctgcgcaaggttgctgagcttgcgacacaatacttcatcaatcctggcaccaaccacccgaacatcgttgggcttattcttgccggttctgctgacttcaagagtgagctgggtaaatctgagatgttcgatccacgccttcaggccaaagtagtgaagatgattgacgtgtcttatggtggggacagcggcttcaaccaagccatcgagatgtctgccgaggttctttctgatgttaagtttgtccaagagaagaagctgatcgggaagtacttcgaggagataagccaagacacagggaagtacgtccttggcatccaggacaccatcacagccctggaaatgggcgcggtagagatcctgatcgtgtgggaaaaccttgatgtcaggcgttatgagctcaagaacagtgccacaggagagacagtcgtgaagtacctgaacccagctcaggaggctgaccagagcaacttcactgacgaggcgacatccggagatctggaggtcattgacaacacgcagctgctggagtggttcgcggagaactaccaccagttcggctgcacgctggagttcgtcaccaacaagtcacaggaaggttctcagttctgccggggattcggcgggattggtgggatccttcgctacccagccgacgtcagtgcctaccaggacggtgacttgtctgatggggagtatgatgaagacttggaatagcaatcaaccagaactcaaatgaatccggtccgggaggagcctgcgctggcccgggccgtgccgggggggggaaccctgaaacttccaaacgatcggtgcaaggagaccatggtggaggatctgtagggaaggaggcttgagcaacttatataggatatatatatggaagcttgtcaagctggtgagtggagactttggagacggtgttttgctctgttgatccgagcttgcagtctggtgatgctactaggaatcagccgtggacgctgccttctgttggtcaggagagcctctaatgagtatcgatcaactagcatcctattagtattgggttggtgccagtagtatggtgaataaaatacctggaggactccgaggttgcacgtacgctttatgacgtgcgtgatatctatgattgtgaaaatgtctgtgacctgtcatttcttataatccatgttctcgttgttgtggattgaggcaatattttgtggaagatttgtcattgggtagtaacttctcgcagagcaagtgcagtaggatgatgtgtgaaagaggaacagggagagaagaaaagccagatgttcatgaacagacttgatattttgtaag

SEQ ID NO: 9465 - DNA, 1867 bp, Zea mays
ataattggaagagttcgagttgcttgattgcttctgcggatgcgcttcccccatcctcacccaaaacctaccggcaaaacctacagcccttcgtctcccacacgcactctgccactcatctctaggttgtgtacgatcatcagcgagaggagctccctcgcttatttgtctctgaaacagacatcattgcttcagttagggaatgaagggagattccagcagacaaaatagcttagaggacaactcacaaatactaagtgcatttccaagggaaccaaagctagaattcctaaaaaacatcacgaaagacttctcaagtgaacgagtgattggacatggtgtctttggagtggtttataagggcatacttcagaatggacaactggttgctgtgaagaagcttgtgcaaacatccggagttcatgatagacggtttcagaatgaggcaggcaatctccagtttctggagcacagaaatatagtcaagttacttggttcttgttaccaagtagaaaagaaattggtggagagaaacaacaaacattttctagcagatgttccagaaaagtttctatgctatgaatatctgtctaatggaagccttgacaactatatttacgatgaatcttctggaattgattggaccatgcgcttcaaaataatcttggggatatgcaatgggttacattttctgcatgaggagcgaagtgaagccatagttcatttgaaccttaaacctagcaacataatgttgggtgacgacatggtgccgaaaattgcagattttgggctttcaaggttgtttggtgaagaacaaaccagaactctcaccaaaaacgttgtgggatggataggatacattgccccggaataccattacagagggagaaatatcagttaagtcagacatattcagtttgggtgttcttattcttgaaatagtgacaggactgaagagggacctcaatattcaagacatttcttctgagttactaattgacaatgtatctaaaaattggacagaaatgtcgcatatagaatcaaagtatccatccttggaagaacaacacctactacaagtaaaaagatgcattgaacttggtttgaactgtgtggagtctgatccaaagaaaaggcctactgtaggatcaataattggtaaactcaaaggtaaaggaactggttcataaaaccatttattcatttgaggatttaatctagaggctttgttgaatcatagtgataattccactgtgtatactccacctctagagttaaatatgtgttctcttgtttaaaatggaatatgttgtggcagaaatcagtcatgaagctagcatacacaaatttatggagaagaaactgcaactgataactgaattcccaagggaaccaaagctacacttcatagaggttatcacaggggactttgccaatgaacgtgagattggtaaaggttcttttggggtagtttataaggtataatttaatttccatcaccatcaatttgagaaaaaaatacgggacatactatctgaatattcctctgttactaatgatatcaattaatcagggagtgcttcaaaatggagaagtggttgcggtcaaaaggcttttggtagttgcaaaaactaatctggataagcaatatctgaatgaagtatctagtctgattgatctcaaccatagaaatatagtgaagctatttggatattgtaatgaaatacaacggaaactggtggagtcccatggaacatatgtttttgcagacacagaagaaaggatactctgctatgaatatttgcctaggggaagccttgacaagtatctttacggtattctactctctcattccctctctggttgt

SEQ ID NO: 9466 - DNA, 1750 bp, Zea mays
  misc_feature (710)..(710): n is a, c, g, or t
tccttaaatacgacctccaaatatagcgactttttaaatatccctatttagtcccctagggtgtttggcactcccaatcgcctattttatgtgtcaattgcactgagaaatgacttgtctgacatcgagttcgtgctcgtgtacaagtgatgcactttaaataatttgagctacaaaaaagttgattccatcatcctcgtttgagaagtcagaagataacctatcaaaaaatttagagaaaaacatataatcctgattcatatgaataaaaataatattcaacagaaaaataatgaatattgaattttatcgtacaaacggaaccaaatttaaatctgtaagcaaataactataaaaactgagttagcatgatttaaaaatatttaacaacctaagaattaggaaccgttgaaggctagagttattttttgttcatcgtataatctgagtttagggagcattttataggaactaatggagatgcgagaacgacctgccatgtattgattgatgccgtcgtaatcctctctctacttctgtgtgagtttgtttggatcccatgagcttacaacgggtagataagaattagtttgaaacttgccactagctaaaatttagctgtcaaaatatagccgttaggaatcaaacagggacagctaaactttagttggaggccaacaaatacatatcatcgtctttagctataggcnattcatgatacccccaccaaaccgaattcccagctcaccagaagaaactgaatttggaagagaaaaaaacgacaaaggaagatataaatgagtgccaaaccacggcggcggtgcattgaaaatctgccgtttttttttctctccacaagaacagaagccaaaatctgccgttttttcaaccatatatatattacacgttacgagtagtccatcaccagggcacccaccacggtacactctcctatacaaaaacaaaggaaggaacagaagccatgactagcaacaagaacactgccgccgccagggcgacggcgacggtggcggtgttggtactagtagcggcgacgctcctggcaacggtggcgaatgcacggccttgcttggacggcgtgctgcctccgtcgacgacgtcacatggcgtggttggggatctgctgccgcgtaagatcatcccgccctctgggcccagcgacttctggagccccgacgacgagccgtcgccgccaccgcctgcggaggcgacagtcgatcgcggtaattgagtgtgaggaggagtggtgatggatgagaaatgctggtgatgtataatgccatttgcgagaacgagcttgaataatcaacaagagcgcagggtcttgatcatttcccttgtgttttatatatcatctcgatctaaatgttctccttcgtttgtttgaaaattaaaaaaaaaaaaacggcctggggcctgattctttttgttatataaaccgagccaactccttcgtttccatcttaaattgaaacgcagatcccctacggtcctagtcctaccgattattatgatacgttttctataaggaaattaaatattcttgccgttgcgagtagagatgtcaatggagcctcgtcagatttaaacatccttgctgttgggagtagaaatgtcaatggagaggtttaaacatcccatacccattctcataaacctatacatatccatatccctatccccatcatggatatagaattcatccctacacatctccattcgagtatcc

SEQ ID NO: 9467 - DNA, 810 bp, Zea mays
cgccacgcgtccgcccacgcgtccgcccacgcgtgggcggacgcgtgcgtgcaaacaccagttttctaccctaaacacaagaacccagatgcataataaaaggtgaaagctagcagaagaggtacctaactctaccctactatagagaaaaagtcagcacattgcaagcaataataatggagacgacgacgaagctccggtggagccggcccggctccttcctcctcgtcgccgcggcgttcctggcgtccgccgccgcgtcgggcgtcaacgtcggccagttcgacgaccacttgcagaagcggaaggagctcgccgaggcgtcggcgagggaggcgtacaggcccgacccgtacaacgtcaccaacagcttcaacgccgccgtccacagagctgtcagcagcagtcggcgtgagatgcgggagaggccgaggaagcacaagaagaggggcccgtgccgggcgacgaaccctatcgacaagtgctggcgctgccgcagagactgggcgacggaccggcagcgcctggcccgttgcgccagaggcttcgggcacgcgaccaccggcggcctcggcggcaagatctacgtggtgaccgaccccaccgacctcgacgtggtgaacccgcgccccggcacgctgcgctggggcgtcatccagcccggcccgctgtggatcatcttcgcgcggtccatgatcatccagctctcgcaagagctgctcatgagcagcgacaagaccatcgacgggcgcggcgcgcaagtgcacatcgccaacggcgccgggatcacggtgcagctggcgcaaaacg

SEQ ID NO: 9468 - DNA, 1491 bp, Zea mays
gcacgagaccattacctagaacatcctaatcaaaatctaatgcatctcgaatgtgctatttatcaaaaataaaagatattgaggaactggaagcaaaactgaagtacaacttctcggtcaaaggccttctgcttgaagccatatcacatccatctgtacaggaattaggagttgactattgttaccagcgtctggaatttcttggtgattctgtgctggatctattaatcacacagcatctctatgctacccacactgatgttgatcctggagaattgacagacctgcgttccgcttcggttagtaatgagaattttgcacaagcagttgtaagaaacaatattcataatcatctacagcatggatctggaatacttttggaacaagtaacagaatatgtcaggtccaacttggagtaccatggtaaagagaatcaattccttcaacaagctacatgcaaagcacctaaggttcttggagacatcatggaaagtattactggtgcaatatttatagatgtaaattttgatgttgatctggtttggaagattgttgaaccgttactttctccaatgattacccctgataagcttgcgttgccaccttatcgggagttgctggagttatgtagtcaccttggttgcttcatagagtcaaaatgtactagtgaaggagaagagttaattattgagatgaaggtgcagttgcgagatgaacaactgatagcacaaggacatgacagaaatggtaaaaccgcaaaggcaaatgcagcagcccgaattttggtcgacatgaagaaacggggtctctctcttaaacaatgcatctcgaaggctaatcaattggatattgtctcttcaaaactgcaatcagaattgacaaatttggaatcgcgacatgattgtcctcacatgaatggcactcttagcctaggtatttcctcagcgagagcagcagttgttcttcctctcaaaatggacaaaggtggacctcggactgcactttttaggctatgcaagagtttacagtggccaattccagaatttgaatttgtggaacaaaggtttaggactcctattgttctggatggggttacaactacaaacttcaatagcttcgtttcaactatcaccttgcacatacctgatgtgacggtcattacacttcaaggtgagccccagactgacaagaagaggtctcaagactcagcgtctctgctaatgcttaagaaattcgaagaactcggagtctgcgtatgcgagacgcagccaagcaacatggataataataataataatgccagttaatggacaacactgattaatgttggggttactatctccctcccaatgtgatttctgttgaaaatgtttgtgagacactcgagactccgtaaagtatttgctggtacagtacattgccatttattgacttagactgagcttaccaatatgaataaatggagatgcaaaacgaaaaaaaaaaaaaaaa

SEQ ID NO: 9469 - DNA, 2853 bp, Zea mays
gagttttagtttctttatttaaccaatttagagaataaaataaaataatttggagagactaaaatttagtccctagaaaaattaaacctcctctattaataaacttgtaaccattttgcaaactaactcgccaatctgtaattagtcccagcatttgaacgatgtgccctttccatcggcctccgcccctgcaactccagtttgaactgtagggaggaaatctaaccgcgggccccaccatgtaactaactggccaaccgacttatcagcagctcaggatcctccctacaaatacccgtgccgcctcaccaatcgggtaatccttccactttcaaacgatcgcaacacaatccaaagaacgacgcgggggagcgagcgataaagccagaacaagaggagcgatccagaggagaagacgaaagagtcaggggagctgctaaggaccgatggccgaccccagctattggatagggatggacatcgaaacctccgtcacgatgctcgtcatcggtctcgccaccgccgtcgtgagcgtgtgcctcttcttcattttcatgtgcatcgtgcaatggtggtactcgccacggatgcgcgtcttcaggctcggcggcgtcaccaccctgaggcagaacctggactacacctgcaccctgtgccaaaacagcatggaggccggcgagaaggtccgcacgctctcctgcgaccacgtgttccactgcggcggcagcgtcaagtgcgagggaatcgaccactgccttcgcactggaccgatggagcgctgcccgacctgttaccgggttccccatcccgtgccctggaagcggacaccgccaccgtcgccaccagcacctacaccttcacagggagcattggcggcagcgctaccacctttgcggctcccgttgtcgacgcgggatttggacgaggcgctgctgcgttgggagcaaatccagaaactagcggaagcgtcgtcatcagcatcgctgcatcggcgccacccgcggacgtcgacgtcggacaaggaggaggtgttgccgcttccggcggacgacgagatactacctgaggcgccgtcatcgcagtagacacgcgtgcgtgatcaagcctggatgggacggtgttgacacagcacgtcctgtgtgcggcgatctcgaactgggtcagttcgtggagatgttcttctaggattctttcgtcattttgttttctgcttcgttgaaactgatcgagggtagtgcgtctttctgatggtcagagactcaggaccagttcatcaagtactccttagttgtttccgcttttgcttccttcgaactcatcgagcttagctgcgttcctgctcttttgttaggacttcagagttgagtccaccttaatgaaccaaatgtctgaatgccaatgaacgatgacttgttagttcttacatcagcatgaatagatccttggttttcattgctcttatactctgtctcaatgtgagaatgatttcagtaaaaaaaaaaaacaaaatggtttgcttatttcttgcttgacatcagttcatatgctttctcgagagccaaaaccttgtaggttatgattcatagttcgctgcttgtttgctttatatcgcgtttatttcgttcttgatattgccggtattatacatttatgaatatatgataactgaagatcattatactgtataaccctctagtcttcagtttttttcactgtatgcaacgcctaatcagtttgagacattagttgaatttcaggacgatatgagcaggttttgatttaaacctgaatctccttgtgatatcttacgtgtgatgccatgattatacctgcatattgttcctaatttgctgttgccgttatgtcttttcagtttcttgtgtaggaatagtagcaacaaaatgctttactgaacattttagttctgtcaggttctgtgcttatgaagcaaacatcaattttatcagaacaggaactgtagcttagttcacaagatttacagaaggactaatcatatgttcagcagcaaaaattggaggtttttttggcctttttagcactcaataaaaaactaacagagtacggaactactgtcatgcacagatcagctgttgcaagaactagaaaacatggcaaaaagtttataccaaaatttgcacactggggcacgaggaaatggtacaaagtgccaaaccaattaacgagaatctatctattagttttcatcagatgataggaactgagccaagaactaacagatcattgcttagttcatcacaagtggacgtagatcagaaaaaaaagaaacaaactaagtttgatcagttccgagaaaacaaaaaacagaagtaacaaaggactccttcgatcagttccaagaagacatagaaagaaacgactaatgaatccttaaagaatctttcgaagaattgatccatacgggcccaaaagacgccaacactgtcccatcccatccaagcttgatcatgcgtctttattagttacgacttacgaccgagacccaaactgtagcgcgtcctggaatcatatcgacgacggatacagctaccgcgcgtcttggaatcaaaaaagacgtcgacgactgcgagtgtgttggcacttggcagtggcacgggcgcgggcagtggcgccaatgtcgtcagcgctttccacggcagcacggagtggacgggcttgcagcaggtggggcagcgcatgcggttctcgcggtgccagtcgtccatgttgctcctgcacttgcggaggtggaaacatcaactagtgcatcgttttttaatactgtacgctgagttaatttagaagaaatatagttatgttttgtaaaaatatgac

SEQ ID NO: 9470 - DNA, 1228 bp, Zea mays
aatttttttggtcagccttccactttcaaacgatctcaacacaatccaaagaacgacgtgggagagcgagcgatagagccagaacaagagcaagagaggagcgatcgatcgagaggagaagacgaaagagtcacgggagcgaaggaccgatggccgacccaagctactattgggaaaacatcgaaagccccgtcgtgctcgtcgccacctttgccgccgccatcttcatgtgcgcgtgcctcgccttcattttcgtgtgcatcatggaatggtggcaatcgccacggatgcgcctcttcaggctcggcggcgtcaccaccctgaggcggaacctggactacccctgcaccctgtgccaaaacagcatggaggccggcgagaaggtccgcacgctctcctgcaaccacgtgttccactgcggcggtagcgacaagtgcgagggcatcgaccactgccttcgcactggaccggtggagccctgtccgacctgtgaccgggttcctcatcccgtgccgtggaagcggacaccgccaccgtcgccactacctataccttcgcagggagcatcggctgcagcgctaccacgtttgcggctcatcccgttgtcgacgcgggatttggacgaggcgctgctgcgttgggagcacaaccagaaacgagcggaaacgtcgtcatcagcatcgctgcatcggcgccacccgcggacatcgacgtcggacaaggaggaggtgttgccgcttcccgcggacgacgagatactacctgaggcgccgtcatcgcagtagacacgcgtgcgtgatcaagcctggatgggacggtgttgacacagcacgtcctgtgtgcggcgatctcgaactgggtcagttcggggagatgttcttctaggattctttcgtcattttgttttctgcttcgttgaaactgatcgagggtagtgcgtctttctgatggtcagagactttgtttccgcttttgcttccttcgaactcatcgagcttagctgcgttcctgctcttttgttaggacttcagagttgagtccacaccttaaagaaccaaatgtctgaatgccaaggaacgatgacttgttagttcttacatcagctataatgttccgacaaaagcatgaatagatgcttggttttcattgctcttatactctgtctccatgtgagaatgatttcagtatgaactgttggcagcatggtttgccaaaaaaaaaaaaaaaa

SEQ ID NO: 9471 - DNA, 1991 bp, Zea mays
cccggcgatcctctagtttcgttctgcagcggcgaactctatcctaaactgcatcaagcccgacgcaccttcgaactctattcctagagacttggcgtttggactccatcttctctctcacatccacggtggcagcggatcgttggtcccgctgtggttcggatcgcagggccactgtagacgtgagttggtatttgaaaataaataatagaatatgtggtagttggtatagggtagagatttagggtaaatatgagtgcggaggattgtggtatagagtaaagaattttgttgaccaggacagaacattcttattagggtagaaatttagagtagtatgagtgcggatagcctaacaggcagttccgtacgcagtatatgtacaagttcggagatttccgggttaggcgtcttccaagctgaattcacggctcacctttcgatcagtcgattccctaccgggaaagcttaaagctcgtgtagcaccttgccatttgctttgccttccatgtgacgcgatcgtcacagccagcggagagagacagacatttccagctgctgtgcgtacatgcgtgtgcgagactgacgacaaaccgcgtaccccgaaatcgcaaggaaaccgccgcaccagcgttcagagcccaatgagtctggaagcctgcttggcccaatcccccgctgcgcaaaagtgcaaaccgaaaccgaagtcagtggcagaaacggcccttatccacacacacaaaaaggtactacgcgacacaagccacgctctccgcttgtggctaagctgctgcacgcgcggaccgacaaaaatccagcactagccaaagcacaggcgaagcagcagcagcgagaggccaccacaaacatggcgaccacggcgtttctacccccggccaagctgccgctgcaggggcgtcggttcgctagccccaaaacggcgggacgtatcagtgtcagggtccctccggcgcgagcgcagcaagagcagcaggtgaaggaggaggaggccgaggcggcgagcgtgccgccgccgcaggccgcggagaaggaggcgaggaagggggacgcgcagtccctgccgcggcagcctttggcggagagcaagaacatgagccgcgagtacggcgggcagtggctgagcagcaccacgcggcacgtccgcatctacgctgcgtacatcgacccggtgaccaacgcgttcgaccagacgcagatggacaagctgacgctcatgctcgacccccaggacgagttcgcctggaccgacgaggcctgccagatggtcttcaacgagttccaggacctcgtcgatcactacgagggggctgagctgtccgagtacacacttcggctgatcagctccgatagtagataaaaaaaatttgaattgaatctcttgttgtctgaaattcgtacggtcatttccccccttttcatctactttagagccactcctgccaaaaaaataaaacatacggtcttggcaaaagaagtgatcggtaagaggatagctgagctcgtttctgctttgaaacagggggctgagctgtcggagtacacacttcggttgatcgggtcagaccttgagcactacatccgcaaactgctgtacgacggggtgatcaagtacaacatgaggtccagagtcctcaatttcagcatgggcaagcctcgcatcaagttcaacagcaaccagataccagaaaagatatagaatgtacttatccaacaccctgaaaagaatggtttctctccattcgattaccgagcaagatgtatactctgcagtcccagatacgatccagagcattccagaattcatattacgcagatgcaaagccatacaccgattctgttggcaaaataagggtttgctcgagtttagataccccttctgtttctagggcactcgaattgggttacacgataccatagtttctgctaatagatacgtatcaccgaagaaaaaaaaaaaaaaaaaagcggcc

SEQ ID NO: 9472 - DNA, 971 bp, Zea mays
ctacaagccacgctctccgcttgtggctaagctgctgcacgcgcggaccgacaaaaatccagcactagccaaagcacaggcgaagcagcagcagcgagaggccaccacaaacatggcgaccacggcgtttctacccccggccaagctgccgctgcaggggcgtcggttcgctagccccaaaacggcgggacgtatcagtgtcagggtccctccggcgcgagcgcagcaagagcagcaggtgaaggaggaggaggccgaggcggcgagcgtgccgccgccgcaggccgcggagaaggaggcgaggaagggggacgcgcagtccctgccgcggcagcctttggcggagagcaagaacatgagccgcgagtacggcgggcagtggctgagcagcaccacgcggcacgtccgcatctacgctgcgtacatcgacccggtgaccaacgcgttcgaccagacgcagatggacaagctgacgctcatgctcgacccccaggacgagttcgcctggaccgacgaggcctgccagatggtcttcaacgagttccaggacctcgtcgatcactacgagggggctgagctgtcggagtacacacttcggttgatcgggtcagaccttgagcactacatccgcaaactgctgtacgacggggtgatcaagtacaacatgaggtccagagtcctcaatttcagcatgggcaagcctcgcatcaagttcaacagcaaccagataccagaaaagatatagaatgtacttatccaacaccctgaaaagaatggtttctctccattcgattaccgagcaagatgtatactctgcagtcccagatacgatccagagcattccagaattcatattacgcagatgcaaagccatacaccgattctgttggcagaattttgtcacccctgaacagtaataaccacataacgagaggctgggcaagacaaggggttgcgctcgtgtgttagat

SEQ ID NO: 9473 - DNA, 2948 bp, Zea mays
tcgacctgcaggtgccagtacaaattttggaccgacgcatgatctctcgcggaggtcaacaaatttctcagattctgattcgttggtgctatcttgatgtggtgttgtctacttgagaggatgaagaagctattcacgccaagttccctgtagcagccgcttgtgggcaagcaggcttttaaggtggggggattgtcagcagccgtgacgatggtgtatagaaggaggcaactgattcaagcgccggacaactgatttcaggagcagaatggattaattgattcatgctgtcgtgtttgtgataaatactagaaagtattagttcctgcgcatttttgatcattagtaatacagaactcgagtcgtgtaggtcggcaagccgtcggcaaccaagagtgctgacaacacacaacagtcgaacaatttcaccggcgggcggcggcggccaccagcgcgtcgccgcgacgttagcgcttgatccggcggcggcgactcagcccctttctctcccccaacgctcaaatgccaccgcgcgccttgcccactacctccacacccgcatctaggcgcgtcgtctacgtcctcctcgcggcgctcgccacagcgccgttcctgctcctcctcctctacagcggcgcctcccggtctgcgctctgtcccacctcctaccgcgcgccccgccgcctcccgtacccgtccgtgctctggtccaaggtgcccccgctccccgcgctctccacctcgccgcacccggacctccgcggctctcgctggatcgtcttcaccgcgtcgccgcacgccccgcggcaccgcccgctgcgcgcggtccccgggtggcaggtcctcgccgtcgccgacgaggctacccccgcggactggtcccacccaggtgccgtgctgctcacgctcaccgaccagggccgccttggattcagctccgtcgctttccttccggcccggggcccggcgcgcaaggcagcggcgtacctcttcgccgtgcagcgcggggcgcgggtcatctacgacgccgacgcgcgcaacgccgtcctgggcgggaacctcaccaggcacttcgatgtggatctggaccagcgccacggaggcgccgtgctgctgcagtacagccacgccaatcctaaccggacgatcgtgaacccgttcgtgcactttgggcagccatcgatctggccgcgtgggctgccgctggagaaggccggggagctggatgctgaggagttctacactgagatattcagtggtggccaattcatgcagcaagggatgtgtaatggccttccagatgttgattcggtgttctacttcactcggaagtcattggagatggaggcatttgatttccagtttgacgcggatgcacccaaggtcgcgctgccgcagggcatgatgacaccagtcaactctgttaacacattgttccactcgccggcgttctgggggcttgcgttgccagtgtcagtgagcccaatggcatcagatgtcatacgcggatactgggctcagaggatactatgggagattggtggctacctagttgtctacccaccaactgtacaccgcatagataacgtgcgtggtcacccatttgatgaagagaaggatctccatgtcaatgtagggaagctgataaagttcctaatggagtggcgatccagtaagctgacactattcgagcggattcttgatctaagctatgcgatgacagaggagggattctggagtgagaaggatttgcatttcatgactgcttggctgcaagatctggttgctatcgggtatcgacagccacggttgatgtcattggagattgaccggcccagagcaaccattggacatggtgacaagaaggggtttggtcccaagaagctgccttcagtgcatcttggggttgaagagattggggaagtaagcactgatattggcaatctaataaaatggaggaagcattttggtgatattgtgctcatagtgcattgcaccgaacttgtggaccgaactgcattagagtggaggctgctttatggtcggatatttcgagcagttgttgttctttcagagcaaagcaattctgatcttgctgtggaattcagcaacttgacacaagcctacaagtacttgccgaaggtgtttgatcggtttggaggtgcccaaggatttctgttccttcaagatcgtatggtcttcaattactggaacctcttgaatgctgataaggctaagctctggataaccaaccaggtgaaggaatcttggtcggatgtgcctctacatggtaacaacattgagtggtttgtgaaccaaggggatatgattaaaaaggcggtcagcaattttccatctcaatatcaagataattacaggagaagtgtaggtgaaaataatctgattcgttgcagcagtgagatattttacgtacctcaacggtacacccgtgatttctcagatcttgtaaaagttattgggagcttagacattcatcacagttttgcagtccccatgttattccttgcgatcgattcaccgagcaactttgagtccaaagctttgacaaaacttgtctacagggcagatcttccatcagatacaactctttcaacaatttatactactgaagcacatgcagtgtaccctgtgaaggttcagaacgagatggattttgtaaaactgataagggctatggctttaggagatccatttcttatggaattggtctgatctaggattgcctctcttttttaattcgtcaggttggcgatagaaaacaaaacaacgagataatgtttggttcgtctttgtcctcccttcttccatatgaggatgaggataatctagtgttactcgatctcagtttacatgtacaatcagataatacaggcttactttgttgagctaaaaaacgaaattccgaaattcatggtgttattttgttg

SEQ ID NO: 9474 - DNA, 1493 bp, Zea mays
actcccagctcaaccatttccacggacgcgtgggcgaggctcggcccattccttgcccacgtcatctctctgtctctccctctcatcgccgcgtcacgcacagccgccgccgtcgtgcgcgtgtgccggaacggccgcgtggatcctccgccccgtcccagcggcgacttgtccgtgcgaagatgctggggttctcgaccggacagctgctggtcgtcctcggggcctgctccgtcatgatgaagcccagtgatatggtgaagattgcgaggacggccgggcggatgactggaagagcggttgggcggctcatagtggctcgccggcagctggacgagattctgggccagtctgcagccacccaggttcataaggagcttaaagacgctatgacacaattagactcgatccgttatgaagtccagaacttatcaagattatctcctgggcagtttatgttgaagcaacataacgctggcatggctgaagcagggaaatctgactcctctgatggtcctacaaccaaccaagaagaatttcgtcaggaaattcgcagtataattcgcgatgaatttgaaaaatactgtagaacacagcccattcaaaactctgtgagcacaactgaacacagaaaacttcatgtggctgatgaaccaacggcactgaaatccaaggacatgaagatggctaattcaggattgacaaatctgcacaaccaagcaatgacgtatgcaaggctatctgaagccccaggacttaagatggattcttccttgagtgggaactacaaagatcaatctaaggagatggatgggctgctaactgtactgccaatatcagctgaaagtgctggattacttccaagccgcccagataaaccaacaggctcagatctagtccttgaggctgtgcttgaagcggaagttgcggagaacgctaaactgtttgtgtcgcagcctcatgatcagctacctaaggaatgaagacgaagatgatgtgcttgaagacgttgcaaacaggaccaaactgttcagctgacagccgcatggtcagttgcctacggagcgatgatggtagtttttgatccttaacaggatttggcatactaggcctgtttggtagagctctagaagttgatataccgatctggcgtccagcaccagcggtgtagcttgtagtcttgtaccctcaggcctcaactagccagctaggattcggatgccatggtagaaactggcgacatagcttgtagcctcaactagccaggtaggtttggctgccatagttgaggtaaagctgtggccggtgggcacgtagcttgtggcctcaaaaggagcaagaaagaaaaatagagtaaattagttgtggttatcaatgtgcatggtgattttaaagcttttaaggatgtcatctgtattctgtgtcctcgcaacactgatattctttgcaactctgagtagagagatacacggaatgttcagcttttcagatcc

SEQ ID NO: 9475 - DNA, 1404 bp, Zea mays
actcactccggcgggtgggtccctccggcccggccgggattcacaatcacaccaccacctttaccaccgaagagagaaacgcgagcaaccagcgatcgccccatggccgccatggctcgttccgtctccctcgtcgtggcgcccctgctcctcctctccctcctcgtctccgccgcggccagcgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacgtggaggaggccgtcgcccacctcaacggcctcgtccgggagcccaccgacgccaagttcctcgagctcaagtcgtggctctcctccacgctcggcggcacctccacctgcgaggacgcctgcaaggacctgcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatgctccggcggcggcggcctcatccggtccctctagcgcaccagcgccatcgtcgtcgtctgagtcctccgccgcaccaggcccatcttctgatggcacctccagcgccccagcaccatcgtccggcgacgattctgattccgacgacgatgggtcagcttgagcctgaccgatgacgcgggtttgggttaccggtgccactcaaaatacgatcccttttattgtaaaagagggatcccttctttccattgcattcttgcaatccgtttcttcttgactatgtttcttcttgactatgtaacgataataacatgagaaaattatctgaatgacattatattttttctaaagcttaaaaaaaaaaagaaaagcgcccaattaattctttctataccacttaaatgtacttttttattatttcttatcattgctggtgatatagaagagtaaaataattgtatgttctaatttcttgtatggtactcatgatcacatagaaatataagaaataacacccgagttatatacttatataaaaaatattatgacatttgcgatggtaaatacc

SEQ ID NO: 9476 - DNA, 1534 bp, Zea mays
cataccgagagaatgaagacacctgtcgtagaagtcacataacttatttggaaggctcagcatgtgttgcggatggcacgttccacttctagtcttctcctagaacggcggtatgccacatgcaagtgcccggcccgggagaaccagtcgtttggcccctggacgccttaagttcacaaatcacacagatatatatagaccatccgcccgccacccgccgcggcaccgccacctttaccaccgagagaggaacgcgaacaaccaacgatcgcctcatcgccatggcacgctctgtccccatcgcgcctctgctcctgctccccctcctcctcctcctcgtctccactgcgtccgctgcacggaccgtgggcgacaccgtgcaggacgcgtgcagcaagacacaattccccaagatctgcgtggacagcctcaccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacgacgtcgaggaggccgtcgcccacctcaacggcctcgtccgggagcccaccgacgccaagttcctggagctcaagtcgtggctctcctccacgctcggcggcacctccacctgcgaggacgcctgcaaggacctgcccaagaacggcgacaaggacgacgtcgtcaacttcagcctcgacttcgagaagctgcagcgcgtcacgctggacctcatcaccgaggcatccggatccatgtccgcaggcatcgccctgccaccctccaacgccggagcgccctcctacggggcggcggcgccgttcggaggtgccgcggacgcacccgccggcacctccgagggccctgccagcgccagcgggccatcagctggtgacgcgccggcgtatggcgccagcgccagcggcccgactgctgatgctccggcggcggcggcggcggcggcgtcgtccgggccctctagcgcacccgcgccatcgtcgtctgagtcctccggcgcaccagggccgtcgtcgtctgatgggtcctccggcgccccggcgccatcgtcgtctgatgggtcctccagcgccccggcgccatcgtccggcgacgacggatcagcttgagcgtgagcgatgacgcggagtttgggtcatttcgtgcctactcagagacgacgatctcttcttccaattacaaattggccgtccgtttactcctcacaatgtgtaatgataataacggatgctactacgtaccgtacggataatgggtacgtagctacatgaagctgtctacggataatgccgtccgtttactcctctcacatgtttaaaattttagtttcgtttctttcaaaaaaaaaaaaaaaaaaatattcccagacccaataataaagaacccgacagacaatgcaacaacctaacaaaatgtaatatatatatatatatatatatatata

SEQ ID NO: 9477 - DNA, 1401 bp, Zea mays
ctgtcgtagaagtcacataacttatttggaaggctcagcatgtgttgcggatggcacgttccacttctcgtcttctcctagaacggcggtatgccacatgcaagtgcccggcccgggagaaccagtcgtttggcccttcgacgccttaagttcacaaatcacactcctatgggcgattgggtccctcgaggccggccgggatcgccacctttaccaccgagagaggaacgcgaacaaccaacgatcgcctcatcgccatggctcgctctgtccccatcgccgtcgccgtcgcgcctctgctcctgctcctcctcgtctccactgcgtccgctgcacggaccgtgggcgacaccgtgcaggacgcgtgcagcaagacacaattccccaagatctgcgtggacagcctcgccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacgacgtcgaggaggccgtcgcccacctcaacggcctcgtcagggagcccaccgacgccaagttcctggagctcaagtcgtggctctcctccacgctcggcggcacctccacctgcgaggacgcctgcaaggacctgcccaagaacggcgacaaggacgacgtcgtcaacttcagcctcgacttcgagaagctgcagcgcgtcacgctggacctcatcaccgaggcatccggatccatgtccgcaggcatcgccctgccaccctccaacgccggagcgccctcctacggggcggcggcgccgttcggaggcgccgcggacgcacccgccggcacctccgagggccctgccagcgccagcgggccatcggctggtgacgccccggcgtatggcgccagcgccagcgccagcggcccgactgctgatgctccggcgacggcgacggcggcggcgtcgtccgggccctctagcgcacccgcgccatcgtcgtctgagtcctccggcgcaccagggccgtcgtcgtctgatgggtcctccggcgccccggcgccatcgtcgtctgatgggtcctccagcgccccggcgccatcgtccggcgacgacggatcagcttgacgcggagtttgggtcatttcgtgcctactcaaagacgacgatctcttcttccaattacaaattggccgtccgtttactcctcacaacgtgtaacgataataacggatgctactacgtaccacggtacggataatgggtacgtagctacatgaagctgtctacggataatgccgtccatttactcccctcacatgttttaaattttagtttcgcttctttc

SEQ ID NO: 9478 - DNA, 4651 bp, Zea mays
tttttcgaaaactttgaccactcgtcttattcaaaatatttatccaaaaatgtaaagtttaatcaaagcacaaactactttaggttaaacaaatcgcaagaaaataaatgataattcatttttttaatatatatacgtgctagtacttgatatttttctgctacaattttgtaccgggcctccatatttgtcggcacgcctcacagccttagaagtaagaccggtttcgtttaacaagtataatggtctggaagtatatttttaaaattcacgaacctaaataacatctcttaacgaagctaatgcaattgctgtggaatatacatgcgcgcagtgcgtgggtcggatgataagcttgggaagtgaactgttctctattcaggtccaaggctgccgtgcgatttcaacggacagatctatgcgatgacacaatagccgacccgctacggctaactggctaagccgcctccagaaagtagtcggtgagtgactaacgttgaatcgcacgtactccaacccacaccggcattgaaaaaacgcggcacatggctcccgccgataatttttttttaaatacaaaaatggccatcgccgagattgcatttgcatataagcacggtttcaagaggcggcgcaagacctgtagatcgatagcggtgagcggtggcgccaatggaccgcagggcgcggcgaagcgggtggccatcgtgggcgccggcacgagcgggctcgccgcgtgcaagcacctcctggcgaggggcttccggccggtggtcttcgaggcgggcgccaccgtgggtggcctgtggacgcgcacgctcgcgtccacccggctgcaggcgtccgccgggtaccgcttctccgacttcccggcgccggcgcgttcccgcgccacgaccaggtcgtcgagtacctggccggcatgttcgtggcgccaagggtgaaggcggtcgtcgccggctcgtcgtcagaggtcagacaccagcagcgtcccgccgctctacagggagtgcgtgcaccctcggatcccgcagatggcggtgatcgggtactcggagagcctgaccaacatctactcgatcgagatgatggccaagtgggtggcgcggttcctggacggcgcgttccggctgccgagcgtggcgcgcatggagcagagcgcggcggagtggggcaggtacatgagacggaggagcaacggggggagctcctgcctcggcgccgtcaacatctggtacaacgaccaactgtgccgtcaaccccaggaggaagaagggcttcctcgccgagtggttccagccttacggcgcggtcgactatgcagattgagagtgagaatggaggttttcatcggagtccgagggtgttccgcttgtgcgtcgtgcgcagaatgctctaggcagtataaatcacctaccacattttttttctttttcagacaaattcgtgaaaacttgtactacaattttgagtttattggatcgacttggaattaagacgaccggacggggctggattggagttggagatcatcttgtattgagtttagattagatgcggttttttgtttttattggatttcagttacgctagttcagagtttacgagtaaatcagcataaaaattgacatgaacaactaaaatagggcgttattaccaatagaaaatgggaatggatccaaatggctgcggtgatcatgtcagatatcaagctagttggtgtgcaccaagccaccaacaagtccaatgctgacaacatcacctatatttatatctaaatgtgccttctttaaaaaatgaaacagtaaagatcagatgccatgtagatacagatatttaaaacagcacactggttgagagttgagacgctgacagaaatcatccaggatgcggatgcaaccaaagaaaacggcgagtggtgggtgttcacttgtttgccctttagccccatccgaaaatatccagcatctcaaagaagaagaaaaaaatctaactttatccagcgaatcaaacggaaaaggctgtataaaagccacctgcctccctctcacagctcctccctcccaagaactcggaagtcggaagcagagcaagggatggatagcaagtcggtgggaatcgtcggcgcaggcgtgagcggcctagcagcctgcaagcacgccctcgacaaggggttcaggccggtggtgttcgaggccgacgggagcgttggcggagtgtgggcgcacaccctggagtccacgaggctccaggcgccgacgacggcgttccggttctcggacctggcgtggccgccggagagcgccagggaggcgtacccaggccaccgcagggtcatggagtacataaggtcgtacgcgcgtgcgttcgacctcctcaagcacatcaggttccacagccaggtgctgggcgtcgagtacctcggtgcgaccgaggaagaggtcatgggctgggatcagtggtccggcgatgggacggcgttcggagccgtgaagggtggcggatggcgcctcaccgtccaggacttgaaagtcggtagcactgaggtatgtacgtgtactctcctcggacggatcatctgtgtcacagtcaaagagagtccagattgttcattgctgttgtttccatccttcgtgtctcaacctaaattacaggtttttgtggtggattttctcatcctgtgtattggaaggcacagtggaaccccaaacatcccagagttcccagcgaatgggcctgagctgttcaaggggaagatactgcactcgctggactactcctacatggacgacggcgacgctgctgagttcgtgagggggaagcgcgtgacggtgatcggctccggtaaatcggcgttcgacatcgccgcggaggtcgccaaggtgaacggtaggtgtccagaactagagctcgtctgtctgatctcgccgttctcaagagcatgcatggtgtggtggctaacaattcttgtttccatgaaggtgccgcgcagccatgcaccatcgtgtacagaacaaggcactggctggtccacaagtccagcgtgtggggagtcgacctcagctacttctacctgaaccgcatctcgcagctcctggttcacaaacctggtgaaggattcttgcgctgcatgctggccgccgcactctctcccttggtaagtacaaaagatcaaatagagagcacattcagacagtaagctgtagaatgtagatagcttaaaatctacctgtttgttttgcttcagagatgggcgatctctaaagcgatcgaaacgtactacaagtggagcgttcctctgcggaagcacgggatggtcccggactacagcttctccttcgccatgtcctcgtgcctgatcgcgatgctgccggaaggtttctacgacagggtcgacgaaggcagcatcgttctcaggaaatccaaggcggtcggcttctctagcgacggagtcgtcctgcgagacagaaacgaaagcgtgagaagcgatatcgtgatcctggcgacggggttcagaggagaccagaagcttagggacatcttcactgcgaactggtgcagggagatagtggcagggtcaccggatacagcagctcctctgtacaggtacacctctgtacagaaactttagtgcatattcaatcaattagataaacttgtgttaaagtccacattgtgttggtttcagtagtaatctcattctatctaactgattgaacacgacacagagaatgcatccatccccggattcctcagctggctatagtgggttactccgagagcctcaccaacatatacgcctcggagaggatgagcaactgggtagctcaatttctggccggcggcttccagttgccaagcgtgagatgcatggaggagagcgtggcggagtgggcagagtacaagaaccgatacaacgggaggtatttccgcaggtcctgcgtaagcaccgctaacatctggcttaatgatctgctgtgccgagatatggggtgcaaccctagaaggaagaaagggttcctggccgaatggttccagccatatggacctgcggactatgcaggtctttgctgaagatggttgcattgcatgcctgtcagtgcatactcctaggaagagatgacagagttgctacctccatgggtgtaatactgcaatgtgaaacgtacaagcaaaatatgtctgatgtttgaactgtaaggtgtgaacctatgagacctgtctaaacaattttgcaacaatctacagttttgaactcgaacagggagaagataagttgtgggtgcaaggaaacacatgccgtatgtttggttgctgatctccagcgctccagcctcgcgctggcctggcccgcgagcgaagctcgttttccacatccccacgcgtgcaggctgaacggtgaaaatcagcttaagttgaatgcgtgcgtgcaggctcgcggatggaggcacagccaaccaaacacgcacttgcgcgcggtcaaagctcggcggggctctggggccggttcggcgcgcgtccccgcggttttagacccgacggtgttcggggcgggtttaaatttttacccgcgggttcacgggttcgggggcccgatttaattcgggttcggggcagttctacattttcaacccgtggtttttatgcgggg

SEQ ID NO: 9479 - DNA, 3880 bp, Zea mays
catactatcgtgacaatggttttatgccatatgcccgttcagttcttgtgatacacaatatagcacatcagggccgtggcccgatagatgatttcaggtacctggatttgcctggtcattacatggatcagttcaaactttatgatccattcggaggtgatcatctaaacatttttgcagctggtattagagctgctgatcgtttgcttaccgttagtcatggttatgcatgggagctcaaaacacctgatggcggctggggccttcatagtatcattaatgaaaacgattggaaattccagggtattgtaaatggtattgatactgctgattggaatcctaggcatgatgtccatctacaatctgatgggtacaccaactattctctagaaaccgttcagactggtaaagcacagtgcaaggaagcactacagaaagagcttggactccctgttcgtggcgatgttccggtcattgcttttattggacggctggaccatcaaaaaggtgtagatctgatagcagaggcaatgccgtggattgctggtcaggatgtacaattaattatgttgggtactggaagacaagaccttgaagatacattgaggaggcttgagagccagcattatgacagggtccggggctgggttgggttctctgtccggttggctcatcggatgacagcaggggctgatatactattgatgccatcaaggtttgagccatgtgggctgaaccgcctggtcgccgccgtggacgggactgttcctgtagtccatgctgttggtggtctccgcgacacagtccaacattataatccctacgaggaggttggagttggatggacttttgagaaagcagaggcaaacagaatgatcgatgccctagggcactgcttgaacacatacagaaattactggagcagttgggaaggtatccaacgtagagggatgatgcaggacctaagctgggataacgctgctaaactctacgaggaagttcttcttgccgccaaatatcagtggtgactgttgttgaactgtccaaggaactgttgatatttgtcattcatagacctgaaggctttctgtcgcatagaagtcaccgactgtttcaattcttttggtgactgcttcacacagctgctgcatgctttgtcctgaattttgcaggacggtgtgcgtcgcaacagccaaattttttttgttgttgccagttcctaataatcgcatcagatgtgaatgtgaattctgagtctacctcctggacaaacacagtggatgaggcttttgctggaaacaggttaatgctggaggaaagattgaggggaagcgtcgtgcactttttgcaagtgtttacgaattcatttgttctacagggagagctcatttagacgctttggtacaggagggtggtagatagcagagaaactgatgctttgtatcttgagtagttttgttgtatctctaaattaggatacttgttacaatgttcagttcttcatatttttttccgtgcatatcctgtagatgatttagtgttccggtcttccgaatgatcgtaaaaaaggggtttgcaggttgttgagaataatatataattatgaaagggcatcggaatccctgaacaatactgaagttctctgaaagaaccgaggccatgaatgtatgtttcggaagtctacgactcacctagggttgccgtgcaagtttttaccatgtcatacatagacaacttattacactatgaatcgttttattttgtcgtaagcaaactattcaatacatatacacaaaatacgaaaatattattcatatatcattgtgtttcttattccccgtatgggaaatacaaacaacgttgtctattactattatcgacagacgtcacggcgcgtcggcgccgctgcttcgaagggctatagactgccgttggcgcagcaattccatacatgacagcctgaaaagcagcggaatcaactgttaaatcattacaccaccaatcgcgtggctgataatagcatctaaattttaaactataaacgtaatataaagatcggatcggattatgatcgtactctatttatattcatttttaacaaaaaatgtagtaatttataaagaaatatttacattacatttacatcgtgtttagtttaacgaatgagtaatctatcatcttctcactcatcactttttatttggtttgtaaattagaacaaattgatctatcattatttcattacttgtagactaataattagtactaatacgaggaatgagtttattctaccaaaattgtaaaataaactcatgatatatcaccttattatctagaatagattaattcttcaaaccaaacacattcttactctttagatcacgatcaatgaccactcctacgtgcgatgcttcggcgtccggggacggtggccggggatacacgatacaggcagacgcgggatcctgggagaagtcgtgcatggtccagggagtgggacaaggtatcgcgccgttcccccgtcggagttgcagttgccccaaactccacctgcagaattacccctccgtcaagcgattcctactcccccgacctgcgctacttctcacgacgaccaaccatctccctccatggtgattggtgtgtatatattcatctggccatcaacgcaatcttccactcaacaaaactactgctccgtgcatactcctctcccaaaatttccttgttttttgtttaaaaaaaaatcggctcgtccatcgtcagtaccgtacgtctgaggtagctctgcatcgggaggaagaactgaaggcgggtgatccatggcttccggcgagcgcgtgtacgaggacttcaagcctccgcacaagatggagcgcgagccggccacccacacgctcaccgtcgacctctctgcccaaggcaagcaacgccgacgcgcgcgtactatgaacaagcacttcatttccctcgtgcaaaagtacggtgaattcgttggataatacaatacaacggcagggtacaggaaggagcacatcagggtgcagatggtccacagccaccggtgcctcatcgtgcgcggggagcgccccgtcgacggcaaccgctggagccgcttccgcctcgatctccccgtccccgacggctgcgacgccaaggccgtccacgctaggttcgacaacggcgtcgtccgcgtcaccatgcctggcgtccagcagccggagcccgtcctcccggtcgtcgccggcaccgccgaccagcagcagcagcagcaggagacgccgctgccgaagcatgctggtacggccgctgccgctggcgacgacgacgacgtgcaagggcggaaaggcgtcgtcggcgctgcggggcaagacggcggtgatcgtgatcgtgccgcgcgagggcaggatgaggtggacaagcacgagacgccgcggaagcaagaagcgaggcagcgcgtggtgagctcagcgaaacacgccggcggcagtagcggtaggggcgacgacacagctgcaggtggggtagggcaggaggtgatggccgccgcttctcccacgtcgtcacgccaaggctacggcttcctccataaccggaagaaggtgaccatcaccgtgctcggcggcgtggcgctcgtcctcatcagcctcggcatctatgtcaactacagcctctcgccataaaccgtgcatgctaccggcccggcgccgtggcgcatgcatcatagcgatgactgcaccttgcgtatgtatcaaagaatctgccaatcacatggatggccgatggaagggaagtgtgtgtgtatgtatgattaatttaatgtgcttctcaaacattgagccaaaaaaaaaaaaaaaaaaaaaaaagtcgacgcggccgc

SEQ ID NO: 9480 - DNA, 1068 bp, Zea mays
cattgggtacctcgaccccccccgatgttgtcctctcccccgcgccgttcatactcctctcccagactttccttggattttttgtttctttttaatttctcgttcgtccatctccgttatctctgaatttggaggcagaactgaagagagagctagaagcgggtgacccatggcttccagcaagcgcgaatacgaggacttcgtgcctccgcacaaaacggagcgcgagccggccacccacaccctcaccgtcaacctctccggccaagggttcaagaaggagcacgtcagggtgcagatggtccacagccaacggcgcctgatcgtgcgcggggagcgccccgtcgacggcaaccgctggagacgcttcggcctcgagctcctcgtccccgacggctgcgacgccaaggccatccacgccaggttcgaaaacggcgtcttccgcgtcaccatgcctgccgtcccgccggagcaagtcccggtcgtcgccagcgctgcgaagcaagacggtggtgaccgtgccgcgcgagggcgagaagacaacaagcacgagacgccgcggaagcaagaagcgaggcagcgcgtggtgagctcggccagagaccccggcggtagtagcagcaagaacgacggcgccggtggcggtagcagcgctcctccgtcgtcatgccaaggcttcctcagcaatccgaagatggccaccactgtgcttgcccgtggtgctcgtcctcatcagcctcggcatctatgtcaagaacagcgtctggccgtaaactccgtcctggcgcgtgcatatgtgtggtatacgggatgtggtaacgattcctggacgcagttggtgaaagttcctcgcgtacggtacgtatcgaagcgattggagggatatgtgtgtttaatttcatttgtttctagaaaatgagcgaaaaaaatgatttacctgcaaatgctgcaagagctcatactccctcaaggtccaattaaatgggtgcatagaacaattccgagtcgaattgtttatctagtttatataagatttgatcagctataatatttcaagaccatttcaag

SEQ ID NO: 9481 - DNA, 2288 bp, Zea mays
cattgggacctcgagccggcgggccttttcctccccgtcgtgtcgcttcctcccgctccctccggagctgcgaaattttgagacccagccgggaaagcggaggcggagactacccaccccaccaccagccccccggaattcgcgcaaatcacagaagctccctagccgccggcgagcactcgtgcgctcccctggaagcggcggaggcggcggcggagcccgcctctctgccggcgccggcgatgggcaactcactggggtgctcggcttccggcgagcggctcgtctcggcggcgcgcgacggggacgccatcgaggcgcggatgctgctggagctcagccccgcgctcgcgcgctactccaccttcggcggcctcaacactccgctacacttcgccgccgccaagggccatctcgacattgtcacgatgctgctggagaaaggcgctgacgttaacgcgcgcaactactgcggccagactgcgctgatgcatgcttgtcggcatgggcactgggaggtggtgcagatgcttcttctatttagatgcaatgttactagggcagattacttgagtggtcgaacagcactgcattttgctgcacatgatggatttgttcggtgtattaggcttttagttgcagactttgtcccgagtgtggccttggaggatattgcttcttctgtggtggatggtggtgattgccagacaaacagtgggagcagtcctaattcatcgtcggggcagaagtttaatgaatcggcccgtgtgaggtacatcaacaaacctgcagatggtggtgttacagcacttcacatggcagcattgaacggtcacttagattgcatgcagttgttgattgacttgggcgctaatgtctcagctgtctcattcccctatggcactactgcaaatttgataggagctggcagtacaccgttgcattatgcagcaggtggggggaaacaagaatgctgtgaggtaagtcaatgtcataaagaaatcatcacctttttgacaagaatcctgcttcagttgtacctatcagagaaatttatttattttggtatgtgatgatgctgttcttgcagctactaatatcaaaaggctctagcaggttgacactcaattgcaatgggtggcttcccgttgatgttgctagaatatttggacggcgctctttggagccattactttctccaaattcacactcgaatgtccctgtatttcaaccatccagttatcttgccttgccactcatgagtatacttaatatagccagagaatttgggttgcagcataccacaccctcaattgatgataatgatctatgttcagtttgtctagaaaggtcttgttctgttgctgctgaaggttgcagtcatgaattctgcatcaaatgtgctctctacctctgctcaaccagcaacatccgtgtcgagttcacaggcccacctgggtccatcccgtgccctctttgtcggaacggcataatgtctttcaccaagttaccaagcacaccaacagaagggcttaaatcaggttcagcgctcacattctgcaacccatgcatactgaacacccggtccatggactcgccagccactttctccaaagccgaaatcagacggaaccgtgtggcagctgtctcttcggagctggtctgtccaatcacctgcagcccattcccgtcgtccgccctcccaacctgcaggtgcagcgacgacgatccatgcggcgatacagacgtgcaggatggtcccgagttccagtctccccggccctcgcacagcgcaagcatggagctggacaagaggggggagggggatctagcccgggccagctgctcaggcatgttctggagccgaagaagctgccacagggaccagcagtgtgatgcggagatcaacgcttgattctttatctgtggttctgaattacgtttggattcgtagcagctccaacgcgggacatgagcagcggttgttttttccgcccccagctatgttccttcctcctatctacagccaatgttttcttgattggtgaaatgctgctgcgtcctttgcagccgtagcgtgtgtgttgtaacagttttgttactatggttcatgtgtacctgtgaatctagatagccttcgaagttgctagccagttacggttctttgtagctctatgtaaattgcagatctggatggaattactttctgtccctgatgataaatatttatatacaacgagtgaagtaccctctaaggccatctccagcggagctggatgtgagcttgt

SEQ ID NO: 9482 - DNA, 2273 bp, Zea mays
ccggccgggccgggattacaaaaaagctaggaaaggccttccatttccactccccgtcgtgtcccttcctccctcttcctccggagctgcgaaattttgagacccagccgggaaagcggaggcggagactacccaccccaccaccagccccctggaattcgcgcaaatcacagaagctccctagccgccggcgagcactcgcgggcgcgcgcgcccccggcggcggcggcggagccctcctctctgccggcgccggcgatgggcaactcgctggggtgctcggcctccggcgagcggctcgtctcggcggcgcgcgacggggacgccatcgaggcgcggatgctgctggagctcagccccgcgctcgcgcgctactccaccttcggcggcctcaacactccgctacacttcgccgccgccaagggccatctcgacattgtcacgatgctgctggagaaaggcgctgacgttaacgcccgcaactactgcggccagactgcgctgatgcatgcttgtcggcatgggcactgggaggtggtgcagatgcttcttctatttagatgcaatgttactagggcagattacttgagtggtcgaacagcactgcattttgctgcacatgatggatttgttcggtgtattagacttttagttgcagactttgtcccgagtgtggccttggaggatattgcttcttctgtggtggatggtggtgattgccagacaaacagtgggagcagtcctaattcatcgtcggggcagaagtttaatgaatcggcccgtgtgaggtacatcaacaaacctgcagatggtggtgttacagcacttcacatggcagcattgaacggtcacttagattgcatgcagttgttgattgacttgggcgctaatgtctcagctgtctcattcccctatggcactactgcaaatttgataggagctggcagtacaccgttgcattatgcagcaggtggggggaaacaagaatgctgtgagctactaatatcaaaaggcgctagcaggttgacactcaattgcaatgggtggcttcccgttgatgttgctagaatatttggacggcgctctttggagccattactttctccaaattcacactcgaatgtccctgtatttcaaccgtccagttatcttgccttgccactcatgagtatacttaatatagccagagaatttgggttgcagcataccacaccctcgattgatgataatgatctatgttcagtttgtctagaaaggtcttgttctgttgctgctgaaggttgcagtcatgaattctgcatcaaatgtgctctctacctctgctcaaccagcaacatccgtgtcgagttcacaggcccacctgggtccatcccgtgccctctttgtcggaacggcataatgtctttcaccaagttaccaagcacaccaacagaagggcttaaatcaggttcagcgctcacattctgcaacccatgcatactgaacacccggtccatggactcgccagccactttctccaaagccgaaatcagacggaaccgtgtggcagctgtctcttcggagctggtctgtccaatcacctgcagcccattcccgtcgtccgccctcccaacctgcaggtgcagcgacgacgatccatgcggcgatacagacgtgcaggatggtcccgagttccagtctccccggccctcgcacagcgcaagcatggagctggacaagaggggggagggggatctagaccgggccagctgctcaggcatgttctggagccgaagaagctgccacagggagcagcagtgtgatgcggagatcaacgcttgattctttatctgtggttctgaattacgttgggattcgtagcagctccaacgcgggagatgagcagcggttgttttttccgccccagctatgttccttcctcctatctacagccaatgttttcttgattggtgaaatgctgctgcgtcctttgcagccgtagagtgtgtgttgtaacagttttgttactatggttcatgtgtacgtgtgaatctagatagccttcgaagttgctagccagttacggttctttgtagctgtatgtaaattgcagatctggatggaattactttctgtccctgatgataaatatttatatacaacgagtgaagtaccctctaaggccatctccagcggagctggatgtgagcttgtaaaatattgctttgaattgtagactctgtttatagactagtttaaaataagaaatgagatattgagtatgatttagagct

SEQ ID NO: 9483 - DNA, 2933 bp, Zea mays
  misc_feature (2411)..(2411): n is a, c, g, or t
cagaaccaaacattactaaattacagacagggtgccatctgaaattaatagaccataaagttacatttcaattacattgggcacctaggttcaccagtcttgttgctacttgttccatatgtgtgatttgtttgaaatttcttgtctataaataaaaagtaaagtaacttgactgccctgtgttgaacccatatttttcttgcagtgcactgcattaaaggcactgcgatccttccttttgtatctgggttattcttgaagaattaattttcactctggaggaaaaatgagtggtcctccaaagaggttgcatgaggagagtagccactctacacctgcaaagcggcctttggacgacaacaacttgtactcaagcccttccgggaaagctattcagtcaagcagcagtgatttccatggtttttttgaacatgatggtagatttgccaaaattcaacgtgttgaggctcgtgatgataagaggccaccccttgtccatcggatgcatggtagctccaactttgttgatcacaccgtcttgtctgacagcagattagaaccaaagcacaataaagatacaagggacaataaggcggatgatcgtgacacaaaagctgatgctctggatgtctatagtgatcccagtattgagtttcagtttaataaaattgacagtgatgtaaaaatagacaatagagctgatggaaatgaaataagggctgacaggaggggtcaccacgattacaaaggtgatactaaatttgacaaggataatcatcctattgttgcatcgagcttaggctggaaagacaacaaagaacataggggcaaaaggtactttgagcagccatctgataatgcggattggcgtttcccccgtcccggtttgcaaggtactgatgaaactctcaaaggtctaacttccatggaagaccgtaattcaagagatgcacatgattctgcttttgacaacaaagctgaatcaaaaggtgaagataagtttagagacaaggataggaaaaagaaggaagagaaacatagagactttggttcaagagaaggtgagagaaatgatcgtcggaccggtatccagcttggaggtagtggagttgagcgaagagaaatgcaaagggaagagagggatgctgaaaaatgggacagggaaagaaaagattccttgagagacaaggaaggcaatgatagggaaaaggattctgctaagaaagatccatctatggtaatggaaaaggataacacaatagttgaaaaacttttatctgatggacctgttaaaaatgctgaacatgagaatacaacaacagaaactaaggtgcttaaggacgatgcatggaaaggtcatgacagggatcctaaagacaagaaaagagagaaggatttggatgcaggagacaggcatgagcaaagaagcaaatataatgacaaggaatcagatgataatggcaccgaaggtgatacagaaaaagataaagatgtttttggaagtgttcaacgcaggaggatggtgcgaccaaggggaggtggtagccaagcatctcaacgtgatccccgatttcgatcccgaacgcgtgatggcgaagggtaatcttaagtactgcaccttgctatgtttactgaagtttttccccaataacttaatagtataaatgcagtttcatggcattctccattcctggaaattcagactttcctaactgagagttgaagatatgaagtcgctgtttaattggtttgaatttattaattagtgatgactagtcatcgttatttcttattttccttattttgtcttgcagggctcaaggttagtcaaatatcaacttccttagcagaattcattaaatactggtgcttcgtttggaactggagtaataaaaagatctgtctctacatatatccattttacattttctttacagaagatttaacaactaaaaactttcactctgatgttggaagttccttatatttttatgttggaggcaattcattgcatgttttggtgtgtttttccatcttctgccaactaaacacagccagtgaggataatagatactgttatggaaaccatgcatgcatcagtactagtaatgttattagtattgggagggctatcctagttttaggatggttagttgtattaggaaagttatcaaggaaagtcagatgttttctgttggctggtgcctaaatactacaaaggcaggccatgcatctgagggagaggaaggaatcttgacagcgataaccaaagaatcttctcgacataagcctgaagattatagagtgatcaacctcatctcgcagtattcatcttgtttcatatggtatcatttgccgtgtttattgctttccaactataaaatatttccacgaccattacttattacctntttgctcccctctgcttctgcagctgttatgtgcttcctgccatggcccagaaaactccaaagtcgccaccatcaacaaccaaaatgcatcctacctaccctgaaaaatctgctgacgtgtctactggcaaccggcattttgctgccactcattttgctccagccttcatcccttctctttcttgatcttcctatattctgcatgttgctctttgtgtccactcccttggctttccacctaaattacttgcaccagtcctagaactggtgctgcccctacctccgccaccaccttgactgtccgatcaccaccaaaagtgacccctgtaagccgctaacctttgcaatcagttttcaccaccattgccatcctatactgccgttgcactcgccctcccctgctattgctgctccacatgccctgtcctgttgctgcacttgctgcatccaatttattgccatcaaacacctctcttttactaaaatcaggtgccaaaatcatctgctacttctgcaaccatg

SEQ ID NO: 9484 - DNA, 875 bp, Zea mays
  misc_feature (853)..(853): n is a, c, g, or t
gccggccgggcccccgaggtaccatagaaaaaccgcagccagtcgatcccgtagcggggcccactcgccgatcaaaggatggccaccgagacagcgaccgccccggcgccaccgggcgaccctcctcatcctcctccggcggaggcgggcgccgccacgccaagccgttcgagaccgtcggggttcgagcagctagacgggcgagtcaaggagctgacctcgtcgcaggcggagttgctggagaggatccagaagctgaaacatgaggtgcagaactggcgctccaatgtagagacgcaggtcaagacataccagaatgaactccaggatctcaagaaaggacttgactctgaagtggaacagctgaaatcggaaatgaaggcggttaggtctgcggtacaggaagagaaaggcaatctacctgcacaaaataccgactttagagacgaacaataaaaatgcaggacaagcttggcagacaccaggccaagcacagtattgaagagcaaacagcaacacagccgtgaattggtgcttccttgcagaggtgaagggctgttctgctggatattcagatcctttcaatggatcaaaaggggggaaagctggcagatacacggaatcacatgaagtattcatttttttaatatataccagcaagtttccaagtgcaaatatctctataacagtgagcaatttcaagagtaatgtacaagaactgcttgttttgtaacaattccatgactactaatactactattacaaacttaatcttgaaataaaatctgcacagcctcctattgttccagtgttctaaacatgcttaaaacaaaaataaaatttgttaccctanaaaaaaaaaaaaaaaagcggcc

SEQ ID NO: 9485 - DNA, 3299 bp, Zea mays
aagcagcactgcagcagcagagttctgggctgatccttgtgcttgtgcttgcgttgcaggagctgacctcgtcgcaggcggagttgctggagaggatccagaagctgaaacatgtgcgtatggatttcccagcacttggttcgatttgaggatttagttgtttccctgatcagatgctgatgagatgtgaatggctgacctctgcttcaggaggtgcagaactggcgctccaatgtagagacgcaggtcaagacataccagaatgtgagttctctgctctgccctttttccctcaccttggaaattcaaggctgctgctgcttgtagtaacgaacaccccataccaccggtgaattgaattgtgttgcttacaggaactccaggatctcaagaaaggacttaactctgaagtggaacagctgaaatcggtgcgccctcccattctgtcgacttctattcctttttacctttggtctggtctctagcaggagcagcacaccatcctgtcattttgctcgtaggaaatgaaggcggttaggtctgcggtacaggaagagaaaggcaatctacctgcacaaaataccgactttagagacggttagttttgtgtggaaaaaaaaagatctatgtgattacgctctactgagccatgctgtcgtgcaagaaactgcaacgattttcttgttttgtagaacaataaaaatgcaggacaagcttggcagacaccaggccaagcacagtattgaagagcaaacagcaacacagccgtgaattggtgcttccttgcagaggtgaagggctgttctgctggatattcagatcctttcaatggatcaaaaggggggaaagctggcagatacacggaatcacatgaagtattcatttttttaattttttttttttttttgccaagtgcaaatatctctataacagtgagcaatttcaagagtaatgtacaagaactgcttgttttgtaacaattccatgactactaatactactattacaaacttaatcttgaaataaaatctgcacagcctcctcttgttccagtgttctaaacatgcttaaaacaaaaataaaatttgttacccaatgaggaattggaatctggaggtggccatgtaatattgcacgtcagcatgtaatcatttctgcaactttgctgcttcatcacagctagctgagatctccttatgtcatttaactgaaatgcaacagtctagtactccatcccaccttgtaaactgaataacattatggagttaattctggacttccgacctcttcagttgctacagggtaacttacaaaaacttaggttgctttcccttaaaagcgaagctgcctaagaaaccttaacatctttccggttatctgtgtgaaggcttcctacaagggcagaatatagggagtcatctgggatcaatccagctttcagcatatcatcatacagctggaacgccgcctctgatctcccttccttcgccagacctgatatcagagccgtataggccacgacattaggttccgttcccctctgcttcatctcttcgaatagcttcagcgccacatccaccttcccattgacacagtgcccatgaactagcgatgcataggtgtatacatctggaacaaaccctttcttctccatctgctttctgaacctctcagcctcacggatcctccccttcttggcgtacccatgaatcataacactgtaggtcacaacactgggcgtcgcccctttctctgccatttctcggaacagccttctagcctccaccatgtcgccatccttgcagtgtatgctgatcagtgtagtgtaagtgacgtaatttggcacgacacccatctcgatcatgatgtgcaatagagtctttgcctcatccaatctattcaccctgcacagtccacaggccagtgtgttgtatgtgtagatgttcagttcgacgccaattttctccatggccgcctttattttaagagcatcgtccaccatccctttgcgacaatagccatcaatcatggtattgaaaatgatttggttaagccctacaccttgcccttgcatgtctgccagcaacatctctgcagcctccatctgcccaatcttgcagaaccctttgatcaatacaccatatgtacgctcgtttggctcaacgccattgccaacgcattcatccaaaaccttggcggccctccgcatgttccctgctcggcaatacgcgttgatgacagcggtgtacaggtacacatcccccacaacattattcgccttcatctcattaaacagagcctcgaccttgctgatgtccctggcggtcgacaaactatccacaaggatcgtatacgtcccgaccgtcgcctcgatgccttcgttctccatgatctctagaatctcctggacccgcccgtcatccttttgtcgcacgtaacagtcaagcagcgagttgtagcacagcgcattcagactcacgccgtggcgaggcatatcgtcgagcagccggcgcgcgtcgtccacgcgccccgacttgcagagcccgtcgacgacgacggacgcggcgaacggcgagacggagcccgggcacgagccgagcgcccgctccaggaggcccgcggcgtccgcgaggcgcccggcgcggcggagcgagagcagcgagaacgtgagcgagcgcgggtcgaggctgccgaggcgggacacggcggcgtcgagcgcctcggccgcgcggcacgccgcgcccgcgtccgcgtacgcgcggaagagcatgtcgtggaacgccgccacggcgtgcggcggcgcgccgcgcgggagcgacgaggcggcgaggtccgcgaacggcaccgccagtaggcgcggcgtgagcagggaccggagcttggacctggcggcggcgaagcgccgcgcggtaaggagcgacgcgaaggcggcgagcggcggcaaggcggcggaccccgccatcgcgtcgtctcggcggcagaggagagaggacggagcggggaggggacgtctcagtgtgggtcgttggatggatggcgtggcgggctgccgggtgttgatggctcggcctgtttggtaggttaggtgggctgggctcatagaagctgtggttcgtcggggtgggctttccagtgggctaaaatgaggcgtgccctccgcggtcttttctttcttcttttttttcaaactcaaaccatccgtgaactaaacacatgtaacgacgttctcaactctctgggaatcagtgtgtgtgagagagagaataattcgttcctgcatggaaaaaatatgcctgcag

SEQ ID NO: 9486 - DNA, 1999 bp, Zea mays
  misc_feature (4)..(4): n is a, c, g, or t
  misc_feature (1998)..(1998): n is a, c, g, or t
gggnaaaaaaaaaaaaaaaaaaaaaaaacacatccgcccctggtctgcccgtcgcgcccgcgcctccgttctctccccgttcgccgctcggttgcttccgccgccgcttcccctggctgcctcgtgtactggtcgagctcaagcgccccatttcgggctgggtccgggaacctcgaatctatctcctaaccctatcaagctagctagctgcgatgccgagcttccctccgccgggcgccgtcaccatctgcgagatcaaccgcgacctcgttgcggcggatgccctctccgacgaccgcgccaaggacgcatatggggatgtcctcgggatggtgttcgccccgattccgttccagccggaggctcttcttctcgccagccgcgagcctgctgctcctgccgcggaccaagtcgagcctgctgacactgtgcccaccgctggtttggcagccaccatatccgacttcttcaggcggatggtcttccctccactagacccaaatctgctagaagaatttgacacgcagaaagtaagttggaatccatacaagcattgcttagcattcgtgtctgggaagaaccaggttactgtccaagactttgaggactcagatgctaaagaaccatgcattttaacaaatgatcatcaaacggatgttaaggctgttgagtggagaccaaatagtgggaagatgattgcagttgcctgcaaaggagggatatgcctctggtcggcatcatatcctggcaatgtcccattcatgaaatctggggtcacttcttcctttagtgccttccctagaggttctggtggtcagtggatacttgtggatgttcttcgtggctcttctgctgagctcgttagtgcactttgttggaaacctgatggaagatacttggcatctgcctcatgtaatagttcatctttcacaatttgggatgtgtctcaagggttgggaactcctatacggcgtggattaagcaatatatcattagtgcggtggtcacccagtggagattaccttctagttgctaaatttgatggtacttttcacttctgggagacaaacacatggacttcagaaccctggtcttcgtctaatggatatgtgtctggagcaaattgggacccagaaggtcgagttgcattgttatccttttccaactcgacgacacttggttcaattcacttctcgtcgaagccaccatctttagatgcacacctcctaccagttgaacttccagaaatttcctccctgattgttagccgaggcatagagaaattagcatgggacgcttcaggggaacgtctggcactgtcgttcagagatggaaacgaaatgtaccgtggcctgatcgcgatatatgacgtgcggagatctccactcgtctcactatcactagttgggttcatccggggacctggagaaggagcaaagccgctcgcctttgcttttcatagcaagtttaagcaggggccattgctttccgtgtgttggagcagtggctggtgctgtacgtatccgctgatacttcgtcctcgttgactccagtcgtagcacctcgccggttcaggactgaatgttgctggcgacttggaagaccgaacgcttcgatgtgcctgctaggagaaatgcaaagctcgagttgctgcattgtgacgttgtggctcgagaaatggcgcccttttggacagtcatctccagatgtgtttgattggatatgtatgtatgcttatgctgattttagcgggggttttttttccccctctggccatacatggatcgcccttttggacagtcaactccagatcgcccaagctacccgcggcctattattttagaactccagcaggcagaagcatgccatattgccccacgggttgaaccgaggaggccttctctctaccaccatcaccagatgcaaaatctgggatcgtcagtgctgtcaaaaaaaaattatagcaatctgaaaacttcattaaccttcgcatttcana

SEQ ID NO: 9487 - DNA, 830 bp, Zea mays
cttcctctcggcaacggatatctcggctctcgcatcgatgaagaacgtagcaaaatgcgatacctggtgtgaattgcagaatcccgcgaaccatcgagtttttgaacgcaagttgcgcccgaagccttctcatgggtaccccccggcccggccggactacaaccagcggtagtggccggcatcatccgtctcgtctcgtctcgtctcgcctctcctctccttttcccccctccctgcacagcgccgctcaccgtcaccgtaccacagcagcgatcgatggctgaggtacacaacgagcggcccgtgatggtgggcgacgtccgggacgcgccggtgggccgcgagaacgacctcgaggccatcgagctcgcgcgcttcgcggtcgccgagcacaacagcaagaccaacgcgatgctggaattcgagaggctggtgaaggtgaggcaccaggtcgtggccgggaccctgcaccacttcaccgtcgaggtgaaggaggccggcggcggcgaaaagaagctgtacgaggccaaggtgtgggagaaggcgtgggagaacttcaagcagctgcagagcttcgagctcgtcggagacgccgcggtcgcctgaggcgcacaggcttttcgctggaggctggagcacaacaatgaaagaatttaactgtcatcccactggaaaagtatgatataatgaataaaccagcgtcttaccacatgtattgtaccctaatgagatatttgaccactgtaatagaatgagatgtgctaaggaatctgaaagccttcttgctttttgttgccaaaaaaaaaaaaaaaaaagcggccagcgcgccc

SEQ ID NO: 9488 - DNA, 765 bp, Zea mays
  misc_feature (6)..(6): n is a, c, g, or t
  misc_feature (17)..(17): n is a, c, g, or t
  misc_feature (738)..(738): n is a, c, g, or t
cctcgnagccggccggngaaaaaatccaaaaaaaaaaaaaaaaacattacctatgggccggcccggcgcggccgggactaccagcggtagtggccggcatcatccgtctcgtctcgtctcgcctctcctctccttttcccccctccctgcacagcgccgctcaccgtcaccggaccacagcagcgatcgatggctgaggtacacaacgagcggcccgtggggatggtgggcggcgtccgggacgcgccggtgggccgcgagaacgacctcgaggccatcgagctcgcgcgcttcgcggtcgccgagcacaacagcaagaccaacgcgatgctggaattcgagaggctggtgaaggtgaggcaccaggtcgtggccgggaccctgcaccacttcaccgtcgaggtgaaggaggccggcggcggcgaaaagaagctgtacgaggccaaggtgtgggagaaggcgtgggagaacttcaagcagctgcagagcttcgagctcgtcggagacgccgcggtcgcctgaggcgcacaggcttttcgctggaggctggagcacaacaatgaaagaatttaactgtcatcccactggaaaagtatgatataatgaataaaccagcgtcttaccacatgtattgtaccctaatgagatatttgacccctgtaatagaatgagatgtgctaaggaaaaaaaaaaaaaaaaagccggcaaaaaaaaaaaaaaaaaggcccccgagctccnaggaaaaaaaaaaaaaaaaaagcggcc

SEQ ID NO: 9489 - DNA, 2077 bp, Zea mays
cattcggcacgaggcctcctcccggccggcctccacgctggacgcatcctcctgacctccacgctcgggtcgggcgcgtgaacccctcgccgccgtcgcagccgcagttccatcgccggagggtgagagggacgaggaagaggagggcaagatgaagacgaccaaggggggcaaggcgatgaaccccaccgacgccttccgcaaggagcagcggaagaaggagctcaagcggaacaaaaaggaaaggaagaaggtgcgggaagttggtattttgaaaaaggatccagacgctatacgagagcagattgagaaattggagaagatgaaggctgatggtgctctcgacaaggctaggaagcataagaaaagacagcttgaggatacatacaatcttattgttaagaaacgaaaggaatatgaacagaaaatgaaagagaagggtgagcaaccgattatgtttagtcatcttgcaccaccaaagaggcggcctacagcagatgaagatgatagagctaatcctaagcccgaggactctgtttactatcatccaaccttaaatccatctggagcaccaccacctggaaaacctccgatgtacaaatcatctataggaccaaggatcccactgccttccttatccagcactggggcctcatcttccatgtcagagtctgaagcaggtccatctaccctgccaccccctccaccaccaccaccattgccagacacctcagagtccattgatccatctgcccctcatttccctttgcctccactcccgccaccgcccccaccaccacctaaacctaacagtgacacagcattgccaggcttacctcctcctcctggtccacctctgagagaacctgtatccggtcatacagtacttcagccgccaccacctccatcgcagaggtctttaaatccgccagcagcgtctagtgcaaatgaaagcaaaacggattctgttcagttgcagccctcagttgtcctgcctccaccacccccgccgcctgggttgccaccaaaatctaatgacatggaggctgctggcacttcaaaggacactcctggacttaaagaagatactgcagcgagagtcttaccaccgctgcctccaccacctagtttgccacctttacctccaaggcctccaatgcaatctgatatgctagctcctggagtcatgagatttccaccacctccgccaccaccagattcaaggccatcgcttatggcggctggagttaacaggccccctccacctcctccaggatttccaccgtctcaaatgccaatgccaccgtatggtgtgctccctggtccgccgccgatgcttaggcctccatttttgccaggacctcctatgcaactagatgagtttgctgcctttgccccaaggcctcagttacctcagcagccatcatacgtgaagtcggctgccccaacagttgtgaagagaccattagcacagcacactcctgagctgacggctatggttcctgcatcagtccgtgtcaagagagaatctgctctccccaagccaaaaccaaaggtgcagcagcagccacaactatcaacagtatccatttcaaagccctcggtgaccctcataagaagcgacgctcggcctccttcagcggcacccaagccgccaagcatcgacgactcttacatggcgttcttggaagatatgaaggagctaggggcacttgatgggtaactcaagtagagcaaatgcctgattgcacttagcagcttaattcatggaaacctgggcatggaaccttttttttttgcaacgtgagaatcaatagtctctggtcaatcaatcggagaaaatcatgcattagtttaattaaacactgggaaaacaattgtaatctatctttttcatactaaaggctctgtggcccaactgtacaagctggagatatttgaaacttgaatatggctctagcaaaggacatctcccagctgcatgtttcatggctgatttgcagataataccagtcggggggaagactactggtgtgcctaattttaaaaaaaaaaaaaaaaaactcgagggggggcc

SEQ ID NO: 9490 - DNA, 1609 bp, Zea mays
atagatcatgaaagagacaaatgaatcataggcttgtaccagcatttactgcatggtacacacatatcagactagtctatacaatatacatggtctagccagcaaaacatgtgtcattgtttgggactaaaattgtaaaaccacatacaggattacaacaataacacttgagcatctttgtttgcatctatcgaagagattcttgaaccctgtaccaaattcttatacagtgcccaggtccgtttggaatgcaggaatttcacaagaattggtccagtttcacagggaaagcacaggaatagagggggggggggattctgcattccaatataccttgatttcgggtacattgtttaacgtagctttcgtatattggtgttgtcttgtaggtggtctcgtgtagtaccacgtaatcttgggttgagttgtgacacaatctgtacaataacttatcatttgagttgtcttgtagtaactcacatttacttaatttgtgtatagaacaataggaatgttttgatttgcatctcgacaagtcatacaatggtgctgaagcagtctcatattcctaaattttagtttatgaggtggttgtttcaccaaaacaacaacctctttctctcaccctccctcttctcgtccacatcataaaaaaaatcatatgtggctttgtatgagaccatgtacttgccctaatggttctaaaaaaatcctatgtggctttgtatgacgtaatggtgtcattagtaactggtgagtaatgatttgattgctgtatcaacatggttgatacaaactccactgatttgtgtctgccaacagatttttcatactccagctgatcgagagaagatcaagtcatgtttatcagagctaggagagatcagtgcttcctttaagaagatccttcattctgcgctggagcatttagtggcatctgtggcgccacgcatccgtccaatccttgacactgttgctactgtcagttatgggttggatgatgctgaatatggggaaaatgaggtgaatgatccatgggtgcagaagctaatacttgcagttaacactaatgttgcttggctccagccagtgatgacatcaaacaactacgattcctttgtgcacttgatcattgacttcattgtcaaaaggctggaggtgattatgatgcagaagaggttcagccagcttggtgggctccagctcgacaaggaggtccggtctctgatcaaccatttctcagaaatgtcccagagaccagtcagagacaagttctctaggctttcgcagatgtcgaccattctaaactttgagcgggtatcagagatactggatttctggggtgacaatgctggccatctgacatggctgttgacacctgcagaggtgcggagggtgttaggacttaggactgacttcaggcctgaagctattgctgctttgaggctctgaatcgtgcgtctatatatacttgttaattcttcatatatgatagagcaacaagatgtcttagaattttttgttacaatgacaaacacctgcattgtaaagaaatctgtgaacatactttttgtctgttatgagcgaattgacgatgtttgggtccatt

SEQ ID NO: 9491 - DNA, 2848 bp, Zea mays
ctcacctgcaagtctactagataacgttttagttgtgttattggcctacaggtggggcctatcctcatttttgtgaggggctgcaaacagcctagtttgcagccgggctgcagcaaatttttttccccaccaggcaccagccgcagcgcccgcacactccgcaccgcaccgtcgcccttgccctgaaaaaaagaagagagagagccgcccgccgccgtctggtcttctcggtgtccaacggtccacagcccaaccctctcgagtctcgtcttctcccccggactccgagatcttgccgatctgcaccgacgccgcggtccgcggccatggcggtgccctctcccgccccgcggtccccgcgccgaccggatgccattgtggccccggacccctcgtccgctgacgtgccaccatccctcgatttcggcgacccggcttccctcgccgcgctccgagtcctcaccgacgcgggtgccgccacccgcctcctccacgagtgcgtggcctaccagcgcgcgctcgacgcccgtctcgacgctctcctcgcccgccgtgctgacctcgaccgcgccgctgcttcgctcctccgctctgccccgcctctgctctcgctcgcggcttccgacgccgccgcgcttaaggaatcctccaccaccaccgcggcgctcgccgacgcgctctcgtcccgcgtgcgccatctcgacgcggcgcactccagggcggacgctgcgctggcacgtgccgaggccgcgctcgatcgttctcgcgcgctcgaagccgcgcggcgggccttggccgccgacgacctcgccgccgccgccaccgctgtgcacgaattcctcgctatcgacgctcggttccccaccgacgacgatctccgccgcgatctgcttgacatgaaacgtcgcctcgaggggctcgcgcgtcggaggctagcggcggtcgttgatgcacaggaccatcctgctgtgcttcgcctcgtccgcctattcccactgctcggactcgctgatgaaggactccaggtctacgtcgcctacctgaagaaggttgtcgctctgcgtgcccgcgcagactttgagcacctcgcggagctgacctccgcgacccagccgacctctgagcggccggattttgttggctgcctcacccgtctctttaaggacattgtgctcgctgttgaggagaatgatgctgtgcttcgtgagctcaggggagacgatggtgttgcttatgccatcattgagctgcaggaggagtgtgattcgcggggcacccagatcctacgccgttatgctgattacaggaagcttgcacgtcttgcatcagatataaactcctacacgaagaacctcctttcagtcatgggttccatggccagtgctgctggaggcaatgaagggcctgatcccagggaaattgagctttatcttgaggagattcttgcgttgacacagcttggggaggactacactgaattcatggtgaataagatccgtgtattgagagatgtgaaacctgaacttgggccgcgggcgatgaaggccttccgtaatggtaacttctataaaacggagcaggatctgactgggttctatgtgatctttgaggagtttttcatggtggagaatgtgaggaaagccatacggattgatgagcccatatcagatggtctcacaacgtctatggtggatgatgtattctttgtactgcagagttgctgccgccgggctgcttccactgcaagcataaactctgttcttgctgtgcttggtggggcaatgagccttctaagcaatgagtatcaggaggcactacagtggaggatgcgggagccaaatttgggtgcaaagctcttccttggtggtgttggagtgcagaagacaggtgaggagattgcgactgcactgaacaacattgacattagctctgagtatgttctgaagctccgtcatgagattgaggagctctgcgtggaggtttttcatactccagctgatcgagagaagatcaagtcctgtttatcagagctaggagaggtcagtgcttcatttaagaagatccttcattctgcactggagcatttggtggcatctgtggtaccacgcattcgtccagtccttgacactgttgctactgtcagttatgagttggatgatactgaatatggggaaaatgaggtgaacgatccatgggtgcagaagcttatacttacagttaacagtaatgttgcttggctccagccagttatgacattaaacaactacgattcctttgtgcacttgatcattgacttcattgtcaagaggctcgaggtgattatgatgcagaagaggttcagccagctcggcgggctccagctcgataaggaggtccgctctctgatcaaccatttctcagagatgtcccagagaccagtcagagacaagttctctaggctttcgcagatgtcgaccattttgaacttcgagcgggtatcggagatattggatttctggggtgacaatgctggccatctgacgtggctgttgacacctgcagaggtgcggagagtgttaggacttaggattgacttcaggcctgaagctattgctgctttgaggctctgaatcgtgcatttatttgtacttgttaattcattatatgtgatatatagcaacgagatgccttagaaaattttgttgtaatgacgaaagacctgcatcgtagaagaagtctgcgaccatatctgtgtgtctgttatgagcttatgatattgcgaactggcgatgcttgtgtccatccatgccgcaagctgtaatattttcttctaataagcttttatacattgcctctcttgttgactggt

SEQ ID NO: 9492 - DNA, 3413 bp, Zea mays
gaatttccattttcaacagagaactcaagatgattaatcctgaaatgagaaggatccactctttcccaacaaataaactatcaacctcaaaaaaagtggaattaatttaatgaattaatctatttttctgtaacaaaaacaattaactatataaacaaataagctatgccaatgaaaagattggtcgtttttgagtagttctaaaattctcatacttcttcgactcgaataacaaaagaaagaactcaaaataaaaaataagaaaagtacgattttttcgaatccattctatccaacgaacagttcttaccttaaccttaccgaaatggatcattctggatatttaaagaatcacagatcgagatcgttttcgcttaaccaaagaaaagaaggacgcttcttttttactaataatacaagaaaacaaataatacaacaaaaatctatctctatcataaagggataggtctcattttctatacagtgttttacctcattaattttttttttttttacttactttagttctttagttttgggaaaataaatagggggcacttcttttctttatattgggtgtcaaatggatcctgtaagaattcccacttcatagatacggggtataaagtttatccaaaaagttccaatttcaaaacacatattcaaaacacatatgagtaatgagtagtaggggcatatcctgaatgtgcctgatagacaaaaatttttcatgaaaataaagatattaaatttgactggacttgacactttattttttgttttctgagaaagaaaaaaatgcttagaaatgcatctaatctacgagttcataagagataattattctctttaataaacttttgtgtcgtgcagggcacaatacgattctatctttcgcttcatcagaaaaaatctgggacgaaaggattcgaacctccgagtaacgggaccaaaacccgctgccttaccacttggccacgccccatgtcatttcgttttatgaaacactaataaacactattatttttatatattattcgtcaatcccacttcaattacctaaaaaatgagggatattttcttgctaggattctagacatgcagataatatagaatccaaaaaatgcattgatcattacatggaattctattaagatattatatgaaagtcgaatttcttccattctcatttgagaatgcgaatacaaggaggtattttgtgtttgggaaagtccgaagaaaaaaggatttggaatctaccttttcttttgctttttcccttataaaaataactcaatcaaaatccaattatctactctacaagaatgaaatgcttgttatgcctaatatacttagtttaacctgtatctgttttaattctgttctttgtccgactagctttttcttcgccaaattacccgaagcttatgccattttcaacccaatcgtggatgttatgcctgtcatacctgtactcttttttctattagcgtttgtttggcaagctgctgtaagttttcgatgaaatctttactattctgcctgccaaattgaatgatgtattcattccaaaaaaaaaaaaaaaaaaggcgcgcccagtcttatattatgaaccttcgattctaaaatgaaaattcttctacattgaatgtatagctgcagcaataaattttgatcagcctttctaccccctgcgcctacgttgaacaggtacctttaggtacccacacaatacctaaactaatttttgatattgataagagtgcttattataaagcaattcttgcaatttttttaagaattgatttttgcatttttaggtgtcaaaataaagaaaacccatcctagtggatccgtgtggtaaggaaaaatgggtaatctattccttaacaaaaaaaaattttggagattatgtaatgcttactctcaaactttttgtttatacagtagtgatattctttgtttccctctttatctttggattcttatctaatgacccaggacgtaatcctgggcgtgaggagtaaaaatcaaaaattttttggaattttttcttataaatttaaattggatttatttcgtacatttatttatgagaaaatccgggggtcagaattccttacaattcgaaagtcccaaatgatccgagggggcggaaagagagggattcgaaccctcggtacaaaaaaattgtacaacggattagcaatccgccgctttagtccactcagccatctctccccgttccaaatcgaaaggttttcatgatatggcagaggcaagaaataacgattgtcaaaaatccttcctttttctttcatttcaaaagtgcataaaaattatattgccaattccattttaattatattcttttttcttaatgttaataaaaaaaagaagaaaattctggttttttctttccaaaattcgatataggctgaaagacaatcagatcttttttctcttcagcgggcagttccatatagaatttgttagaataaaacaagcgggttaaaaaaaaaaactcttttttttatttatccacaaagcaaaaaaggttcttatcaaacccacaataaaatgggaaagaaagataaagtaagtagacctgaccccttgaataatgcctctatctgctattctgatatataaattcgatgtggatgaaattggtgtataagcgcatttttgtatttccttagacttagatcgcgcaaggcaagaatttttcgctatttacgatttcatattcttgttactagacgttctataggaataagaagaaatcgcaactcttttccgttacacataataaataaagggtttcaaaagtcaatttttcttttcaatatctttcctttttttttcagaattccatttttgttcttccacccatgcaatagagagcgaatgagaaaagagggggttttcccttaaaaaatgggctttgaaatagaaatcatggaataatgctgaattcaaatgtttatttctttatttcttttctatagtacccgcgccccccgccttgtgacctctgcggatttagcacgacctgggttgtgaccccatagataaaaatgcaaaatttctatcttcgagacgactgaaaaagggcattgaacgagaaagaaatcgtccacagataatcaaactatcgtatgccctggaagtaatatgaggtgctcgaaaatggttgaagtaattgaataggaggatcactatgactatagccgttggtagagttactaaagaagaaaacgatctatttgatattatggacgactggttacgaagggaccgtttcgtttttgtaggatggtccggcttattgctctttccttgtgcttatttcgctttagggggttggtttacagggactacttttgtaacttcttggtatacccatggat

SEQ ID NO: 9493 - DNA, 1633 bp, Zea mays
  misc_feature (325)..(325): n is a, c, g, or t
acactgccccactctcctctacctccgcgccaatgcgcctccccaacatttaaacggccaaaccagcccaaaccccaaccccaaacccacagcagtaacaggggcacactagctaagctaaacctcgccacggcacagcaatggcgccgctccccgcttccctcctgccctgcctctggctcttcctctgcctcctcgccgcgccgtgccccacagcgcgggcggcgcggttcgcgtgcaacgccacggcgccgcgagcgtccacgtgccaggcgctcgtctcctacgcgccgcccaacgggacggccacgcccacgctggccgnccgtgcgcgcgctcttccagctccgctcccaccgcgcgctgctggccgccaacggcctcccgctctccacgccgcccacggcgcccgcgcccgtgccgctgctgggtccgcctgccctgcctctgctcggggggcgccggggccacgttccagcggcccacgtaccgggtccgcgccggggacacgctcgacgccgtcgcgcggggcgtcttcgcgggcctcgtcacctaccaggacatcgccgccgccaacaacgtctccgaccccaacagggtcgccgtcggccagcagctctggatccccgtgccctgcagctgcgaccccgtgggcggccaacccgtcgtgcacttcacctacgtcgtgccggccgggggctccgtgtccggcatcgcggaggagttcggcaccacggaggagacgattctcacgctgaacaagatgcccgacgccaagtcccttctcgccggccaggttcttgacgtgccacttcgagcttgtagttctgccattagcagcacagccattgaccgcaaccttctcgtgccaaatggaagctacatcctcaccgccaacaactgcgtcaagtgtggctgcagctctagcacctggcagttggactgccagccaacacagggactgagctcgtcgttctgccctgcggccaagtgcggagacatgttcctcggcaacacatcctcctccacctcatcctgcgagagcacagcatgctcctacgccgggtacaccaacagcacatcgttcgccatcctcgccaatgtgaccaccagcaacgtgtgtaacgctgggatgactccgacggcgcagccggctcactcttcggcgtttcggttggagccggtgtggctgagatggacggagctggttgccttgtctctcttcacgctgtctttcttcgtctaggctatctgcggcaaaggctgaacgttgttgccatgcgtctgtcgttagaatctggccctctgattcctagtttgatgttgtgagtaatatctgcagtgtttgcgcgacttcgatctgtaactggttggatttgtaagggcaaactctagggtaacactgatctgtgttagacggtagatcaggaaacatttgtacttcgtcaaacttttgcaaagataatttcttctgttagcaaaaaaaaaaaaaaaaaaaaaagaaaaaaaaaaaaaaaaaaaaaaaaaaaaaaaaaaaaaaagggcggccgctcgcggtctagaacaaaaaaaaaccctcgggggggggccgggaacccatttccccctatagggggccgaataacaattcccg

SEQ ID NO: 9494 - DNA, 1696 bp, Zea mays
actaaaatactccaagccgctgggccgccgtggcccacccaccgccgtcgtcaccctcccgccccgccggccgccgcagatgggccagccgcggcggcgcggctacccgcacggccgccaccaccggtgcccgcgcggcattgcgctgccggcggccggagcgggcctgctcttcctctccgtctcgctcctctccgtctcactcctctccgcgccgccgctcgcggacccgcgcccgggactcggcacctcctcctcctcctcctctcgacggttcctccgccgccatccgacaaacggctctgacagcgaactgaagggctccgagagcggcgacgcgttcagtgttccggcacgcggtggatggactgggcaggatgatctttggggatcgaagcttgctagcaacttccacggatgcagcaactctagtagtagatttcttgattctggtattaccacacgaccagatcgatacttgattgttgttacaagtggaggtctcaatcagcagagaacagggatagttgatgctttagttgctgcacgtatattgaatgctacacttgttgttcccaaactggatcaaacatctttctggaaagattcaagcaatttttcagaaatctttgatatggactggttcatctcatttcttgcaaaggatgtcagaattatcaaagagcctccagaaaaaggaggtaaagcaatgaaaccttataaaatgcgtgtcccccgaaaatgtactccacggtgttacttgaaccgtgtcttaccagcacttctgaagaaacatgttattcgaatgactaaatatgattatagactctcaaataagttggatactgacctgcaaaaactacgttgcagagtcaattatcattctttgagatttactgacccaatacaagaattggctgaaaagctaatacaacgaatgcgagaaaagaacagatattttattgctcttcacctgagatttgaacctgacatgcttgccttttctgggtgctattatggtggtggagaaaaggagaggagagaattagctgcaattcgcaggcgatggagaaccttgcatgtacaagctgtgtgatgtgtaatcattactcgcttactgagatagaattaccttttgctaaaagttttcatattctagatacgtgacccggagaaaggaagacggcaaggcaggtgtccactaactcctgaggaggtagggttgatgttgagggcattaggctacagaagtgatgtgcacatttatgttgcttctggtgagatatatggaggggaagatacattagcatcaaaaaaaaaaaaaaaaagcaagctttattcgataccgtccgaccctcgaggggggggcccggtacccaattcccccctataggggagccctaattacccgcgctctcctgggccgtccgtttttaccacgtcccggacctggaaaaaccccctggcggtaccccaacttaaatccccttggagaaaatccccccttcccccaatttggcggcaataccaaaaacccccccgccatttttcctccccacattttcacccccccattgtccaatggcaattgccacccctccatgttctcctaacctcccactgcattttgcttcacaccaatcttttttttaacttcctccaaactttcttccatacaatcaatcttctaacactg

SEQ ID NO: 9495 - DNA, 8426 bp, Zea mays
  misc_feature (371)..(371): n is a, c, g, or t
tggttatgccttttcatatatcactaaatagagttactgaccagttattctactggtcaattttttttgaccaacttgcactgcttttgaggatgatgtctcaataatgatttgcttcatgtgttatgtaacttatttgcacacttcattatttttatgcttctgtgtagtttaatttaaaaacatagaagcatgaaataaagaaatttgattttttgtatgcctacatgtgtagtttgatttagaaactgagcctcagctcagctcagctcagtaggtaggaggtgtggatgcacaccctcaccacccaggtttgagtcgtctttgactgaattcagatgcccatttcttttcttatttataatgcctcntagtcctcgtctactttttttttgtggctgagattatggaagatatcaaaatattatgatgaatccagtcacacatagctcattttaattcctggtggtgcaggttattcgaatgactaaatatgattatagactctcaaataagttggacactgacctgcaaaaactacgttgcagagtcaattatcattctttgagatttactgacccaatacaagaattggctgaaaagctaatacaacgaatgcgagaaaagaacagatattttattgctctcctcctgaggttggttcgtcctgtgacattaattgaaccttttgtcagtatgcatctgttcatttcgtttatttattacttgtttcagctcactcagtagcaagtatatgaatgtagactactttggccctttgatctatcagtagtgagcggtgcatctcctgggcagaaaaccttatactattaataacgattaatgaaagctgtagtctgaataattcaataatgacaatgatttttcacttctttggccattgaattgcctcaaacttttctcctggagcttctttgttgcatcatctccaaaaaaaattcttctgttctatttgtgtactataagaaaatgaattagttgttgaaataaaactgctgaaatcgctagttgatttcccttctgctccagctggttctctgcgatcttaaataaaatggtaatgtagcagaaaagaatgaaagatggttggttatgtgtgcgcgtgtgcgcgtgtgcgtatgtgtgtgtgaaatatatcttgttacttctttattactattccgtacaacattagctcgttttgtttctatttcttgaccaagacatggttgttgttctgatggcagatttgaacctgacatgcttgccttttctgggtgctattatggtggtggagaaaaggagaggagagaattagctgcaattcgcagacgatggagaaccttgcatgtacaagctgtgtgatgtgtaatcattactcgcttactgagatagaattaccttttgctaaaagttttcatattctagatacgtgacccggagaaaggaagacggcaaggcaggtgtccactaactcctgaggaggtagggttgatgctgagggcattaggctacagaagtgatgtgcacatttatgttgcttctggtgagatatatggaggggaagatacattagcatccctgaaagcgctctttcctaatttccatacaaaagaaacactatcaagccaagaggagcttgctcctttcctgaagttctcatctcgcatggctgcaatcgatttcattgtctgtgaggaaagtgatgcttttgtggctaacaacattgggaacatggccaaaattctggctgggcaaaggtaatgcatcttttgtaactgttcttatgcttaactgctgttaacttgttaactcaaccccccctctcctgatcatctatctctgcaggagatattttggacacaagagaacaatccggccaaatgctaaacagctctatcccttattcatgaagaggggaaatatgtcatgggatgcatttgcctcacaggtgcgaacaatccagaaaggatatatgggagaacccatggaaatcacaccaggaagaggcgaatttcatgcaaaccctgccgcctgtatatgtgaaaagaccagcagaaactcagcaatagtcaagtccatttctggaaataacctggaacctgtaactgacagtggaataaggaaaaccattggcattagtagaccaccatatcctgtttatactgatgaagaggcagatggatctgatacagaagaagatccggacagcagtgggagaggagaggtgattgacactgaacctgacgatgattctgcggtcagacaggaggaccctgagctagaggagatcctgtcagattagttcagttgtgcggctgtttcccccggttaagctatgctaatctgactgcatatacatgtgttgtatgtggcagcaattttatggtttgggcatcaccgaactagcttagatctgcagccgctggtgtacatagattttgtggtgtgcagctgtccaccctctttctcttagctgaatgagggcatgatcatgtttgtcacctgtgcaagccagatttgcttaccttttcttagtatcccgccatcgctcaaccctcaagcaaatgtgcaaataaaagagaataaaaaaacaagagaagttggttctccagtgccgttcaccatcttgggcattggacggcgcatatgatatggaccggaacctttgcccgacaaggcgacaagcagcttcaatccagttcctcggaggtcgcgttagagcgtgggagttcgcttgttttaataactttttaaaaggccgtgtgtcctcttctgttgctcccctgcagctttgaaaactgacgcagcgctgttgacccccaaccccaacggttccagggttcagaggagcactgtatctctgtcaggaattggacatgtttggcggcactagagctagagctggagctccgcaaacctcggttcgcagcggacaaaaagttcgtgcagaaacggcaggataactgaaactcatttcacctcgctcgttcgttggctcacaatcatgtgatgcacctgtagactagaatgacttgagtcagagctccacgaacgaacgaacgccaacaccgcaatctcgtgaactcacaaaccaacaggaccagcgtcctctggtatcacagacgctgccgatgccgtgagcgtgtgatggtgcctgcatggcgccctctctgtttcgtgggacgggagctgggagcacgcgcacggacgtcggacaaagggcgccgctgcgcccacttccggcgccccggcggccaggggacagatgggatcgccgtctctttgctactgggcggcagcaggctttcaccgccgaggaacgcagacacgaaccactgccgctgccgagtgcccggccactccgcacttgggcactccgcactccgacagaccacgcaccagcagcagggagggcaagcacgcagtttttttaccaccctgctccggcgtggtggacggatccgggatggccgaacggccgccagatcctccgcgcggtcgaaacgaggccctgcagcgtgctgaataccaccgcgccgcgcgcgtcacctggactgaacgtctgaacctgaactgaatgctcagtttcagtctttctttcagactttgtacagtagaccttgtttcggtctacattcttcagtggtcgtcacttcccgccagtgacgcattcgtttgattcaggggattagctcctctcgcgtgtttgttcgttcgtatataccgcaaattaaacacaagaaacgctgccactgccagtttgacagcaccaaaaccagctgagttcatctgagcttctcgagtgcgtatttcacagttcgccgacggtgagaaacttccggcgatctccaacacagcggagacgctcacgccgagccggcggcaagctggaaccgtctgcatgtaatgttaagctacgattccaccgcgcacagagaatccccgcaagatgctcagtgcaggcgagtgagccagcgcccacgcttgttctgtcttctccccacccccacctgctcactgtgcacacaccactaggcactaggctcacgctgtcatctccaacgacaccttttacgcgcgatccgaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaccccaaacccacagcagtaacaggggcacactagctaagctaaacctcgccacggcacagcaatggcgccgctccccgcttccctcctgccctgcctctggctcttcctctgcctcctcgccgcgccgtgccccacagcgcgggcggcgcggttcgcgtgcaacgccacggcgccgcgagcgtccacgtgccaggcgctcgtctcctacgcgccgcccaacgggacggccacgcccacgctggccgccgtgcgcgcgctcttccagctccgctcccaccgcgcgctgctggccgccaacggcctcccgctctccacgccgcccacggcgcccgcgcccgtgccgctgcgggtccgcctgccctgcctctgctcggggggcgccggggccacgttccagcggcccacgtaccgggtccgcgccggggacacgctcgacgccgtcgcgcggggcgtcttcgcgggcctcgtcacctaccaggacatcgccgccgccaacaacgtctccgaccccaacagggtcgccgtcggccagcagctctggatccccgtgccctgcagctgcgaccccgtgggcggccaacccgtcgtgcacttcacctacgtcgtgccggccgggggctccgtgtccggcatcgcggaggagttcggcaccacggaggagacgattctcacgctgaacaagatgcccgacgccaagtcccttctcgccggccaggttcttgacgtgccactccgaggtacgccttctactttgctcctagcagctggtctattcgacttgtttgggtatattccttgagcttaaaagaaagtagatccgctttcaatgattttgagctatactatgttactgttgcttcttacacatggaccctgaaaagttctgaacctctttgcatttgcatctttattgctggtaaaagctgtgattaaacatagacatgctttgccattaggcaaatgcaaagtgtctatctctttttgctcctccattgtacgcctaaagagttcccttcagtttgtatgcctcaaaagcttgtgcttttgaataggcaaaaaggatgattaaaaaatggcactgctagttgtttcagcatttctgctctccgctccgaacttctgctagtagtttggaagtagctgagcatgtcttgaacattagcttgtaaaccgaggttttttgttcttgatgacatacgtgtaggttactatttgtgtaaatgaattagtatctccaacagaagtacgcgagttatttatgcttcaacaaaatattttttatagccatagttcaggataaggtaattgatatgatgtctttccaaacatagcatttggatctgaggttctgggcattgacatttgccatatctcataggctatattccaagatgatgttaaacccttgccttcggaatgaagtttggaccaaatgaaattacaataccagtagatgaaaatagattatggtagcagaaaaattacagtgaagtttgttacatgtcagtcgccttgtttgttttccattgtctttgtcttgctgttgctagtggtattgttgtgtggttaaattgcacttcagccttacatcctgtttgtttatctttctaaatgaactgaattaacatcaagttcaagctagcctgtaatgagcattcaaaagtgtaatgcctcatcatgtacatacgatagcatactcattcagtcgtagacatttaagccgtttactggagtttcattccggagctaatggtctacatatgcagcttgtagttctgccattagcagcacagccattgaccgcaaccttctcgttccaaatggaagctacatcctcaccgccaacaactgcgtcaagtgtggctgcagctctatgcacctggcagtgagtgctctcgctctatggaaactcataaattctgaatcagcctttgcaatccaattctagcctcatagtgctccatgggcttcaggttggactgccagtcaacacagggactgagctcgtcgttctgccctgccgccaagtgcggagacatgttcctcggcaacacatcctcctccacctcatcctgcgagagcacagcatgctcctacgccgggtacaccaacagcacatcgttcgccatcctcgccaatgtgaccaccaccaacgtgtgtaacggtgagtgagtaggacaccgcttgtgtttgcaagatccaatagccatcatgttctgtgcctttggcaattggcggcagtgctcttgtctaagttgttgccgttggccctttgttgtttttgtcactggcagctgggatgactccgacggcgcagccggctcactcttcggcgcttcggttggagccggtgtggctgagatggacggagctggttgccttgtctctcttcacgctgtctttcttcgtctaggctatctgcggcaaaagactgaacgttgtcgccaagcgtctgtcgttagaatctggccctctgattcctagtttgatgttgtgagtaatatctgcagtgtttgcgcgactttgatctgtaactggttggatttgtaagggcaaactctagggtaacacttctgtgttagacggtagatcaggaaacatttgtacttcgtcaaacttttgcaaagataatttcttctgttatcaccatagcctttttcgtgttctagaatctggagtattgtttggctctagcattccaacgtatggattcaacatcattgcctgtaatttcagctccaacgtcttgaaagaacatactgtatgtagatatagaacacatatcaggggctaaagttaaccttattgatcaagggctaatgtgtggggtaagagcaactccaaaataacgtgttgtaaatcaaccccaaaacagacattagtaaagaatagtaatctctccctcaaatttccgcgcccctcatccaggaagcattacatttaataacataaaagcacatagaagcatataactgaataaaacgtaaagaataaacatgaagcaaattatcattaatctctcgtagcagttgaaagtaatacaattagtcatcctatcattcttcgtgatggttcaaaccgccatcttaatatccttatcaacactaaaacaatctatatcgtcaattgatgtgaatatcggccaaacgacaatatagctggctttgtcagatagcactttcaactatgtgatttaaaaacgaagtcccagtttacccctccacttaacaccgttatctatttctggctttgccaagttttagatgtggcaagtcttttgaaagtgctcatattagcttgcatgtatcgtaatggtaagtacaagaacttattttgtacggctttactttattagtgaagctatttttccagtatttttgtccaacgatgcagtgtgacctcagcgaacgggattttggtttcaggcgcgagcgcgagaggctcaagacgcactgcacgatggacgtcgttcagagtcatgaagttcagaataacggcatgtgagaagtggctcaacgcggaacaaacccgaagatgttgagcagcatttttcacaacgcagctcgtttcgtttggagatcagccgggcgtgaccgcagtagcagcgctagcgcaccgtgctgctctccgccgatggatccgtccgagtacactgccgcctacctaaatttcattcgcctgagacgcacacggcacgagcggcgcgtaatccaaccatggccaggctcagctccgggcctccggctggactcactggaagcatgaactgaaaccaagaccctagaaaaacaaaaaagagcagacgccgcgggcctccggctggactcactggaagcatgaactgaaaccaagaccctagaaaaacaaaaaagagtccgcgtggcgtgccgcctccccaccccgcccccacttggccacttttgctccggcctcactggtgccgtgctatgggcgcgccgcgcgcgcaagttcaggtcgaggcagacagcccagcgcgtgcgccgcgcacagccaaaaccccggggcgcgggcggagcccccacccaaaacccgccgcctctccgcctccaccttcgcgtgctctctccgtcctgacatcgtagcgtaggagcaaaaaaaaaaaaaaaaaaaaaaaaaaa

SEQ ID NO: 9496 - DNA, 1357 bp, Zea mays
gttatgtgacaaactgcaagaagcaaacatacagcgccgccgcgcccgtgggcccgcgggggcaatggttagagtatttgaacgagtcaagatctcttattgaagctcttgaatcacagcagattatattgataaacgaaatagctgaacttaagaagaaggggtgtgtcgaaatctcaaggttgaacagtgaacttgacctccaccataggcaggattacttgaccaaagaggagcccaaagcggaacttcttaagtgtttcggtaaagaagattcacctttgcagaggaagtttaaaagaatgcaagcttcacttgaaaaggcccggaacctaaatacaaggtaccaaatagatcaggcatcacactgttttgctgagaaagaaatggatgaagttcgtaaacaggttgaggttgaaacagctaaggtgattcaatgcttagaagaagatctgatatcagtccaacagcaactaaatgcaagcaacaaaaatgacttgttagccaaacaaagcataaatgaacttcaactagaaatcaagcagttgaatgataagttacttgaggtgttgaaagagaacgaaatattttcttctgtggccaagcaaaaagaaaaggaaattgaactattgtccaatgactggaacagattagctgctgacattggaaaatgtcttgtggatggaaatgtagctttaggtgaagcttctgatcaggttgcctttatttccaaatctttatctcaaagaaaatggatcgagaaacaagttcgaaagctgtgtagtggtatatctgaaagagatgagctactcgaagagcttcagaacaggttgaaagaggcagatgatataagacgtgacttagacttgaaattaaggtccttaagaggagcaatgcaggttgtaaatgaagagcatcagcaggaaaaatgtgatcaagaaaaagaaatatattttctaagatcacaaatatctgaacaaggacatgtaaacaatcaccaactagaagaaattcacagaataaacctattgttggatgaatcaattgagacttttgtacagaaggaggttctgcaacagacctgtgtttctttacaaaaggcaatgggagaagagattcatcgtctggagtcacaattagaccagtcaaagatacattttgctcatttattgaatcagactcaggaaaaggaacagcttattgggaagcttaaaaatgaagagttaaatgttttgttaagactgatgtcagaagttctaaagacaaacagtactgtacgtgagcttcgaattggattcaatacattgcagtcaagcctttatatgagcctgaagtgatcgctgtcaaattcagattg

SEQ ID NO: 9497 - DNA, 1386 bp, Zea mays
cccacgcgtccagttgttctttggcttctgatttcaacaaaaaaaatggtgtttctctaaaacccacaaagccctcctctgctctccatccctgtctctcgctttccctaacccacaccagaataccagatcgagcaccgatctagggttgcacctcttctgctagccggctggcgaggagccgttcggcatctggacgcggccaagggagatgaagctcgcggggctcaagtctgtggacggcgcccacgaggagtccatctgggcggcggcgtgggcgcccgccgctgaccaccgccccacggcggtgctcctcactggcgcgctcgacgagaccgtccgcgcttggctccccgacgacctcgctgccttggggtcccccacacggggccacgcgctcggagtcgtctccctcgccgcccaccccgccggctcgctcgccgccgccgtgtcgctcgacagcttcatccgcgtctttgacgtcgacacgggggcatccgtcgccacgctggaggcgccgccgtccgagatttggggcgtccagttccatcccaagggtaatgctctggccgcagccggtggtggcagtggatcagtgaagctgtgggacacggagaagtggaaggcgatcaccagcctcgccgtcccacgcccggagggagctcgccccgacaagacaggcagcggcaagttcgtcctgtcagtcgcctggagccccgacggaaggctcctagcatgcgggtccatggacggcacgatcgccgtctacgacgcggtccgcatgaagttcctgcaccacctggagggccaccacatgccggtgcggtccatggtgttctccccggtggacccgcacgtgcttttcacggcctgcgacgactgccacgtccacatctacgacgccagggagaagggcctcgtcggggccatgtcgggccacgcgagctgggtgctgagcatcgacgcgagccccgacggcctggcggtggccacggggtcgagcgaccgcaccgtccggctctgggacctcaacatgaggacctcggtgcagaccatgagcaaccactccgatcaggtgtgggccgtggccttcaggccaccaggcggtgccggagtccgagcagggcgtctggctagcgcgtcggatgacaagagcgtctccctgtacgattactcgtaggtttttgtttccttataaaccgttgcaaatgcctctgttgtaccgaccagagatttgaattcgggcatggtggttggaagaattgttgtacgcagcacagtagtcgaggtgttaaattgcaaggaaagagtttatttcgtgttaaaaaaaaaaaaaaaaaaaaaaaaaaaaaaaaaaaaaagaaaaaaaaaaaaaaaaaagcggcc

SEQ ID NO: 9498 - DNA, 1164 bp, Zea mays
tcaggccggccgggaattgggtgcctaaccgaccgaacccacatcctgcttactgcccacaagaaagaagctagggaaacccgggggatcggaggactgaggagaggcagaaaacagaaggcccggctgcggctgcggctgcggctgcctttggtttcgtcgtcgtctccgcctgttttcccctctttccatggcaggctgatgctcttcaacacacacagtccactgtcgctcctcagttataagtagctagggcatctggctgctggaaaatcaagcacgcatccaccacacacacagctagctagcagatcgtttcgagtgaagatccaaagaggtagagagatggaaaggatgagttcgtcgctgcagtactgggtggaggagcacaagctctcaaccatcggagccgtgtgggcgacggcggtgggcgcgtcggtggcgtacagccggcggcgggcgccggcgcgggcgacgggcatgcgcctcatccacgccaggatgcacgcgcaggcgctcacgctcgccgtcctcgggggagccgcgctcgcgcaccactaccacggcaagagcaccaacgccgggaagaggcagcagcaggaggacctggactacggcttctactcgcagctgccgccggccaccgacgccgacggcaacgagaacgagcgctggagctggtagagcatgctgcatcgggacaagaacaagacagcagcgagaagaaagaaaaaacaataaattagtagcaataattggtgggtggtttggcatttggcaatgatgcgtgacgtggcgcctgcaggctttcttggtcctaatcctaatcctaatcctaatcccaatccatccagctaagacgtccacgcccgtggttttgtcctgttgatttgccaccggagacgacgatgcagcgcttgctctttgatttccatggcttattatcgatcagcctccgattcttctcctgcactactactacttgtaccatttcatctattgattgaatgaatggtcacgatgatgacgataattatgttttgtttgtttgcaaaaaaaaaacagtggatgtcatgtggcggttctgtgctgtgtgtgtgtgactactgccttgcgttattttaattattgttgcaccagcttgagacaaaaaaaaaaaaaaaa

SEQ ID NO: 9499 - DNA, 824 bp, Zea mays
  misc_feature (783)..(783): n is a, c, g, or t
ttttgttttggggtatcactttcttggataattggattggattggcacattgtgttgtgcctttgctgacttgtcctgcactattttcctgttggaattctgttcacggtccccttacttaaattgccattcacctggatgcctcctggttgcctctgatgctccatgtttgttcttttctttgagtacccgacaaaactagtggtgctggtgagcgacacgccaaagccgcgaggtccgaacgccaaccggaagaggaacggccggaaacagaagctgttccccaagcactacgttacatccgaagatgatacggccggttcctagcatcagcagcacggtagcagtttgaccgttggctttggtgatgtcagcagtagggagggcacatcatgtcgcctctgccagctgctgtgatctgaagaggcgtttagctcatcatatgcctttagtcttttgagaggtctttagggttgaaaggtacttcgaaaaccgaaccagcgtctacaggcctaagagggatttccattgaaactcgtcgatgatactacagttttctttccccatctgtgccggttgtgttgtactaccactaccagtgacagtgagtgacttctaagctattcatttttttaactggagaagttgataccatgataattaaaaaaaattgggtgtgtattgaactattaccaagaaaatagtacttggattgtgatgttctgaaccttatgttttgtaggcaatcgtgacttgaaagcggtccaggtatatcttgtttanaaaaaaaaaaaaaaaaaaaaaaaaaaaaaaaaaaaaaaaaa

SEQ ID NO: 9500 - DNA, 1820 bp, Zea mays
ctccccgcctgcgccctggctgtctgctgcttcatgtgcctttcatttttgtttccatacatgatactagtagaatgcgttaataagccaaataccagtattcatgtatattgccaccacatagtgccggcctctagtcaagcatgccctctcccaaaacatctcccgaatccaaagcccactcaacatttgtgagactgctatgtggaaatatatggtaatccactaatcctgatgtgtgtttgtttcgtattccttgacaggtacttactgttaattgatgatgtatggtcatcatcaacatggcaaagtatttggaaatattttcctgaagaaaataagaagggaagcagaataattgtcaccacacggtttcaagctgttgccacgacatgctctgcacataaagatcaagatcatattcatttggttgatgttctttccggtggggaccccgacgccggccgcgtccaaaccttgtccgagtgtagaggtaatagtgccagacaatcaaaccagaccaaggtgccagacagagtttggcagatgtgtggtggcttgccgttggccatagttaccatggcaggtgtggtggcatccaagccactgatgatcagagatgaatggattgccgtttgcaattccttgtttccggagccagaaaaatgtcataaaccagaggaatttatgaggataataaactattgctacaacgacttgcctagtgatctcaagacttgctgtctgtatcttagcatatttcctaagggccgtgaagttagcaggaagcggctgattcggaggtggatagcggaaggtttcgtcagtgagaagcaaggtttgagtgtggaggatgttgctgacacatgcttcaaacagctcattgaaaggaagatgatgaggcccgttgagcacaacagcaatggaagcgtcaaaagttgtcgggtccatgacatggtacttgagtacatcatttccaaggcagcagaggagaatttcatcactgtggtcggtagccactggtccatgtcaacaagtagcaagaaagttcgtaggctcactatccatggcagtgaccccaaacgtgcaaagaatgttgacagtatgaacttgtcacatgtccgatcactgactgtgttcgagaacctggacaaactgcacttcaaatcatttaaaactggaatagtgcaagtgttagatctcgaaggctgcaaaggtttcagggagagcgatgccaacgtttcagacatatgcgaaatgattctacttaagtatctgagcctacggaaaacagacataaaaaatcttcccaataatatttccaagctcaagtacctagagactctcgatgttagggagacagaagttaaacagctgcctacgactgtagggcagttggaacggataactaacatccttggtggtgataagagaagacagagaaccctgaaacttcctaaggagctcaagggaacaatgaaatctttacgcatattgtcgggggttgagattgtggagggatcaacagctgcatcagacttcagttacttcactactctgaggaagctggcaatttacaggatccaccacaatgaagatatattcaaaaatttgctgtcctcgatccagtacctcagtggttattcactccaaactcttttaatcgttgatgagtcatctgaattcttcaagaccctggagtcaatgtcgtcatcccatctaactgacctgagagctctggagctgtctggcaaattgctttaccttccaaagtggctcgacactcttcaacatcttgtgaagttaacgctttcaacaac

SEQ ID NO: 9501 - DNA, 849 bp, Zea mays
ctcgagatttctcgtggaaatttcatgcgttccttatcttccgttccgctcggaagtctctctaccaccttctccccattccgctgttccgccctctcgcgtcgcgtgcctccaggtccctcctctgcgtaactgggtggccgccgatccgccgccaccgccctgcgtcaggtgttccggtgacaagcgtccacctgtgcccggcctcggcggctgcactgcgcgccgcgggagccagcagccgcttctccaccaaggcgaccgtgccgctttcaagatgttggaataccaaaacgcaattggggggagactgaagctgaagggtaaagcgctggacgtaaaggatggtggggtgaagaaaaagaagaagaagtaccagcgtgaggagtcgtctcagattgcgcacgatgagctccacaaaggggggagatctgaatcaccaattgatcccaacaatgagcggattgaatctgacaagaccggagatgaagggaacccacatcctgactatggccatctcacaccagcagagcgacgctacatggaacagaagcagaagatcgacatgcagaagatggccaaagtcgccaacaagtcccatagagaccgcatccaagacttcaatcagtacctggcaaacctaagcgagcactacgacatccccaaagttggtcctggctaacatagccaaactggctgtgttacgcacaacaattgtgtgctgggtctatccatttatgttagcatgttatgtatcgtttaaaacgatttgttgccaccagaaattgatatttaatttcaaaagcatgttccaactaaaaaaaaaaaaaaaaaagcccccaaaggcgg

SEQ ID NO: 9502 - DNA, 762 bp, Zea mays
ctcgaggccggccgggggaaatttcatgcgttccttatcttccgttccgctcggaagtctctctaccaccttctccccattccgctgttccgccctctcgcgtcgcgtgcctccaggtccctcctctgcgtaactgggtggccgccgatccgccgccaccgccctgcgtcaggtgttccggtgacaagcgtccacctgcaagatgttggaataccaaaacgcaattggggggagactgaagctgaagggtaaagcgctggacgtaaaggatggtggggtgaagaaaaagaagaagaagtaccagcgtgaggagtcgtctcagattgcgcacgatgagctccacaaaggggggagatctgaatcaccaattgatcccaacaatgagcggattgaatctgacaagaccggagatgaagggaacccacatcctgactatggccatctcacaccagcagagcgacgctacatggaacagaagcagaagatcgacatgcagaagatggccaaagtcgccaacaagtcccatagagaccgcatccaagacttcaatcagtacctggcaaacctaagcgagcactacgacatccccaaagttggtcctggctaacatagccaaactggctgtgttacgcacaacaattgtgtgctgggtctatccatttatgttagcatgttatgtatcgtttaaaacgatttgttgccaccagaaattgatatttaatttcaaaagcatgttccaactgcggaaaaaaaaaagcggcc

SEQ ID NO: 9503 - DNA, 766 bp, Zea mays
  misc_feature (749)..(756): n is a, c, g, or t
  misc_feature (760)..(764): n is a, c, g, or t
  misc_feature (766)..(766): n is a, c, g, or t
attttcgtcgaatcccctcctctcttcttttataatggcaattggcggccggccacgacattctccccattccgcggttccgccctctcgcgtgcctccaggtccctcctctgcgtaactgggcggccgctgatccgccgccaccgctctgtgccctgcgtctggtgttccggtgacaagcgtccacctgcaagatgttggaataccaaaacgtagttggggggagactgaagctgaagggtaaagcgctggacgtaaaggatggtggggtgaagaaaaagaagaagaagtaccagcgtgaggagtcgtctcagattgcgcacgatgagctccacaaaggggggagatctgaattaccaattgatcccaacaatgagcggattgaatctgacaagactggagatgaagggaacccacatcctgactatggccatctcacaccagcagagcgacgctacatggaacagaagcagaagatcgacatgcagaagatggccaaagtcgccaacaagtcgcatagagaccgcatccaagacttcaatcagtatctcgcaaacctaagcgagcactacgacatccccaaagttggccctggctaacatagccaaactggctgtgttacgcacaacaattgtgtgctgggtctatccatttatgttagcatgttacgtatcgtttaaaacgatttgttgccaccagaagttgatatttaatttcaaaagcatgttccaaccaggcccaaagggccnnnnnnnnaaannnnnan

SEQ ID NO: 9504 - DNA, 1207 bp, Zea mays
cattgggacccccctcgccggccgggaacctggttcaaacacctcgcttcactagaggaataatctagcagcttctgttgcctccaaattgtccggagaaaggagttgaagcagtgtgagagggccctgagacgatggcgaacctgttcctcaagcaggcaaagcagtacgtggcgacgcggccggtctacccgccggagctcttcgacttcatcgcctccaagacccctcgccgcgacatggcctgggatgtcggcaccggcaacggccaggccgcagcgtcgctggcgaagctgtacaagcacgtggtgggcacggacacgagcgcgcagcagctcgcctacgcgacgcgcctcagcaacacccgctacgtgcacaccccagcggacctgcccctggaggggatccacgccaccgtggccccgccggcctccgtcgacctcgtcaccgtcgcgcaggccttccactggctcgacctcccgcgcttctacgcgcaggcccgctccgtgctgcgccccggccacggcgtgctcgccgcctggtgctacaccgagccacgcgtcgacgccgccgtcgacgccgtgttctggcgcctgtaccacgggtcccagggattctgggcgcccaaccgccggatggtcgacgacgagtaccggagcgccgacttcccgttcgacccggtcgagggggagaagcacacgggcccgttccagttctccacgcaccgccggatggacctcgatgactacctcatgtatatcacgtcctggtccgcctaccagactgccaaggataacggcgtcgagctgctcgatgcgcccaccgtccaggagttcgcggcggcgtggggcggcgatgccaaggaggtgaagaccgtcacgtaccccatcttcctcaggattggcaaggtcaggtcggagtgagctgcacggaaaaatgaaactcgacaaactatggatacactacggacgctccgacgattgatgatcgatcatctaggaatcgatgcttataacctttttgaataatgttttattcgattgcaaatgtttgttcgatctgcacaattgtatttcaaattctaatgcatgcactattctgttcgactttttttttaaaaaaaaaaaaaaaaaaaaataaatttcaatatctatactgtgatgacaaaatatccacaataacccatgtgactgaaatctttggtttt

SEQ ID NO: 9505 - DNA, 1218 bp, Zea mays
attgggaccctcgaggccggccgggcttctgtccagtcctctgtcctcacctaccttatccccaaaaccctatcagcccaaaaccgaacccacacctctgcccttcccatggcggccacgctattctccacctccctcttgccccagttcctctccctctccgctaagcccgccgccgccgccgccgccccgtccgccgccgccttcccatcggggatgccgcagctccacgcgctgtccgccgcggcggtgggctttaggccgctcgagcccgtgcgagcagccgcgaccgcggccgtgacggaggagctcgaggcggaggggcgttcgggcggggacgagttttcagatgatctcagggtcttcgtcggtaaccttccgttcagcgtcgacagcgcccagctcgcgggacttttcgagcaggccggctccgtcgagatggtcgaggttatctatgacaaattgacgggaagaagccgtggattcgggtttgtgaccatgtcttcggtcgaagaagttgaggtggctgttgaccaatttaatggctatgtgcttgatggaagaagtttgagggtgaactctgggccgccaccacccagagatcggtcatcaccgtcaccgcaaagacccaggggtgatgccaacagggtctacgtgggtaacctttcctggggagttgacaattcagctctcgcaaacctgttcagtgagcaaggtgaggtactggaagcaaggatcatctatgacagggagagtggaaggtcaagggggtttggttttgtcacgtacggttccgccgaagaggttgagaatgcaatatctaatctcgatggcgctgacttggacggcagacagatccgtgttacggtagcagagtcgaagccacctaggcagcaatactgaaattcctcttgagatttttgtaggtgtaccggtagcccaaactctggattatagtgacgccagtcctggatttggtctcgagattcattgaagttaaaaagccctcatgtatatggctcactatttatatacatgtaatattggattcccgtgttcagtgtccttttgtatcaatttggctgcatagtgtcttgtggcacttcaaaggacatagattgttgacgggcaaccaaacctcaagaaagtatcttgtattgtttcttgtctcgtgtggtttgttcactacatttacttttgaaaataaaaaaaaaaaaa

SEQ ID NO: 9506 - DNA, 1475 bp, Zea mays
atttaatacttccagtacctatctttctttattcgttggagatttgcgccaggatccatttcgaaagaatctagcaagccagccatctgcgtcgtaacttgttgttcttcccctccatcctacttccaagctaccaaggacgggcgcagacggaggaccagcgccgtcgtccaatcccctactagcggcaccggcacgaaggtcagtcgtccaatcccctactaggggaacagccggcggcacgaaggaaggatttggaggatgacagaagctgcagttacaaggtactggtgccatggatgtgtgagggttgttgaggaggccatgggggaggagatcaagtgcccattttgtggtggtggattcattgaagagatgattggtgaggaatttgatgggttggccagccagcagtcagagcgggattcatcacaatggggagcgtcgaacaacccctttgagcagccaagggcggaggcggacagtgaggatgaagaatatgatgatgatgatgattacgatgatgatataggccgtgcatttgagagtttcatcaggaggcatgggcggccatcagctctccgtcgggcgtttgacagcatccaggacgaccttagagctgatagggatagtgacttctccattctgatcaatgccttcaaccaagccctcgctttgcaacgctcagtgcttgatgctgatgaggcccgagatgaccaaggtggatctagcaatgatgatggcttgatggaagaatatgtcctgggggctgggctaaccctgctgcttcaatatttgactgagaatgatccaagccagtatggcacccctcctgcaaacaaagaggcggttgacgctctgcccactgtccaaatagcagaggctgtcagctgttcagtctgccttgatgatcttgagctagggtcccaggcaaagcaaatgccttgtgagcataagttccactctccttgtatactgccatggcttgaactccatagctcctgccctgtgtgccggtttgagctgccatctgaagagacagaagatttggatgagcctagcaatgtggacagaacagagaacacccatgaggaagtcagggccgatggccctgaagatgacagtgagagcagtaacagagcgtgggcccttgttccttggttcagtgggctattctcaacacctgaaccacaaactgtcagaggcgctttcactgatcagcagactcgctccacttctggaaccaacatgaatgctggcgaaagctgatctcttcctcctttgtgaataatgcccatacatctgagaatagcaatggaccttgtcagtagataacttatttttctgtactgataatccttcttggatgaatcgcaaggtacaaagtttgtgacagctccattttttgccaggattttagcgatcatttcactgttgattgatttcatagctactgagcaaaaaaaaaaaaaaaa

SEQ ID NO: 9507 - DNA, 745 bp, Zea mays
actcctataggggattgggtccccccgggttggccccccccaggccgcccccgaaatcgcattctcatcgcatcgatctgcggcccgacgactacgacgacggggaggtaggggacgaatcgttgcaagcaacgaggtcagaactaaggaggccgatccatcctccagcctccgatcccatccgacgacatggtctgcgtcgcgtgcctgctgccgctcttcctgatcccggtggtcaacgccctcccttacctcatcgacctcatcatcagcaaggtgtatcggctatttggatgggagtaccggagacctgaaagagtcccacctgcatgtccatacaagcctgcagctcagaagaacgatgagggtgcgagtgaatcaaaacccctggtcgaaccgcacggtgctggtgctggtgctgcggcggcagaagataagaaagtggaatgatgcagcaggcgcttaaaatggaggccacggctctgtgtggttagctaagaaacaataattgttgtggatggttatgtacttgggtgatgggttgaacttgttatgacactccggatccttaccagttgcattactaatcgctgctgctggtctggtctgtctgaatagaagggagttgaacttgcagtcgcaaatgtaatagcgagagtgaatcttgttgtccaaggctttcgtatagaatataatgcttgaataatgagctcgaaaaaaaaaaaaaaaaaaacagaccgccccc

SEQ ID NO: 9508 - DNA, 1402 bp, Zea mays
agaagcaccctgccgcctcaccgcctctctcactctgagaccgcagatccgttgtccggtgagtggaagccgcacgaacccatggcctccggcgagcttgcctgcacctacgccgctctcatcctcagcgacgatggcatcgccatcaccgccgagaagatcgccacgatcgtgaaggcggccaacatcaaggtcgagtcctactggccggcactcttcgccaagctcctggagaagcgcaacgtcgaggacctcatcctctccgttggatctggtggcggagctgctccagttgctgctgccgcacctgctggtggtgctgcggctgctgctgccccggctgtcgaggagaagaaggaagaggccaaggaggagtctgatgacgacatgggcttcagcctgttcgactgaggagaccccctcacccagccattagcaaattttacttgtgcagtcaaagactatcttgtcttatgttatgtctctaggcttttgttacaactacccaagttttgagtttttgagatgaggctatggcatgaactcaaaccatcttggcacccggcgccggccgggtcgggcatgtccatcgtctatcttctcccccaaatcgcattctcatcgcaccgcacgagctacggatctgcggcccgacgactacgacgacggggaggtaggggacgaatcgttgcaagcaacgaggtcagaactaaggaggccgatccatcctccagcctccgatcccatccgacgacatggtctgcgtcgcgtgcctgctgccgctcttcctgatcccggtggtcaacgccctcccttacctcatcgacctcatcatcagcaaggtgtatcggctatttggatgggagtaccggagacctgaaagagtcccacctgcatgtccatacaagcctgcagctcagaagaacgatgagggtgcgagtgaatcaaaacccctggccgaaccgcacggtgctggtgctgcggcggcagaagataagaaagtggaatgatgcagcaggcgcttaaaatggtggccacggctctgtgtggttagctaagaaacaataattgttgtggatggttatgtacttggttgatgggttgaacttgttatgacactccggatccttaccagttgcattactaatcactgctgctggtctggtctgtctgaatagaagggagttgaacttgcagtcgcaaatgtaatagcgagagtgaatcttgttgtccaaggctttcgtatagaatataatgcttgaataatgagctcaaaattatgattttgtcatcaaaaaaaaaaaaaaaaaaggcccctagggccctcaaaaaaaaaaaaaaaaaaaaaaaaaaaaaaaaaaaaaaaaaaaacccccaaaaaaaaaaaaaaaggttttttgaa

SEQ ID NO: 9509 - DNA, 3624 bp, Zea mays
  misc_feature (3497)..(3497): n is a, c, g, or t
cggaaactaaaactatatttcagtttccgtatttggcaatttatggactaaaatggaataaaatggagggattaaaaattagttcctacaaaccaaacacccccttagttggcaatctgaatatctgttctgtgactaggttttgtccatctttgtcagtgggcgagagtctgaatcagacttctctttaccgttttctagttctcgtcagtttttctgtttctctctcttgatcgtatctgtatctaaactgtggtatttccgttgatgcaatggaaatgggtctccctcggttcgaaaaaaaaatagggtatctatccgcctaatgtattggtcagatgacgaataattacaacaaatacacatttacggattcaatgcccaatagtgaattcaatcgtggttgctccagcaagaccgcacactgagtagttcttcgtctttgacttccgcgcatcaccttccgaggacggccgcgaggtcttgacgtaggccgcgaccatctcctcctccgacggcttggggtcggtggggaactccatgacgatgagccagtgctcgtagtcacagccgtcgagaaggatcgtctccttgggcggccggttgctccagttcggggacgggtcgttcagcggggagtgcccggacccgccggacgacgcggtcctggccccgcgcggcgcgagaaggggccacggggcgacgtgcggtgaggcggccgcggcggcgagggggcccaggcggcggcggagcgcgcgggaggaaggggagaggaggagagaggagaggccgcggcgcgtcgctgatgcggctgccatggttcggggcagtcggtagggagctccgatggagacagcggcggggcgcggcggggcgctgggagttggagccggcggcggcggggggtgagagatggtggtagccggagtgtgaaggatgcggaaggaaatacaaatgggttctgcgccgactggtcggcacactactgcggtcgacccggaagatactgggcctaatgtaactagtgacaagacgcagatcggcccaaaccttgtttgtcgggcctggtaatcggctacgagccagcccaacacgtccagagcccgccatgcctgtggaatctctctcccgggcggtcgtgccttgcagacgcggtggcgaggctaccctaacggcggggaaccggaggctgtcaaggtctcaaggacatgatggcggtgccggtggccccaggcggcgatgccaagcattgcataccgcgcgccccagtagtcgcacatgagttcctgacgacactgactaggctgcctcgtctcgtacagtcgtacccagccggtcatggactgctgcactgcattgatcagaccatcaacagcgcaacgttgatcctgcagactgagcgaagcattactgttcagtttcctctttcttcccctccgtcttctgtctgtagcagtacacacggctcatattctgtgctgtcgtagtacacaaatgacgagaatgagcagctagctgctagaacttaaaaaaaaacggcacctgccagaaccgaacgagtaccaagtagcagcagttgtagtggtaatggtaacacacagcaggaagctggtgtcttgaattaattagcaaatagcagtggcaaagaacaaaaactagaccaaagagccctgctgcgaattatcaaacagcagttgtacttgcgatccatatccgaattaattagcaaatagcagttgaattactttggatggctgcccgctcaaagatgcagcataacggtgacatggttgccgcagcaggagcgattagttgcagtttggttacagatcaccggcagcgacgagagcccagtgttgcttcctctgattctgatagtcataatagtctgatactctgattccattccggcctcatctcgtccacacgctgccttttgctaattgcctcgttattctgtgcccccacgctgttgggaaatctgtatgcacagcacgagcactgcacacctgcagtcctgttctccgaattttagcttgacgagagagagagagcaaagagcatcgaactccctcgtaccagcagccaggaggagagaaagtgaagagaggcttgaggtatttttcggccaagaaaaaacaaacgttgaaattctctctttatttcgtccagggggagtagttgggagcatcatgacagctactgtgtcaaattgaaagccgtagctcactcaaaatgtcttcctcccgagtaaaggatattttttgtttctttttatttgtcgttagatagttaaattttgtattatccaacaattactaaaacgaaacggagggagtattaaacattggtaattaagttaaactgaagatttggctgaacttaccccgtatggccgtttgtacttcgcactacctccgttcttgaattagtttttttaactaaaccgtgacaaataaaaaaacggaggaagtagtttgtataaaaatagagtgactagggcacagatttgcagccgacgaaagatggtctacctattcatgtgatctcaggtattggactgcaatccagtggctgtctagctgacactcacaaaaaaagctaaatccaagatcttcagagtagcagagtgaattactcatctgacaaagctgtatatgcaagtatagtccgctgaatgattttttttttttttttaccgaataataaacgtctcatcaatctgaaaaaaattacatatttacatagcacaaagaggggaggagaaaaagcaaaggagagaaagaagagtagaaggaacagatggaatctagagaagcaagaacgctgacagcacaacgcacgcctcaaggaaggaggaacccaacccgctacgctagctaggggatctcgtcgatcagacggccacggcgaagtaagcgagcgtgagcgccccgtcgggtccaccggcgccgctccccgcgagcgcgccgaggaggaggcggaacgcggccacggggcaggggatgcggagcgggccccggcgcgcgtagccgtactcctgcgcggcgtggcggaggagctcggcgatgggcggccggcccagcagctcggcggggacgacgaaccgctgcgtctcctccccttccgcgccgacctccaccggcacgtgccccgccggcaccttcccgccggtggcccccggcgacgccggcaccggctccgccacggcgcccggcgccaccctgcacgcccccgtcgacacgcaccggagaaggcccctcatcgtcatggcccaggtcgcaggtctccgccggtgctggtgttactgctaccccacgagcgcgcgcggcggtggagatcgaggcggggagcgaggagggcaggaggctagctgcagcgccggaggaggaggggacgcgggggcgtgtgctctgcaggcgttgctatatagccgcgggctgcacgcggagtcgtggccgctgaggccgacaggcgggacagccgtacttgtgggnccacgtggaggtgggggtgtacgtctgtacgaataggaccacggcgagtacccgaggcgcgcgggggaggggagagagagggacggcccggccagcggccagacggggatgttgagtgagtgggatc

SEQ ID NO: 9510 - DNA, 811 bp, Zea mays
aaatcgagtcgagcaagttatcgaggaaccagtatttcgtccggtcgtccagccctatctgcagtccaccgtcgggcgagcccgagaatcccgtctcctcggcgccgcggcccccggtttttttatgctttcctttcggtcggcgacgcatacattcggcgagggagaggaagaagtcagtaaagtaaattctgttgctccaattcggacgaggagatgccgcggatccctctgatcaggttccccaagcggaatctcaaagccccatctccatccgcgccagcggcgtcgcaacccgcagaccagcacgcgaccctcatgttccggttaggggctaaagcagaggcaccatcttctggagagattaaaaattaccgctttagatctgatgtgccttgcccaccttctcatactgccgtaggaggtccagcttcactccttcctaagcgcaaacccctgactgaagaagagattgaggctattatgctggggggctccatctgatatcacctcatatgaattggaaattctaggaacatcaataagattgtatgcctgagcttattgcctttgacctctgaaagagtgttattgaagccatgtcgatatggaagtgtgtgtttttttttaattcagtctggaagttggctgttgagacatccatttccagtactccgcacatgtaactgagcaaaccgtgaacacatttagttccttgcagaagtgttgagcatggaatggttttgcttttgcataccaaaaaaaaaaaaaaaaaccagggcggccaaaaaaaaaaaaaaaaaggccccta

SEQ ID NO: 9511 - DNA, 3340 bp, Zea mays
  misc_feature (18)..(18): n is a, c, g, or t
  misc_feature (3324)..(3324): n is a, c, g, or t
  misc_feature (3337)..(3337): n is a, c, g, or t
ccctcgggccggccgggnactacaagtatttgatgcagcttcggcccgaagcttgctctagaagccggaggagaaactggtagtttagttcggcttccagcttttgaccatcagaatctcacaagaaatccaaatattcagactccagtctagcattgagcgacgagcccgagtatcgtctttagactcctcattcctcaacccgacgcggcggtgtgcccccctgctttttttggcctctccactccgttggcgacgcatacatccggcgagggagcggaagaagtcagtaaattctgtcgctccaatccggacgaggagatgccgcggatccctctgatcaagttccccaagcggaatctgaaagccccatccgcgccagtgccgtcgcaacccgcagatcagcacgcgaccctcatgtcccggttgggggctaaagcagaggcaccatcttctggagggattaaaaattaccgctttagttcagatgtgccttccccaccgtcgcatactgctgtaggaggtccagcttcactccttcctaagcgtaaacctctgactgaagaagagattgaggctattatgctgggtggctccatctgatatcacctcatatgaattggaatttctaggaacatcaataagatcgcatacccggacttattgccttcgacctctattattgaagtcatgttgatacagaattgggtttttttccaattctctgcaagtcagttgtggagacattaatttccagtattctgcacatgtaactgaccaaatcgtgaacacattgaggtccttgaggaagaagtgttgatcatggaatgtttttgcatctgattattttgtattgatgtcttgaattcttgccaaaaaaaaaaaaaaaaagcggccccccttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcanccgaacgaccgancgc

SEQ ID NO: 9512 - DNA, 834 bp, Zea mays
caagaaatccaaatcttcgggcccctcgcggccattgggcgacgagcccgagtatcgtctttagactcctcattcctcaacccgacgcggcggtgtgcccccctgctttttttggcctctccactccgttggcgacgcatacatccggcgagggagcggaagaagtcagtaaattctgtcgctccaatccggacgaggagatgccgcggatccctctgatcaagttccccaagcggaatctgaaagccccatccgcgccagtgccgtcgcaacccgcagatcagcacgcgaccctcatgtcccggttgggggctaaagcagaggcaccatcttctggagggattaaaaattaccgctttagttcagatgtgccttccccaccgtcgcatactgctgtaggaggtccagcttcactccttcctaagcgtaaacctctgactgaagaagagattgaggctattatgctgggtggctccatctgatatcacctcatatgaattggaatttctaggaacatcaataagatcgcatacccggacttattgccttcgacctctattattgaagtcatgttgatacagaattgggtttttttccaattctctgcaagtcagttgtggagacattaatttccagtattctgcacatgtaactgaccaaatcgtgaacacattgagttccttgcggaagaagtgttgatcatggaatgtttttgcatctgattattttgtattgatgtcttgaattcttgccacacctgaagatctgatgatcatgccttttgaagcatgcctattttttgaagcaggccctaagttccgtgtgtttttggat

SEQ ID NO: 9513 - DNA, 1527 bp, Zea mays
  misc_feature (204)..(204): n is a, c, g, or t
  misc_feature (206)..(213): n is a, c, g, or t
  misc_feature (215)..(216): n is a, c, g, or t
  misc_feature (219)..(219): n is a, c, g, or t
  misc_feature (222)..(222): n is a, c, g, or t
  misc_feature (225)..(234): n is a, c, g, or t
  misc_feature (236)..(251): n is a, c, g, or t
  misc_feature (253)..(265): n is a, c, g, or t
  misc_feature (1494)..(1495): n is a, c, g, or t
tctcaaagggcggttagttttgggaaggtttattaggggggacccattttttcctcctcccccctgcgataaggggcggaccggggaatcgaataaattcgtttaagcggggatttgccagccgcgcccccgctagaagttggacaacgaagggtcaatgaactcactatagggtggatatggggcgcggcggcccccctcgancnnnnnnnnannttnttnttnnnnnnnnnntnnnnnnnnnnnnnnnntnnnnnnnnnnnnntttttttgcaagcgaagaggaatcttccatacttcgccgaaatttcaggactgcaatgattcagtcagcaatgctgaaacacagcttacatgtcaacctcaacctacacgctccagacccaagaggacatgtatagtcacgagattttttttttttttttctgaaccaacttagggcccgttcgtttgtctagtattggaccaggattcattccaacttatcaaaacttacataaattagagaaacaatccggctaggaaccgttccgggcctccaatccgtaaaaaacgaacagggccttagtttatatataaataagcaactgccggcaaaaaccatacaagtcttcccatattgataccgctttcctactcctgccagcatggtttcagtgctgctcctgattctgtgtagcggcctcctgtggacatggcggcctctgttgctgcgtcgtcgaagggcctctttgcatcgtctccctcggctccacttgggcaatctcgcgtcgtctgtcgtaacgaggacgaggcctgctccttacctgctgcctctcattgaatcggaactgaggtctgtgtatgaccttaccatctacgaatagatcacctccgtagtccttgttaggaacatccagatacgaatcaggtaacacccatagaactcccggcaatcctttaactttgtatgataactcctctgaaattaatgcaccaaatcctgtgtatgttgaagtgcacactgagtagatcttcttctttgcttcctcctcacttccgaggacggccgcgagggtcttgacgtaggccgcgaccatctcctcctccgacggcttggggtcggtggggaactccatgacgatgagccagtgctcgtagtcacagccgtcgagaaggatcgtctccttgggcggccggttgctccagttcggggacgggtcgttcagcggggagtgcccggacccgccggacgacgcggtcctggccccgcgcggcgcgagaaggggccacggggcgacgtgcggtgaggcggccgcggcggcgagggggcccaggcggcggcggagcgcgcgggaggaaggggagaggaggagagaggagaggccgcggcgcgtcgctgatgcggctgccatggttcggggcagtcggtagggagctccgatggagacagcggcggggcgcggcggggcgctgggagttggagccggcggcggcggggggtgagagatggtnnttcgattaggatgttaggtaatggtctcgtgc

SEQ ID NO: 9514 - DNA, 1819 bp, Zea mays
ctttgcccccgacgccggccggggacgtggtcctcctatgcgtcagtaactaggattaggttgggctcgagagaaggaacgggaagaacgaggccgacgagaactgggaaggcatggcgatggggttagaggacggcgagtacggcgccttcatggagaaattcaagatgctgccttcgcaatctcagcatcagcagcagctcccgcttcacggcctcaccttcgctatcaaagacatcttcgacatcagcggccgtgtcactgggttcggcaacccggactgggcgaggacgcatgcccccgccggcgccacctcccccgtcgtcctggcggcgctggccgccggcgccatcagcatcggcaagaccgtcatggatgagatggcctacagcataaatggggagaacgcgcactatggcacgccgactaatccgtgcgctcctgatagagtccctggaggatcctccagtggatcagctgttgcagttgctgcaaaactcgtcgacttcgctctgggcactgacactggaggtagtgtgagggtacctgctgcctattgtggcatatttggactcaggccttcccatggattggtttcgacagaaaatgtcattccaatgtcacagatgtttgacactgttggatggtttgctagagatttatctatgttatcttgtgtaagcaacgtgttgttgccactagctgctgacaacactatcaagcaaccaactcatgttacaattcctaaagactgttttgaaatcttaggctctctgagtgaccaaacatatcagattctcaatgcttcggtagctaagagatttggtaacgatgcagtagacaataggaaccttggtgagttcgtctccgccaatgttccaactgttgggaaattcattagcgacttctccagaagcgaagcaccatctgtacctgctctatctgttatttcatatgtcatgcgatgcctccaaaggtctgaattcaaagctaaccatggagagtgggtcaaaactgtaaaacctaacctaggccctggcatccgagagcgggtgcatgaagccattgcatcagaagatggacccatggaggattttcatgttctgaagactgaattcaagtcggcgctttctgctcttatcaaggatgatgggatccttgcgataccgacagttcctggttctccgccaaagctgcgcatggaggctgttgcattagaaaacttccgcgcaagagcattttcattgctgtccatcgccggactatctgggttttgccagctgagcattccacttggagtgcgccatggtgttccagtgtcagtctccctagtggcatgccatggtgcggaccgtttcctcctgagtgtggctcaggagctgtatgggacgctcaaacaggagaccaagaaagcctggagctggagttcatcagactcctctctctgagccatcaatcatgattcatatgcaaagttcaggttccaccggctctcgctcgctccgtgtcctgcacgactgcttgttgatctactctagtagatgtcgatgtggcacaggcgcactcgatccatgtgtaccgaggagacaatatgttttgccacgtaggcacatactacaatttgctgtttctgtatgcatatggtgatagagagtgcctactacaaattcaggcatgttggaaattggatctctggatttcaatatgacagcagcaagtccaaaaatcgtggaataggaatttgtgtgtgaataatttgtgcataaaagggcacagaaaactgttgatatcagtatatgtgtgagaaatggtggaactc

SEQ ID NO: 9515 - DNA, 4708 bp, Zea mays
gttgctcggtaggagttggtcggtgcctttctgtccaattggcccgccacaagcaatggacctacttcgggtaaccgcctctggggacgtgtcaccccgcgtacttgccgccctcttcccctcactcgtgtcgccgtctccgtcaatctctcccctcgtgccgtcgtcgacaccatacatccactctctaatatcgtaacgttagcacgagtcacatgatagtgtaagaaaggtgaagcatgaatgcaactctcgagtgaggaacctatggtaggattgacgtaaaacgattatgttctccaatattagaatgacaaaggcaacaaatgatcaattatatttggagagcgtcttataacttaatgcataagaggaaaaaaacaactacttatgccatagacaataagattttaaataattacggtagacatgaatacatatatattaatatataaaagaaagttctattttaatttataaccgggacaacaaatcaactggcccggtctatttgcttcctcgagagcgagagaacatagttctagcgcatgcctgcagaaaaaggtgcaccatcgagaaacgacgagttggtgtcccagcgcgtattgtcgggtggggtaggcgtagaattaatcgtcctcctccacgctgtcgccttgtcgactactagcagcgcctgatcgcaacggccattgacggacctaggcagcgcagattggggaaacgagcgaaaactttccacagctagatgccctcctcccccccgattcggaccatccttctggaagcttgtgctcctataatcccaccaagtcaccaaccaggccaggtaccatctcttccccgccagctttgcgacgatgctgttcacaattgctcgtcgtttatgtgcacctgaaagcaaccgttggttcctccaaagatcaccacatggcagcttcttcttctgaactattgaaaccgtgattgcgtgctgtcaggttgaattccaccctgacctgagaatctggtgctttcagcttttcttcgaagtggtttctttcttctctccgaagcttgacaagcacacgcgcgtttatgggggatataaataaccatcagtccttcttatgagaaacttatttacagtttagatttaacgtaaccagttaaaaccactttgaaggataaaaaccatcgccgattatgagaaatttccaagatggtgcagtgtgtccaatcaccgatcttatgctgttcctacttgcgagaatacacgtcatcaaataactacaatcgaactgttttttcttcagcaccgctccgaccagccatcaaaccttccacgcatcctattttttgacgatcataattcttgtggttgatttgttttgcgtgaagtgttgttagtagattacctagtactaagctcgtatatttaaaccaaaccagactagcatactgtataggcttattcctcgtgatgaagtctaaaatttaatcagcgtcgcaacttggatttacctaacctgctggcttaagcaaacgtagccgtccttgccacacacacacaaaaaaaaggtaactagactgaagctgtgagccacagccacttgggtgttagcggaaggacttccggagtaacaaacatactttggttgtttgtaacggcccaggagaaggcccaaactctcgcagcttataacctgtacctgtaggctcgaccaccaacagggcgtaaaaacaaatgaaactgaaaacctttcctaaagaaagaataacaactaaagaggcaatgcacaaagaataacaactaagtgagccatttggttgtcaccctagcgtggcaccctggtcgatggcgctcttggaatttgagacagaggatccgcgacctggcgacgtggccagccgtgaggggcaagtggcacgtgaagagggcgaggtgcatgtccagctggcggcttccgcgccgcggggggcggagggcccgcccgcatagaccccgcgccgtcttggggggagggggaaagatatctatccacgtcggccggcccacgtcgctttcgaatctcccctcctccaatcggctgcccgcgcccacgtgaacggccggcccgccggcccccgctttttcctcccgcgggccgctccgtgcgcccggtccagcagaggaagccccggcggcgagcgggcgtcgccgcgacgagccgtggacctctcccagcgaggcgccgggcggcaggcggtgtcctcatccgtggcgcatgtatatataggatcctcctctgtcgactctgcacgccttatcgccacacagacacagcacaacgcacggagtcagattgcgggcagcgctcgctaatcgccatagcttgtagctgtagagaaactgctccgggaggaagtagacaaggagagagagagaggtcaacagggcactgccggagccggatccggatccggagccaaaaaaaaaaaacccagaaggatccatggctcccggagccggagacgactctgatcccgcctcttatatccacacggtaattaaataccccgtctgtttcgttgccagttcctgtagttctgctgaactgaggtcacacccgtctctgcatgctgcatgcatgcatgatgcaggtgcagcacctgatagagaggtgcatgacgttcgggatgagcatggaggagtgcatggaggcgctggcgaagcgcgccgacgtccaacccgtggtcacctccacaggtcattcattagcagagacgagctaggaatctccgtctgaaacagtcgttcgatctggtagacttaatacatgcatgtttcctgcaggctggcaggagctggagaaggagaacaaggagttcttcgacaagtacaggcagtggatctcggagaagagaagcgggagtacctcctagtcctagtagcacgggactcgatcgtgtctctctgctggcttagctcgctttaaattagcccgtgatgtgtattacgtgtgcttagttattttaggatttattattacttactgtgtttgattagggaggaataagcggtagggagggagggaggccagcttgtaatgtgattctctgtaagcaagcagagcagtagtcacctgtacggcgcgggctgtggcgttatgtgtacagggtaaagcagggaaaagccatctcatcatgcgcagcgcagaactgtacgcaagtagccgttgctggcgtggcgtatgtatgtgtatacacaatttgcctcctacttctctaccgtatgggcttatcctcgccaaaaaaaaaaaacaaatgaaaaagctcgtccttttctgacagtaatgtaaaccagaaattgagcttggtgtacttatcaaggcggtaccgttgcgttgactatgaccgaacgtctgtctgattgtctatacacgagaaacggtggctacatgagtgtatacaaaatacgtcattctgagcccatttacgactggccagctcgcgtgggactggtcgtgcggtcgtagtaaaccaatcaagcgcatactgaattagtggagatcctttttattagcactagtaaatgaaggtggacgagtttgctgcacctgcagttccttactatacaagttctcttgggtcagagtcagagattcggtagtgagacactgtattcttctatttgctaatcgatcgagtccttcggaggctgtagctctattagtttagcctatctcggaataaataaactttactaactagtgcgaacgaaatggtattctgtacgatgctggttagccttctggctcctgggtcgggcgctgtcttcctctttgtttctagttcagactatttgtacttccgtttgcctcgtgttgcaaatcttaaaaaaaatacaggcagagttgtatacggaagttttatctttataaccctaaatatagggaaccactttaatttcctgcgatatataattaaaagatgcatgacaaaagaccggagaacgagatggttggcggtacgtgcacatggaggaggatagccagtaaaagatgttacaaaatattgtgaccaatccaaggatgcgacaaattctcttcaagatatatatctcttggagatacacccttttatatgtatataaacagaatctttcctacaataaagtcataactgttgttctcttaaatctcgttacgactgatttgtgatttacaacaaaagagaactagaaactagaaagtattttgggaaggccgggccaccgtgcatggatgcaacgcagctagccaggcgcccaggccagtccaaacagggaaatataggacaagtttggtgcgacgtgacgtggcggcacaggacgacgggagactcctcccttcggccggcagcgagaccgggacgcaaccggtccggtggtgacatatgctcagcatcgatgatagctcccgcgcgagtcactgtcgcgcaaaaaagatggagaggggccgggcgggtcaccgtaccgatcggtccgcaccgcaacgtctcaatcagccggctactgcgcgtgtcttgcgggcgctggcgagtgtgtccgggtggtctgttcagtctggtgtggaaattattagtaatttagctgctttgtaaagtagatcacacaagaagagaattggtaggcttcctgccctgtgcgacggccggtccgtccatgcgcgctccatatatattggccagcgcctggtgcgcctgacaa

SEQ ID NO: 9516 - DNA, 1125 bp, Zea mays
acgccttatcgccacacagacacagcacaacgcacggagtcagattgcgggcagcgctcgctaatcgccatagcttgtagctgtagagaaactgctccgggaggaagtagacaaggagagagagagaggtcaacagggcactgccggagccggatccggatccggagccaaaaaaaaaaaaccccgcgagaaggatccatggctcccggagccggagacgactctgatcccgcctcttatatccacacggtgcagcacctgatagagaggtgcatgacgttcggtatgagcatggaggagtgcatggaggcgctggcgaagcgcgccgacgtccagcccgtggtcacctccacagtgtggaaggagctggagaaggagaacaaggagttcttcgacaagtacaggcagtggatctcggagaagagaagcgggagcacctcctagtcctagtagcacgggactcgatcgtgtctctctgctctgtcttagctcgctttaaattagcccgtgatgtgtattacgtgtgcttagttattttaggatttattattacttactgtgtttgattagggaggaataagcggtagggagggagggaggtcagcatgtaatgtgattctctgtaagcaagcagagcagtagtcacctgtacggcgcgggctgtggcgttatgtgtacagggtaaagcagggaaaagccatctcatcatgcgcagcgcagaactgtacgcaagtagccgttgctggcgtggcgtatgtatgtgtatacacaatttgcctcctacttctctaccgtatgtgcttatcctcgccaaaagtacacagcagttgaaaaagctcgtccttttctgacagtaatgtaaaccagaaattgagcttggtgtacttatcaaggcggtaccgttgcgttgactatgaccgaacgtctgtctgattgtctatacacgagaaacggtggctacatgagtgtatacaaaatacgtcattctgagcccatttacgactggccagctcgcgtgggactggtcgtgcggtcgtagtaaaccaatcaagcgcatactgaattagtggagatcctttttattagcactagtaaatgaaggtggacgagtttgctgcacctgca

SEQ ID NO: 9517 - DNA, 1276 bp, Zea mays
ttgggtacctcgaggccggccggggttagtttccgcgagagaccccggttagctcccgcgggagacgagacagcgcgcgcaaaacaaacctcaaacgccaaacgcaacacccgccagcaggccacctgtgagcagcgatgagctcgtcgacgcccggccgcgatgacgacgcgccggacctcgtctgccagatcgactgcgtccacggcatggtggacgcgctctcctcagtccgctggaagcgccaccaggacgcggtgatggagctgtcggagcacgggatcgttctctccgtagaggagagcgggtgtctccaggccaaggtcttcctcaagcgcgagctgttcgtagagtacgactatgcgggggacgggaggcagcggttcggcctcagcctgggtctcttcgtcgactgcctcaacatcttctcatcgccaggccacgcgtccgccgtcgagatccgttaccctggccccgacatgcagcttctcctcaagtctgtgggctctgccgatgcatgcctgtacgcagaaatcagaaccaggattccagacacagtctcctgggattaccattttgagcatgctgggaatagtccagtcagttttaccgtcaagtccgccgtcctgaaagaaacgatcgacgacctcgaatggccaggttccagcatccagattcgaatgcaaccagatcctccaactgttatactaaaaggcgaaggtcatggcgacttgcagaccgaattcccctactatgcaaacaccgacctcctaatcgtgttccaatgcgagcacgaagtgtcacacaggtacaaatacaagttcctccgagcgaccacctcgaacatccccagcagtgccgtgaaggagaaccgcaggaccaaggtctcgatcgggaggggagggatgctgaaggtccagcacctggtgtcgcttgccaggccaggcatgccgtacttccgtagcattggtggagggaacgagcagacgagccggatcgcgcatatagagttcttcgtgaagcccgaagaagacgataacggtgcctagctagcgttttgtggagtgtgttatcggcatgttgtttgagtagttcatgtgaaactgaagccgggtcttggtttttgaaacggctagtgtcgtctatcatacaggcatcacgcttctaatcatgtggatcctgttactaggcacgcattattttcctaatcaggtgaaacacatgtttgtggccttgtgatttgcaaaggtgccctttcaaaaaaaaaaaaatttat

SEQ ID NO: 9518 - DNA, 2553 bp, Zea mays
ttttttttttttttttactccaggtacaccaaccacacctcagtagccggccaatgttaggctccaatacttcaggcatggtcgtggcatattaaagagaatattttgttagttgttacagtactgattagacctggcaactacactacaggacaggcattaacatgccataaattgtacaacttgtccctagtttgtgctttgagatattcacaatgataagacaagaaagaatcccaaatttgtctacaatctaacagggggtaccagtttgatccatctgcccgccagacaatgccaaactgacagcttctttaacaaagttatgcaagcattctctgcaaaaatcagtaattgctgacgagttcagctgtttgactttggggctgtgcttgcagacaggtcttgagagtgcaagggattgcgatggcgaatgctcaaatctgcaggcagccaagatggaatgtgttgctgtccgagcaacttccttgaatctgtcagaaccatgtgttttgtctatcttgagtagcttcaactcacgaatggccaaagaagaaatctcactttttgcaattttacaggttgacctggatcttttggatctttgatcactgcatctttccgaactgtgttttctcttgcgctcatgctggtccagactagaacttttcgtaacttcaatggttgctgcaatatcttcagcacaaacagctgaaggttcctcagggtttaccggcatagtggattggctcccagatccaacactagatcctaattgtagggatgaagtcacagctgactggccagatgatgaaccatactttagtggatgcagcatgtctgatacgagtttttctggtctgtgtgtattaaaggtagatactaatgcttggtcaacatgttgaatgtgggtcgatgatgcaactttgccactaaagctttcctgatttattcgattctgggaagaaaccatcctctcatgatccaaggcacgactgttctcaggcaagctatggcatcctctggagttattcgtgggcagcgtatgttccacttttgtaacatgaccacagattgaataattttgttgacaagacttactacgcagattcccgttcttgtgtcccacaattgtatcaattggactgtaagaagtcgatctgttacccatggaaaatgggggacagcagttaatggaggcaggtgtcttagatgtcttcctcccaccagatgatttagccatctccaaccttttccatgccttacgggcatcacgggtgtccttttgcaagacttttttactatggcccagtgaggtattagtttcctcagagaagggcattggcagcggaacagaagctgcagcggcgccatttcgggaactgagagttacaggctctgcataacgttgatgctcagtagcaacagaagcagaaccagccatatccttccttcttctgacaggcatatgcggagcaaaccccacagaaccagcacgcagagcagcccagttctctcgcagctctcttatgcgcttatcaagattgcgggaattgcgtaatgttctagctctctcaacctcaagacgaatgtgagcatgataggctgcaagaccattgtctcgtccctgggtcgatctgggacactgagatccagctgaagtaccctgggatccaatatcctcagcaatcctcctcctaaagatccctgcactggtagcaaaatcatcacccacaatttcataaatggaaggaaccgggtcatccgtcgaaccgccaccactccgcgcatatggcctttccagatcatggtcctcatccacaacaccagaaatcgagggggctggaactggctcagctccaggaacatccatgctgatctcaaattcaccctgattctcagcctgccatctcaattgatcatctctgatcgtcccgcagtctttgcagaaccagtccccctctggcacggtggtccccagcccgacacagtaagtgtgtgcagctgagtcgcagagctcgcagagtagcagcagctcgtcatcgctggagctgctgcaaacggtgcatatggtgttcacgtaaggatctccgcccactatgctgctcccgttgccctgaggatggtgtacctggttgcgctcttggatcgagacgattcgctcgtcggggaaccggccggcgacgggcgggcggcggatggtgtggaagcgggccctgcagaagggacagcgggactcgacgcggccccaagccatgatgcagacaaagcaaaagaaatgggcgcagcagtcgagctcgccgcggatggcccgccggccgtcgagatagcagatgccgcacatcttctccgcgccctccgcctcgtcctcctcctcctcgtccatcttgcccttgcctttggatgactcggacggcggaagtgccgaggagtcgatgtcggcgagggcagccatgagggatgtggtggtgggtcgggcgcgtcggagcggagagagaccatgggctagtcggtcatttttcgattaggatgttctaggtaatggtctcgtgc

SEQ ID NO: 9519 - DNA, 1353 bp, Zea mays
attctcatcacgcatcagtgagccgttcctagctctcagcgcgtcttcgtcctagtccaggcctcggatccttgttaacctcgatctcgtgcagtcgtgcagccagtcagtcatcaggctgcaatggagcgtccgcgcccgcggccggagccggcggcgatcgacatcacctgggtgtcgtgccgcggcgtcaggtcgtcgctcccgttccacacgccgtgcctctacgcgtccgtctccgtcaccccgtcgtcgtccgccaagaacgcgcacggccaccgccggccccaccgcgtgaaaacgcccaccgaccgtgccggcggcgagaaccccgagtgggacgcaccgctgcggctctacctccccgagcccgaggcctcgccaacggcggcggagctggagctggaaccggaagcgggcaagaacagaggcgacggcgtccttctggtgcggttcgagctcaaggcagaggtggctgtgctcggcgacgtgctcgccgcgtccgccgtcgtgccggtgcccgacctcgtcgccgacgggcggacgcgccgcgtgtcctaccagctggcgggccccgacggcaggcagcccaatggcgtcatctccttctcctacgccttccaccaacggaacgccgacgccgacgaccaccaccaccaccagagcggcggcgatgccaagcttctcgtcgcgcccccctgctccacctccaccgtgttcagtcccgtcgcgcagccaccgcccacgaccgcggcgccgcggctgtacccggcgatagagtggccgctgacggaggaaataccaatttaccatacaccgctactaccagtaccagctggggctgcggcggtcacgctcgctagctcgcggtactaccctcctccaccgtcgtcggcggctcaagtgcagatggagccggttgcggtgtacccgccgccgttgccagagacgtcgtcctgcaacgtgtacccatcggtattgccggccagcgcgatgtaccccccggtagaccttgctccagtgagctgctatccgccggcatcaacatggaacgatcggtgtttgtacggctgaagtcatcgttcgtggttttggttttgtgtatgatagattgatagtttaattgatttaccgttccttcatggctcgtgctgtccgcccgcccgcccgcccgcctcggcgttttagcggagccagcgcgcggcgtgtatagtttactgtaagcctggaggtttccatctatctttgcatgttagacagttagaggcgtgctcgttttataaatttgctccattttgttgctgggaacacaaagttgatttatctcttgtggttcgaacacaaggttgattt

SEQ ID NO: 9520 - DNA, 748 bp, Zea mays
tggcttgggtacctcgaggccggccggcaggcggatgacctgatactcgtctgcggcatgccgcacgcatgtccagcacgccgcggccaagacgagcagcaaagcaaaccgtatttgtcccgcggcggcctcttcgtcccgcaaggtcgccccacctagatccggccacgccgcacgttccccttttccgccgcagcgatggtgtacgtggattcctgggacgagttcgtggagcggtccgtgcagctcttccgcgccgaccccaacaccacccgctacgtgatgaagtatcggcactgcgaggggaagctcgtgctcaaggtcactgatgaccgcgagtgcttgaaattcaagacagatcaagctcaggacgcaaagaagatggagaagctcaacaacatcttttttgctctgatgactcgtgggcctgatgctgatatcagtgaagtttcagagaagggacaggccgagcaacagcaaccgaagaaaggtcggggaaggagacaatgatgccggtctgattcttatttctttcagaaaattcacaactggaatggtggattgacgtttcattgattattgttgtccgctctgtaatggtactcggaaggaagttttttcagtacagaaccgagaacaaactgaatgcacactatcatgaattcatgattgagaaaaaaaaaacacagcaagcggccccccaagggacaaaaaaaaaaaaaagaaaaaaaaaaaaaaaaaagcggcc

SEQ ID NO: 9521 - DNA, 1786 bp, Zea mays
ccggccgccggctcttcccctcccctgcgactcgtcgccccctgcctcatgtccctccctcacgccgccgccgctgggttcccctcccatcccatctcctctcggagactgtggcgttaatacgggctttctctgctagtaaaaaaatgacaatagattttgaatggaacctgtagtgcatggccataagtgtactcgatatgcggcagggcggggtccggtccattccgagggaagacaaaacacgcaatacaatagtattagaatttagaaatgtatgtctctatcctactatttaatgttgggatcgatatatatgatgcccaaggtgcctgctgcctagagtccattgttcattagcaagaagtgcccgaaaacagccggcgacacagctgaggcggcagaagcagcttctctcgtcgtggtgtttgagtttcagcaggcagcatggcgcatgctcaagaaattcagctccagatcagaggcattccggacgaggaatccgtcgacgcccgtgatggacccaaggccgccacggggcggtccacgagaagcagcttccgatggtggatgacggtgctggtggacatgctgatggttctctgcgggacgactgtggccaccctcctcggccgcctgtacttcaactccggcggcaacagcaagtggatggccacgctgacgcagtctggcggctcgccgcttctggtcgtcccgctcctcctgtcgccggcgcgctcggcggaggagcgccggccggcggcgctcaagatggttgccatctacgcgggcatcggggtcatgatcggcttcgacaacctcatgtactcgtacgcgctgcagtacctgccggtgtccaccttctcgctcgtggccgcgacgcagctgggcttcaacgccatcacctcgcgcctcatcaacgcgcagcggttcacggcgctgatcgccaactccgtggtcgtgctcaccttctccgccgcgatcctcggcgtcggatcctcctccgacgagacctccagcaacgtgccgcgcggcaagtacccgctggggttcgtcctcgtgctggccgcctcggcggtgttcgcgctcattttgtccctcttcgagctcaccttcgagaaggtggtcagggtgcggacggcgcggtgggtgctgcggatgcagatgcacaccaacctggtggcgtcggcggtgtccgtggcggggctgctcgcgtcgggggactggcggacgatcccgggggagatggcgtcgttcaaagacgggaggacgaggtacgtgctgacgctggtgggcacggcggtgtcgtggcaggcagcggccgtgggcttggtgcggctgatcatgagggtgtcgtcgctgttcgcgaacgtgacgtgcacgctggcgctgccgctggtgccagtgtttgcggtggcgctgttcggggacaggatgaccggtataaagatcgtggccatgctcatggcggtatgggggttcctctcctacatgtaccagcactacatcgacgcacggcggcgggccggggccgagaacgccgagtgccgccgcggcccccctcgcccccgcacgcacgggaagccacgcggtcttgcccgcttgaggctccgttgtgggcctgtggctcgacagtgtgtagtactcaatgctacatagatagctagatgcctaaagatagcaaaatgtttagggctatgggatccatgttattttctaggatagtaattccaaagaatatcatttgaataagatattaagttatttatggaaagttttttccttc

SEQ ID NO: 9522 - DNA, 1254 bp, Zea mays
gcaccaggggctgcaagaaaagttctcggtgctgttcctcatgatcttggattatatgacccatggttcaaggtcaatgcgtacactctctataatacagatcggtggaaagatttgaatccgacgtttgtgccccgagtttatagagatgtggtggccacaggcgacaagtcctttgctcgagctgtttggccatcagtttatatagcaatggcatatatggagcaatttgataaggataaagatgggatgatagaaaatgaggatttcccagatcaaacatatgacgtgtggtcaatggctggtataagtgcatactgtggtggtctttgggtggctgctcttcaggcagcatcggccttggcacgtgaggttggtgacaaagcttctgaaaagcttttttgggacaaatatgagaaggccaagtttgtctatagcaagctgtggaatggttcttacttcagttatgatgatggcgacaacaaaatgagcacatctatccaagcagatcaattggctggacaatggtatgccaaagcctgtggtctcttcccaattgttgacaaagacaaggcacaaagtgcgctagagaaggtatattctttcaatgtgatgaagttcaagggtggtacaaggggagccatgaatgggatgtggccagatggcactgtggacatgtctgcaatgcaatctagggagatatggccaggggtgacatatgcactagctgcaagcatgattcaggaaggcatggttgagcagggatttaaaacagctgaaggggtctatcatgctgcctggtcaccaggaggacttggatactcattccaaacccctgaagcctggaacaacgacgacgagtacaggtccctgtgctacatgcgcccgctcgccatatgggcaatgcaatgggcactgtcgaagccgaagctccacaacactccacaggcagatataccccaggactcattccccaagaaccagttcgcctacgcgcggatcacaaagctcctgcagctgcctgaagacgaatcgtccaaaagcttcgtccgggtggtgtacgagatcatccggaacaggtttaggtcctgatcgccgcctccgcacgcctgtgcgctgagtgtccgaattcttgatgatacaattcattagtcactgtcattgttgctgttggatcccgcggattcgtatatgaaactggtggtaataaacttgccaagtgcggtagttcgtatataaatgaatttattaaaa

SEQ ID NO: 9523 - DNA, 4175 bp, Zea mays
  misc_feature (3371)..(3371): n is a, c, g, or t
cttagccccgtccccgagctttgaacgcttgtacggtgccaaaaatccagatccaaagcattcctgtatcaaaaatcctcagatattcttaaaaaaagatacgacatcgacacaatccatccagaatacgaacacatcaacctttctgaggtggatcgccctcaaatgactgatgctgcaaagacttgcgtaaactatatagcaatgagaatccagccgagtacaaaaatctgtttgttgcattaaaaaatgcagtatgtgtttggcctcagattagcattttggcacattaatcttagtcgccgataactcgggcaaaagattacccgaagcgcaaaatagttaccgagactcatgccatacgctgtcatcaccggcaacgacatccaaagccaacccgcacatcaaaccaatccagcaaaatccatagtcgcttaactgtttagaatatggacacgagaaaaataggcgttcgagagggggggacacgagaaaatctatccaactccccggagatgttgaaacgtatcgacagggaagcgaaaaatcgggaggaatcaaacctcaatgaaaacggatcgacggggaaacaaagaaaggaacgaaacagtgccccgagcgatcctagttgagagatggaggtcggaagtctctggaggttgaaagaagccgcagcagcacccagcagaccaaggtaagaaacggcggcggcggcggaagctagggcttcttctgcggagaccgaagaggcgaagagtcactagcactacgtctcgcctttattacgcttctgaacgttgggctctgatgggctacgttctgtggtgggaatctttgactgcgaaccggcccatggactgagaaagatttgggcccaaaaccacagtcctcgtcttctgtcggaaaaaagatcgcaaatgaaacgaccccgcagctgacgtgatgtgatccatctgttgccctgctctgctcaccggattccccccgacctcgccaccgccacaaacgctgtccagctcctcgcactctgacactccctcaatctccctccttcccgtccacgtcgctcgccgttccgcctcccgcattccgtccaacacccccgccgccactaccatggcgaccatcctcctatcctcccgcctcccaaccaccggtacagccacgccgtcgcccacccgccccgctccgcggttcctctccttccccgggaccgccatccgacgccgcggccggggcccgctcctcgcctcctccgcggtctcaccgcccgcgccggcttcggcggcgcagccctaccgcgcgctgccggcctcggagaccacggttcctcgtcacgggcgccacgggctacatcggccgcctacgtcgtccgggagctcctccgccggggccaccgcgtgctcgccgtggcgcggtcccggagcggcatccgcggccgcaactcccccgatgatgtcgtcgcggacctcgcccccgcccaggtcgtcttctccgacgtcaccgacccggccgcgctgctcgcggacctcgccccgcacgggcccgtccacgccgcggtctgctgccttgccagccgcggcggcggcgtgcaggactcgtggcgcgtcgactaccgcgccacgctgcacacgctccaggccgcgcgcgggctcggggccgcccacttcgtgcttctctccgccatctgcgtccagaagccgctcctcgagttccaacgcgccaagctcaagttcgaggaggagctggccgcggaggccgcgcgggacccctccttcacctacagcgtcgtgcgccccacggcgttcttcaagagcctcggcggccaggtcgacatcgtcaagaacggccaaccccgccccctgggcggacgcgtggggctctgcgcttgcaagcccatcagcgaggaggacctcgccgccttcatcgccgactgcatatacgaccaggacaaggccaacaaggtgctgcccattggcgggccggggaaggcgctcacgccgctggagcagggggagatgctgtttcggctgctcgggcgcgagcccaagttcatcaaggtgcccatacagatcatggacgccgttatctgggtgctcgatggattggccaagctgttcccggggttggaggacgccgccgagttcggcaagattggcaggtactatgcctcggagagcatgctgttgctggacccggagaccggggagtacagcgacgagaagacgcccagctacggcaaggacacgctcgagcagttcttccaaagagtgataagggaagggatggcggggcaggagcttggcgagcagaccatcttctaggccttctccattaccagtttccgggagaaagaaacttgtagtagattctatgccgacaatgtacttgtagagaggtgagctttttgacttgctgatgatgtaaacacgactcgcgattcaatcataccaaagtatgatgattgtctaatttggaggaagagaaatgttttgacttgttgcttcaaagaagctgatatcttgtctgcacataatacatgttttcgcccacagtttcttaagagagaaaccgagagtctctcgcaaatatgcagagtctctcacggtggtgttggtgtacatatataggagttgtttctaagagttctacataaatacaatatggatttaaactagattcttgtttatctcgaagcatctcaaagggattagctaaatgacttgtcgaaccaaattttagctttccaaattgacccgtctctagctaaacttggctagccactccggctaaccaaactaacttgcctattcgagagtctgttgaaatgctacatattttaatacataaataaagagtcaaataaagatttaaaaataaagtccgttggagatgctatcataaacgaaacatctatttagttacaactcttcataatatctcaacagcctcccttaatcttcaccttctctaatctagattatacttagaattttctattaatcttacatgtaaagcttcagtaaatccatcgaccacttaatcatttgagaaaaaatcaatatcaaccattcttttaaaaactctttctaaaaaaatgataatctctactactattatgtgagcactgtaggcgtccatctcgcggtgcacacgttctgccgctccgcgcacgcccgcggccgaacgctccccgcaccttcatcctccgcgcagccacgcatccacagccgtgattcccgccgccccgccgcgctcaccttccagcccgcggccgaacgctcccccgcaccttccatcctccgcgcagccacgcatcccgcagccgcgattcccgccacgctcaccttccatccccgcgctctcccatngacgtcgatgctcatcctccgcgcagccacagccgcgattcccgccgccccgccgcgctcacctaccagccccgccgcggatccctgatgttgagatctgggagctgaagctgaagatctcgcggatgcgggtgcggctgacggagctggagcgggagcaggggctaatgaagcagcaggggaggatgcgcggcggggacggcggcggcggcgagcacgaccgcgccttccttgcgtcgctctcgaggggcatcggcagcatcaccatgttcggcgggcccgcggcggccgacagacggcgcaagaattgtggcggccggagctcccagtgctccgacggcaaggcccgcaggcggcagaaggcatccttccctatgactgatgcttcgctgctagcgtcgacagtggaggcgcggcaggcggtgatcgtggatggatgcggtctcagcgtctggaggatcggtcggagctaagcagggacggtgggtgctgacagctgagtgatacgtgtatttctaggaagatcaagcccagagctgtcgcatagccagaactgcatctacttccacggcaccgtcagcaaggacaagttggtcatccagctctctaggaagatcaaggacggcatctgaagactgaagtactttgaagtttgatgaacaacaaggacatcctcacgcacaagtttgatgaacagtaagtactctaaaatactcaaccctgttttaatttctggtgatacgtgtatttcttaaaggctggttatgcgatcattttttgtccagacagccagtaatcaacaaa

SEQ ID NO: 9524 - DNA, 1826 bp, Zea mays
aaatttgtcgggtttcgaatcaaatcaaaccgtgtcacaagcaccgtcgactcgtatcgttgtgatctgattcacttataccctgttcaaatcctaactttagagctcagatttgtattcttttgttaaagaaaaactgtgaaaggtctcctctgctgatttttgttttatctccaatccttatcctcttcatgggatatttcctgatgtcgtgcttatcttctctccttcatccgtccagccacgcgatatttcctatgtctcagccattcttatctctgcagtcgatcctcatcgtcgcgcacagcaaaaaaaaggaaaatctgcccccgcccccattccctggatattttctcgcggtgcttatccccttccacgcgtgcaagcttcttcccccggtcgcccctcctctctctatcttcagcacctctctctccctcgcgtcttgtccccccgcgcgcatcttcccccagctcggaccacgccctagttcccgctccctcctgctcagctctccagcacgcgccctgcttcctcctcgccggccaccaagaagctctctccgctgcagcaccatgcgcgtagcggcgtaggacgttctcctctcgacctcctcccacgctcggctcctggatcggatctccgggccgtgtgctccagtgctggcgcgcgcccgtctcccatggcgctcctctctgctgccacgcccatctccctgctcgccctctccatcgccgtgaccctccttgctcctcccaggtccaactgttgtcctccctattccacctcttcaagctcgcctccacctcggctctggtgcatgctcggccaccacgatgtcccagcgccgatgaaggtccgtcttgcagcagcaccgtggtggccttcgacttggagcactgcgatgactccatgccgtgcccctctgcttcctccatgcccgagtccgagatcctcctgcggctcgttcatcgcggacatgggcacagagcctgtacgctcggagtgctgacctcaacatgctgctcggcttgggcaatgaccccctcagacccagccatcgcttgccactgaaccaccatcggattggcttccagctccccctcgcacgtctcccaggagctaagtccgtccgccgtgcaatgtgcctcggtctctggtcgaaggacatcggtgccctctgcccttgctcacctctctggtcgtgctcgtcgggacattattctctagccaactgctgctgcgagctcgcccggacacctcgcctccttgtcgtatcatgcgccatcctcgagcaacgtgtgcacgccgcgtccctgctcttccttgccggtcttgtttggcttcaacgtccgcctcttggattccttgccgtttgttcctgcttcgactcctttgtggtgggcgaggaccgccactcaggtgctcagccatgcctaggctgctagacgcccgaacccggggtcgccacgccatcattttcgtcgaatagaatcggtgtgccaacacgtcgatgtcgtcatttgcctccgcactattgctggtaggcgatcttgctgtcgtcgtgctcgctccgactctgtctctacgtgctcgccttcgatcaccgctgtaatcttgggagtttgagtgaagtagtggaacccacggggcgcttgctagggactcgacaggaggcaggaacaagaatcatcaatgtttgcttggagttctagttaattcagtaatcgttctctagttcgctatttttattaattgattggatcgatggattgaacagatatattaatcacaatgattatcttgattgaagcataaaaaaaaaa

SEQ ID NO: 9525 - DNA, 1785 bp, Zea mays
cagccgcgcgatatttcctacgtctcagccattcttatctctgcagtcgatcctcatcgtcgcgcacagcaaaaaaaagggaaaatctgcccccgccccccattccctggatattttatcgcggtgcttatccccttccacgcgtgcaggcttcttcccccggtcgcccctcctctctatatcttcagcacctctctctcccacgcgtcttcttcccccgcgcgcatcttcccccagctcggaccgcgccctggttcccgctccctcctgctcagctctccagcgcgcgccctacttcctcctcgccggccaccaggaaactctctccgctgcagcaccgtgcgcgcaggacgttctcctctcgacctcctcccacgctcggctcctggattggatctccgggccgtgtgctccagtgccggcgcgcgcccatctcccatggtgctcctctctgctgccgcgcccatctccctgctcgccctctccatcgtcgcgcccctccttgctcctcccaggtccaactgttgtcctccctattccacctcttcaagctcgcctccacctcagctctggtgcatgctcggccaccacgatgtcccagcgccgatgaaggtccgtcttgcagcagcaccgtggtggccttcgacttggagcactgtgatgactccatgccgtgcccctctgcttcctccatgcccgagtccgagatcctcccgcggctcgttcatcgcggacatgggcacagagcttgtacgctcggagtgctgacctcaacgtgctgctcggcttgggcactggccccctcggacccagccatcgcttgccgctgaaccaccatcggattggcttccagctccccctcgcccgtctcccagaagctaagtccgtccgccgtgctatgtgtctaggtctctggtcgaaggacatcggtgccctctgtcccttgctcacctccctggtcgtgctcgtcgggacattattctctagccaactgctgctgcgagctcgcccggacacctcgcctcctcgtcgtatcttgcgccatcctcgagcaacgtgtgcaagccgcgtccctgctcttccttgccgatcttgtttggcttcaacgctcgcctcttggattccttgccgtttgttcctgcttcgactcctttgtggtgggcaaggaccgccactcgggggctcagccatgcctaggctgctggacgcccgaacccggggtcgccacgccatcattttcgtcgaatagaatcggcatgccaacacgtcgatgtcgtcatttgcctccacactattactggtcagcgatcttgctgtcgtcgtgctcgccttcgatcaccgctgtaatcttgggagtttgagtgaagtagtggaacccacggggcgcttgctagggactcgacaggaggcaggaacaagaatcatcaatgtttgcttggagttctagttaattcagtaatcattctctagttcgctatttttattaattgattgggtcgatggattgaatagatatattaatcacaatgattatcttgattgaagcataaaaatgtcgtagttatattagatggttgtcaaaatatcttgttgcatgtgaggaaaaaaaaaaaaaaaactagtgtcgtgaggtaaagcttaggtttaaaatggtggttacataggagtacccgagcggacgtgtctgtcgagtgtgtttaaattggttttacttatgaagtgtggcgaattagtggcatgaagaatagatttagtattttaatcgatcatttgataagttgacac

SEQ ID NO: 9526 - DNA, 745 bp, Zea mays
tgcggcgaacgcgcgcctgacgccgatgctggtggacaggggcccgacgttctactacgtggggatgacgggcatcaaggtgggcgggcacgtgctgcccatcccgggctccgtcttctccaccgccggcacgctggtggactccggcacggtgatcacgcggctcccgccgtcggcgtacgcgcccctgcggtcggcgttcgccaaggcgatgcagggcctggggtacagcgcggccccggcgttctcgatcctcgacacctgctacgacctgacggggaacaagggggggagcatcgcgctgcccgcggtgtcgctggtgttccagggcggcgcgtgcctggacgtggacgcgtcggggatcctgtacgtggcggacgtgtcgcaggcgtgcctggcgttcgcgcccaacgctgacgacaccgacgtggccatcgtcgggaacacgcagcagaagacgcacggcgtgctgtacgacattggcaagaagatcgtcgggttcgccccgggagcttgctgatccggccatggtttgtgaaaaactccagatcatctgcatccaccaaagtggtcagtgtttcacaaatgcagactgaagattcgtacttcgtgtctgtaagatggtacactttgtttgaaaaagaagaacgggataagtttaaaccacctcttcaatagttctctcccccccctctacttccttagttcttttttatttattaacatttagttaaaaatacaatac

SEQ ID NO: 9527 - DNA, 1530 bp, Zea mays
cgataaacctgccgtgtcccgttcaccccgcgttcgcttcatccgggcgtgggctaccgccgcagccgccgccctacgtccggtgaccaggctttcattgagctttgccgacgacgaccacgcaccagatggctgggtatatgtcaagagggccccaaaatggttctgtgtatgtctgcaatctacctcctggaactgacgagaatatgttggctgaatattttggcaccatagggttgctaaagaaggacaaaaggaatgggcgcccaaaaatttggatctatagggacaaagtttccaatgaaccaaagggtgatgctacagtcacttatgaggatccacatgctgcttcagctgctgtggaatggttcaataacaaggatttccacgggagcactattcaggttcacatagctgagtcaaaaagcaaagatgctttcgataaccccacaaatttgaacaccattgctggtgtcagtgaacaagatgaagtggataacggagcaggcagaggtagagggcgtggtgatggtcccggcaagtcttggcagcaagatggggactggatgtgtccaaatacaagttgtggcaatgtaaattttgccttccgtggtctttgtaatcgctgtggagctgcacgccctgccggtgctggtggaactggtggtggaggtggcggtaggggtagaggccgtggtaactctgatgcaagaggaagcagtcgtgcgggtgctggtgctgctactggtggtggtccacctggattatttggcccaaatgattggccatgtccaatgtgcggcaacatcaactgggctaagcgtaccaaatgtaatatatgtaacacctccaagcctggtaccaatgaaggtggtgtgaggggtggccgtggtggtgggtacaaagagctcgatgaagaagaactagaggaagttaaaaaacgccggaaagaggctgaggaggatgatggagagatctatgatgaatttggcaacctgaaaaagaaatttcgctctaaagctctgcatactggaagtgcgcagacacttcctgggtctggacgtgctggatgggaagttgagcatcgtggttctagtgaaagggaaggcagggagaggagcagggatcgtggtagggacgactatgatgaaaaggaaaccaggagcatagatagaggtgatcatggaagggaccagcgccggagccaagaccgcgaaagggaaaaggggagggagagaagagaccatgagtatgagagaagtagggagcgtgaccggcgccacaggtgaagagagaaatgacagggctttctgttcttacatcgcatttgccactttttgtagccatggaacccgtggtcttgtgttagtatctgggggcgtgcattgattctcagaatctgatttttgctttgaatgtttcgctgcattggcactttattcagatatgccgttccttctgttactacttttatgtttgtgaaacacgtatgacactcgtggatccaatgtcatgcccatcacgagcttg

SEQ ID NO: 9528 - DNA, 2637 bp, Zea mays
gcacgagaccattacctagaacatcctaatcgacaagaactaatctaagtgcctcctagaaaaagcttaaccaaagcaaacccctcgcccccacgcaaaccccgataccttcgccttttccgcccgcgccgtccgtctccgtcgatggcgatggagattccggcgcaggtgcgccgctactggctgccgatactcctattcaccgccggattcctgttccaggtcctcgtcctgccccgccacttcccgcccactcactacgacgtattgggagtggagaggttcgcgtctgtcgagcgggtcgtggaggcatacgagtcgctctccaaggagtggctatctgaaacgagtcaccaaccaactgttgatattataaagatccgttatgcatatgagctgttgacaaatccagttttaaagagggactatgatctttttggactggatgagcataaggatgtccttgagagagtcaaagaacaatatcaaatggtgcactttctcaaaattgatcttccattgttaaaagactctgtagtcagtttgatcgatgatgccttcaatgtactcacacatgagtcgttcatgtctgctattagtgaagaatacccgttaatcatacttgtatattcaaaggggagtcctcggtgtgctcaatttattgagtactggaagcaaattggcactcaattggatggaattgtcagaactgctatggtagaagttggtgattcacaagtggctggttatttcgccgaaaaacggttctcgaaacggccatttttccgtaatggtgtaccaacacttgttgcataccctgctaactgcaaaagtccatcctgttacatgaggtacccaggtgggctttttgtggattctgttgttgattgggttgcaacatcagttgtaggattgcctcggatcttgtactattcaaaggagacattgggcccccaattcattgggaagagtggcaatcataaggtcaaaactatctttttctcaagtactggagagcgtgctgctccattccttcgccaagctgcccaagagtattcaagttattcatcatttggatttgtcctatggagagaagacgaatcccagatttggtggaattcgttaggggtggaatcggctccagcacttgttttcttgaaggggccaggcacaacgccttttgtacaccatggaatttttagcaagtcagagttcatagagatgatggaggagcacaagcaccatgaactgcgacagctaagaagtgacacatctttggaactgggttgtgatgctagaggtcattcacgtgctggcaatgatgcagcaatttggtattgtgtaattgttgctggtcgtccaggtgcagaattaagcaagaagagacaaattttgcggaaggctcaagacaaattgttaggtgatgttgacagaagtgctgggaacgttgacaattcagtagagacatcaagtgctgcaactgccttcaaagatgataggttaacctttgtttggttagatggagaagtacaaaagcaaatttgtgccttctaccttgccactgattatactggagcctgtggccctcgagactttggagatgacaatgataaacctgaaatttttattgttcgattccaaagaaatgcaacatatgaggcactgaaagctgaaaaaaagaacaatcttgtggatgttctccagggacagcatgctgatgcgtcccagttagtggcaaggtacaagggcccagttgaaattgaagagataaataggtggatctctcagattatcaaagatggagatactagagaaattccttactttacttcaaaggtgccagatcttgtaccagaggaaacaagcaaagcatggaattctaaaagtatccgctcagcagggaaaagtctaaaagagaacatcggtttccatttccaagattacctaacccacccaatgattggttcaactttgcttatgtgcggatgtatttctatgggaatattatggttcaggaacaacacacccactcaaagtactcgacaggagaaagctcggaaagacaaggcaaagaggccccgtccgaagcttagcacgtcgctcttcggtgaaccttctgtcccagacgtcgacccaaaagatgctcgtcagtgggaaatgtcaagctcggattcagactaatgactcgcttcttacatttggacctgacgtactgcaaagacgttttaaaattaagtaaactacatagtagtgcggtggccttagttttgggaaatggaacagagtataaccgatgtagtgaaaacagttggaccactgaagtaatccagttgccatctttccgatgcttcagctgccctgtgacgtgactccagggacgtatttgttgacacctgcttgaaaactgacaagcctctctattagacagagtgttaacctgtggtctcagaatggagtaaacaatggtagacagagtgttaacgtacatcatgtctgatgtaagccggcaggtattttcgtcgtgagccaaaactcggctaacgtcgtgacacggactattatttttatttttcttaaataataatcccttttcagacaaaaaaaaaaaaaaaaaactcgagggggggcccggtaccc

SEQ ID NO: 9529 - DNA, 3013 bp, Zea mays
  misc_feature (1289)..(1289): n is a, c, g, or t
tgaccagcgccagcgggattgcgcaggagctgatgggcgggagtgcgtgggagatggtgaaccgtaggggatcaacaaaaatggctagcgaaggggagacgatggcgagtgagatgcataagtgaggatgaaggtgaggctgttggaagcaattttgactagccttttctattttttaccgagcataattcatttacctagcttgttggagttgctcttagctttcaaccattgaggtaaatcgacctcatcgaagggcaattgtcaaaagtgaatttgttgaaagctaattaccatgaccaaggagatgagccaaataatcttcaggtttcttcatgtactccttgtgcaagcaaggaagtgtccatgacaagaaaaggctgtgcagatctctaacagcctccaatttgtagagtttccctggcttccaaaatggaatgtcagtcttcggacctatatccaaaagagggccagttttaaccttgctaaacagctccattgtccagccttctagaatgtcaagtggttctgaaacatgcaaagagcaagagcattaactcatggatatgatttatagttaaaatatctttttaaaaggaaagattgaagcccacctcctccgattataaccaatctcattgctcctccatggtaatttctcatgtacatctctaaaatctcttctcttagattgattccactgcccattgcgtcaactaaacttttcttatttcctattggataattagataatatatcaaaacttcagaccaaatgcaattcaaagaatagcacaacatgaaaatgaatgtccaccttattgtgttcaatattatatctggctagcaaacttaccccaggtaaatctgttcaaagggtgcccttgagaacaggtatgagactggagttggtaaaggcggcaggtatcactttgcaaaacttgattaaactctgatgtaacacaattgtaaaggcaagagtaattacaatgtacaatggtattcaacgagccaaaataaattagtagttagccagaacaagataaccacagacctgagtccactgctaatatctcacggtccattgcttcagccttaacaaggggtgacacaaagaactgagaaaatctaataatggaatcagaaccatatatgtaagtttcatactaaagagttcatttaagaagaaaggaaaaaaggaatgaagaacagtgaacaaatggcatccacctgtctaaggctcccttcagatactctcgtttaacctcaaaatggtagcatgtgtactcngtttcagtgaaagcattagatgcaccgccatgtttggacaggtaactgtcatactacataaaggagtcatcaagtaactcacatggctgtcatccaaaagttgctcagatatacagcatatagcaaaggtaagtgatcacaagcaacacgagaacatctgatatgaaccaaataacatgcggaagtgcatggaatttccaagttccacaaatgtttggaacacatcatgggagtcacgtcatcactgatcaagttctgtcacacattagcagtgctgaagcctctatatgttatgagtatcagcactacaaaataaatacattcatcattctagatgagcactaatgcagtaggtttcatgttctattcaaataactgattaaactgtaacaccttcatacagtgtactttaactgcatgcaaaggtaaaatggtttctataactgatacttagagagagagagactgaaagtatccactacatgcttaaggattatttggtcagaactcagaagtcgatgatgcataccgagatgctacggagagaataaaaggacatatgaaaagaaaacactaaatacacctgcaaaccttttcaccagcaaaatttaaatgtatacagtaagaaacaggcagagtacaaaagacaatgtgtaacacaaattctatacaagaaaggacgacgaagagttaaattcatcacctttatcatagaataaggatatgtttgaaagatcattacaatggctgttaatttgatgttatataagacatctactataggtgtacatttgtgctgtgcctaataggccggcccaaagcacacaatttctggcacggcccatatctggcacggcccaacctaattgtgggcctgggccggcacggcccacattgtgggccgtgcctgggcctcaagtcaagcccacgggccggcctggcacggcccatttaactaaggcccaccgaggcccactaaatatagactcagtatttaactaaggtccgtcaaagcccacatgactagcataacttggagaatctagagcttcaataagccatcgagaaccaatacctagatatggatagtgaatagtgatgatgatcattgtatatgtattctgtatggatgtatagtactcaattaaacactaaacagagaactgaatattatttgtgagctagttgtaatatttttttctttctgaccaaaggtttataatgtgcatccacaaaacatcttagttttattttggtcatatatatattttatactttttgttgatgtattactgttgtatgtatatgggccggtctggcacattaagacattttgggctatttgggccggcctggcacacataactaattgtgggccgtgccgtgggccgatgactgggcacacgtgctggcacggcacggcccataattagatatgtgcttttgtgggccgtgcctttgtgggccgtgcttttgtgggcctgtgccgtgccgggccaggccggcccacatgtacatgtataacatctactgtcccacaatggcaaaactgaattaaataagttaacagcaacgtagctacagaattgaagcttgtaccataatgatcagcaactaaacaaacgacacccccagggttcaaaactgggcctcccaggatattaaggacaagataacttcagcaaccaagcataaagtattaacagaagagtctgttgttccta

SEQ ID NO: 9530 - DNA, 1763 bp, Zea mays
gcacgagatttttttaaataaaaaaaaacatgaggtgttttcccccaaacaccgctccacctccttccgcctcgcctcgcggggggtccccccccattccccagtcgccgcccaagtcaaaaggagggaagcttcttccactacagtccttgaggccgcccatcaacgactagacgctggtcaagctgcaccaaccctagccccataaccctaggtccctcctccacgcccccttccagagaggcgaggaaggaggcgaaaggaaccatggattcctccggcggcggcggtggagcgcagatcaagggtatggcgacgcacgggggccgctacgtgctgtacaacgtgtacggaaacctcttcgaggtctcctccaagtacgccccacccatccgccccatcggtcgcggcgcctacggcattgtctgcgcggctgtcaactcgcagtcaggggaggaggttgcgatcaagaaggttggcaatgcgttcgacaaccacatcgacgccaagcggacgctcagggaaatcaagctgctgcgccacatggaccatgagaacatccttgccttaaaggatgtaattcggcccccaactagagagaactttaatgacgtgtacattgttactgagttaatggatacagatctccatcagatcgtacgctcaaatcagccattgactgatgatcattgccagtacttcttgtatcagttgttacgagggctaaaatatgtgcactcagcaaatatattgcaccgcgatctgaagccgagcaatttgttcctaaatgcaaattgtgacctcaagattgcagactttgggcttgcaaggaccacttcagagacagatctcatgacagagtatgtggtcactcgttggtaccgggcaccagagctgctgttgaactgttcacagtatactgctgccattgatgtctggtcagttggatgcatactaggtgaaatcgttactcgtcaacccctgtttcctggacgggattacatccagcaattaaaattgatcactgagctcataggctctccagatgatgcaagcctgggatttcttcgaagtgataatgcaaaaagatacatgaaacaactaccacagtttccaagacaggacttccgcctgcgtttccgcaacatgtctcctggcgcagtcgatttgttggaaaggatgcttgtgtttgatccaagcagacggattacagttgatgaggctctgcatcatccatacttggcttcacttcatgagatcaatgatgaacctacctgccctgcacctttcagctttgattttgagcaaccatcctttacagaagcgcatataaaagaactcatctggagggaatctttagcatttaacccagagcctccctactaatatcaaaaggatgatgagttatctgctagaggcatatgaagatctctaggtccagcggacgcaagaacttatgtctgtgtcagtgtgcgttgattatttacgtgcggtttgttgggcatacgggcatgggttggtgctgcaattgcaactctattatggcttgtgagagcaaacaaacgtctgtattcattttcagatgcctgaacccaggcttgtattataccgcttgactccataaattattcttgtgtatctatgcttgtaattttgcagacaattacttgaacgccccttgtatatctgagttgacatctcttttctatagaaaaaaaaaaaaaaaaaaaaaaaaaaatgttactaacgcgagcctcgggggg

SEQ ID NO: 9531 - DNA, 1873 bp, Zea mays
cttcctctccccaccgcacgcatccagtggctgctgccgcctcgcccccgctcctcctcctctcccgccacccacgccgcgcaggcctcaccaactggtcgtcgttgcctaggggccagaacgcaggatccacagccccgccggccgccaccgcctccaagcctgctgcgccgctcactgtcaacctgcctcgccaagtcgcccggatctcgacgccccacctgcggccggcggcggccccgccaaggtgccctgacagagttcgtgcgctggctggttgtctgcggaagactctccctctggcatgtaccgatgcgatctctcaactagtcataagcagctgaaagtagttcacatatatacttaaatactcaatcaatgaaagtagtgcactaaaatttgttccgacatcaagtttgctaaactattacggcaacatctaagctatgcattatcatacaccaacgcagttcgattgtccagctgataataataaaacgaaagctacgttgtctcctgctcctagagtgaactgagtcgacagaccacatactgacatacgccttgccttcttgtaaatatagcagattttgcatcatctggacgctagatagtttttttcttgtgttcagactttcgaagttgaattgaacaaattataaggatgtttagaactgctactgaattgttagagaattatatagatatgttatgttaccgacttttttttacctgatgtgttcttttatctcggcaaccctggatttgaatcctagctccgccactgccgccacctccctgctccaaccccgcacctccgcttcgccatgaacccttcgtcgtcatccacctcctcctctggcgggtaccactctagggccgctgcctttgcttccccgcagccgcgcggcggtggcggtggcggtggcggcggccgagatgggagcgaccgcatcgacgccctcggtcgcctcctgacgagggtgttgcgccacatggcggcggagctgcgcctagatatgaggaccgatggatacgtgcgcgtccgcgacctgctgaagctcaaccttcagaccttcgccaaggtccctctcaagtctcacactgttgacgagatcagggaggcagtcaggcgggataacaagcagagatttagtctgttggaggaagatggcgagctgttgatccgggcgaaccagggacacacagtaacaactgtcacatcagagagcctgctgaagcccattttgtcccccgacgaagtgtcagtttgtgtgcatggaacttacagaaaaaaccttgactcgattttgcaatctgggctaaagcggatggcaaggttacacgtacatttctcaagtggcttaccatcagacggagaagtaaccagtggtgtacggcagaatgtaaacatcttgatacatctggacgttagtaaagcacttaaaggtgggatgaagctttatatttcagacaacaaagtgatcttgacagaaggttttgatggcgtcgtccctgtgaaatacttcgaaagagtcgaaacatggccaggacgagctccaataccgttccaaagataacagcccatgtttcagcattgctagttcgtacgtactgaaaaatgatttgccgtgctgtatcccggagaaccattgggtaaatttgattgtgctgggacctctcagtgattcgattgatgattttccggactccgtgaaaagttgtggttctttgtgagtcttttcggtttttgtgtaacgaaaccgaaagacgagtgagttagtttctctgtgcctaggatgtcaagatggtttgtcaaccatctatcctaattaatggagtacgagaaaaaaaaaaaaaaaaaaaaaaaaaa

SEQ ID NO: 9532 - DNA, 3118 bp, Zea mays
  misc_feature (2532)..(2532): n is a, c, g, or t
ttaaccaacgaaaatagagttgcatctttcttgagagcacccacccaattgaatgcatatgcagcaacatgcacagataaaatgttttataaatatggtttcttctgctcggtagaatgtatttttcaaatccttgtaaaaaaagaatgttaattttcatgttttgtcttttgttttcttaaccatcttgatgcagcaagtaccagaaaactctgtttttgtgatgggagataaccgaaacaacagctacgattcacatgtgtggtaatgcatcagttccattgaattttttgggtttttttttcttctgttgccacttttgtcatttcagagtttgaatttaattgaccggcaccattgcataatctttgcaggggccctcttccagcaaaaaacatattggggagatcaatttttcggtattggcctcctggtcgaatagggggtactaccaagggttgcttcagccctgaattaagccctggagcaaagccagaatcacttactgatgtcaaatcgacaaagtaggagattgagaagttagttttggtggtgcctgatgtgcaggggaagcttcggttattcttcgtggtagaatgtcacagaggaatcctgtgttgtgtggcaggtagttctattagaacccagagagaggaagacaatttgattctcattgagtcattgaattggattggccaaaaggcacagaaaccattttgtctcagggtttcttgtccttttgccttgctgtatacgtacgtattagggaaacttgataccatgatggctgacctagttaagctgcaaaaaagtatggttccactgttgaaatctagagtctggaacatgatgaaatccgcgtacagcatgacgcgcaagtacatcctgtaaatggagaacgtgtatattcgatgtgccgttgaacaacgcagagaaactacccggattacttacgctaccgcagaaaaagatggattatgttagattgcaattgcaggcgtacaattcagcctttttttaaacatttggttgtttttttcgggtgtcttcgttaagtgtttggaatagatctgtgagtttgttaaggcaccgtccttgcgcatgcggcatgcatcagcacgcctcgccttatacccccactggcccttgttcccggcgaaacgtcgtcgcgaattgatctgaagccactcctcttctagtcttcatcttcatcctgcactatacgtacccgcaagccacgcgagcgagcgagcgcatgtgctgctccatggactggacgcacgctaacttttttcccatcttcaggtcgcactgcacatgcgcacactggccctcgtttgcgatatatagcaccaatcactgttcgtcgtatcactaaggatagaaatatggctgtagctgtttacgccctcgccctcgcgctcgcgctggccatggccgccgcggtcgacgcgcagcagaccgagtggctcagggcgcatgccacgttctacggcggcgcggacgcctccggcaccatgggtaagaagccgcagcatacatgcgagctgacgacgaacgatacaccatatatgatatatcataaactaactctgtcgtcgcatcgtcgtatgcatgcggcacgaacgatcgagcagggggcgcgtgcgggtacggcaacctgttcgcgcagggctacggcacgcgcacgacggcgctgagcacggcgctcttcgacggcggcgcctcctgcgggcagtgctacaagctggtgtgcgaccggccgcaagacggacgcgacgtggtgccggccgggcgtgtccgtcacggtcaccgccaccaacttctgcccgcctaactggaagctgcccgacggcgggtggtgcaacgcggcgcgcccgcacttcgacatggcgcagccggcttgggagaagatcggcgtctacagcggcggcatcatccccgtcatctacaggagggtcccctgcgccaggaagggcggggtgcgcttcaccgtcggcggccacgactacttcaacctggtgctggtcaccaacgtcgcggggcccggctccatcagggccatggacgtcaagggctcgcagcagccgccggcggacgacgaccactggatgcacatggcgcgcaactggggcgccaactggcactccctcgcctacctcaccgtccagaggctgtccttcagggtcacggtcaccgacggccagaccatcgtcttcgccgacgtcgtgccgcccaagtggaggttcggccagtccttcgccagcaacctgcagttcaagctgtgactctgatctcagctgcagacctaattaatttctaccttgcaccagctgtatatgcatatgtgatgtatatgaagagatctgctgatttcataagtaccgacaaattagtaactatactccgatttttttttgtttgattatctgactcaatgctcattgtatttatttttgctggtaatttaaaagttcttcttactggttactgctgagcaaaattaattattattgttcgaaaaatgacganttgttgcaaagagaagtcaatggacctcaacatttacacaagctcaggctctactagatcatcatatcaactcgccagcgtgaccaggcttgaatagcaagcacagtattgactttgactctcgttcgtatgtatgtacactgtgcgaagcaatacgtggtgttgtgcttctcaagagtcaaaaggcagctttacgtacgcacgtagcacaactaaacgtcggaagcaatgtgccgtgaacacgaccgtacgattggcactgcagaggatcttcgacggcaaaagttattttcggggtcgaatcctggccgccaaaaataagatcttatttttggcggtcgcgaaccttagccatcgaaaataattttagccgctgaaaataaacttattttcggtgaccgtgtgcaggccgccaaaaattaacggattttaaacgcaagatatcttttctctctttccttctcccttcctcctctctcctgacacgagcggttgcagagacgccgccgtcgccgcacacgcccgatcaccaccgacgccgagccctcctcccgccaccactctcggctcccgctccctctacaca

SEQ ID NO: 9533 - DNA, 2200 bp, Zea mays
  misc_feature (24)..(24): n is a, c, g, or t
aaccagtctcaaacctcaccggcngcggtcattgaccgcaactggttgccgtgtttacttcccccacgcgccacgtttccgcgcatcccgagactccgagagagtggctggcggaaattgggacctcgagccggccacaaatccaatctcgctacgtgaagttcgcctcgcggcctcgcctaccaccacccgtgcccgtgtcccgccgccggcggcgctggggatggcggggcccaaggcggctgaggacggctcggcggctccgctgctgcctgcgcaggcgggggaacggagctcaggaggcgtgggcggaggggccacgtccgcgcagacgctggggaacgtggttgtctccatcgtgggcaccggtgtgctcggcctcccctacgccttccgcgcggccggctgggtcgcgggctccatcggcgtcgccgccgccggctccgccacgctctactgcatgttgctactcgtggactgcagggataaactcaaagaggaagaaactgaagagtgctgtcatggtcactacacatatggggatttgggtgacaggtgcttcgggactataggccgatgcttgacagagaccctcgtccttgtttcgcaggctggtggttctgtagcatacctgatattcattggccaaaatctccattccacattcagccagctgatgtcaccagccggcttcatcttcgccatcctcctgcctctgcagatagcgctctccttcatccgctcactgtcgtccctttctccgttcagtatatttgcagacgtgtgcaatgtccttgccatggcaatcgttatcaaagaggatcttcagctctttgaccaccccttttcaaacagaagcgcttttaatggactgtgggcagtaccattcaccttcggtgttgcagtcttctgtttcgaaggattcagcatgacccttgcactagaagcgtcgatggcagaccggagaaagttccgctcggtgctttcccaagcagttgccgccattatagccgtgtatgtctgttttggagtttgtgggtacttggcctatggcgaggccaccaaagacatcataacacttaatcttccgaacaattggtcgtctgctgcagttaaggttggcctatgcatcgcactggcattcaccttcccagtcatgatgcacccgatccatgagatcgtcgagacaaggttcagatccaacagatgctttcggaagctcagccacaacgatggcggcgcggagtggataggcttgcacgcaagccgcgtcctcgtggtggcggtcctcactgtggtggcgtccttcatccccttctttgggtccttcatctcgttcgtcgggagcaccatgtgcgcgcttctctcctttgtgctgccggctctcttccatctcagcattgtaggctcgtcaatacccttgtggaggcgggtgctggactacggcatccttctctttggtctggctttcgctggatatggtcttgtcactgctctctcctcgcattgaacaatggcccaaacagtcaaaaaagtgcagagatcaggatatcttgtgatgacaggagtcaaatggatgctaggagcaccatatatcagatagcacggctcggattagtgcgtgattgaactgatccgcttcaacccatatagccgcagtcatccatggaagatataccttagcggattggaatggtgatttcgagaaaccaagttgacattgttctatgcatgttacaaaaatctacagatgtcatgaactttaagagccatatcttaatcgcgtatgcatgttacacatctacatgtgtcacgtttcaaaaaaaaagtttatgttgactaataagaaaaaaaaaaaaaaaatgtcacatttgaataacaaaaatccattaatgtgtatgtttgcagtgctcgcttaaagggtaactggaacgtgcctgtgtaatgccacggaacataaattgcgaccctccaatggacttagggccctgacgacaggcggcatgagtacaatagtgacgacaaaatctgcgattaaacatagatacataacgatataaatatgtctacccaaatagattaaaatggaatctcacaaataatttctaaagagtaaatatataatgcttaatcataagcaattatgttgacaccttgtaccgccgccagggcctccaaagatatatgttttgggaaatgg

SEQ ID NO: 9534 - DNA, 1444 bp, Zea mays
  misc_feature (1385)..(1385): n is a, c, g, or t
  misc_feature (1390)..(1390): n is a, c, g, or t
  misc_feature (1408)..(1408): n is a, c, g, or t
  misc_feature (1411)..(1411): n is a, c, g, or t
  misc_feature (1415)..(1416): n is a, c, g, or t
ttaaataaaccagagcagcagagcgctctgtatcgttggttccgcctagggttttagcttctgccgccgtaacctcacctcctggcccttgtcgccgcaagtccgcaacctccccatccttcgaatcccatacgaatccctagcccgcaacccgccgggcgacgagcggcggagcccgcagccaacatggaccggtaccatagggtggagcgggcgcggaaccagtcgaccatcgaagagaacgagatccgcatcaccgcgcagggcctcatccgcaactatgtctcatatgctaccttcctcctccaggaaaggagaattaaagagattgttttgaaggccatgggacaggcaatcagtaagtctgttgctgttgcagagattatcaagaaaagggcccctgagttacaccaggataccaacatcagctctgtcagcatcactgatgtctgggaacccatagaagaaggacttgtcccattggagatgactcggcatgtttctatgatatcaattactttgtcccccagagagctggacaagcacactcctgggtaccaagctccagcatatgttgaacatcccaggcaacagcaggtgccaccactgcagcgccaacctcgcagaccatcaggacaacaattccagcagctggagtatgaagattcctatgcacggggtcgaggaagagggaggggccgtgggcgtggaaggggttgggctagaggtggctatggtggatatggaaacaatcaaggtggctataaccaaggtggtgggtattacgacaatcaaggtggatatggtggctatgatgatcaaggtgggtatggtggtggatatggctacaaccaaggcagatatggaaactatcaagaaaatggtggatataaccgaggtagaggaggtggtatgcgaggaagaggcaattggggttaccgtggaggctatgaaggaggcaggggtggcggctatgaaggaggcaggggtggtggtggtcctggtggaaggggatatggtggccgaggaaggggtagaatgggtggcggcggacgagcgaactaagtgcatgcggacttctggtgtttccttcaatgcatgccttatcaatatatcagggaaaatacgagcattttatgttggaagcagttcagttacgtgtgaggtctgttgttttttttccctgggcgcgaggtttggttgtgagcataatgcatatgcaagttttatcatgtaagtcatctttcaatttttcctgctgcagaggttgttttccactttttcccatgatcgttgaatgctgagcatgctgccctatgttcatgcctgcagtattaactgatggcaactctagttaaaatgttaattctatttgtgcaaaaacnaaaanaaaaaaaaaaaaaaaaanaanaaannaaaaaaaaaaggaaaaaaaaaaaaaaaa

SEQ ID NO: 9535 - DNA, 1937 bp, Zea mays
gtccggtcggcctctctctctctcaccacacttttttctccggacgcgctcgttcgttcgcgaaggcgccccttcctgccctcacatccgctcctccctccccgacaccgaccgacccctcgtccgctcgcctccctccccgatccccaccgccatggccgccgccgccgccgccgcgtcctcctcttcctcctccgaggttccgatcgccgcccgcacctgcgtctccgtcggcgaggtggcggtgggcgcggtggctacaggcagcggcgaccgggtggcggcggattgcggggtgtgcgccatctgcctcgacaggatagcgctccaggagacggccctcgtcaagggttgcgaccacgcctactgtgtgacctgtattttgaggtgggcatcctacaaggagaaccctctctgcccacagtgcaagcatccattcgaattcctcagcgtgcaccgctctctcgacggctgcctacatgactacctgtttgaggagagtgtttgcctccttctgagggcagcttggtttgaacctctgatcgtagaggctcacgaggaggctctggaagaagaagagtttctccaccagcagtaccaatacgatgatgacgaagatgatcttgacgaggaatcttattacatgaacaggtccccaagcatccgtattggtaacaggagatggggtgacaatgggtacatcaggggaggcaggaaagaggcgaggccagtgaatactgatgtggctgctggtccatccaggactccgaagaagaaagagaaagccgcatcctcttcggcgtcggtgtcagtgtctggttcggggtcaggatcggggtctgtatccaaggatgtcgctggaaggcgggcgaagagggcgcagaagcgagaagctgcagacaaggcagctgcagagaagcacctgaagcacctgcagaggttggggctgagaaaatcgccagagcctgtagtgcccgaggaggttgggccacaggtgaatgagtgacttaagccgccgcctagtgctatatggtgctgctaaaaacactgcagccctttgggccacaaaataatcttccactgtgaagagcttgagcgtggccttgtatcatggcagcttttcgcctcgttgtacatagtctagtttctcatcactgttttagattcagcacagaaatgcagctgctgtctgcacgactgttgcagctatgaagctgtatgtacctcactgttggtgcactattttagttattgctaatcacaggggatgcaatcggcatctgtgttgattactatggggacaaatgaggcgtggaaccaattctacaacgcaaacttgtaaccatatggaatcactcgccgttgacatgatactaatcctgttaactagttaaaaccttgcttgctgtgccttgtccgtcatcatcgaattttgtcccccaatcgaagaatctgtgttgttgcccaactattctgcacgggttttgtgttgcgtgtccacccgcgctgacaaaatagtttcagatggtaacaagatgttcttgttttataaggctgtcttataaggggtatttgtttagaattataatctgtccagattatataatccaacaacttttgaactactaactcttagttagttcaaaagttgttgaattatataatctgggcaaattataatctcaaacaaacaccccttttcagcctgttttacaactgttctaaatgaagctagggttggagggtgacttgatgtcgcacccggaattaagagccaaaacgggacacaaatcaaatgtgtgctaggatcaagttttacacatatgatgactcctggtatagaaacgaatgtcacatctttaatatataatgaagttctgtacaaaatagttaaataattatattataagaagacaatgatccatgtgaccagatag

SEQ ID NO: 9536 - DNA, 3642 bp, Zea mays
ttcctagttaataaaaaacataagagagatttctagatgaatagcacccagatgttaaattaattcataggtcctttcgacatcaccaaaagacaacgagacacgccggtcaattacatgtgaaaactgcattttgacaaaaggagaaaactctctaccatctatttctctaaggtgtaactttgcaaaagcatattggaactccattagcattgatcctcccagaattgcccagccaggagaagcgtctgctaatctcaaatagcagattaacgttcctttctccatgtaaataatcatcctaatagcatggagcatctagaaatgccggaataaatggatctttgaaaatcaagaaccaacagttcagaattgcaaaaatgagttcagaaagaaactacttatggtcattcacagagcaagagaaaaatatgacaactcaatttcagactggcttcatcagagacaaatttagttcttttagtgccttctatgttctatcccttgctcccctctagcatctgattcacttgtacctagctgcagatttcgactctccactctgctgtaattaaccattttaattcaaaatttacagtagggcttccccctcctaaactttcaaaaaaaaagacacgccggtcaattttgcaggcgacccgtccatcctttttgacttggcgttccaattccaacatacacacgggcaatgcttacgtacggtagcaaataaccgcatcataaattaaatttagagaagggaatgcccttattattttaaataaaagaagggaggcattaccaatatagctctggccgctgggctttccagccacaatggtttcaagtgctgccgtcatcgcgttgacgtcccacgaaccacgtcaggatcaggctccttggctggcacgaaacgcgtgcgattaccataccattctagcagacgccctagttgaacaggtggtcccttggatctggtagtgggaatcaacaagcggagacctggagctgacctgatcacagaagcttcctggcgctcccaattcccaatttcgcagcccggttcagcgaggaagcttgcggcgcacagcacactgcggaaaaagcagaaggctacagtttcagaaggaagcttgggtgccaaggaaatacaattaagcaaatgctactctctttttttattattattttcttattccctatgtaatcatactataaacaacacagggaaatgcagccagggattgcatttctactgaaccctgataactttatagatgcactagtccatgtgcagtgtgtgtgaactccgaataagaatcaacagctggaatggaacgaaccagagcagcggacaaaaaggaaggtgcttaaggcacttcgccaacaaaacaaaacaaaaagaaggcatgttagttagtacaacgcccattttcccttctctgaccaagaccgcactgaagggactattattatagggattcttttctttggaggaatataaataatagtgatgaaataataatctatcccattacttttaggcgaagtcatccatcacctgaccgctcccaactatactcacgcgggcctttaaaaagccacgcatcccattgggacccgccccgcccgcccccaattctcctcctactctactctccttcggcaaagaaagcaagtcagcctcaccctctcacaccaccgccactcactcagtgctccaccccaagaaccaagcagctcacccccatggcgtcctacgacaaggccttcgaatcctacaagaaggccctcaccaccgccgcgtccgtcgctgcgtccatgatgctggtgcgcagcgtcgtgaacgagttggtgccgcccgagttgcgcgatctggtcttctccggcttcggctacctgcgctcgcgcacgtcgtccgaccacaccatcatcgtcgagaagaagaacgacgggttcgctaacaactacgtctactgcgctgtgaagacttacctcgccacgcgcatgaacaccgacatccagcagcgcctgcgcgtcagcagcatggacgaggacgacaagatgatggtcagcatggatgagggcgacgagatgctcgatgtttatcaaggcacggagttcaagtggtgccttgtctgcaaagacaactcaaatgactccctcaacagcagccagaacgagtcccacttcttcgagttgaccttcaacaagaagcacaaggacaaagccctcagatcgtacctcccgttcattttggccacagccaaggccattaaagcccaggagagaaccctcatgatacacatgactgagtacggcaattggtccccgattgaactccaccacccatctacattcgacacgcttgccatggacaagaagctgaagcagtccatcatcgatgacctggacaggttcatgaagaggaaagattactacaggaagattggcaaggcatggaagcggggttaccttctgtatggtccacctgggactgggaagtcaagcctaatcgcagccatggccaaccatctcaggtttgacatatatgatctcgagctaactgcggtcacatccaactcagacctcaggaggcttcttgttaacatggacaaccgatccattctagtcattgaagatattgactgcaccatcgaactcaaacaacggcaggaggccgagggacatgatgagtcagattctacagaacaaaacaagggggaaggcaaggtgagtactatcttctcgattccaccacttcctcagttatcttgacaaataatttggattttctgaacaggtaacgctgtctggactgctcaactttgttgatgggctgtggtcaacaagtggggaagaaaggatcatcgtcttcacaaccaattacaaggagcggctcgacccggcactgctgcggcctggaaggatggacatgcacatccacatggggtattgcaccccagagtctttccaaatccttgccaccgcgtggtcgcggccgaggtaccatgacacgtatccagagattgagaaactgatcaaggaggtgacggttacgcccgcagaggttgctgaggttctgatgaggaacgatgacactgatgttgtgctccatgatcttgtcgatttcctgaagtcaaaaatcaaggatgccaatgagatcaagactgaacacaaggaagcagacaaccagctagatgagaagaaaaatgacaaaaaataaaacccagtgcatttccttccaaaaaagaagatgaaagctaatggcggtttaagactgagcacaaggaagcaaataaccagctggatgaggagaaaggcaacgagatagtgagaaaaaaaaacagtgcaattccttctagtagaggaaagaagatgaaagcaacacatcgtatttcatatagatagatcctacaggggatccattggcatatgtgagtgtttgcatattgttaacattatgtttttggtgatcaatgaggtgtaatggtacctcggccgcgaccacgctattctgttagtgcttgtttaggagcatgtatgcagaactacagatatgtaaaatcccattacaacttacatgaaactgcaaacatgccattgcatgcaaatggcaacctggaaaaaaaaaaaaaaaaa

SEQ ID NO: 9537 - DNA, 1019 bp, Zea mays
  misc_feature (4)..(4): n is a, c, g, or t
cttngagagttttgattctcaaagaagttggaatgacttataatttgtgatggagtattatttactatgagtaacaaaatactttcttactggacagatatctcgatcgtcgtaagcggcttatcatagcaatggatgctgcatttgccccgcgtccgttgcactcgaaaaatatcgtgcactttgatttgaagtgtgataacttgcttgtaaatcttaaagatcaatcacgtcccatatgcaaagttggtgactttggtttgtccaaaataaaaagaaataccctggtttcagggggtgtgagagggacactcccatggatggctccagaattactcaatggaagcagcaataaggtgtcagagaaggttgatgtattttcttttggtattgttatgtgggaaatcctcactggcgaagaaccatatgccaatatgcactatggcgcaattatagggggcatcgtaaacaacacactgaggccacatgtgccagcttcatgtgatccggagtggagaaggctcatggagcagtgctgggctccagatccggcacagcgcccagcgttcacagagatcgctggacggcttcgctccatgtcagttgcagcaaatcaggcgaaggcaaccaaataagatacaggtggagtactgcctttcaacccccaatccgttgggggttctcttctcctttttttccttttgactggagagtaatacatatacatgcatgttatagagtgctgtaaaaattagtgcatcaatttatttataaccatgttatgagctggattgtatccgtgaatattctggacccggtttgaaggttggtgatgtgtagaagtattagttggaatttgttgaatggtcgcaggtgtgcttgtgctccctcataaaacagaaatgaatgttgtaatatattcaaaactgtgaacaaggagctctatactacacctttctattaaaaatccaaaaaaaaaaaaactcgagactattctctctctctctctctcctggtgc

SEQ ID NO: 9538 - DNA, 1638 bp, Zea mays
atgcgctcacatggagactcccacacgaactggaatcatctccgcctcgccacctcttcatcttcttccccagtagccgccgccaccaccactgcagcagccaaaccacgtgacacctcccgcgccgctcaaccccacagcatccgttgccaccgccgctcacctccccggcgctcccggctacaaccactgcaagcatgaggcagccaaccagcgcgggcggcgacgctgggttcttgcgcgcggaccagatcgacctcaagagcctggacgagcagctcgagcgccacctcggacatcccgcggagcgggtagttggcccagtctctgggacagggagccgccgcggcgaaacggccaagctgggtccggaggagctgacgccactgcagcggtgccgtgaggactgggagatcgaccctaccaagctcatcatcaagggcgtcatcgcgcgcggcacctttggcaccgtccaccgcggcgtctacgacggccaggacgtcgctgtaaaattgcttgactggggcgaagatggccatagatcagaacaagaaattggtgcactaagagcagcgtttgcacaagaggtcgctgtctggcataagcttgagcatccaaacgttactaagtttattggggctataatgggcgcaagagatttaaatatacaaacggaacatggacagcttggcatgccaagcaatatttgctgtgttgttgttgagtaccttgctggaggtgcgctgaaaaattttctgataaagaacaggagaaggaaacttgcctttaaagttgtggtccaaatagctcttgaccttgccaggggattatgctacctccactcaaagaaaatagtgcaccgtgatgtcaagactgaaaacatgcttctggacaagacgagaacggtaaagatcgctgattttggtgttgctcgagtcgaggcttcaaatcctagcgatatgacgggagaaacagggacgcttggttacatggctcctgaggttctcaatggccatgcttacaacaggaagtgtgacgtgtacagctttgggatctgcctgtgggagatatactgctgtgacatgccgtaccctgatctcagtttttctgaggtcacctctgccgtcgttcgccagaatctgaggcctgagataccgcgctgctgcccgagctcgctagcgaatgtgatgaagcgatgctgggacgcgaacccggacaagcgtcccgagatggcggaggtggtgtccatgctggaggcgatcgacacgtccaagggtggcggcatgatccctaaggaccagacgcagggctgcctctcgtgcttccgccagtaccgaggtccctaacgcagggttgtttatttatacccggtgaaatgatgatattggtctctacactacaactcagtgtaatctaatcgcagaagtggctatataatggagaagcttatcattgcttgccatgggtgtaaatggatggggcggggtggttgacgattggtgtgcttgtatgctcgcttcgagttataatgcttgctgtaagttaaggtgtggacggagttgctgttgccgtttgctcacatcgttaaattcgtgggcgtgacatgaagcaaggttatgtacaaaaaaaaaaaaaaaa

SEQ ID NO: 9539 - DNA, 7696 bp, Zea mays
  misc_feature (1731)..(1731): n is a, c, g, or t
  misc_feature (4481)..(4481): n is a, c, g, or t
cgacccgggcatcggattttattgccgaggccgaaatgttaaaagccaagccgcttctctgatcacagagcaactcttttcctgtcgatgctgacctgtcaattcggatatgcgttcgtatttacgtagtactgtatatactagtacatgttttacctcttgatgaatgatgacagtggacatgcatgttgattttgagtcctgtccatccagagcgacaccaatccgccggactgcgcggtcgtgctcaccactcacagatgcagcgcaccgcggtctcgtcacctcggcccaccggccgcatcgaacaggaaaatcaatcgtatgctaggcccgttctccggctcccccccttgcattccgacctgaaaaatcaagccttttcttttcttttctttttttttctttcgttcatggggtccaatggcccgacctttctccctcgaaaggtgaagggctgaaggcgagaaagaagcttcaaaacgaatcatccatcatcttgccaacccagcaaccctgccaagccatcgcattccagctctgcctttgcaagatcgccgccactcgcagccagcaagcaaccattccaccacatacttttttcctccggtttcgtccggcggcgagcgagcgaggtagcgcttgtccatgccgcggccgtgagggtgatcgaacgaggactacttcggcctagcgcggggagccatgtcggcgtcggcgtcggcgggtaagctggcggcggcgctgcaccggaggacgcgcagggtcacgtccgcgctggcgtgcgcggccctggagtgggtcctcatcgcgctgctcctcgtcaacggcctgctggcctacgccgtcgccaggttcgcggactacttcggcctcagcccgccgtgcctcctctgctcccgcgtcgaccgcctcttccaggccgaaggcggtggcggcggcgacgctagcggcgccggcgcgcggtggctgcgggacgccctctgcgacgcccacgccgcggagatctccgcgctggggtactgcctccgccaccgccggctcgctgaggccggagagatgtgcgtgggctgccgcccgtcgtcgtggaaggagaggacaagcgacgcaggtgcgtgcgcctgctgcgaagctgctgctgtactgcgcgcttctcctgtgcgcgagctggaagatactacaagggatgcgcgtgtctcggagaaagaggtagaagatggcgaccagggctacgttctgctggctcaagatgatcacgaggaggagccggatgaggtcgaaaaccgacaacaagaaccgcagagcgaggtggatggccgacaacatctggaagacgaggtgatggctgccgttcaggacgaatccttggaattcatggatcaggtcgaagacatcacgatcgaggacgaccggttggtgtcggtggtggcgcttgacgagatgaccatcgccgatgattcgggtctccatcgggatgtagaagaggtggacggaacgaatcatgtagtagaagatgagcaggatccgagggatgtggatgtcggagcggttctggaggagaagaggatgttggattcctcggttgcaacgccggtcgatttgaccgaggactctgtcgtgcccaccagccccgtaccttgtcctgagacttcaacagacccatctcatcctgatcatagctccgtttcccaagacgatggagatgttcttgaagatactttcacggccgangaagcccccgccgtggtgcctcacgtctttgtgcctcaaggtacttactcatgtgcttctcagtatcatgttccctatattgcaactggtgtggtgaccatcacatgtttttagcttcagtatcggaagccgtttccgaggatgacaacagaacagctgctgaggtggacacgaactgcgaagtgtcaatcgggagcgatatatgcgaacgggaacaagatgagcatgtcgttccatttcaagatttggcagcatttgaggagctggttgctccattggcaactggagatgatctaccattgccatcggaggtcctagagccacctgaccaaggtagttgcattacatgattgaaggctacttcatccctcaaaaaaatccccacttgatatgtagtagttgataattggctcttctgtcgtactaaatttaattttacttttgttcgagtagaagcaggcccacgcgtccgggaggacgtgaccacaagcacgggattagacctccaaccaaatgaacagaacgagatcgaagaagacagagcacctgagacgccgacgaacagcgtcgccacacaacgctccgacagaatgttcttgctcgagaggaaacggtcgctgtcgctgtctctggatgggagcgtagcgagcgagatggaaggcagcgagccgtccaccgtggaccagctgaaatcagcgctgcaggccgagcggaaggcgctcggcgcgctgtacgccgagctggaggaggagcggaacgccgcggccatcgcgaccaaccagacgatggccatgatcaaccggctgcaggaagagaaggcggcgatgcagatggaggcgctgcagtaccagcggatgatggaggagcagtcggagtacgaccaggaggcgctgcagctgctgaacgagctggtcagcaagcgggcgagggagaagcaggagctggagagggagctcgagctgtacaggcagaaggtgcagcactacgaggacaaggagaggaggaggacggcgagcttcaaggccaatggggtaagccccagtggcagtggcacttccgtgtcgtccagcggcgaggacagcgacgggcactccgacgactactgcgagctcggcgactctcctgacggcggcaacgtccagagctcatcggatgctgcccttagctccatgagggaccaggacgacggcacgaagcacctagcggctctggacgattccttgacgtacttcgaggtggagagactctccatcctggaggaactcaagacgttggaggagaggctcttcacactggaagacgacgatatcaacaccagcaaagaagttactggccattcctcgagtgacatggatttaccacacgatggccttcagtcgccggagtacattctcaccggtgacaggccaagattcggaggaagggcctctatcagcagagggaagagccttctgcctctgttcgatgcagtcggcgacgaggcctgtgaccgaatgccgccatctgctggagcaggagaggcagaccaggccgacgatgcagcaacgaagccggtttccgtgcttgtcaaagagcaggagaggctggcgatcatagaggaggtcgaccatgtctacgaaaggttgcaggcgctggaggcggacaaggaattcctgaggcactgcatcaagtccctgaagaaaggagacaagggcatggaccttctccaggagatcttgcagcaccttcgcgatctccgcagtgtggagcttcacgtcaagaatgccggtggtgccatggctgcaaattcagcctagcaagttcatctatacgcggtaacggtaagcaccttctttcaaatctctcatcctcaacatagcatctccctaaaagttcagatagtcacacgactttgtcagtttctagcgataacgcccagcaacaatcatgtttttttccagatgacactactagcttggtatggattcagtcgattggattgtaggactccaaagcactgcattggtgatggtccctgcaaggtactgccggagttatagggaggctctgctcattttgcctgtgggccggaagcaagccctcccttttgtgctggtccagcactgccaactttttctgtcgtggtggtcgcctggtctggtcggtcggtcgtaggaatcattagcccttccaaagctgcacaaagctgaatcacggtgacagcttctgcagcatgcacggggcaaaagaaaaaagatagccccagtggagatgtggatgtttttttttcttgtctgatttaatcttttgattaactttggatttgtttgtgcgctgaggtagggagtcctcgtgtattttttttttggtgaggatgtagcttgaacggttggtatgtgcagtttgtgctttctcaatatccaggtttataatgaaaggaaaggcggtctcacgaagaaatccctgtggtaaaaaaaaacttctaacttatttagactttgtttggttacttaggatctacatgtgttaaggtggattaggatgtaacttatatcccaatccacctcaacaaatatagattagagtcaatactaaagtactcaaactagatcttagatgtctatacatctctctccatttatatgtgatggagtggtttgatgtgaatctaaattccacaccaaatcagttcaacacacatgagaagatacatagacgtccaaatttctaatatataaagcaccggttttaacagttccacggtttcattntcttcgcgcgtcatcattttccttcccgttttatgaaaaaataagataaaattatgcacaagggttcaagttttagttgttggttccacatttacacttaaagattggtttgtccttcagaattcttaggctagtttagaaactcaaattcgctttagattggtccaattctaagtggaattgcgttttcaaactagttgtggtcaaccacacatctgaccccttaaggctagtttgtcaactttatttttttcaaaagattcttatttttctaaggaaaaataaactaatttccctaaaaaaaggaaatctctttgaagaataagattaccaaactagcccgaagccgttagaatttctaaccaaaatacgctccaccaacaaaatgacccactcgtgaaaataaccatgcagaccgaaattctggccgagaggcccacacaccaatagagtggtccacttgggaaaatatcccctgtacacaaacacaacagcctactcagcacaaaaaatacctagccgccatggtttccctctcaccctacgtccctacccccatcactcccctcacagccatccgatcaacaacctctctgtccaagccactgttccatctcctcttgctgcggcgagggttagacacaacgacgagccaccgctaccagttttggtccatccatccagatgttctactctgcagtttgcactctcaagtctcaaccattaaactgtttctactttatctttggttagccagcacccatgcagttaaccatcgaaaggtgacatgttccacagttccaggatttaatgcacagcagcagcacgcacccgaaacgcaactacgttcacttcaggaattcacagttatgagccctaatcctccaatgcaaataagtactacacttcaggattgcagagtactgagcgctaatctgcatggagaactgtacaataggcagcaccacctaatagcaacaatggtatccatgtcaatgggggtgacaatgctactggtacagttccatatgctgacattagtttggaacagagctgcaagaaacacaaacaaacattattatcagaactaatacatgaaaaactgctttggcaaaagatggtacagactacagaaagatgtaccttcaaatgtattgctgcggtgatcaagcatgcaagtagaagagcccttcttgtccagctaccacaaaattggatcaccatggacaccatcttgtcggcgaatttcattagtgaagcccttggagcaactggcagcaatcttggtgactcggcatgcacatttgttgagtcaagagagtatactactcttcttctgtgctgcaaaaacacagtagccttttctgcaaacagaccatatgtaaggactattactgggacaagcaccagatagaggaacggtagtgtgatgacaagcacatctgggttgctcagtttgttgcccgtcaagcccccatcatgaattggcacgctccatccagataagtacatttgagcgatttctccattttcagacgttgcatggccccaaaaccatggcatttcaattagccagagcacatatgttaccatagaaaaccagaaaggtttactccttgtgccctccattaaaaaccaaaccaaccaaaagtaaggttttctctgctggatagaggaggacggaattgacacagcccacctttgatatgatgaacttctcctaacaaagtgatacaatagtttggggatgaacaacaatacaatggtgaaggccaaattactccacagaagaacttgatacatgccttcccactggacttcaaagagcagatagttggtccatggacttgtgggaattgccatcttaccctcaactgaaaatggtctctgctcacttgaaatttttacaccatgagaatcaagaacaaacacctgcaaccagtagcgagtggcggatgaacttctgtaattttcagcattccatttggcatggaacaaaggtctgtgagcagaagtactggtaacaagctgcagaggtatctcctcgacaatcttaaactcacaatgagagtcaaagattctagcactcacattacttataaattgatgagagaaaataaggacatttatatcatttctcatcgaccacttttctgaatccaacatattcatacttcttgaatctgttggatatgtgatcaagatggaagtttggagtgcatgtttcaatgtgtggtctatgaatgagactgcacacaccatctattgctaaaaatcctcatcaatctggagtccttccagtctccaagttcccattcccaaaagcttgacttgtgatcttctgttgttctgatttcatgatacctccaaagctgcttactaacttttgcatggagatgaccacataggtatgctgaaatagactgccctgcaagcacactttcatatcgctgtcctttttcagatgatgcagtgaatgacatagggaaatgtccaaaaactactttggtaactggaacattggaatgattggtccagtattgaagctctgaatttaccgcttctatccttttatcagtagaatggccaaaaagatttgcaggaaaacgaatgccaacattcatggtatcatcaatacccagaaattggtagcttctatctccctacagtgccttttaggacaaaaattagtttcagaactgtagtggtcatgaaaatacatatgcacaattcccaaagtatgtttcataacttgtattggacatttagtatacaagagaatgatactgaaaaatgggacattgatttactagttactggattagtagtcaataatgttcaacattatctttgccagtaaatatgttaacagtttacaccttgagaagaaacagataatagtttagctgaaatttgactgccattggatttgagtaaagaatggtgcatagaaataccttgaataaattcaatgatgataaacagtgagatctgacagaggtaataagtcgtacctgaagcaatatactactgatggtgcttaattgcttaaactgtgagttaacgctgtaagttgagaagaagtccaattttcctcctctataaggcactccatatgtatcatgattgcctctaatatcaaatatcctgctcttatcaatgccaccgcttccaacaattgcatcaatagttttcttgtaggtaatccattcgta

SEQ ID NO: 9540 - DNA, 1234 bp, Zea mays
gcgacgggcactccgacgactactgcgagctcggcgactctcctgacggcggcaacgtccagagctcatcggatgctgcccttagctccatgagggaccaggaccacgcctccgagcacctagcggctctggacgattccttgacgtacttcgaggtggagagactctccatcctggaggaactcaagacgttggaggagaggctcttcacactggaagacgacgatatcaacaccagcaaagaagttactggccattcctcgagtgacatggatttaccacacgatggccttcagtcgccggagtacattctcaccggtgacaggccaagattcggaggaagggcctctatcagcagagggaagagccttctgcctctgttcgatgcagtcggcgacgaggcctgtgaccgaatgccgccatctgcaggagcaggagaggcagaccaggccgacgatgcagcaacgaagccggcatccgtgcttgtcaaagagcaggagaggctggcgatcatagaggaggtcgaccatgtctacgaaaggttgcaggcgctggaggcggacaaggaattcctgaggcactgcatcaagtccctgaagaaaggagacaagggcatggaccttctccaggagatcttgcagcaccttcgcgatctccgcagtgtggagcttcacgtcaagaatgccggtggtgccatggctgcaaattcagcctagcaagttcatctatacgcggtaacgatgacactactagcttggtatggattcagtcgattggattgtaggactccaaagcactgcattggtgatggtccctgcaaggtactgccggagttatagggaggctctgctcattttgcctgtgggccggaagcaagccctcccttttgtgctggtccagcactgccaactttttctgtcgtggtggtcgcctggtctggtcggtcggtcgtaggaatcattagcccttccaaagctgcacaaagctgaatcacggtgacagcttctgcagcatgcacggggcaaaagaaaaaagatagccccagtggagatgtggatgtttttttttcttgtctgatttaatcttttgattaactttggatttgtttgtgcgctgaggtagggagtcctcgtgtattttttttttggtgaggatgtagcttgaacggttggtatgtgcagtttgtgctttctcaatatccaggtttataatgaaaggaaaggcggtccccccg

SEQ ID NO: 9541 - DNA, 2081 bp, Zea mays
ccggcccccccccccccaccctaacctttccactgctccatcttcctcgcagcgccggcgatccatcctccgctccctcccttactcgcgctcggcacgcaggcgacgccggcggtggtcaggctcgggctctaagcgacggcgtcagtgtcttcccctcccacctctcggcagtcgcctcgcgccctcgcctccggtcctccacgcaccagccggctactctgcgctgagctgattgtcccattcaataaagaaagcgaagggcatagataccagaagcaacactgagcccatcttgcttggaattctatctgctgttggaacaacttacaccaatatcatggcaaaccttgctgattcttttctagcggatcttgatgaactgtcagacaatgaaggctatcctgaagaagacaatgctgaggcagcgggtagggatgacgacgaagatgatgatatgcctgaccttgagtctcttaattatgatgaccttgatagtgtctcaaagttgcaaaagacacaacgctataatgatataatgcaaaaagttgaaaatgcacttcagaaaggtactgatttctctaatcaaggttccatcctggaggaggatccagagtaccagcttattgttgactgcaatgctttatcagtagatattgagaatgaaataatcataatccataatttcatacgggacaagtataggttgaagtttcctgaactggagtcccttgttcatcacccaatcgattatgcccgtgttgtcaagaagattggaaacgagatggatttaacactagtagatctggaaggacttttaccttctgcaattataatggttgtctcagtgacagcatcaacaacaagtgggaagcctctttctgaagacaatttggaaaaaaccactgaagcatgtgacagagcccttacccttgatgcgtcaaagaagaaagtgcttgattttgtagagagcagaatggggtacattgcaccaaacctttctgcaattgttggcagtgctgttgcttccaaactgatgggtactgcaggtggtctgggagcacttgcaaaaatgcctgcttgtaatgttcagttactcggtgcaaagaggaaaaatcttgctggattttctactgccacttctcagtttcgtgttggctatcttgaacaaactgaagtatttcagagcacccctccacctttaaggactcgcgcctgcagacttattgctgcaaaatcaactctggcagcaaggattgattcaattagaggtgatccaactggaaaagctggacggaacttgttagaagaaattcgtaagaagattgagaagtggcaagaaccgcctcctgcgaagcttccaaagccactcccagttccggactctgagcctaaaaagaagagagggggccgtcgtcttcgaaagatgaaagaaagatatgcgcagactgatatgatgaagcttgcaaatcgaatgcagtttgggattccggaggagagctcactaggtgatggcttgggggaaggttatggcatgcttggacaagcagggagtggcaagctacgtgtctcagctggacaaagcaaacttgctgctaaagtggcgaaaaagttcaaggagaagagctatggtagcagtggtgcaacatcaggattgacatccagtttggcatttacaccagttcagggaatagagttgtcaaatccacaggtccaaggaaaccttctcggaggcggaactcaaagtacttacttttccgagaccggcacattttcaaagatcaggaggacgcaatagaatcctctttgcaaccatcacatctcatttgcactgcatttgttgatatccttgggatgcactgtagaaaattcaaaagtcaatcttgcaatgttccagagactttagaatggcaattcacagttaacagtgatgcttcgagcacttaatcccaggatatttgcgaccgaacctgacttttgagaattctgatgtccatagtctatattgcctcgtgtacaagttcaagcgaacaatttttatctcatggttactactagatgagattggttcaaaaaaaaaa

SEQ ID NO: 9542 - DNA, 2012 bp, Zea mays
gagaatgaggagacggaggaagaggagacaaagaaaatgatcggggaggacaacagcgcagccgtggaatctgacggcgccgacaaggagagcccggaggtcgtggagctgaaggcgaagctggcggagaaggacacggagatcgctgccctcacggcggaaaacgctgagctgaagaagcaggcagaggaggccgcggaggcggcgaagaaggccgaagaggggcccgcgtcgagggcggccaaggccgagcacgaactgaaggagggcgcagcgcgggaggcccgggtgggcgagcagctgcgggcgtcggaggccgcgcgggaggcgctggacggcgagctgcggcgcctgcgcgtgcagaccgagcagtggcgcaaggcggcagaggcggcggccgctgtgctcggcggggacaaccacctcaccggactggccggcaacggctggggctcccccgccacgatgcccgacgacggcgacgacgagggcttcggtggcaagcggaagggcgccggcatccgggtgctcggcgacctgtggaagaggaaggggagcaagtgaaggcctgccgcctgccgcggaatgggacccgtgtcccaaatttcgcaacggtgagctcgctcagcccgcccgcttgccagcttgaacaactccatcccttgcactagcttagctccatcgttttaccgcgttttggttcggagtctacttatgtttgtatgatgatgatgacgatgatgagacgatgctcgtgaggttaaactatgtctgtaacgcttgatcccgctgctgcctgctacctccgcgtaaggagcaaccaagatggcttggtgcttttactgcattgcggcggtgctgttgacgagggagtagatggtgtttattttcatggtggaattgaggaatgcttgattgcagcatcaagaaatgcctcttgtgactctaacgaatcctaagatatcattgcagcgcgtaggatctccggtggcctttagagagagagagagaatcgctggaatcctaaagaggttcatcgtgatacttgctgattgtatggtggctgttcatgatacttccagcctatgaattatgattgcatccgatggatgcaaccagattttgatttgagcagcggattggagcagtatgtcagtagcatcgtcttggtgaatatccataggaccacctgatagttttgactttcaaggtgtccagaatcctaaaacgaagcattctcggcgcagccaactcccaccaggccggcacaagccattttgcgcgccgattgtttgtgtccccatggactcacgtcgtgataacgatgagttcgaagatgttttttttactggagctcaagatggttgaagcaggctcgtcctctcatgccgacggctgccagccgagtgccgacgcccgctgatcggttgcaatcacggacattgaacccgattccattctggaaccacgccaaggcccaagggtaatggcagtgtttccgcataggccggatggcaggttgtggactgggccccattcagtgtactgcctttgtaggttcgttctctgattggacgcgacagcttttggctttctgtactgtaccgctaacctgaaacatggaaaatataatcgttgacaaattataaagtcttgtatataaattgacaacggtaggtttgggcgtcacttcgaataatagatttatgatgcatttgtatatttagaaccactactcattttggtgtaaatgtgcaataaaatcatctagagcatgcaatctaaatctaacgatcactactgttttatatttaacatccttcatataaaacctagtaccatatgttacctaccttttagatggaagaggttaaacgtaaaataacaatcatcattagattttaattgaatgcaccagatcccttggttgtgtatttacacccagtatgattgattgtacagaaatatgtatattctgtttataatttaggataatttcatagatggcggtc

SEQ ID NO: 9543 - DNA, 6893 bp, Zea mays
tgctatctctcacatgagtcaatgacatgtggagtcaatggtatatatctaaattgcaatcttttaatggtatagatccaattattctataattgattaattactactagtagcgaattccatgaattgaaaccaaccagagagcctttcatcttggctggtccgtgcagaccctccgagctcttgctgatttggaaagccatacccacaaaggaaccagtgatttgcatccgcaagctgattctgccactgtgtttgcttcaaacgatggatcccattcaaatcacaaagttttctgcccgcgtgctgatgaaatttccaaccttttttccaggggccttatacctcagggcaagcaggggcacctccatggccgcggtgctcgactccttcgtcaaacggtgcacagcagcactggaagattttgcagaccaggaggcctgcgccgccctcggcatcgtggacgatgtcaggggcctcctggccacgctgttgcgcatcgacgccatcatctcccacgaggagcggaggagggtccttagcgccaaaactgatgcgtgggtggtgcaggtgaaagatgccatgtacgagatcgacgacgtcctcgatgtctgcatgattgagggcgcaaagatcctcgctgctggcggcccacccacgcccaaggtccgatgcttcttctgcttcaagctttcagggccccggaagttccgacatgagatcggcttcaccattagggacattgatctcaggctcagggaagtagaggaggaaatgcctaggcttcctgctggatcagctcactctgatgatgcaaaaagggattggttcagtcgtgacgtctgtaagaactgctcagacgcgatgaagccccaggcagttgggtcgcaggtccaaaaggctgtgggtggccttgtgccaaggatgcttagagagggcaagaagaaggtggatgtcttcgccatcgttggtgcggtggggattggcaagactacacttgctagggagatctacaatgatgacaggatgactgaaaatttccccatttgtgtgtgggttgacatgtccaagaatttatcggagctagatttccttaaaacgatcatcaggggtgctggtgccaatgttggggttacagaaaacaaggaggaactcctcatcctcctcgcttctgccctttccaaaaggttcctccttgtcctggatgacttggagagcccgagcatatgggacaatctgctcaaagattcattgggagatggtgttgtcagaggaagaatactgatcacaactcggaacgaggaagtggcaacaagcatgaaggcaactatccaccatgttgacaaaatggaccctgagagtgcctgggcattattgtgcaatcaagttgatgcagaatgcaattcggaagagcttgcaacattaaaggatgttgggattaagattgcagagaaatgtgatggccatcctctagcaatcaaggtcattgcaggtatcctaaggtcaagaggcaacagcaaggctgaatgggagatggttctgaacaatgattcttggtccatgtgcccaatccttccagaagtaccacaagccgtgtatgttagttatgtcgatctttcttctcaactgaaggagtgtttccttcattgctctctgtatccagaagaattccctattcagcgctttgctcttgtgcggcgttggattgctgaaggaattgtaaatgccagagacaaaaaactgcttgaagaatcagctcaagagtattatgtagaattgataagcagaaacttactacagcctgatcctgaaagtgttgagcgatgctggataacacaccatcttctccgctctctagcccgcgctttgatagcagatgagagtatcttaatttatggccagcagaaactgaacacctcattgtcaaagccccggcatctcacattgtgtagcatggaaaacagcttggatggtccaatttcgctgaagcagcagatgggtttaaggtcgctgatgctcttcaaaagcccaaatgtcagagcaatagatcttctcatggagtcagcttcatgcttgcgtgtattagatttgagcaagacagcagtggaggccatcccgaaatccattggtaacttggtacatttaaggtacctcaatcttgatggggctcaggtcagagacataccttcttccattggatttctcataaacttgcagaccttgagccttcaaggttgccaaagcttgcagagacttcctcggtccatcagggcattgctagagcttagatgcctttgtctctatggaacttccctaagctatgtaccaaagggtgttggtaaattgaagcatctcaatcatctagatggtctaatcattggtcatgacaacaatgcgcctgagggttgtgacttagatgaccttaaagcattgtcagaactaaggcaccttcatatagagagtttggatagggctacttccggtgcgtctgcactcgcaaacaagccattcctagaggatctgtacctctctgagcaagcaccagcaatagaaaatcaggaggatctggaggacaaagatgaaacagaaaaagaagagaaggaaggacaggaaagaagcaatggccaatgcagaggagatgagtcaaccaaagctagtgaaaagatatggaatgagctcaccccaccccagagcatcaagaagctggtaatcaagaactacaaaggcgtaaagtttccaaaatggataaaaggtcccaagctaggagactccttccccagccttgtgtttttggatcttgaaaactgcatgtcatgtactaaactgccttcacttggcctcctgagtcaactccagtccctgcaaatctcaaatgcagactcagtcatcaccatcggttcagaattccttgggaccactgtactttcatcagccactccattccccaagcttgaggttttaaagctcagaaacatgaagaaacttgaagagtggtctttaactgtggaggagagccaggtagtattaccttgtttgaagtcactgcagatacagtggtgtcctaaactgaaagctctaccagaaggcctgaagcatgtagcgctgtgtgaacttcatgtggagggtgcacatagcctaactgaaatcaaggacctgccaaaactatctgacgagctccatctcaaagataataaggtgctacagaggatctccaacctgcccatgcttcgttccctcattatcgatgactgctcaaagttgaagcatgtggcaggtcttgatgcgctgcagcacctcagacttgtctttcctccgtccaccgagacattttatttcgaagagctagtaattttctggagcgttgccttcccacggtggctggagctactgattcagaagtgcaaaggcctgcgacggtttgagttgcagtgtggtctgtcattgctcaggagctgcctcgacggtggcaagaactggcatctcgtgcagcagatccccgaggtgcgcatcataagctgcgatggcaagagatactttcggtataacaagagccgccgcatctacgaaactaatgcacagtcagaagaatgaagccatttctgaaaaccttggcacggtatgtgccttgcacgcttcacattgttgctcatcctgtataaatgatcttattatgtgttagggtaataacaacagcttacacgtgtttgtgtttccttatctttgcagacactggtttgttttgggtcagccacacgtttcagttgtcgctgtccctactttgttccgggagtattgagagcttgtgttctgttcacgattgattcaggtgttttcctttgttttgcgtgttttttttcttcttctttttatcgctgagccgatatatatgcactggttctcctctgaatatgggtgtccttcaccaggactcaatatgtgtaattcttttctgtttcctggtcatgattgtctgtaaattgtaaacattgggtttgatggatatcgacactggagtgtaaagtgttggcggttaaatacacggccctctttcctggctcagcaatgaaacttctgttctacagttacctagtcaacgtgaatgctgcgagtagtatatgcaagacaacacgctttgcacttgatacacctcactgtgcccctaatctgcaggtcgtcgggtgagggttcttaaagttacagcatgacagctgcgacaagaactttagccaaattatgtataaaatggagaggtcatgttcaattgaaatccacccaaaccttgaatccagctaatgaaaatctggggtcaaatcagagtccatgtgtttggttgcctgtatttgctggtgcttgcatcgcgggatgcaatgagctggtgtttaattgttatcaatcaggctctacgcgtgcgaggtgtgtgtttggttacctgtgtacagatgtgaagtcagactcgcacgatacttaaagcatcttgggtcaggctctacaggcgcgagcaaattatttgcatatctggagccaggctcctgctaacctggctcatgcagtcgggctgccgggagaagccaaccaatcacacggagtgtgtacgctgtggtcaggatgagtacgttgtcatatgtagtaaagttatactgcagaaatctgaaatctttgactgatagtgttccaacaaggaggttaaattgtgatttcttgtaaccttaataaacacaaatccctttccctttttagtgccatatgttcaaacggagaagtcatggtaagaaatccatgtaaggattaagggaatcttgcaggtcagggatgtgttcgttggttttcatgcctttcttgccttggatgtttcttcagcataagttctcccaacccaagcaaatcaatgtgctttctcccctgcgcgccatctcccatttaattttccagctggcgtccacacaaagaaaactctgccagtaggccaaagttttgtttcatcacgctcccttccttctataaattgttgcccatggacattcagacccagccagtcacagcattcttcttcctccgcacataaaccataacattcttctccaccttgtttctttccaagccaccatggcctccaagctgagtttcaagagggcagacagcatcgcggaaagcatgcccgatgcgctgaggcagagccggtaccagatgaagaaatgcttccataggtgagcctaccttagaagaaggcatcatcatatatatggatcgagagggttcacatttgcagttctgaaagcaaacaaacaaattttcaggtatgtttccaagggaaggaggctcttgaagaaccagcagctcatagaggagctggacaaatcactggatgacaaagtcgagagggaaaagcttggtgaaggcttcctgggttacattatttgttccacgcaggtgatctcatctcacgttaacatattttgcagtaattattcagtttttctggaatggtcctgttcctgtattaacagaacaaaaaatcacacagctcgcatccctgcaggaagcagtggtgctaccgccctatgtcgcatttgctgtcaggatgaatcctggcatctgggagtatgtcaaagttcattctgatgacctgtcggtcgaaggaatcacaccctctgagtacctcaagttcaaggagacattatatgacgagaactggtctggcattcttcaccgatctaggctatacatacattaatcacagatgtgttgatgccaattgaaaaaaaaatgaatgtgttcttatctcatcactttcagggccaaggatgacaactcactggaagtcgatttcggtgctcttgacctctcaacaccccatctgacactgccatcgtccataggaaacgggctccagtttgtgtccaaattcatgtcctccaagctgggcgacaagcctgaaattagcatgaagccgttgctggactacttgctttcgctaaactaccgtggcgaggtacggcaatctgaccacctacccatgctgcatatactgacagaagtttaacccgatcatctgatgaacatgcagaagctgatggttaacgacaccatcgatactgtgaacaagcttcagacagcgctgctacttgcggaggtatttgttagcgggttgccaagatacaccccattcctgaagtttgagcaaaggtatctcaaggagatagaagctgttcatgcagacaccagatatgcattatatttgtaaacctaaggtttctggacacaacgctgttgcaggtttcaagagtgggggttggagaaggggtggggtgacaatgctgaaaggtgcaaagagacgctgaattgcctctctgaagtgctacaggcgccagaccctatcaacatggagaagttcttcagcagagttccatccatattcaacatagttgtcttctccatccacggctactttggccaagagaaggttcttggcttgccagacaccggtggccaggtggtctacatcctggaccaagtcagggcccttgaagaggagttgctgcaaagaatcaagctgcagggtctgaacgtgacaccaaagattcttgtggtaaagttagctttatcatgatcttggccattcgtgatccatatctgctcagtgctcactttacatatgtagatcaaatgctctaaaggttgctagttttgttcatgcagctgactaggctgataccagatgccaagggtacaaaatgcaatgtggagctcgagccagttgaaaatacaaaacattcccacatacttcgtgtgccattcaagactgaaaacggcaaggagttgcgccagtgggtgtcccggtttgacatctacccttacctagagagatatgcccaggtttgccagctaccacttcg

SEQ ID NO: 9544 - DNA, 3857 bp, Zea mays
  misc_feature (673)..(673): n is a, c, g, or t
gccggccgggctggggtcgggtcctctccccctttcgacagcgtcagaaacaggggagggggaggtaggccaggaggaaggaaggtggtagccggcgacgtggtggcattcgccacctttagcctgggctcaatcgcctccctcttcctctcttcctccgtcctgcttgccccaaccttcgttctacagtacaggggccttatacctcagggcaagcaggggcacctccatggccgcggtgctcgactccttcgtcaaacggtgcacagcatcactggaagattttgcagaccaggaggcctgcgccgccctcggcatcgtggacgatgtcaggggcctcctggccacgctgttgcgcatcgacgccatcatctcccacgaggagcggaggagggtccttagcgccaaaactgatgcgtgggtggtgcaggtgaaagatgccaatgtacgagatcgacgacgtcctcgatgtctgcatgattgagggcccaaagatcctccctgctggcggcccacccacgcccaagggccgatgcttcttctgcttcaagctttcagggccccggaagttccgacatgagatcggcttcaccattagagacattgatctcaggctcagggaagtagaggaggaaatgcctaggcttcctgctggatcagctcactctgatgnatgcaaaagggattggttcagtcgtgacgtctgtaagaactgctcagacgcgatgaagccccaggcagttgggtcgcaggtccaaaaggctgtgggtggccttgtgccaaggatgcttagagagggcaagaagaaggtggatgtcttcgccatcgttggtgcggtggggattggcaagactacacttgctagggagatctacaatgatgacaggatgactgaaaatttccccatttgtgtgtgggttgacatgtccaagaatttatcggagctagatttccttaaaacgatcatcaggggtgctggtgccaatgttggggttacagaaaacaaggaggaactcctcatcctcctcgcttctgccctttccaaaaggttcctccttgtcctggatgacttggagagcccgagcatatgggacaatctgctcaaagattcattgggagatggtgttgtcagaggaagaatactgatcacaactcggaacgaggaagtggcaacaagcatgaaggcaactatccaccatgttgacaaaatggaccctgagagtgcctgggcattattgtgcaatcaagttgatgcagaatgcaattcggaagagcttgcaacattaaaggatgttgggattaagattgcagagaaatgtgatggccatcctctagcaatcaaggtcattgcaggtatcctaaggtcaagaggcaacagcaaggctgaatgggagatggttctgaacaatgattcttggtccatgtgcccaatccttccagaagtaccacaagccgtgtatgttagttatgtcgatctttcttctcaactgaaggagtgtttccttcattgctctctgtatccagaagaattccctattcagcgctttgctcttgtgcggcgttggattgctgaaggaattgtaaatgccagagacaaaaaactgcttgaagaatcagctcaagagtattatgtagaattgataagcagaaacttactacagcctgatcctgaaagtgttgagcgatgctggataacacaccatcttctccgctctctagcccgcgctttgatagcagatgagagtatcttaatttatggccagcagaaactgaacacctcattgtcaaagccccggcatctcacattgtgtagcatggaaaacagcttggatggtccaatttcgctgaagcagcagatgggtttaaggtcgctgatgctcttcaaaagcccaaatgtcagagcaatagatcttctcatggagtcagcttcatgcttgcgtgtattagatttgagcaagacagcagtggaggccatcccgaaatccattggtaacttggtacatttaaggtacctcaatcttgatggggctcaggtcagagacataccttcttccattggatttctcataaacttgcagaccttgagccttcaaggttgccaaagcttgcagagacttcctcggtccatcagggcattgctagagcttagatgcctttgtctctatggaacttccctaagctatgtaccaaagggtgttggtaaattgaagcatctcaatcatctagatggtctaatcattggtcatgacaacaatgcgcctgagggttgtgacttagatgaccttaaagcattgtcagaactaaggcaccttcatatagagagtttggatagggctacttccggtgcgtctgcactcgcaaacaagccattcctagaggatctgtacctctctgagcaagcaccagcaatagaaaatcaggaggatctggaggacaaagatgaaacagaaaaagaagagaaggaaggacaggaaagaagcaatggccaatgcagaggagatgagtcaaccaaagctagtgaaaagatatggaatgagctcaccccaccccagagcatcaagaagctggtaatcaagaactacaaaggcgtaaagtttccaaaatggataaaaggtcccaagctaggagactccttccccagccttgtgtttttggatcttgaaaactgcatgtcatgtactaaactgccttcacttggcctcctgagtcaactccagtccctgcaaatctcaaatgcagactcagtcatcaccatcggttcagaattccttgggaccactgtactttcatcagccactccattccccaagcttgaggttttaaagctcagaaacatgaagaaacttgaagagtggtctttaactgtggaggagagccaggtagtattaccttgtttgaagtcactgcagatacagtggtgtcctaaactgaaagctctaccagaaggcctgaagcatgtagcgctgtgtgaacttcatgtggagggtgcacatagcctaactgaaatcaaggacctgccaaaactatctgacgagctccatctcaaagataataaggtgctacagaggatctccaacctgcccatgcttcgttccctcattatcgatgactgctcaaagttgaagcatgtggcaggtcttgatgcgctgcagcacctcagacttgtctttcctccgtccaccgagacattttatttcgaagagctagtaattttctggagcgttgccttcccacggtggctggagctactgattcagaagtgcaaaggcctgcgacggtttgagttgcagtgtggtctgtcattgctcaggagctgcctcgacggtggcaagaactggcatctcgtgcagcagatccccgaggtgcgcatcataagctgcgatggcaagagatactttcggtataacaagagccgccgcatctacgaaactaatgcacagtcagaagaatgaagccatttctgaaaaccttggcacgacactggtttgttttgggtcagccacacgtttcagttgtcgctgtccctactttgttccgggagtattgagagcttgtgttctgttcacgattgattcaggtgttttcctttgttttgcgtgttttttttcttcttctttttatcgctgagccgatatatatgcactggttctcctctgaatatgggtgtccttcaccaggactcaatatgtgtaattcttttctgtttcctggtcatgattgtctgtaaattgtaaacattgggtttgatggatatcgacactggagtgtaaagtgttggcggttaaatacacggccctctttcctggctcagcaatgaaacttctgttctacaagaaccgctcggccggacccaggac

SEQ ID NO: 9545 - DNA, 1717 bp, Zea mays
  misc_feature (52)..(52): n is a, c, g, or t
cagtaacctgacaccttcattccggtggcctgaaatgccatggcgagacacntgatttaacttgagcagccattcccatgatgatttaagtgcatcatcaatccctccattggagaataaaccctggatagctagcttttggagtgctttggcaaacaagttggttcctgtcttaacagcttgcctgacgactgcaggcgtctcatcattcagaaggtgcagcaaacaagggatcatatcaggtagatacctcatgtgttttgacccaagctcaccgatgatctcggcaacaagcttgcgcacggggctggcctcatcggtgtggaggtcggcgatgcgcgcgacgcggttggggagcggcaccctgcggaggtcgcgcaggtggtggaggcgcgcggcgatgtcatggggcgccggaaggggggttccgggcgggccagcatcgggcccgccctcttctgctggctgtgttgctgctggggctaaagttgatgagaaggaaaccctaataacctctcccgggtcccggcgctgagcgagcaggactgcaggagcagcgagaaaggcaaccgcggcgccccgccgccccgcctcgccgctgcctcacccgccgtgcgctgccgcgacccgaccaaatcgaactgaagctgcgtgaagcggctgttgggctctgttgttggatgggctttcgggcactcagattgggctgtagtttagagagtcccagcgacctgtagcctcctcctctctccgtcgacctcgctctcgcctcgccgcctcctacccgcagcagcgcctccattgctctctctcacgagtcccggcgttccagtggggggcattcatggcggggcagtccgacccgcacctctccatcttctcgccctccgaggtggagttcgtggcggaggatgagattgtcgaaatcgtccccaacatccgcatggacgccctcaacatgatctgcggggatttcgggcccttcttcccccagattcccaccaaggtgcctctctggctcgctgtcgcgctcaagaagcgtagcaagtgcaccatccgcaccccggactggatgactgttgaccgcttgacacaggtattggaagcggaaagagagtcgccacgagaattccagccattaccattccactatattgaaatttctaagcttctgtttgatcatgctcgtgatgacatctcagatgcatacctggtaagatctctaattgaggacatcagagatgtcagatttcacaaggttgagactggattagagacgatatctggacgcacccatgctgtaaagctcaaaaatctctctgcaatggaagtgaacattgtccgccctttcatggtgagaactttgcaggcattctataagcacgatagtgcacagatgattcagcaagcagataatatagggagcagagcaacactggttacagaccgtggcccgagaagagatctaaggcgcaggtagtccacttgtattctgccaaaaaaaatgtatatctgaggacagcagcaagtggttgctttcttgccaccccacccccccagtatgtgctaatgagtcctgagatgtatcagatagtaaagcaatggtggatcatagtttgtctacttttatagagggaactggcattgctcttcccccgctttgaaattgtactgctttattcctactgatgttatatgaaaacacccaaacaaacgc

SEQ ID NO: 9546 - DNA, 1237 bp, Zea mays
ttgggtacctcgaggccggccgggatctttgcgtcttggggcaatgacgcagcttatgaggtcataccgaggcgcgtcaattgctggttgaaaactatttccaaaccccctctttggcccactgggccactgagaatttctggaagggctccctctcttcggagagggtaccggccggcgtagtttagagagtcccagcgacctgtagcctcctcctctctccgtcgacctcgctctcgcctcgccgcctccgacccgcagcagcgcctccattgctctctctcacgagtcccggcgttccagtggggggcattcatggcggggcagtccgacccgcacctctccatcttctcgccctccgaggtggagttcgtggctgaggatgagattgtcgaaatcgtccccaacatccgcatggacgccctcaacatgatctgcggggatttcgggcccttcttcccccagattcccaccaaggtgcctctctggctcgctgtcgcgctcaagaagcgtagcaagtgcaccatccgcaccccggactggatgactgttgaccgcttgacacaggtattggaagcggaaagagagtcgccacgagaattccagccattaccattccactatattgaaatttctaagcttctgtttgatcatgctcgtgatgacatctcagatgcatacctggtaagatctctaattgaggacatcagagatgtcagatttcacaaggttgagactggattagagacgatatctggacgcacccatgccgtaaagctcaaaaatctctctgcaatggaagtgaacattgtccgccctttcatggtgagaactttgcaggcattctataagcacgatagtgcacagatgattcagcaagcagataatatagggagcagagcaacactggttacagaccgtggcccgagaagagatctaaggcgcaggtagtccacttgtattctgccaaaaaaaatgtatatctgaggacagcagcaagtggttgctttcttgcaataataccagctaagtatgtgctaatgagtcctgagatgtatcagatagtaaagcaatggtggatcatagtttgtctacttttatagagggaactggcattgctcttccccgctttgaaattgtactgctttattcctactgatgttatatgcaagtgtgtgtgtgtggctcattgatctctccaaaaaaaaaaaaaaaaacggccgctatatgctaagct

SEQ ID NO: 9547 - DNA, 1049 bp, Zea mays
tagcgtggtcgcggccgaggtacttttttttttttttggaagaggcaacctttttacctttttttgctgaaggtaaataaattcactgaattgttacaacttacagatgctggcatgctacaaccagacaagaaacagaagatttattcattcttgatactacaccgtggggaggatcaaaaagacgagagctctgctcaatataaagcatctagttcttttattctggctaattacagaaggtcgatgttgatctgccacccccttttctgtttcatatctcatcatatttacagtcgtggaatctccccctacaccctacaaaaattgcgattccatgaagttcctttcggtggtactggcttcccaccgtgtacagaaacctccttctgcggcaatgttattgaatcctttctactattacctggcctttacatatacagcaaggaaaacgaagaaccgcttctgaccctcgtgcacaaaggtaacgcgttcttcctggaaaagcaatggaaatatctctgggccgccagcgccccagccctcaggtcaagcaaaatagattaagacaaatcagtggcaccatcttccttcggatcatgataccgaaggaggcaatgagtagagcagcgcgtcgctcgtgaatcggctatctagtaaccgatgttaccactgcattgcagaagaaacacctctggttgttcaggagatgcctgcttatgcagccaaagcaggaccggtgatggccccgcgggctcggcgctgcggcctctccgttgtagcaaatgcaacaagtgtggtcgtcgtcttcatcgcccgcgtttaggctatggtaaaattattccccccccccgcacgctgtaatgcgtcggaagtaatgggagaactctttaagctgcgctagctttgcaagggatgaatcccctcgaagaacattgctctgcagaaatacatgcatgatcgaacaccgtggaacaacatagcaaacaaaacaccacccccactacacactaaaaatcaaccagatcaaggaaaaagatacaaaatag

SEQ ID NO: 9548 - DNA, 2312 bp, Zea mays
  misc_feature (2287)..(2287): n is a, c, g, or t
  misc_feature (2302)..(2302): n is a, c, g, or t
  misc_feature (2304)..(2304): n is a, c, g, or t
tataccgtaataaaggttggagtaacaacaaattgaagaaaagcttgtccacaccggttgagatggtttggacatgtccgacgaagaccttagaggcactagtgtatagtgggattataaggcatagtagtaatgaaaagagagaggaagaccgaagctgacatagacagtaaaaagagacttgaaaggatagaatgcactcagagatttagcattgaatatgagcgaatggaaaacaattatccacgtgtctgaattttggtttgtggtttatgttgggtttcaactctaacctaccttaacttgcttgggactaaaagacttgagtgatgtttggttgtggaatttgaacggtgatgtagtctgataacactgtaaatggaaaagaagtaagccattacttagattgtttggttcagctcaagtaagtcctggtatcccatcgcactctgacgggaggagtattagataacgctccattttatatacgtccatatccgattacagggtaacacattacattgtggctcaaacaaacacgatgcaacgtaatcagttaccgttgtaatcaaatcacgttacattccaccgaaccaaacaacaccttggatgttattgttgtaatgaaaaaaatgtagctttcaaaaattgcacaccaaccaaattttcagtaagaacaatctacctataaaaaaatcagaaatttcagattaagatgtttacttacatgtcaaagaactctgcatcagctactgatatgatgtggttgagaataaagacaaccaattcagtcaacctccgcaaattcatatctggtcccatgagaaaagcacaaggaatctctcgggtacagaattccaagattctcgcaaggctacatgagatatcaaaaattacactgcacttcctctgctgcaaatcagcaacctgaaaataaaagatgattggtcatatttttcatagttacagggttacaccagaggaacaaaggaacacattgtgcctcatgataaaaaaaaaactcggccggagagggaaagactgccctcccggtattatattaagaacagaccgaaacatagtcccggacgataaaatccccgaaccatagccccccatcactagcatgccatcaccgcccactctgcaacagcccagacagagggtggcacgcaggacgtaacccaggagcgggcggggcacagcgaggggattctgttaaccaagcccaaattcgtacccgagggggaatcgaacccagaaactaaaggtgctactcggaagccttaaccattacgctagaggccctttcaccctctcataataaatcatattggaataactagagcaatcaaatccggcaatgattatacattttattattatacagctggatcatagagaagttaaaggatatgactcatgcatgttaccagcacacaaataggtatatttaaaaaaagatagtcaacctggtttttatcttgcatctcccggatggacatagagaactcggtcattgtccagctgagtgtattgaaaagtcgattaagaaaggaaaagaacagctcttgttcatgaatacatgtctccctcagtagaacctttggaggaaaccagatgattaaattattcaaattgcataacaaccaaatcaaacaaacaaagagaaatcaaaccaaaagtaatagtatctagaaaataaaaatacctgaaaagttgcagatgatgcggattcaccattcttataggaagcaaatcctgagcctttgcagaaccgggaaagtatgtttgtaacaggaatccatgatctgttgtcaaaagctgataaaagtgatctaggcattttatttatagcctcccgattgttctcgaaaacaagcatgaattctttatactgtacgagaactgatattgattgaagaagaagatctttcaagtcagggttcactatcctcgtatcatcgaagtgcttgacaaccaaagtgacaaacgaggccaacccttgcatgagaaataatgcaggggaaacaaaaggaggatcgctccttcgcagtgcatggaaacaatccaccagtgattccacatagaactcaggaacatagtggaacatgctatttgagtccctaaggaccaaaagaagctccacgacccacatgcaagttgcgtacattccctttgcttccactgggagaaaagggtggcccggtaccaaacacaatgccgtacacaatctaccaaatcctcgtgatagctattccgggctctctcccacccctcactgctnctgagcatgtttttncnccgaacgc

SEQ ID NO: 9549 - DNA, 496 bp, Zea mays
acagaattccaagattctcgcaaggctacatgagatatcaaaaattacgctgcacttcctctgctgcaaatcagcaacctggtttttatcttgcatctcccggatggacatagagaactcggtcattgtccagctgagtgtattgaaaagtcgattaagaaaggaaaagaacagctcttgttcatgaatacatgtctccctcagtagaacctgaaaagttgcagatgatggggattcaccattcttataggaagcaaatcctgagcctttgcagaaccgggaaagtatgtttgtaacaggaatccatgatctgttgtcaaaagctgataaaagtgatctaggcattttatttatagcctcccgattgttctcgaaaacaagcatgaattctttatactgtacgagaactgatattgattgaagaagaagatctttcaagtcagggttcactatcctcgtatcatcgaagtgcttgacaaccaaagtgacaaacgag

SEQ ID NO: 9550 - DNA, 1036 bp, Zea mays
gagagcccaaaacagaagtgccaattttgctttttttttggaagataatatcatttacatgtcacaaaaacagtgtttatagtttcataaattactaaaatggcggataatgttgtagtccgtattttttcagaaatttggttcttcattaggagctagtagcttctgatggagtaagacgtcattggtatctacattcctccagtttatagattacaaccaagctgaaccttttagagatgccccgccgagttccttgttgattcaccattatgaccgttcaactgatgctttagatctggcaaactttttgagcaatctctcaaataccttgaaagttgtagctattgcacatgaacatgggtcatgaatggacaaacaactttaggtgggaaatccatagcagagcgtgggcttgcaggggaatggaagcgacgggggtagcaacatgcagcagtccgtgaggctagcaggggaatggaagtaccggagccgcggatagagtagcaagagatattagaagggctcaggatgcatcacctcaggcataggcgcgccagatttagaatcgatagggtaaggagggtggacaacaactaaccttagatccaaaggaggcagctatgcgaactgcaaactagagaaaacaaagggcttcgcgaccagtaaagcattcatgcagacaaagccatatgagtacggagagggaaacgcgaagtggaagacgacgattgaaggagatctgaagcggaggaagccggatttgctgcaatcgcgtacctcgggacgggagaaaaaaggggacaaagcaggcctatttgaactttaagaaatggacgacgaactagaggcgacgaagatagcgacaaatttcaccaaacaaccaaaaatggacactgcagtaaggacgaaagcaatgggtgatgaatcgattttgacaaggaagcggggagagaagaggtggaagagggacgctacgacgggaacgaagagaggcgacatgagacaaggttcgagcagaagtgttcagaggcga

SEQ ID NO: 9551 - DNA, 2107 bp, Zea mays
  misc_feature (833)..(833): n is a, c, g, or t
gcagcccgtcaggttatatagctcactcttgatcgccgcccgggtcgcgaagcgatttgcctctcgtggttcggtgacggatcggaggcgctgcgagttcgaagctggtttctctgggctaagtcggttcggacttacttgttcagtaggtgtagtgtagctcgatagacgagaagaatatctggcgtggaagtttcagcaaagctcctggattaaattggcatcatagagggcgcaggatccaaatctgccggaaacctgtatcttcatccagtatcaaggggaagttctgttgttgtgagttcggtgatggatacatccaaaagcaagcaaggaccagaacatctccttgttcttgtccatggtatcatggcaagccccaaagactggacatatggggaagcagtgctgaagaggcggttgggtgatgattttttcatatatgctagttcaacgaacagctacaccaaaacctttgatgggattgatgttgctggaagaaggttagcaaatgaagtacgtcctttgaagtttgtcctagaaaaaaggtttcaagcattctccttgttggagactgatatctcctgttcctggatcctaatgaactgctttagaagctctgataattgtgcctatggaaacaggtcttggatgtggttaacaagatgcccagcttgagaaatatttccttcctagcgcattctctgggtggtttgtttgctagatatgctattgcaatactccactcagtctcagtggaaacaaagaatgcaggacaaagtagtgcacttactgttcctacaacaagagggccagcaaaatcaagatgtgcnttcaggatttaggttctattgctggattgcagccaattaattttattaccttagcaaccccacaccttggggttagagggagaaatcaggtgcatcaccaaaatgtttcggattacgtttgcaaaatatactgcacattatccagcaaaggctcgattcctgggaaaacgaactctctatttgttattttgttcattcatgtcgattttgaagttgcatggtatgatttttacaagcttggattatatcattgctgaagtggtcaataccaactagcatctataacttttgaggaaaaaaacgacgaacttattgggacctgttcctgttagtgctgagcgatttctttgacacatgcttatatgttttcccccgaattaccagcttccgtttcttcaaggtctatcaatcctagaaaagcttgctgcgcctttggctcctttaattgttgggcgcaccggtgctcaactcttcctcactgatggtgatcctagcaagccacctctcctgttacagatggcatccgactgtgatgacaaaagctacatatcagccttggcagcttttaagaaccgtgtcctgtatgccaacgtctcgtacgaccacatggtcggctggcgaacgtcttcactaaggagagagaagaatcttataaagccctcacatcgttcactggatggctataagcacattgtgaatgtggaatactgttcgcccgtgtcatcggagggcccacatttcccttccaaggctgccagagctaaagaagctgcacagcgatcgccaaaccgagaaaataccgaggagtaccaccaaatgatggaggaggagatgctccatggcttgcagaaggttggctggaagaaggtggacgtcaacttccattcgtcattctggccttactctgctcacaacaacatacacgtcaagaacgagtggcttcacaatgctggcgctggtgttatcgcgcacgttgcggacagcatcaagcagcaggagtcacggccatgtcttcctgccaatctatagcagtagcattcagcaatccatttgttcaaattatctgtcgctagcaaataaacccatgaccaaactctgttcgtcagcatccactgagcggcgaaatatttgggactgggacacacaataagctgtgtatcattatcggccgcctaggttttacattgtttgatgtcaattgtcaaatggcatgtgtttcctcatggaacagacgaagcattcgaagttgatataaagacaacctaaattgtcat

SEQ ID NO: 9552 - DNA, 1720 bp, Zea mays
  misc_feature (30)..(30): n is a, c, g, or t
  misc_feature (1679)..(1679): n is a, c, g, or t
ccgggaaaatcccttccccgcggaagcggncagcccgtcaggttatatagctcactcttgatcgcttcctggtttgctaagcgatttgcctctcgtggttcggtgacggatcggaggcgctgcgagttcgaagctggtttctctgggctaagtcggttcggacttacttgttcagtaggtgtagtgtagctcgatagacgagaagaatatctggcgtggaagtttcagcaaagctcctggattaaattggcatcatagagggcgcaggatccaaatctgccggaaacctgtatcttcatccagtatcaaggggaagttctgttgttgtgtgttcggtgatggatacatccaaaagcaagcaaggaccagaacatctccttgttcttgtccatggtatcatggctagccccaaagactggacatatggggaagcagtgctgaagaggcggttgggtgatgattttttcatatatgctagttcaacgaacagctacaccaaaacctttgatgggattgatgttgctggaagaaggttagcaaatgaagtcttggatgtggttaacaagatgcccagcttgagaaagatttccttcctagcgcattctctgggtggtttgtttgctagatatgctattgcaatactccacccagtctcagtggaaacaaagaatgctggacagagtagtgcacttactgttcccccgccgggagggccagcaaaatcgagatgtgcttcaggattaggttctattgctggattgcggccaattaattttattaccttagcaaccccacaccttggggttagagggagaaatcagcttccgtttcttcaaggcctatcaatcctagaaaagcttgctgcgcctttggctcctttaattgttgggcgcaccggtgctcaactcttcctcactgatggtgatcctagcaagccacctctcctgttacagatggcatccgactgtgatgacaaaaactacatatcagccttggcagcttttaagaaccgtgtcctgtatgccaacgtctcgtacgaccacatggtcggctggcgaacgtcttcactaaggagagagaagaatcttataaagccctcacatcgttcactggatggctataagcacattgtgaatgtggaatactgttcgcccgtgtcatcggagggcccacatttcccttccaaggctgccagagctaaagaagctgcacagcgatcgccaaaccgagaaaataccgaggagtaccaccaaatgatggaggaggagatgctccatggcttgcagaaggttggctggaagaaggtggacgtcaacttccattcgtcattctggccttactctgctcacaacaacatacacgtcaagaacgagtggcttcacaatgctggcgctggtgttatcgcgcacgttgcggacagcatcaagcagcaggagtcacggccatgtcttcctgccaatctatagcagtagcattcagcaatccatttgttcaaattatctgtcgctagcaaataaacccatgaccaaactctgttcgtcagcatccctgaaaaaaaaaaatacccccccctcggacacacaataagctgtgtatcattatcggccgcctaggttttacattgtttgatgtcaattgtcaaatggcatgtgttcctcaatggaacagacgaagcattngaagttgatataaagatatcttttattgccccccccccccc

SEQ ID NO: 9553 - DNA, 1151 bp, Zea mays
  misc_feature (902)..(902): n is a, c, g, or t
  misc_feature (988)..(988): n is a, c, g, or t
  misc_feature (1107)..(1107): n is a, c, g, or t
  misc_feature (1111)..(1112): n is a, c, g, or t
  misc_feature (1114)..(1116): n is a, c, g, or t
  misc_feature (1124)..(1124): n is a, c, g, or t
gccggccgggttccggaatcccttccccgcggaagcggcagcccgtcaggttatatagctcactcttgatcgcttcctggtttgctaagcgatttgcctctcgtggttcggtgacggatcggaggcgctgcgagttcgaagctggtttctctgggctaagtcggttcggacttacttgttcagtaggtgtagtgtagctcgatagacgagaagaatatctggcgtggaagtttcagcaaagctcctggattaaattggcatcatagagggcgtcaggattcaaatctgccggaaacctgtatcttcatccagtatcaaggggaagttctgttgttgtgtgttcggtgatggatacatccaaaagcaagcaaggaccagaacatctccttgttcttgtccatggtatcatggctagccccaaagactggacatatggggaagcagtgctgaagaggcggttgggtgatgattttttcatatatggtaaagcatgctagcatttgaattcttcattcactaggttcaatactagtcattatctaaccatttgttctagcttctacagtgccggtttatgaactaaatggatgttaaaaaaagtgtatgcaaacatctttgtctacagctagttcaacgaacagctacaccaaaacctttgatgggattgatgttgctggaagaaggttagcaaatgaagtacgtcctttgaagtttgtcctagaaaaaaggtttcaagcattctccttgttggagactgatatctcctgttcctggatcctaatgaactgctttagaagctctgataattgtgcctatgggaacaagggtcttgggatgtgggttacaaagatgcccagcttgagaaatatttccttcctagcgcattctttgggtggtttgtntgctagatatgctattgcaatactccactcagtctcagtggaaacaaagaatgcagggcaaagtagtgcacttactgttccttcancaagagggccagcaaaatcaaagatgtgcttcaggattaggttctattgctggatgcagccaattaattttattactttagcaaccccacaccttgggttagagggagaaatcaggtgnatcnncnnnatgttcgnatacgttgcaaaatatactgcaggtcg

SEQ ID NO: 9554 - DNA, 1055 bp, Zea mays
gcatcccttccgagcggaagcggcagcccgtcaggttagctcgctcttgatcgcttcctggtttgctaagcgatttgcctctcgtggttcggtggcagatcggaggcgctgcgaattcgaagctggtttctctgggctaagtcgattcggacttacttgttcagtaggtgtagtgtagctcgatagacgagaagaatatttggcgtggaggtttcagctaagcaacgagaccaggaagtttcagcaaagctcctggattaaattggcatcatagagggcgcaggatccaaatctgccggaaacctgtatcttcatccagtatcaaggggaagttctgttgttgtgtgttcggtgatggatacatccaaaagcaagcaaggaccagaacatctccttgttcttgtccatggtatcatggcaagccccaaagactggacatatggggaagcagtgctgaagaggcggttgggtgatgattttttcatatatgctagttcaacgaacagctacaccaaaacctttgatgggattgatgttgctggaagaaggttagcaaatgaagtcttggaagtggttaacaagatgcccagcttgagaaagatttccttcctagcgcattctctgggtggtttgtttgctagatatgctattgcaatactccactcagtctcagtggaaacaaagaatgcaggacagagtagtgcgcttattgttcctacaacaagagggccagcaaaatcaagatgtgcttcaggattaggttctattgctggattgcagccaattaattttattaccttagcaaccccacaccttggggttagagggagaaatcagcttccgtttcttcaaggcctatcaatcctagaaaagcttgctgcgcctttggctcctttaattgttgggcgcaccggtgctcaactcttcctcactgatggtgatcctagcaaggcacctctcctgttacagatggcatccgactgtggtgacaaaagctacttttcagccttggcggcctgttacgaaccgcgtcctgtatgccaacgtctccttcg

SEQ ID NO: 9555 - DNA, 2816 bp, Zea mays
tctcgtcctataaatctataaatttaagatagatttttttaagttataaaatatcacattcttaaatatagtctacttcattagttacattctaattattcagaatgaagggaactaatctgaaactatcagatctgccggcagaggagggccacgctcatccggtcatcccgtcatcggactcggtcggacacagggtcccggactcggttggacacagggtccagcactccagcagccagccgtccaggcaccaggctcatccagtgttcgagtcctcgtcgacttcgctttcccgattcctaaccccgcaggccgcaggctcgcatcgccaagcatcttccgcgtctcttcggagacatctagtaaaagcatcttccgctactccgccctccgcctcccccgtctgcttcgcaatccgatccggcgaccggcggccatggatcctgcgccgcagacgcacccgatcctctcttacgtgctctcccgcatccccaacctctccatgaccaagacccccaccgccgagttcgacatcgagcagccgcctgtgcacaccccgtccccgcggacgccgtcctccgcgggagagttcgagctcgtcgagcgcatgccggggctgcgccacccgtccgtgctccgcgccatgacccgcgccgtcgccgacgtctccgccgcgcgctccgcgctgcaggtgctcggcccgcgccccgaccacgagctcgtcgactcctcccgcgccatagtggccgccgccgaggccggggattcgcggatccccgcgggcgacgtcgaggcgtgccgcgcggtggtgcgcctcgatgagacccacgacgcctacgaggccctgctgcacgaggccgagtccaggctcgagagggtgtaccgctccgcgatggaggggacggacctggatgacgaggcggcggagagcgtcaaggatcaagggccggtcgcggggcctgagggcggggacgcggcggtgggggaggaggtggtggcggtgctcaagcaggccgaggagggcaagccggtggagagcgtgcgcctcgtggatcgccagcttcgccatctgcccgaggcgttcgggaggatcctggggctccgtgtgctcgacgtctcccgcaaccagcttgaggttattccagatgctataggaggacttggtcatcttgaagagctttttcttactgccaatgatttggtatctctacctgataccattggactgctatccaatctgaagattttgaatgtatcaagtaataggcttagggcactgccagatagcatctccaagtgcaggtcgctagttgagcttaatgtgagctataatggtcttacttatctgccaaccaacattggttatgacttggtaaatctgcgaaaactctggattcatatgaacaaattgcgttctcttccatcatctgtctgtgagatgagatcgttgtatctcctggatgcccattttaatgaactatgcggtctaccatctctcttcgggaaacttagcggccttgaaattctcaaccttagcagcaacttcagtgatttgaaagagcttcctccctcgtttggtgacttgctaaatctgcgtgagcttgacctaagcaacaaccagattcatgctctccctgacacttttggtcggctggataaactggagaagcttaacctagagcagaaccctctagtcatgccaccagaggacattgtgaacaagggcgtggatgcagtaaaagagtacatgtcaaagaggtggctggacatattgctcgaggaagaacaaaggcgcattgcggcagagaccccagaaatgtcatcgactcctaaagcttggctgactcgcagcgtctcctgggtcacggacgtttctgagagtttggcagggtacctaggtgggaacaagtcagagaaagatgcatatctggaccagcagttttgatactttatgtttcttttgcctaatgtgcattcgccccatgtatacacaaataacgtttaccaaaaatcttcattacagatgtgttcctggtgagtataccgtacggttttgcttaggaaatggatgtgttcctaatgggtctgtcgtacggttttaccgtggtccattgaataatagtatctcacagcacttgagagtacactcaagataaacattgttcagagatcgacctgtcttctggtatttggctttcgaaattcgctgtgaatttttgttccccggtcttccatttcatctggggttctttgattgatttggggttctctgatggtttaattttaagatttgtttttaattcagaactattttgctccattagtacctaccaattttacatgaccgacaataccacgatcatgttacgtgctagttttaccatgaaatgtttaagaacaaccgagccaagattgacttatatttgattctactgtagtatcatggacgtcattaaaaccaacttctgtttcctaatgcagtcgacaaacttgtttgaaaaaccgtttcgataaccaaccatctcaggagaaaaaggtgtaagatgtcggtacagaatgaacgagtgtgaggacagcatgaataagtcaaaggcttcagctctgtgctgttggcttctggaaaagaaatttgagagaaaaacagtggacaattctctactactattaagaagacaccgtaggcgtccacactgccgtggcgcacggttctgccctgcctccgacatcctacccttgcctcgctcttgatcgcgcaatctcaggaaccctccatcgccgccccgccatcatcggcccgcgcccgtgcgcatgcc

SEQ ID NO: 9556 - DNA, 1932 bp, Zea mays
gacgcgagaccaagacaaaagcagccagccgcgaggcgggccccccccgcatcccatcccaccagttccccaattccatttctccatccatgacagctcgccatttccccacctgttcctacgctaccgccacctaaaaaaattccaggcactatccatttcaatcttgctcaaaggtcatttcattccggccggtgccttttttaggccgattggagggaaggctggtctgtgttttgttttcctgctgcctcttgggcgagttgaatttgggcgcctcttgctccaggcagtattttatcgagctagagtctggtacccggcgattcttgcttggtccaggcgccaaggcgaggaattgggcctagctccagctcaaatctgtgccttgttgcagacagaaggatttctgcatgggcgaccataactaagatgtgagattgggtggcgtcagctcggctggtgggtgattcttggtgcgtacacagacacatccctggaggcttgagctgatttggcgaggaggacagtgcaggagagagatgtctttcaggagcctgattcaggacatgaaggacgagttcgggagcatctcgcggcacagcctgcggtcccggtctcaccgctccgccgggaacgcggcgcgggcggcggccgcgggaccgtcggaggcgatggatcagagctgctggtcgcagctgccccccgagctcctgcgggaggtgctggtgaggatcgaggcatcggagagctggtggccagcgcgcaaggacgtggtgtcaggcgccggcgtctgccggacctggaggggcatcatgaaggaggccgtgcgcgtcccggaggtgtcagggaagctcacgttccccatctcacttaagcagcctggcccaagggatggcactcttaaatgtttcatcaggaggaatcgaactactcagacatattatctgtatattggattgacagaagcattggctgatgatgggaagtttctacttgctgcacgcaagtgtcgtaagcccacctgcacagactacctaatttctcttgataaggttgatatgtcaaagggaagcagcacctatattggcaagctaagatcaaacttccttggaacaaagttcactgtctatgatgctcatccaccatatgatggagctgcggtctcaaagagtcgctctgcacgtgtggttggtttgaagcaggtctcccctagagttccggctggaaattatcccgtttcacatatttcttacgagctgaatgttctgggctccagaggtccaagaaggatgaactgtgttatggattccatccctgcatcagctgttaaggaaggagggaaaactcctacacagactgaatttccacttagcagccttgactctttcccatcatttccattcttcagatctaaatcagctcggatagacagttcaacgtcgcaatcatccagtcagagggaagataggttggtgctgaagaacaagtctcctaggtggcacgaacaactgcagtgttggtgcctgaatttccgtgggcgggtcactgttgcctcggttaaaaacttccagttggtggcttctgaggacaatggaccagagagccaagagagtgacaaggtgattctccaattcggaaagatcggaaaagacttgttcaccatggactacggttatccaatatcggcatttcaagcttttgcaatttgtctgagcagttttgatacaaaaattgcctgcgaatgaggcaaggtgattttcccccttctctattccccttgcttgtattatggacatgcagtaaaattttattgaacatgcaatttccaatgtcaaggatgattggatgaagctctacaaaaaaaaaaaaaaaaaaaaaaaaaaaaaacgcccgctagtaaaggatcctagcgttacgctgcgcgtgcat

SEQ ID NO: 9557 - DNA, 1875 bp, Zea mays
ttccccccgcggtcccgtcccaccagttccccaattccatttctccatccatgacagctcgccatttccccacctgttcctacgctaccgccacctaaaaaaattccaggcactatccatttcaatcttgctcaaaggtcatttcatttcggccggtgcctattttaggccgattggagggaaggctggtctgtgttttattttcctgctgcgagcgctttcttgggcgagttgaatttgggcgcctcttgctccaggcagtatttttatcgagctagaatctggtacccggtgattcttgcttggtccaggcgccaaggcgaggaattgggcctagccccagctcaaatctgtgccttgttgcagacagaaggatttctgcatgggcgaccataactaagatgtgagatttggtggcgtcagctcggctggtgggtgattcttggtgcgtacacagacacatccctggaggcctggaggcttggcgaggaggacagtgcaggagagagatgtctttcaggagcctgattcaggacatgaaggacgagttcgggagcatctcgcggcacagccttggcggtcccggtctcaccgctccgccgggaacgcggcgcgggcggtggccgcgggaccgtcggaggcgatggatcagagctgctggtcgcagctgccccccgagctcctgcgggaggtgctggtgagaatcgaggcatcggagagctggtggccagcgcgcaaggacgtggtgtcaggcgccggcgtctgccggacctggaggggcatcatgaaggaggccgtgcgcgtccccggaggtgtcagggaagctcacgttccccatctcgcttaagcagcctggcccaagggatggcactcttaaatgtttcatcaggaggaatcgaactactcagacatattatctgtatattggattgacagaagcattggctgatgatgggaagtttctacttgctgcacgcaagtgtcgtaagcccacctgcacagactacctaatttctcttgataaggttgatatgtcaaagggaagcagcacctatattggcaagctaagatcaaacttccttggaacaaagttcactgtctatgatgctcatccaccatatgatggagctgcggtctcaaagagtcgctctgcacgtgtggttggtttgaagcaggtctcccctagagttccggctggaaattatcccgtttcacatatttcttacgagctgaatgttctgggctccagaggtccaagaaggatgaactgtgttatggattccgtccctgcatcagctgttaaggaaggagggaaaactccttacacagactgaatttccacttagcagccttgactctttcccatcatttccattcttcagatctaaatcagctcggatagacagttcaacgtcgcaattcatccagtcagagggaagataggttggtgctgaagaacaagtctcctaggtggcacgaacaactgcaagtgttggtgcctgaatttccgtgggcgggtcactgttgcctcggttaaaaacttccaagttggtggcttctgaggacaatggaccagagagccaagagagtgacaaggtgattctccaattcggaaagatcggaaaagacttgttcaccatggactacggttatccaatatcggcatttcaagcttttgcaatttgtctgagcagttttgatacaaaaattgcctgcgaatgaggcaaggtgatttccccccttctctattccccttgcttgtattagtggacagtgcagtaaaattttagttgaacagtgcaatttccaagtgtcaaggagtattggatgaagctctccaagggggggggggggggggggggtgctcgagggggg

SEQ ID NO: 9558 - DNA, 7995 bp, Zea mays
  misc_feature (185)..(185): n is a, c, g, or t
  misc_feature (5372)..(5372): n is a, c, g, or t
gccccccataatacctattttatgacgtgtcataataatacatactcatctgtcttaaaatagtagtcgtcattttagggaattagcacatttatacattttttgattgatacatgtgttttatatatgtatctagattcatcatcatccatttgaatatagacataaaaaccaagagctaaaangacaactattttagaacgtgtgagtatattataacataaatacagcttataaaggttaactaagataggccacaaccttctttatgatcgtgtcattcagcacatgtatttggcctccatccgtgccactagcacgctaggtggtagcgcctgcatccacgctagatctcgtccatgcttcagcagtgcaaatccatgccaccacacaggacgcagtcatgagccagcgtgcacggccaatgcacatctaaaagttagcagcgtgccttcatccaaacgcaaggggatgcaagcagcaacatggcaggcctgctacagcacgttagtacatcaggccgaggacgtcgtcgtagcactcaccctcaagatggtcgctggtggctccgccaaacatgctttagcttatagcccctcctttgatcaaatcctggatccgcccactcggtaacatgatactgtggaacacttgtaccctttgtcgccaagcttcaaaccaatcgcaagttttttcctcaatcattaatatcttccgatgatttttctaacttttgagagtttagtaatcactttctatggtttaggctctagaaagtttattttttttctgtagtaaatacgaaaactaaaacatagtttaatttaatatatatatatatatatatatatatatatatatatatatatatatatatatatatatacacgatatgcattccctttcttttacaaaatcgatcgtcgtgacattctcgaccaaaaactatttttagaaatttatttttttaaaaaaaatcccaccctgacactttgcttgtccgaacctgtgtccagtgacccttcatgctctcgatcgagctcgttgcctccagcggtccagccataagccatgcaaacacggcaagatgtgcgccagtacaatgactccgtccccggcatgcagatttgagatctgctagctcagccaggggagacagatcccctctgcgatgtgttgcgtacttgtgcatgtgcatgcccggatcctatgctactactatacgtacacgttgatgaacctgcagaaaatattgttaccgcgaaaaacttatcacaattcacaggactacaggagaactgataaaacgtgctttgttgctctgacagccctgtgcagagtactttatagctagtgcaacgttgccttgacactgacaccttccattgtcgtccgtggcagccttatgtcacttcaggcctcttgtccggatcgctgttccagtttttcaggtgatttgaagtactaccacatcgtcgtgagcaccatatcatatttcagtgccttaaatttgattaattatatatatataagtactaatgtttaaactatcaaataaatgatattagattagtcataaacatattttataataaataaatttagtcatcagaaaatgttccctggctctttgctctgcgttctgttcatgcaaaaacattttgaaatttcatgggttagaataatccgagtaaaacaaagaaacgagctgcggcaaatgcactggggcttcgatgcgccaccacaaggaccgcaagccaaagctgagccaacaacagccacggtacgtgggcaggacaacatttaaattaattaatgtttagaaacgcaacaaaagaattccagtcgccaccactgcaccgccaggatgatatgcaaccccaccacgatgtccaagaatcttgcgttccccatggtcgacggatcacagccatgtgcgcgcgcctctagcagcgctgcacgctcggcggcggcagcggcagcggcacgtccgccttgggcgcagcggcggaggttttcttcgcgtgctcggtgcgtccgagctggcctgggccgcgcccgccggtcgcggcgctcccgctccgcatacggcccttgccgaggtggtactggcagagagcgtagcccaccagcgtcggctggctgcaccgccacccgcgcccgttcttccggctgcaccgcgacccctccatcagcgcgcctgcagggccccgcgcggccctcctcgcgccgccgccggtatcctgctttgcctcttgctgctgcctcgtcgccttcgcgcccgctgttgctgtcgtcgttgtcgccaccgctgctgcgccgacgccgttgctgagacgacgctctccggcctggatcgtcaccggctccggcacgtggcagtcgcgaccattgtctaggctgcagcaaagtaggtgtaatgtagctttaaggttttgtgtccgcatgctgggtcgttggacagaataaaatgcgatcaacaacaaaaaaaaagaagaagaagaaagaagcagcggcagaagcagtacatatcatatacagtaaccgtagcgctgagactaataaactccaagcacaaaaggatgcaactcctccaagctagcaggcatggatgcaatgcaaagcactaatgcctcccgacagaaacaaaagtgcaatgtgcaagtgaactggactgtttcatgcatgatgcggcgcgcacacaaccgcacatggaccatgtttcccaaagcagatcgagttgcactcttgcacccatacattgcacttgcactcatacagatcgaaacaccgagttgcacacccatacagatcgaaagaacgtggacgacgccgacgccgacgcggcgatgcgatcaagcaagcaaggtcctgatcgaagtggcgaatggaagaggtcgcactggatagatagatgtcgtcgcatgcatgcacatgagggtggcagtggccggccggctccacagtccacacagcctacatgggtgcatgagggctttgtctggcaatggcaacattggcaagcaagcgagggcattaatcgattggactgatgtgtcaagctggcattgcccactatagtagtgtgtgaaacagtgaacccaagccctgggcgctgggcgctggccctgcaggcatgcaaaataagtgggggccttggatcatttccttcctttttttttctgtgtgtttttttctattcgtaattcccacggccgccatcgcaggcccacccgtaccattaaccatactcccacgaaacggatggcacgcagcacgcacaggcagcagcacttgctgtcacggtttgcagttggttctgctcatcacatacctgctgcggccatctgaaggcccctgtcgttgccgttgttgcgcacctaggccgccgcagcggctgcgctgctccaccgcgtcgtcctgctcctgcaactgcaaagcagtaatccaggaacatgcggccggttagctagatctgccgtccagcccacacggcccgtgggtgcaatgcaacggaagggagcttttatttcccaggtacgagacgggacgggacggggcgacggacgagggacgaccatgtccttaacgaatcccctctcgcgtctgggaatgcgtacatacgcggatcggaatcacaatgaggagatggagatggagcgcgcgtacctgcggcagcaatgctgggcgccggagcgcggaggagcggctgcggccgtcctcgagatccgcgggtgcgggggaatcatttgttgccgggtgcaagtgcaactccccctccccttgcttgccccccgggggcggaggaggacgctcctgacgatctatcgacgacgcacgcggcggcgactgcggcgcggcggatggatctgagggcagcaggtaggcgagaggctggcccggaggccgcctcctgatcctcatgggcgggtctagcggagcggagagagggcggagtgaggagagatttggggagcgagggtgcaaatcgaaggagggggtggtggtggggtggggtggggtggcttgtgttgtgttgtgctgtgtgtgttggtttggttccttcgttttagttttggttggtctttttatggctgcacctcgctcacgtacgcacttatttatgggaaacagtaaatgcaatagaggtggtgtgagatcttggtgcagtttcgtctcgctccggcactcgtctgtctcccttgccctgcccttttggttccattggacttgggacttgggaggagaggcctggagcctggaggggaagatggcgtgaggggttagtggtgggctgcttatgtttttgcatgcaatgcactacacgcactatgttccattataaaaattgtttcagatgatcaaaacttatacaaattaagtaatcatttatggccggaattgttacaggccacgattcctttggaaccccgaacacaccctgatccatttttctctatcggatttaaagcggagcggataatataaggacgtggatgctactttttcccccaatggtagaactagataactatatgcttgtgaacaattggtttataacatagtgtctctacttacaggtgataagttattaagcaataagtaataatatcctcacaaattctggattcaaaaattagaacatcacacaaccactttataaaacaagtgttgttctcaacaagccgtttctttaatcatgcattcctcttggtttcgatcttggtagagaagctaccatatatcctacttaaaccattggagaatctacataaagattacagataattcatatctatggggttttttctattccatatcttaccatgcatccacacgcaataggatttagattatttgtattctgcattgataataaattttttccatatcctcaaattttggattcaagttagatcagatcggaggattattcacaccaatttcactcacatctacctagggaggaggtgccaaggcaactaagatttgttccaggggtagcattgctaggtgtacaagcaatgaagcaacataatattttcgcagcggcgttgagtatgcgcaatgcattgtatgtgatatcatgtagaaagtaaagcctcggtatatacgtactatacgctgttgtgagaagactcgacaaaacaattgagaaaggttatcttgtcgatccaagatttagggttgatttgaggctccaataagacttgcaccgaaaaaacaattatctacagacgtttacgtgttgaccacaaaacgactagagattcacacaaggactttatgtacatatgtatatccattgtaatccgtgtgggttggactagaccgatgtaaactttaaactaaatttcatatcaaatcattcnaattcatgtagattgaggtgaatacatacgcatttaaataaggcctaattgatgtcgtgtcgaccacgaaaccacttaacttttacgtaaccgaacccataggatgtcatgctgaccacaagatcaattgaataggaaaaggtgtcaagtttaatgttggcatgaaagccaaccttgtagttctaatttttttttggtagaaagccaatgaacgcaacatatttctagtagcacggacatgtgttaacggatcgacgacaattgtgaagagatcagctacatgtagccgcgtagacaattgcaccatgaagttaattgatatgacattttccgatttacctcggcgacaacgtgcattcatccaaacacaaagtacggtcgagcccgagcaaggtgttgcatttgcatagttggcatgccaagttgatcaaaacgactggtaccctttctttagtttcgacctattttctcgaaagttcaatattgtagagagtgagtgagagaggattgcagccatgagccttttaaaaaaacaagaaatacaatcagtgtgctagctatagtgcaaggatggaagtagagtagtagaaatgtgaaaataccttgattccaacagttgcatttgttattatggtgttaactccgttctcgaataattatcgtccactaattcattttggaactaaacgacgacaaataaaaaataacgaagggagtactaattagatttgacacgcaaaaaaggtgtagtggtggccagtttttggccggacggccagaatggcgtgcctaatataatcggtaacctactacgagttacccacaagagcaggcgagcagcagtgagctgtgctttagcgagttactagcttgctgccataaaatccttagaccttaattaagccagatatgtgctgctgcgtccagggacgggtccacgtagaagcaagggtattcaactgaatacccattattttctagcatatatatatatatatatatatatatatatatatatatatatatatatatatatatatatataatatttatatattaaaatattataaaaacataaaataacactgttttacagctatttgtcctaaacttcgcttttcgcgaacttttttttatttctctaccgtgcgactagggataccaatcgtgcggttaagatacgagtatatgatttacaaattcataactacgagacaaaattaaatccatactcgtactcatatacgttcgtaggtatagatatctactaatgtcagatacatatcgggtaacgggtatggatactgtatatccatacccaagaaaaaattaccaatggataccttattatattcatactcatacccgtggataataaattataccatatccgtgtctaatagataattatttgttttccctgaataacaaatttaggctgtcaaaaaaattgtgcccactaaaattctgaatacccatcctcgaaatcctggccccgcccctggctgcgtcctgagtcttcagggttgacttaagatcttcactgacaagtgggtcccattctctcacactgagacgagctccggttgggcccagctggctttgcatgcatagccgacctggcgacctgcgtctgacaaagagcccatcaggcccaagagtttggctgtcggtcgatcagcgactcggcgtcttattttctcctaggaagttacttttttctggtttcagctctagtcacattagttgagcggcttaggaacctgttgatcttcctcatcgctgggacgggacggttcaggacggaaattttatggagtatttggtttgagaaatgaggtaaactatgatcttcttattcttcactttcttgtttggttcgtgaaatggaatgagctgatctatcaccattttattcctcataagctaataatagtaataacatgaggaatgagttcatttcaccaactttatggaatgaactgaagatgcactaccttatttataatggattgattcttcatactaaacaccaccttagtgggacagatccatgcaatcgttcctctgggtcctttgccatcttgaggcgaggcaatgagccggcaccagaatgtgggggcgccttcgtatgtccggcggtggcctgacgcgcaacgaatcatgcgtttcgtgccatgattcctgggctggcctacatgcagtccacatgatgtgtcctgtcaggagaagagaaggaagatgattgagggaggccacacggacagtttaatggctaaacgtaccgccaccggcatatggacggccttcttcaaaaatatacgcatggatggatggatggaccattagagatggttgatggcttgatgcttcggtttggtgaatgtcgatgggcaatggagcagaacgttacgctctctagattcttgaacctactcgtctccttttcctatccttcaaccgtccttcagcatgggaacgtacaatacaatccttctgtggttaccgggggggggggggggcaactcgatgcaacaggacaagggaaaggaccagagcaagctgcatggtccatggattgtcatcgatcgagttcaagggaaacaacaaagcatacacggcc

SEQ ID NO: 9559 - DNA, 5700 bp, Zea mays
cctgcagagttgctctgagatgtttggactctagggcattacaccatccctagtgctgttgtcaccttagtttgagatatcgacactccctttaatcatgacgatgcttgtaccctccgtagaccatcccgtgcgttgtgcaatatctttttattatcatttatcactttcatccatggttttcaagttgtcgcataagcgtccaggcgctaaaaaatcatgagtgcccctgtcgtcacaaccgtaatctagcagaacaagagaggaggcgagggagaagaaaaaagaactagagaaggcaaagctcctacctccgccccatccccattggctcccatggctatggcagctttcctcactggccagcagctctagatctgcatagagtggagaggggtctgcaagggggtggcactagcatgggagaaggggagggtaagcgacagggaatgctggaggagaggtgccggcggcagcaatagatgtgaacgggggagggtgggttatatggactgcttggtggtctcttgggctggaatttgttagtttcttcccctttcttcttttccttttcctacctccacactgcaacactgaagttcttcctattcatatggtgtccccttgcgtatgactcaaaagggtggctcgccatcgccttaataaccatgcttcatcaaatccttatttttctttctcataacagctcttaactatcatcatgctaattgttgcctacagaaggacatgcctggtgcagtggtgagagctatctcattgagtcaccaagtcatggggttcgaagcagcttctccgcatcggggaaggcttgcctccgtttgtcctttccctagaccccactcatgtgggagcctccggcaccggatctgccgttcacccctctggtcggaaatttacgattttacttaaattgtcagtataggatttacaattttcatagtcattatgaaaactattttataacactaataaaaaaggatgatgtgaattgcatggtgccgccaaatgactgctacctttttttcttgtatctggctatccattgttattgattgtggttctgccactccattgctcaagctgaaaccttttctttttaggttggcagtgttgatgtacttcattgctatttatgcccatggtgaagagaatgagaccttccaaagacgaacatattggctgcttgaagagtaagcgctagatacagtgttgtagcttaactgactataacatacataaataacttttgaagtctattaatacagcagctgatagttgagatgatcccatgataaaattgaaatgataatgcttattatcctgtttttcaggggtttcatgaatattgttcttgttcactaccttgaaatcaaggtatgttttgatttcacacgatgaatttgtatctctattttctttgaaagttttgttaagtgccagttgaaaagctcatattcattcaccatcaatgccaacattgctggcatctacatctacctgtacatttatgatagccacatgatctcccgatggaaaaaggcgataacaattgacggggaaaagtgtctgttccagttgtgactaatagtctagaccagtgcatgaatatttgcaaactgaaagctcactgctcactgttgtggtaccctgttctccagatcacttgctaactacaaaataaattatttctggcagtgaaagacattctgttaagagtgcaagaatgatctgaatttagcttttactctgatccaagcctttttaaggatattttatttctatatctgactgccttctttttgcagggtgccaaacaaagtttcaatcatgctaaagaagctgaagagactgcaggattatctaatgccgatagtcctgcatgctcaaactctttcgctagtcagagccaggtagcctcccgatctatggatgctgaaagcccaattagtggacagatttcggaatatgaagatgctgaaacaggtcttgctgtttctctatcttcgttctgcatcatctgtactaagtatacattaaacactgcacgataaacaatatatgtttagtgtctaatgcataatttgctgcaacagataattctcgagcaagctccagataccaccctttcactgagatgcagcagcctgtggatggtaccgtgatgggtaacttctttggcgcttcatctccaagtgtttctgtaaataatctaggcaagcttttcactccaccttcaaatattatatataaatataggcatttagctcatgtttgactttctacagctgcaggttatcttggtgaaatgcaacctacgggagctaattttaccagtcattttgccactcgcaatgacatagctagtgtgttcaatgatactggctctgagttaggaggtggtcccaaaacttcaattgattcagtactgttgggtgaaccatttccagaatatccaggcggcttcatggagtcgacactctattcttctgttgcaacattgggtaacagtctggaagatggtttgcagacatttatgtctgaggctctctacaccaacaatctcactcaaaaggaagttgatgcacttggtgcagcaggcataacatcctcgaaggtgatttgctattttctcgttttcctcaatgtctctaaaagcattatagtttctgcttctgctgggtatcttctctgcaaacacttgtttctgtaacaattagttgcccagtccacctgcagaggtgagttccttagctctgcaatatcatcgcagtgcactattgaaagctataagcacctccagtctggaggccacatagaacatgacccaagagaactatctactagttaccttggtttgtcatcctttgttttcattacaaacactagatgcttcaatttttcattcctcactgaccactgttggcttattatgtcaaattagtaagaggaaaggactaacttcagcagtgcacttatattctaggttcctagttttctaaaattgtcttgaatagttcaatatatccgtgcgttgcaatttactgtagtatcttaagaatgatgccgtagggcattggagtttacctatttccatgagctggtatgatgtaaccctttattttcagacagagaatgatggttatacagatcaaagtgtcaggtatccacttttaaagcagtcatcatcagacctctttaagatggagccagatggtttgaaaaaattcgacagcttttcaaggtggatgagcaatgagcttccagaggttgttgatttggatatcaagtccagctctgatgctttctggagtactactgaaaccgtgaatgttgctgatggatctagtatacctattaatgagccattggatgtatttgtagtcagcccctcactttcccaagaccagctcttcagtattattgatgtatctccaagctgggcatacaatggcacaaaaaccaaggtttgtttcatcttttactatgtttgtgggccccaatatatataactctgagggcatgaggcgtccaaatcttactgtactattaataagcatttattttttcctttacacaatgcaggtcttaattactggtacattcttggcaaaaaaagaagatgtggaaaattgcagctggtcttgtatgtttggagactctgaagtctctgctgaagttttagtggatggctccctgcgttgctatacaccagtacaccattctggacgagtcccattttatgtgacatgttcaaatagagtagcttgtagtgaagtgcgagaatttgagttccgtgattctgagacccattatatggatatctcagataagcatactacaggcataaatgaaatgcatttacgtatccgccttgataagttactttccctggaaccagaagactatgaaaagtatgtcttgagtaatggaaataagtctgagctgatcaacactatcagttcattaatgcttgacaataatttgtctaatctggcattaccatctgatgagaaggaattgtgcactgtacaggatcagaatcttgagaaacaggtgaaagaaaagctatattactggcttatccataagatacatgatgatggaaaaggtccaaatgtcctaggcaaggaaggacaaggtgccattcatttagtagccgcacttggttatgattgggctatcaaaccaatagttgcggcaggagtaaatataaacttcagggatattcgtggatggactgcgcttcaccggccgcaaggcggcggcaacgatctctaaaataatttcccttcctttttgcatctgcccttccatgctgaaatttatggtatttctgtaattttagggagcggacagttggtgccctgatagcaagcggagctgcatctggtgctttaacagatccaacgcagcagtatccatctggaagaactcctgctgatttagcatcagaaaatggtcacaaaggcattgctggttttcttgcagagtctgctttgacaagtcacctctcagctcttacattaaaagagtcgccaagtggcaatgtggaagaaatatgtggattaacagcagctgaaggttttgcagcatcaagttcttcccagcttgcttgtgttaattctcaggaagagtccttaaaagattcacttggtgcagttcgtaaatcaactcaagcagcagccagaatatttcaagcttttaggtgggaatcattccacattcggctcgagattgaatatggagatgatgattgtggattgtctgatgaacgcacactttcacttgtttcccttagaaacccgaaatctggacacggtgattcacattctgctgctgttcgtattcaaaacaagttcagaggatggaaaggaagaaaagagtttatgcttatccggcagaaaattgtgaagatacaggcccatgtacgtggacatcaggtaaggaaaaactatcggaaggtagtctggtctgttggcatcgtggagaaagtcatactgaggtggaggagaaagggaaggggtctgcgaggtttccaacctgagaaacaacttgaaggtccatcatggcagatccaacctgcaaaggctgaggctgaggatgaatatgacttcttgaaggatggcaggaaacaggctacaggcaggttggatagagcactggctcgtgtgcgttccatgaatcagtatcctgaagcaagagaccagtaccgcaggctgcaagcctgtgttaacagcctacgagagtcccaggcgatgcaggacaggatgctggctgattcagctggcaccgatgggggtgatttcatgactgaattggaggagctatgccgggatgatggcgatgccccgatgtcgactatttcttgacatggagcttactatagatcagttaggcagtgacatgttctttaccagactagatgtaaattgttgttactaaatggtctctactcaccgttgaacaccataatataatgatatataccagctaatacatggacttctacagattatgataattgatcagtataatttgtggaattattatattttaaagccaattaaggtttaacataataaaagtaagcgaaatccaattgattcaggtaaaaaaaaaaaaaaaaaaaaaaaaaaaaaaaaaaaaaagaaaagaaaaaaaaaaaaaaaaaaagcggcc

SEQ ID NO: 9560 - DNA, 3811 bp, Zea mays
  misc_feature (866)..(866): n is a, c, g, or t
  misc_feature (2384)..(2384): n is a, c, g, or t
tataatgatgttttaaggccctgtttggcatgacttcaactccaaactctagactagagttaagtggagccagccaaataccctaacttcacttttttttggagtagcctaactccatagagtcggtggagctctagttcatttgagattgtggtttggagcacctcttttctagctccaaaccactccaaaatagacataggcatgaagtttaatagtatttacctatcaatgccattgatgacacaaaatatatttgttatttcttggcaaccctatcacgtttgttcttccctgcttgtgtttcgttgccatagctgccagggagatgccacttcgccccctacccccaccgcggctagatggggagttccaagctagcgatggacttgaccatcttgctcgcccacatgcgtattgtcaccattgacttggcgcttttgaactcggcgctgacactcgtcgtcaccacgacgcctcccttctctagccccttcctgatgccaacgaccttcgtcttgtccttaaccatgacacccatatctgccctgggtccgcctcctccgcgccggtgctcctgacggtggcaagcagtgaggcgttgctacgtggccccatggagagctgtggcgcgaggcttagcacgttgtaggccgcctcggctctatgcctcggcctagaggcggcgcgcgagacaggctactaacgggtaatgttctttggggtaggcatcgcagatggtgtgggactcgccgtgtgaggagtcgaggtggtggagtaggttgaaacggtggccggcagcctcagggcctacgttcaagatggccatagcgtggacaagtttgctcagtggagttatgaacacnctgcatggtaaactcctattagccagctccaactccacgtgaaacctactccacttggagttaaggagtagagcagaaatttgtggagttgaagccatgccaaacatgacataagacttctgcatatatgcaaaagatgaacaaactaacgacaaaactaggtctaaaccgtcgttagcttttcttttcttataaaaaacacaacgtgctaactagaagcattcaacatcggtgctgcccggctcgacctgatcaatctgctgactcggcattataccatgcttcgcagttcaatatattacactgcaactagctgttaattgcatgcgacgctagttcagctggatgacacagatacttaacaactcctcctatgatggaccaggccagtatgatttaaacaaaggacctaaaatattccgcccgttcaaaaatcagcctcccgtgttgaaaagtattagctggtgcgcgggcaacgccgagtcaaagtcaggctcgtaccgaacactccactctgccactcccactcccactcccgccacggccagccacacgcgcgctctccaccttcacgcactcggctcctccacgtgtcagccgcaggccgaaccaggttccttccaggaagcttcctgtgatcggctgatcgcctccgcacccacgatataaagcagaccggccccgtgctcgcgcccccaagccaagctagcacatccatccaggtcatccatcagctcttccctctgctcacaactcacaagcaacagttctgttggagcttatcaatctctcgattcccaggaggaacggaaccaaaggtctgctggtcgcgcgcgtgccactagtcaggagacgggatgggcaaccttgtctcgcagtgcgtcgggaacggtgccggcgcgcggcctctggtcatcggggcgacggacggcagccgaacgatggtcgaggagaacaccgcggtcgcggagctgatgatcgacgcgccggggcacgtggttgctcgcgccacggacgtggcgagggagcgacggttgcgggcgatggcggccgacgaggtcctgcgcgctggcgtggtgtacctcctcgtgccggcaggccgggccggtgcgcggctaggcggccgtgaggtcgaggccatcgggaggctggtctctgggaagaagggttcgaggaagagcaggcccggcggcggcaggagggtctttccggacgtcagcgccgaagaggacgcggctgaaagaaaggaggttgtgtgtgctgttaaacgggcccatgatcatggatttgggcccaggcaatggaggcccgccctggataccatctatgaggcctagattttttcttcttattagagagagtaggaaaccccattctttggtttatatgtttaggaacttaccatgtacaactgtatacattcgtctaaccgtgcaactaaaaaacgaagacagaaaaaatattcttttttcaaattattgtctcatattttgtagatatttttttaaatcagctcancgtgcgatgtctttagttgcacgagtacatcaatggttacacctgatgtggtatttttttgctgaaaggagggaggccaagttgtgtgcatacactttgtgcatgattggttggctgcccacccgcgcctaggctccattcatgcgttgaccgcatttgagcatgtggttggttggctgcacggtagcaatcgcgcctgtgcgcgcagatgcaagatagactttttttatcgtcgttgtcttgcatgcgtggggaagtagaaatcgtccgtttcaaccgatgcagactgcgctgagtcaggcgccgagactgttagcaaccaaacaacaggtttgtgaagacctaacccttcctatgtagtcatatatatgcaatcagaaatttcaatgttagtggttgctggaagtgaaaattacttttttcatgtgaaaagttatgcgcttcggttcttcctaaagatggggataacgtagttataccgagggcttgttcggttgcgtctgaatcgaagggaattaaatcactcactagtcaaactttaatagaagtggatttaatcccactcaatctagacgagctccgacccaagacaccagcgagtgctccgcagctccttgctgtcgagctagctctgtcccatgacaccagcgagagctcatttgcaccttgtcatcgagatccttcctgcaacatcatcgagagctccagttctcttttccatcgagctcatcccttgacaccgaccagtgggagctctatcgctccttgccgtcgagatctgtccacgacacccgcgagagcaagattgcgagatggaaggtgtgcgacgagcagggaccctttattgatctccaagaaactataacacctcgtccactctcggaccagcgctacttactcctagcagccctctaggatcatatatcatccccacaaaccaatatgactcttttgtgcacactttgtcctcactcatacgcgcccgagaagacttcccggtcggtcacccatcccaggattgctctaggccaagcacgcttaaccccgaggttctttcgacacaggcttccaaaaaagaggatacaccttgtttgtattagtattctatcaatcctattaagccttgggccagaatatcacataatcgatcaggctaggatatcacagaaacgatcgtctgcgtggagtggacctacacattttactcctaatagttgttggaaaaattaagacaattagtttgaatttaatatgaaacaaaagcatggccgtgacaacaaatatgtacataaagcaaacagatctaaacatctcgtgccaattaagttaaaagtttaactagcacaaccacgtctaaatagattaaattggacagtatgaaagacatgatgggagggagatgattgtatgtttgttccttggtggtg

SEQ ID NO: 9561 - DNA, 2183 bp, Zea mays
tacgccaaaaccgagaaaaactccatccctttccttttgacattcccatgccgccacacggggggacatggggacgtcaaaaaggggatctgtagctgaaaagctaaagtacgtgtctatgcatgcttcatttgagcaaataattcatgtcaaataatataatgcgatgccaaaccattctgaaaagaaataaacaaaagtgatgatatgctgttgacgtagaacggtagagactagagagaggctagcagtaccacttgctctggatatatactttaattgtttagatactagataacggatgggtgaaaatacactcttgcagtacacgtcagaggcaaccgtggggtcctttctttcttatccaaaaccaaaaccagcgaaaccaccggccccgcccttgaccaaaactagtccgtcagccggtggctcccgctcccctcgctgccgctcgtaactggggaaggccgcaaccccctcgggcaggcagcggctacccccaccaccaccagtgcaccaccactccaccagcgtggcagcgacgttgctgctgtcggcccgtacgtcctggcgtgtccttggcctacttaacccgcaaggacacgccgccattccgcagggcgagctcaagcctcaagctgggattggcccgtcggcagaacaagtgcacgcgggaccgggcaacatttcccgctgcagccaacaagcagagggggcgacgatatatagccacgggcggccgttgctggatccggcatcttcctcgatcggcaagacgataggatggggttccacctgctggcgttcgtggcggcgaggggcctcatgcaggcgttcaacctgtcggcgccgctcagcctccggctgccgctcgcgcgccacctgccggaggccctcgccgtcctgtacggcgtgctcgccgcgcaagccgcgtggctcaacggcgccctggcgcgcggcgccgcctggagccacagcgggagccggggcggcgtcgacgagtacgtccgccacgccatgctcagcgtctacgactgagaccaccggcggaaggtcgacggacagcaggcgccacgcgagggcgcttctagctgctgtccctgcccccgtcgtgctcgtggtggcaagtgcacgccgcgccggcgccggcgccgccctctgctagctagcggcgactagcagcgtagatctttgtaattcattgctcgctcgctcgtttggcgttccttcttgttcgtagcatgatttttgatagcatcgaaaaggtttgggaggttgctctctgtaacatgcaattgcaagccgtcggtggtagctagtggctggtaaattaaatacaagtgatgaattctgttagactgaattttctcgtcgccagccacgacgcattgatatatctccatgtgagcagctcgctcgctcctcctcgatcgggtcgccagaaaaacgctgggaagcccgaaaatgcgaccccatggtccatggacgacagcgaagttggtcatgctgcatgtgtggattgtgtgggccggggctcaattgtcacatcttgtgcaaatacctgatccgtcctgcacttgcctgcgatacctcgtcatcatatatgaaccagctgattagtagcttagttgattagtactccagaacctagtgttgcttaattagatagctctttattacgcccaagctatatatctgcgagagaccaaaccaaaaaaaaactatactgctggacccaggtgtgtgtatacataatctggtccagcatgtgagttgctgacttatccgttctgttgaaaattaaaagacgtgcgtgactcccatctatagagtacagagattcaaaacaatggacttgtactaaaaactagactacctccgcggagagggatagaaagatgcaaaacgaccttctcctgtcctgcatctgcatgcaataagcagccgctttagtgctgccgtgcagagaggtacttccatgctgctcctggccgtgccggccgtgttggccgggttcctcaaggcgttccgcctcgccttcctgctttggccgctcaacctcgcgctcccgctggcgcgcgacctgccgcgggcctgcatcacggtccgggccatcgcgtccttctacgccgccgggctgcggggctacgtcgccggcgcccaccgcggcgtgcaactgctgc

SEQ ID NO: 9562 - DNA, 1980 bp, Zea mays
gtgaaacacagccatagatctacgtcagaaccaaccgtggggggaggtggtttctttcttatccaaaaccagcgaaaaccccgggcagcccttgtcccctcccctggcctcgttgccgctcgcaactggggaaggccgcaaccccggccccggcacggcagcccccaccactactaccaccagcagcagcgaccttgttgctgccgtcctggcgtgtccttcgcctacttaacccgcgaggacacgccgcattccgcaggcgcgatcgagctcaccaagcgcggatattggcccgtcagcagaacaagtgcgctgcacgcgacgcgatcgaccggccggccgggcagacagacattatctcaattcccactagctagctagctgctgcaggaggcaagagacgacgacagacagccagccgccaccgtgcggtgccaaggcgagctccggtccgcgacctgttgtgcgccgccgctgctggcttctcttccgcctcgacgcgcgacgatcgatggggttccccctgctcgcgttcgtggcggcgaggggcctcatgcaggtgttcaacctctcggcgccgctcaacctccgcctgccgctcgcgcgccacctgccggaggccttcgccgtcctcttcggcgtgctcgcgtcccacgccgcgtggctcagcgacgccctggcgcgcggcgccgcctggcgccacaccgggaaccggggcggcgtcgacgagtatgtccgctacgccatgctcagcatctccgactgagacgcgcgcatccacggcggacgacaaccaccatctccgactccgtccctgcgcgatcgagaaggcgctagctatcaagctgcggtccgtcgtgcatgctcgtggtggcaactgcatgccgcccctcgctagattagcttaggatctctctccccctccccctttgtaacacattgcttgctcgctcctttggtttcttcttgttcgtagcatgcgtgatttttggtagcatcggaaagatctgtgagattgttgtaacatgcaaccgtggaccgtggttaatttgtaaatacaggtgaattttgttcgagctagtgaaagtttctcgtcatcagctcgtccagatagtgacgtgttctccgccctccgctccatgacgaccatctaggtaaagctagatcgcctcctcggatcgagaaagagcaacccatagctccgacaggaaccagaaaaacgcagggaaacgacgatgcgatgcgtccaaccgtgtctgtcatgtctccccgaccccatcccttctccgttcatggcacctctgggacatcccttctccttctccgtatatatctcagctgggagatctcgacattgtattcattttttgtgcaaatttcacaataatctgtcgtggaacgggaaccctctagtgacattgtacagaaaaaggttaacatgaggccatagttttggtgtttatgacatttgaaattgttgggctcatcgccaagcgcggtctagcaggctggtggcggggtcatcttcaccacgatcaaagcaacaccgaattactcaagtttttttttgaaccaaacttctctaacttcatcgaattatacactagaggggatttagtatactatggtggattcagtatagtaatcataatttaatgccgtacaaatgtagtcgttgcagtttttctacaaatctggctttcaaaccggggaagaagcaaagaatcctaagaagatatattgcgaaaagtatttagcacgccgtactccagtttactcgatcaaagtatgaacgtctactgtttggaaaaaaaacgagaaaaaaaaatacttgaccttagattttggagaaacacgttgctcgtgatcgtgacgaatgaagagaaatcctctctttgatttccaagtcttcttacgccactcagtctaatcggatcaccttttttttcaaaaacatatataatgcactcaagtttcaca

SEQ ID NO: 9563 - DNA, 941 bp, Zea mays
cattgggtacctcgaggccggccgggacagccgcacagccgccgcccctccatccacctctccacaccatctgacgctgctcccaccgaggtctccaaggctcactcctcaccagcttctgctctctccctcctcatctctgctctgctctccgccgttaactctccagctccccctcgctccgttcccttccccccaaatcaccgggaccaccaccaccttcttcaagatcggcgggcgggcaccggccggcgatgacatccaccgtcaccacaaccgttgggtgcggggggctccccgtccgcccgttgtcgacggcgaccagaggacgcccacgcagatgcgccgtccgagcccaggccgcgggagcggatgcctccaatgataagtcagtggaggtcatgcgcaagttctccgagcagtacgcccgccgatccaacactttcttctgcgccgacaagacagtcactgccgtcgtcatcaagggacttgctgatcacagggatactcttggagctcctctatgcccttgcattatgatgacaaagctgcggaggtagcacaaggattttggaattgcccatgtgtccccatgcgtgagaggaaggaatgccactgtatgctttttcttactcccgataatgactttgctgggaaggatcaggttatctccttcgaggagatcaaagaggcgacatcgaagttctaagcccttgtatttgtcacggagtgtttacttgacagctaattttttatatgtgtatgtactcaagtagcatctataagatatgccatcaggaaaattttcataaaatgtgcagtaaacagcacttcgcaaggctgccgatcatatgagccgccttcggcctttttattgtatctgggctccatttcgtgaattaaaaaaaaaaaaaaaaaaaaaagggggggcccggtaccca

SEQ ID NO: 9564 - DNA, 947 bp, Zea mays
ccggccgggaaggtctctcctcaccagcttccgctcgctccctcctcatctctgctctgctctggaccgttaactctccagctccccctcgctccgttcccttccgcccaaatcaccgggaccaccaccgccttcttcaagatcggcgggcgggcaccggccggcgatgacatccaccgtcaccacaaccgttgggtgcggggggctccccgtccgcccgttgtcgacagcgaccagaggacgcccacgcagatgcgccgtccgagcccaggccgcgggagcggatgcctccaatgataagtcagtggaggtcatgcgcaagttctccgagcagtacgcccgccgctccaacactttcttctgcgccgacaagacagtcactgccgtcgtcatcaagggacttgctgatcacagggatactcttggagctcctctatgcccttgtaggcattatgatgacaaagctgcggaggtagcacaaggattttggaattgcccatgtgtccccatgcgtgagaggaaggaatgccactgtatgctttttcttactcccgataatgactttgctgggaaggatcaggttatctccttcgaggagatcaaagaggcgacatcgaagttctaagcccttgtatttgtcacggagtgtttacttgacagctaattttttatatgtatatgtacttaagtagcatctataagatatgccatcaggaaaattttcataaaatgtgcagtaaacagcacttcgcaaggctgccgatcatataagccgccttcggcctttttattgtatctgggctccatttcgtgaattaaacctacgcaattcgccgctcttaactacaaatcaaagtaaagccgtccctctctcccagataagaaacttaggtttgtttggattgaggagttattctatccaaaaaaaaaaaaaaaaaaggccccta

SEQ ID NO: 9565 - DNA, 2046 bp, Zea mays
  misc_feature (989)..(989): n is a, c, g, or t
  misc_feature (992)..(992): n is a, c, g, or t
  misc_feature (1061)..(1061): n is a, c, g, or t
gcacgggaccgtcgaagcgcgatcgaacggctgcacaactaaaggatgacgtggcttactgaggagcgagctttccgtccgcgtttgttatatagaaatgctgtctgagctgaactgaattatgtgggctcagaagtattaaacgtgtgattggttgctcacatagtctaaacgttatctatgggcttaagtgtatataatatgaatgtattaaaagaaatactaaaatattaattgtttattatgttagggcataataaaatttaatttactaaaatatataatacaaatcttaatttattttaaaattacttaatattcataattatgcgctaatgacggcctgtcccggcgacacgctcagagaaccaaacgccctggccctaaagcaccggatattttctctctatccaacaaacaggggacaaaggaacaggggacaggcacagccgcacagccgccgcccctccatccacctctccacaccatctgacgctgctcccaccgaggtctccaaggctcactcctcaccagcttctgctctctccctcctcatctctgctctgctctggaccgttaactctccagctccccctcgctccgttcccttccgcccaaatcactgggaccaccaccgccttcttcaagatcggcgggcgggcaccggccggcgatgacatccaccgtcaccacaaccgttgggtgcggggggctccccgtccgcccgttgtcgacagcgaccagaggacgcccacgcagatgcgccgtccgagcccaggccgcgggagcggatgcctccagattgtagtggaggactccaattgatgaactccattttttgccctctcctcactgaaatcgggatgaactgactgatatgacaatgatatctgctgtggacagccgcgggagcggatgcctccaatgataagtcagtggaggtcatgcgcaagttctccgagcagtacgcccgccgctccaacactttnttntgcgccgacaagacagtcactgccgtcgtcatcaaggtcagtaccgtccgatagtgctgaactccgtcnttataagtgatactgcgagccaacatcaaagatatccacttgattgacaccgagctttaggtatattggcatcctagcacaatgtttttgggtatataagtagggggaatggaagcgaaggccgggaataacaatctagaacagaaagtagcggattgggtgacaacataggtgtcatataaggcttagaaattagcaaaatgttaagagggatgacaaacgccgccatcattcacagttacaaccaggctaagccatgaatagcactatgttcttgcactggggaagaacagaagctatttcattttaaggataaagctgaaaggaagaaacagtaatatggatcagaggaaattaattctcctagcaatgcttcttggtaatggtaatcctcccaggagcctacagctccgtatttataacctgagaggtaactgtgcagaggagagtcttgacactactgagatgctagcttcagttgctgtttggcacagccagcttatgtgcatcaggtggttgatatatgactccacttattcatccaaattcccagtaaatatttgtcacaagagagaaatataatttggaaaaaagatagtttattttatagcaaaaaggttgctctaaaacgtgcaaagcacagttgtatttaagcctttaagggcaccaccaggttgaggacggtggtaatgctgaacaattccttttcctctcttggtcccaacccaaaacacacattttgtggggcagtgggtccgtgactcgtaggtggatctatttagaagtttagggttaagtattttagtttcagtgccattctaggaattgagggaacaaatacgttacaattataaatcagcaagcttatatctaagcacatgagtatgtttaatgcaagtgctctaccctggttttctcagagcaaccatcatcttttcttgatgataggtatatataggaattctgtaattcgttcgtgttgatt

SEQ ID NO: 9566 - DNA, 994 bp, Zea mays
ccttggggacccccgggcccgcccccgggggggaggggacaggcacagccgcacagccgccgccgctccatccacctctccacaccatctgacgctgcttccaccgaggtctccaaggctcactcctcaccagcttctgctctctccctcctcatctctgctctgctctggaccgttaactctccagctccccctcgctccgttcccttccgcccaaatcaccgggaccaccaccgccttcttcaagatcggcgggcgggcaccggccggcgatgacatccaccgtcaccacaaccgttgggtgcggggggctccccgtccgcccgttgtcgacagcgaccagaggacgcccacgcagatgcgccgtccgagcccaggccgcgggagcggatgcctccaatgataagtcagtggaggtcatgcgcaagttctccgagcagtacgcccgccgctccaacactttcttctgcgccgacaagacagtcactgccgtcgtcatcaagggacttgctgatcacagggatactcttggagctcctctatgcccttgtaggcattatgatgacaaagctgcggaggtagcacaaggattttggaattgcccatgtgtccccatgcgtgagaggaaggaatgccactgtatgctttttcttactcccgataatgactttgctgggaaggatcaggttatctccttcgaggagatcaaagaggcgacatcgaagttctaagcccttgtatttgtcacggagtgtttacttgacagctaattttttatatgtatatgtacttaagtagcatctataagatatgccatcaggaaaattttcataaaatgtgcagtaaacagcacttcgcaaggctgccgatcatatgagccgccttcggcctttttattgtaaaaaaaaaaaaaaaaaagaactcggccctcgagccccagcaaaaaacatttcgtgaattaaacctacgcaattcgccgctcttaaaaaaaaaa

SEQ ID NO: 9567 - DNA, 942 bp, Zea mays
  misc_feature (766)..(766): n is a, c, g, or t
ctatcccaaacagggggccaaggaacaggggacaggcacagccgcacagccgccgccgctccatccacctctccacaccatctgacgctgcttccaccgaggtctccaaggctcactcctcaccagcttctgctctctccctcctcatctctgctctgctctggaccgttaactctccagctccccctcgctccgttcccttccgcccaaatcaccgggaccaccaccgccttcttcaagatcggcgggcgggcaccggccggcgatgacatccaccgtcaccacaaccgttgggtgcggggggctccccgtccgcccgttgtcgacagcgaccagaggacgcccacgcagatgcgccgtccgagcccaggccgcgggagcggatgcctccaatgataagtcagtggaggtcatgcgcaagttctccgagcagtacgcccgccgctccaacactttcttctgcgccgacaagacagtcactgccgtcgtcatcaagggacttgctgatcacagggatactcttggagctcctctatgcccttgtaggcattatgatgacaaagctgcggaggtagcacaaggattttggaattgcccatgcgtccccatgcgtgagaggaaggaatgccactgtatgctttttcttactcccgataatgactttgctgggaaggatcaggttatctctctccttcgaggagatcaaagaggcgacatcgaagttctaagcccttgtatttgtcacggagtgtttacttgacagctnattttttatatgtatatgtacttaagtagcatctataagatatgccatcaggaaaattttcataaaatgtgcagtaaacagcacttcgcaaggctgccgatcatataagccgttcggcctttttattgtatctgggctccatttcgtgaattaaacctacgcaattcgccgctctt

SEQ ID NO: 9568 - DNA, 621 bp, Zea mays
  misc_feature (7)..(7): n is a, c, g, or t
aatagcnagcccctccgccaccctccacggcgcccgtcctctgtcgttgaaggacagggagcggcggctagggtttcgcggtgctgtggcggccgacgcccgtcctctactatccgtggcgaccatcgtcggctatccgcggagctgtggcgatcggcctgtgctcctatccgcggttgccgaggaaagtactatgttgttgatgctggatatccaaatagggatgagtacttggccccgtacaaaggacaactgtatcatgttccggaatggagaaatgatcctccacctaatggctcactcgaaggtgaagcatgggaagtgagtcacaggtccaacgacctccatgaaggtaaagcacatggcttcaagtgagtcgcaagtccaatcgagtccatgaaggtgaagcatgggaggtccaagtgaatctggaaagaataacggtggaagtaggttggccttataataggggaggagtagtagaaattattttccgcgtagtctgggttttaattatttagataagattgtggtgtgtgaagaatacagaggctagaatgcacctgaggtgacattggttatcggaagtgacttttaacttttcaaaaaaaaaaaaaaaaa

SEQ ID NO: 9569 - DNA, 907 bp, Zea mays
  misc_feature (552)..(552): n is a, c, g, or t
  misc_feature (578)..(578): n is a, c, g, or t
  misc_feature (688)..(688): n is a, c, g, or t
  misc_feature (693)..(693): n is a, c, g, or t
cgagggccggccggggattgggacaaaaacatagcgagcccctccgccaccctccacggcgcccgtcctctgtcgttgaaggacagggagcggcggctagggtttcgcggtgctgtggcggccgacgccgtcctctactatccgtggcgaccatcgtcggctatccgcggagtgtggcgatcggcctgtgctcctatccgcggttgccgaggaaagtactatgttgttgatgctggatatccaaatagggatgagtacttggccccgtacaaaggacaactgtatcatgttccggaatggagaaatgatcctccacctaatggagaatcaggaggatcagatcctcaggaggatctggagctaaagaagcaggagctggagctttgtcaaacgggccctaagctcactcgaaggtgaagcatgggaagtgagtcacaggtccaacgacctccatgaaggtaaagcacatggcttcaagtgagtcgcaagtccaatcgagtccatgaaggtgaagcatgggaggtccaagtgaatctggaaagaataacggtnggaagtaggttggccttataataggnggaggagtagtagaaattattttccgcgtagtctgggttttaattatttagataagattggtggtgtgtgaagaatacagaggctagaatgcacctgaggtgacattggnttatncggaagtgacttttaacttttcataaagctcacatatttgtccaaattaaaatgtaacatagacttttgacaaaaatactaaaacaaacaaaacgtagcatagacttctgatacaaatactaaatcaaatagttgcttgagatgataattatcagtgttaatagttttttgttaacttaagaaaaatgtgacatatgtactttgtatgaaagta

SEQ ID NO: 9570 - DNA, 4067 bp, Zea mays
cctctttagtcgacctgcagcctccgtggccatgtggggcacacgtgatggcaccaccgcgagctcgccctgtcccgaccggggatcccctgcgagccaccctccttcccgaggctctacggcatagccgccgtcctcaaccgcacggtcgcggcctagatccggtggacacgctcctttgtgctcggtcggcgagcctccccttcctcccttggcagaggcacggaccgagccatcactcttcggcgcatcctcgcccccctccccaacgtcagcgccaacgcggtcatggctatctccgtacgaggtccttcctctcggatccacaccactccatccctacactgtctgttgcctcgattcgccaccacagtgcctccctgatccactgtcgtaagcgggctaaccctcggaatgcgtcgatgaccgcgatgaccaggctcctctgactgcaccttcacacttcttctgtcatcagcgtcactcatcccctgctaggcctggtgtaggcccctgcccggctagacccgccccgtcgccctccattcatcgccttagttggatccgttactgccacggccttccatcgtccctttggctggatcgccgtctttccggctagatccgtcgctgtcatggccttcccggccggatccgtcgttaccccttttattccgctgtgggcgtggccaccatgaccagcgcagacgtgtgcgctgctgtcggcctcccagacggggctccttgatgtctggacgatcgaagatgcaagaaggttggcctacttgtgctcttttgttgtgtcgccctgctgaccattgacactcgaacgtcgaccctccaaaagaacaggctactgttgcatgtctcccgaccacgaccacctcgacttcagctacctcggcatctaggggctatcatcttcttagagtccacactggtctctactctatccgcaacatccgcaccctcacgacgctgcgactgcgggggatatcaacccattggctcctaccttcgacttctactccagtctcattgtgtgtggtgcccctgttgcgactgcatagggatggataccgctggccgtatccgccaccgctggccgtatgtctgcggttggttggtgctacgagaaacatctcactgctggcttgcgaattcctgcttcgagcctctctgctatgtctgcgaattcctgcttgtctgcgaattcctgctatgtctgtgaattcctgcttgtctgctctggtcgcgttctcctatgctctactcgtaccagacgctctgctcgctagccgctctgctattttggtatcaacgaatagttgcttattttgcttgagagaaaacataattcccagccgctctgctatccgcattcctttttgatagctgcatatatttgttttagattttaattttttacagcaatatgggtgatagtgccgattggaatgaagataacactgctctagtgtgtgaattgttcgccgaacaagtgaaggcgcacaaccggtctggtacccacttaaataaaacagggtacaaaaatgtgatggacaaattcaaagaaaagactgggttgtcctacaccaaaatgcagttcaagaacaaatgggacaagatgaggattgaatacaccaattggaaaagactatcaaaggaaactggtttgggatgggacacagcgaaaaaaacctggagtgcgacaaatgaaaggtggaagaacttgaataaggtaatagaactttggataattgtctttattgcatcttgtgttacatgttatatgtctaacatcttctttctcctaatgtgtagcaatacaaaggaattgccaagtttaaagatgggcctctgttgcatgaggaagaaaaagccatcatgtatgaagatattaggaacacaggagatgatcagcgtggtcgcggccgaggtactacaccacaaattctggagggtgaaaccactgagaacactgatgacaacgatggagactatgaggccaatgatgacaaggatgaagactttgaagaatgtgaagaggtttcccctacaactgctaaaggaaagcgtcatgtttctgttggtcgaaaggacaagggtaaaaagcccaggtcattgggaggacattgggtgcaagatcaattgagcaaacttgtgacagcaagtgagaagagcacagcatccgttgagtctttggcaagaaaggaggacaatgggtgctccattagagatgtcatggcattggtgaaggagtgtggtgcagttccaggaacaaaagaacacttcatagcatctcaagtttttgtcaagagggcagagagggagatgtttatgactttggacacaccagaagaacgcttcaactggcttacaatgaaacatgattgggtcactaggatgagtcactaggatctgtaattttttgtagcactatgtcccattttcagtgctattatgtatctgtttaatcctttttactccggtttgaacttgttgtgacattattgtggatggattgtatcaattttgttgctgccctattttttgttatctattttgttgctggccttttcactggtttttgtttttaagatattttgttgttgtctcattcctttgatgtatacagatgtcttcttcttctgatagtgaaagggactcaagtgattcagaagatgacttgagagttcttcaagttattattgggaaccaaaaaaatattgtggctgctgcatctcttttatcatggtactatgcatcatatgttgataagaatgagccaagggcaacaacattttctggtattgcttgggtcatggaagcattgaacaatccaaaagaatgctacaacatgtttaggatggaaccagctctattatacaatttgcatgatgagttggtaagagactttggtctatcctcttccatccatatgagctctatggaatctttaggattgtttcttgttatttgtggtcatgcttggtcattcactgccgtccaaaaggatttcaagcactctaatgaaatcaattagcagaaaattcagtgatgtcctgaattgcatggtagcaatgtcaaaaaggtacatacaaccaaaggatcctaatttccatacagtgcatagaagaattaccaatgatcaaagaatgtggcctcactttaagggttgtattggagcaattgacggcactcatataaatgcaacacctccaaagaaagatttgatcaggttcatgggaaggtctggtaaacctactcaaaatgtgatgggagttgttgattttgatatgcgctttatatatgcatctattggacaacccggctccatgcatgatactactgtgttgtaccatgcgcttgaagctgatgaagatttatttccacacccccctctgggtaaacaaatgtcaaaatttggtctactttttgtccacatatttttcaaggttctaactcaagtataattgtatgttacaggaaagtactatgttgttgatgctggatatccaaatagggcgtggtcgcggccgaggtacaaaggacaacgatatcatgttccggaatggagaaatggtcctccacctaatggtgagcaagagctcttcaatcatttacactcaattctacgaaatgttgttgaacacacatttggtgtatggaagatgaaatggagaattcttctaaagatgccaacttatcctatggacaaacaaaaaatgattgttgctgctacaatgtgtcttcacaatttcatccgtgagaatagtgcattggatgaggattttcagagatgtgatcgagacccagattatatccctactattccatcccgttataggcgacatgtccctcagaatgcatcagatacatccaccacagggtcgagtagtaggaacatgaataggttccgtgatgatgtatcgaaggtactttgggagtcgaggtgattagaagaggtggttcgtgtcatattttggatatcgtgtcgtgctagtttcatgcaatttatggattaaacatttgagaccattttatgcactactatgatggaaata

SEQ ID NO: 9571 - DNA, 2495 bp, Zea mays
cagagtaattacaacaccgtgctctcaacagggcgcacaccaaatagtacacccatgagttacaatgacaggtgggcctctagaaatgtctcctagtgcaccaacgacgtgttgatcacttcgtagccttcgacgccaccactggagccttcagtgctcttcgctgtccttagataggtgtatggtgccgagggttctggggcgacgcctactgaaggccttaatcggtgccgatcgtttaggggcctccgcttgacgttatcccttgttacggtcggtcgtcgttcgaaagccccttcactcgaggtcttgtgtactggttaatttaaacgaaaatgggagccttcactccgtgatcaaggtcattttcggtctccgttcaatattagatatggagatagttaagctgctggagataggcatggacggtctttattacagactctacggcatgactaagttcttgtagggccgaggattagatatagggactggtccgacacggcatgacagggctatgacgtagtgcccaatagaatactacgagtctggtcagccgtttgcccgtatatacttggcagttggcaccaaccatacgtgtgggcatatttcaccaaggctccgacgaccaccggtgaaagtgaaacgtcggtgtccggcgacgaccgagttcccatcgccggaaatcatggagaagcttccgtcacagcagcaggttgtgctgttggcgagtcctggcgcgggccacctcatcccgatggtggagctcgcgcagcggctcgccgctgaccacggcttcgcggtcacgttggtcaccatccccggcatgtccaacccggcaacggaggccgtcgtgctgtcctcgctgccgtcctacgtcctgaccgcggtgcttcctgctgttcctcttgacgacctcccgtcggacatcggcttcggtgccctcgtgttcgagttcgtccgccgatcgctcccaaacctccgcgcgctcatggaggacgccagccgcggctcggtgaccgcgctcgtatgtgacttcttcggaacctcggcgctgccgctcgccgcggagctcggcgttcaggggtacgtcttcttgccgaacagcttcgccatgatctccatcatgcgccacctcgcggggctccatggcgacgccgctgcccccggcgaataccgtgacctcccggacctgctcccggctcccagctggaggcctggttcttcaccacgccgacctccccgaagggttccaggaccggaaagacccggtgtacgcctatcacgttgaggaggcccggagatacggccgcgccaacggcttcttggtgaacagcttcgaggagctggaggtcgtcatggtggaaacgttcaagcgggacgccgaggacggcgcgttccctccggtgtaccctgtgggaccctttgtcaggtcaagctccagcgaagaagccgatgaatcgggctgccttgagtggctggatcgccaaccggagaactcggtggtatacctctccttcggcaccgggggctcgctatccgtggagcagacggccgagctcgccgccgggctggagatgagcggccacaggtttctttgggtcgtgcgcatgccgagcctcgacggcaacccctgtgcctatgggtcgatgcccggcgacaaggacgacccactggcgtggctccccgagggattcttggagaggacgagcggccggggcctcgccgtcgtggcgtgggcgccgcaggtgcgcgtgctgtctcactcggcgacggcgtgcttcgtgtcgcactgcgggtggaactcgacgctggagagcgtggcagccggcgtgccgatggtcgcatggccactgtacgcggagcaaaagatgaacgcagccatcctgaccgaggtgaccggcgtggcgctgcggccggcggcgcgcggcaacggccacggcttggtcacgcgcgaagagatcgcggcttcagtgaaggagctaatggagggggagaaaggaagcgcggtgcgcggccggacgagagagctgcgtgaggcttcgaagcgtgcgtggtcgtcggaagggtcttcccggcgggcgctcggggaagtcgccggcaagctgaaggctgcacttgtcaacgggaacggatcggctccatgattcgttttcttcccgtgaatcggatgagataaaaaaaactattttttactgcaattcattgggtgtggtaattatggcatatgtatttatggactagctgtatctattcaaagttttttttgcttgcgtacatgtttcatttctatgataaataaattgttgaaaacaaagcttattggatgccataataatttagctctctcgggggaggggtcggtggcggatcccccaatatggcgaggcctagcggccgccagacctgttgctcatactctattaaaaataaacattggattcaaaaaaaaaaaaaaaaaaaaaaaaaaaaaaaaaaaaaaactcgaggggggg

SEQ ID NO: 9572 - DNA, 1787 bp, Zea mays
cgccgccctggccgggctcctccctcactactcacacccctcacttttggcggcgccgactgggcacccgcgtcgaccttcgccaggtcttcgtcggccctttggctggaaacaagcatccaccaggaacaacgcaagggatgctcgattggctctagttacttagcagaaccaaaagaggaaggccatcaaagatacgagggctttttctcgccatgtctcggtcgccacacctcccaccccgctgcccacccctgggtcctcagatcactcgaagggatgacagcatgttcacgcagagctgcaggtttccatctggggatacgttctttagtgagccaccgtgctggctcgatgatctccttgcagattccgggaaagctcccaagcttcctcctctcagaagggcctgtagcgattctgatgccatcttggatgctctgtcaacatttgaaagcccaatttgtcgaattgaggaaggcaatcaaatctctggtggtgaagctgatgacttgttggatgctggcgaaggtggtgaaagcggttctgtggtcgaggctagctgtgtttatggtccgaattcaccaagacagaagagtaggctgacaacttcagagagttccatggtaaatgctgtgcttgagaatgtacccagcaaccccttgcagtacttgagcatcgatgcctccagtggtatgaatggtaatgtggccaatggaactgctgatacctgtgatgcttttggccaccctgatcaagacaagtcatttaaaaggtacacttacatttgtgagtgaaatatctaaaatacttccttcgaatattctgtggtaaagtagcgatccatgccaatccataacattgctgcttttactaaactggatttttttagtgaaaatgctagaaacatataaattatcaagtgcagatgtgaactttggctctcgccaacagaaatggaacacgacactccactgctttgcagaaattaaattaactgatggcgcttctaattgagtaacactaacggcaacagctactatgcaatcaagccttaggtgcaaacgtgaagcgagtcttttggtccattaaatcattatccaaccatagatataattgtagtttgttagtttttttaataaatctacgtgaattggtggtggaaaggtttaagtgttaaatataatatatggttggatcatgatctaatggatcagaaggcttgtttgtacgcttgcacctaaatcctgattgtatagtagtcattgcttacgtataagttatgtgtggatacatcatacataatagaagctataaatctagaaatgccaaaacgtcttataatttgggatggagggagtattatataatcttaaatttatatatgatcccattacttgtaccatttctttgctataggtgagtagtttcttagcagcactcccatcagtattgcagtattgctcttataatttttgacgcatctatgagttattgtcttgtgatgtatttgtcagttatcatctagatcgatcacaactgatgagttttcatatagccttgaatcattcgcagtgtttaatgtggattacttaatggtgttttgaatgtatgcaggcaataatcaagaggttcattgtgaaccactagaagttattcgtgaagtaagcaaagatacttatcttgggaatgcttattttctttgatttattaaagtagattttgtgtgtgtgtatgtggtcttttttaatatgtgttgttatgtcacttcaaataaaatgctgcag

SEQ ID NO: 9573 - DNA, 2597 bp, Zea mays
ctttcacttcgtggcgccgactgcgcaaacggcaccaaccttcgccaggttttcgtgggctctttcaccgatacaaccatcctccagaacgcaagggatgctcgattggctctagttacttagcagaaccaaaagtggaaggccatcaaagatacgaggctattttctctccatgtctcggtcaccccacctcccaccccgctgcccaccgctgggtcctcagatcactcgaagggatgacggcatgttcacgcaaagctgcaggtttccatctggggatacgttcattggtgaaccaccgtgctggctggatgatctccttgaagattctgggaaagctcccaagctccctcctctcagaagggcctgcagcgattctgatgccatcttagatgcgctgtcgacattccagagcccaatttatccaatcgaggaatgtgatctaaactcaggtggtgaagctgaggacttgttgggtggagtcgaaggtgatgaaagtggttctgtggtcgaggctagctgtttctatggtccgaattcgccaagacagaagagtaggcttacaacttcagagagttccatggtaaatgctgtgcttgagaatgtccccggcaaccccttgcagtacctgaccatcgatgcctgcagtgatgtgaatggtaatgtggccaatgtaactgctgatgcctgtgatgcttttggccatcctgatcaagacaagtcatttaaaaggcgctcagggcaaagatctagggtccgaaaacttcaatacatcgctgaacttgaaagaactgtcgaatcgcttcagaacattggagctgatttggccgtcagaatgtcatcacttttccatcttcacaatgctctatcaatggaaaacaagcaactgaggatacatatttccagtcttcagcaagcaaaactgattaaggatggtatgtctgagggcaaaactcttgtgcaatcaagcttctcgtgcaaccaccgtgcattaaaactaccaaaagtcgtgaaaaattctcaaataatttacagatgtgctttattattatttactcaatccagagagcttacaaacttttgatggtttgattgcatgacgtttgcacatgaagcttgattgcgcaacagtttttgtcttcttttaatttgttttgtgatttttaccctatgttaccctgatatggatacgtgatacgccgataccctgatacactatttctcaaaaaacaccgatacggggatacacaaatatatattataaaaaaataaatgctgggatattggaccacacaagttctcaaccagtacatagttaataaagtttaggccatcaagccattaaacctaggaactttagtctttaggttctaacagactataatattccatcaagccagagaacttttacctccacacaatagtagggacagttaccatcatttatgcttcagtggtttgtccaataataaaaagccatctgcttcttattcagctaatcacagccaagtgatgtatccatgactcctttaacataattaaaatcccccaaaacattgcaaatttagtctggagggttgttgtttgttaaaccgctttccggttttaagttctgacccaatgacttgctgttaattatattttttcctctcaattttaacattacagcttgaactgcagtgtgccaggaatccctgttgaattgtttttatagggataatctgaaatataacctagcatatgcaaattgtttctgtagttccttctggaattcattctcaggcaaaaaaatattttggcattattgcatctaccaatactaggtatgaactatttggcactccttcctaatgttgccaatgagtatgaaatgctgtgattatctagctaaagtatgatggttccagaacatggttcaatcctgtctcaatgaaatgcttttgaaatataatccctccgcaggtcagacgcaggccctaaagaatgaagctgaaaggttgaagcagatgtctgcccgtcaccgccggagcagaagcgtcacttcctgttatgacctgagctcattcggagcagatgctacggcagtcaattggcagatgcctgacatggcaaggctcagcctgaatggaagctcctctgtctccccaagaagcggctatggtatatgacagcagccggccctaacctccctcagaagataagtcgaggcattaccctagataacttttcgctaaccttacccaggcatatatttgagggcccatctttgactaggatatcagttggattcgctgaattttgcagaggctatcagcttaggcccggtttggttggggttttaggctgtttttgctttccaaaagccaaaagatcaaccaaaagacttttttcagaagcagttgcttttcgtaattttttttaaaacaccttagaccttgtttttggcttttggttttctgcttttctaaatgggttgaataaataacacagttgtttcgagagagatactataagaggtacattttacatttgttttaacggttcaggtttttcatagttgacgccttaccgcagagtacacaacatcttatcgctca

SEQ ID NO: 9574 - DNA, 2657 bp, Zea mays
atcacgatagcatatgatcattactccattagtccacttggttcatattaattctttagagcctaatcgcataggagacattgaattgattcctaaaaacaaattctacaaaattcccaaggcaatccaccaaatcaaagcagggcagcaacattggtcaattaattagaataatctgcgagatggctgtgcaaaattaccaggctggacttgaatttctcgacgagctcgccggtactgcgcaatccctcaaaaatctccttggtctggctccggcgctcgaactctttgatgccgtcccgtatcatcctgagcacctcccactctttcccctcttccgcctccccgttccacaccacgcgcctccagcgctccccgccatccacttcagagacgatggcgttgcggatggcggtgatcccagagaggtcgacacgtgcgcgcgcgggtttccccgccccgcgcggcgcccacccctcgagcaccctgcggccgagctcccgctcctgcgacacgtaccggcgccgcagttcggagatcttgggctggatccgtgtgcgcacgaactcgagctcggctatgggcgcccccgcggcgagcggcggcggcggcgcggaggtcagcgcagtggaggcggacgcgaggaggtgctcgagctcgcggtccgcgagcgtgcggagggaatcagccctcgcgcgcatgaggcgcaggtcggcggtggcggaatcccgcacctcgcgccacccctttgagagaaacgagaaggcgctgccgtcaccccgcccagctccgaagccgccgccgccaccgatggagaccgacggacgcggcgacgccctcgcctccatggccaattccggaatggccgcggctagggttttggcgttttgccgtttgggagtcgcgagaaccgagagaagcagctagagtgctagacaacacgcgaggtgttgggaaagagaggggagaggacgacgacgccacggagctccgacgccacgcgttgattcgggccggaccgccggaggaaggaagccgcgttccgacttggaggtatcccatccgtccctccgtggctggctcttgctgtggggtcggcatggcagtgagagtgattggagaattggatccgcagggcagatgtggaatccagctttgtggtggggtggaacggtgctacggtgacgtgggcatacgtgcggtcgggaagtgagcggggaccgtccgggggttggcaacgcaaggccgttgcccatgagccaggagcccaggactgcaacgcaaggcccatttcgttccgccgccagcttcaaggccgcaaggcccatttgcgttgatcaaccgcgtcctcgacgattgcgttcacccgaatcacgcctccctttcctttctcctccctcactactcacacccctcacttttggcggcgccgactgggcacccgcgtcgaccttcgccaggtcttcgtcggccctttggctggaaacaagcatccaccaggtatgccagcaactcctcttcctgctgtgcgaaatcgagcacaccaaacccttcccaacccccgcggcggccgccgcgtcggtcggatctgacccaaagctgctgtttttccatatgaaaggaacagcgcaagggatgctcgattggctctagttacttagcagaaccaaaagaggaaggccatcaaagatacgagggctttttctcgccatgtctcggtcgccacacctcccaccccgctgcccacccctgggtcctcagatcactcgaagggatgacagcatgttcacgcagagctgcaggtttccatctggggatacgttctttagtgagccaccgtgctggctcgatgatctccttgcagattccgggaaagctcccaagcttcctcctctcagaagggcctgtagcgattctgatgccatcttggatgctctgtcaacatttgaaagcccaatttgtcgaattgaggaaggcaatcaaatctctggtggtgaagctgatgacttgttggatgctggcgaaggtggtgaaagcggttctgtggtcgaggctagctgtgtttatggtccgaattcaccaagacagaagagtaggctgacaacttcagagagttccatggtaaatgctgtgcttgagaatgtacccagcaaccccttgcagtacttgagcatcgatgcctccagcggtatgaatggtaatgtggccaatggaactgctgatacctgtgatgcttttggccaccctgatcaagacaagtcatttaaaaggtacacttacatttgtgagtgaaatatctaaaatacttccttcgaatattctctggtaaagtagcggtacattgctgcttttactaaactggagttttttagtgaaaatgctagaaagatataaattatcaagtgcagatgtgaactttggctctcgccaacagaaatggaacacgacactctactgctttgcagaaattaaattaactgatggcgcttctaattgagtaacactaacgacaacagctactatgcaatcaggtcttaggtgcaagtgtgtaatgaacctcttggtccgttagatcattatcccaccgtagatataactatggtttgttagaggtcttttataaatctacgcgagctgatggtggatgggtttaagtg

SEQ ID NO: 9575 - DNA, 1219 bp, Zea mays
  misc_feature (11)..(11): n is a, c, g, or t
tacgccaagcncgcaattaaccctcactaaagggaacaaaagctggagctccaccgcggtggcggccgctctagaactagtggatcccccgggctgcaggaattcgcacgagaccattacctagaacatcctaatcgaaaagaaactcactcgccatcgccgggcatcgcgggcatcgcacacaaacgcaacctgcagccatggcacagaagctcgcgccaccgacggcggcggtcgtcgtcgtcctgctggcgctcgccttgtcggccgccgcgcagaactgcgggtgcgcgtcgggcctgtgctgcagccggttcgggtactgcgggacgggcgaggactactgcggcgccgggtgccagtcgggcccctgcgacgtgccggagaccaacaacgcgtccgtggccagcatcgtgacgccggccttcttcgacgcgctcctcgcgcaggccgccgcctcgtgcgaggccaacggcttctacacccgcgacgccttcctcgccgccgccggctactacccggcgttcggccgcaccggcaccgtcgacgactccaagcgcgagatcgccgccttcttcggcaacgccaaccacgagaccataaagttctgctacatcaacgagatcgacgggccgagcaagaactactgcgaccggaacaacacgcagtggccgtgccaggcggggaaggggtactacggccgcggcccgctgcagatctcctggaacttcaactacgggcccgcggggcagagcatcggcttcgacgggctgggcgaccccgacgcggtggcgcgcagcgccgtgctcgcgttccgctccgcgctctggtactggatgaacaacgtgcacggggccatcgtctccggccagggcttcggcgccaccatccgggccatcaacggcgcgctcgagtgcgacggcaagaaccccaactccgtcaacaaccgcgtcgcctactacaagcagttctgccaggatttcggcgtcgacccgggcaacaacctcacctgctgaatgatctctctctcattgggttgttgtcctgtacttacacatgtgttggttgatggatagatggcgattgcgtggtgcggatgtttcggtttggcggtgtcaattctgatatgcgcgtcggtgctgttctgatactgactatatacggaaataaaaatctgatttgcattaacaaaaaaaaaaaaaagcggccgctttcggtt

SEQ ID NO: 9576 - DNA, 3387 bp, Zea mays
  misc_feature (280)..(280): n is a, c, g, or t
acgtcgagtgtttcgcgtaaacgaagtctgtgtcgattgttttatttcgtcgagagtggtgctcgataaagcatcgataaaatgcactcgacaaatagcctagtgtcgcggctctaccggtgcttgtgcgtgtcaatgtcaaatactcggatccggccatgacgataagaaatgtaatggatacagctgggcgctgactaatagttggggcctcggtttgactttgactcgctgacgcaactccggttcttgttgtcagcgctgcacgaatagtcttcanagtagtgatctctttccagaacaaacgccgactgattccgtccttacggttgcagaggaacagcttgaacaattatcgcgacgccacacctgacctactccacgtacggtaaccaaaacgcagaactgctgtttggctcgcccgtcggccgccaggcagacttcactttgagtaataacaacaacgctgtcatccgccggccgccaaagaacaaacgtgcagctgagcacggaaactgcttcacgttttcgtcgtctctgacgatctgcgcggccgttacgccatggtagcctagccggatagaaagtgaggcgacggcgacgtgcttcagaggtcgacgcggttcacacacaccgacgtgcagatgccgacctgggtttgacttgactcggccctcgcttcatttggttggacgatcgcatgcttcctctccaaaagttaagcccaatcctctactactctataaaagccaattaagccccagcccaccgtgaaactcactcgccatcgccgggcatcgcgggcatcgcacacaaacgcaacctgcagccatggcacagaagctcgcgccaccgacggcggcggtcgtcgtcgtcctgctggcgctcgccttgtcggccgccgcgcagaactgcgggtgcgcgtcgggcctgtgctgcagccggttcgggtactgcgggacgggcgaggactactgcggcgccgggtgccagtcgggcccctgcgacgtgccggagaccaacaacgcgtccgtggccagcatcgtgacgccggccttcttcgacgcgctcctcgcgcaggccgccgcctcgtgcgaggccaacggcttctacacccgcgacgccttcctcgccgccgccggctactacccggcgttcggccgcaccggcaccgtcgacgactccaagcgcgagatcgccgccttcttcggcaacgccaaccacgagaccataagtacgtgcgaacaaaccgaagctcgtccaagctctagctgctactaatcaagtttcgactgctcgcagagttctgctacatcaacgagatcgacgggccgagcaagaactactgcgaccggaacaacacgcagtggccgtgccaggcggggaaggggtactacggccgcggcccgctgcagatctcctggaacttcaactacgggcccgcggggcagagcatcggcttcgacgggctgggcgaccccgacgcggtggcgcgcagcgccgtgctcgcgttccgctccgcgctctggtactggatgaacaacgtgcacggggccatcgtctccggccagggcttcggcgccaccatccgggccatcaacggcgcgctcgagtgcgacggcaagaaccccaactccgtcaacaaccgcgtcgcctactacaagcagttctgccaggatttcggcgtcgacccgggcaacaacctcacctgctgaatgatctctctctcattgggttgttgtcctgtacttacacatgtgttggttgatggatagatggcgattgcgtggtgcggatgtttcggtttggcggtgtcaattctgatatgcgcgtcggtgctgttctgatactgactatatacggaaataaaaatctgatttgcattaaaaaaaaaaaaaaaaaaaaacaaaaaggcctcgggctatccctgaggttaagttgtttgtcgttagcatacgttctcgttatgacggattcaaacaaggtggttcatgtcgtaagtatcacacagtcaaatcatgatttcactaaagttgctcttagtgaatctctcatgagaaaagagcacaagacccctcacaatcaatgattaaagtcaacaacaatctctaatagttgttcaatgatcccacgaaccttgggtcatctaggtgataacaatcactaagagtaataagtgtagaaccaacccaatccatttaactatagcaacaactgtatgtgatgcactaggagctctccaacctcacacccaaatgatgttctataagatgcaagagagtggagtatatgtccctagtcccaagaggtgttctcaagtgcaagaagtgaagggatgctagacaagactagacaagaggtctatttatagccctaacttaaaatccaattgttacctcttggtggatagaaatcaagggcactaggcatatctggtgcaacattggatctgaatcctacacatgtgcaccagacatgttcggtgcttttccattggttataatacctacggctataaagtagttgttaccctttttaggtgtcgggtgcatgtcgggttgaagtgtacatttaacatagtctctaagtacccagtccaatatggtatttggtgccacactcgacatgtctgatgcactgtagagctaaagtgtgtgttccatatgctctttgaatgccctgtcaagtaggtcatctggtgcctcacaggacacatccagatccggcttaccatattcgatgcacattgagcaccattgtgcttgactaaaaaactatacatcaaatacaagccaacattgtatgtggtgatcatgtctggtgtaccatacatgtatggtgccttatgagaaactgcatctaaagttttttctcatgtcttgtcaagtttgttaactctcaaatattttgcgaaatatattagatcatagttacatttgtaagtgcaataaagccctaattgtgggttttggtgatagtgacatcacaattagagaactatcactatttatcgagcattatgaatagggcaaccataaacagaagattacataagacagtggtggacaccccaagcttatacggactcatttttacatttataatattaattagtataggatcattgactaataaggggaacatgagattgtcagtacgttaaggtctatcaatgctcaaactccaccaaccactcctatttaggtccgagaacattgtgccaaagttttaactcatttgagtttctctaacatgtgtgaactttaatatgatctttagacaggggaactttgaatattccattcttggtcattccaatagtcacctactgcgatttctgacggtatgatatggaacatgggtcatatccctctccttgtcccctag

SEQ ID NO: 9577 - DNA, 2877 bp, Zea mays
acgtacgttttagtcctttactttactttgttctcgttttcttccttgagttggcttggcttctgtttgtttcttccttgaccagctagcagtggaacgcgaggaaatcaacggtcgtggctggaaactgccatgcctatccggaacagtccgatcgacaaacagacgaagccttgatcttgtcttcagtcttcacaaaaggttggaaaacacgggccgggcccatctgatgatctgaaacaccactcactgttttcgtccaggttcggtcccgatcgcccggcgatagatatataggatagacgatattctgcacatgccgtataaatacgtagccgacgtacggctacacacaaccacgtagccgccggcatgcgcggtcgtcgtgttgcttgcgcgcgccccaatcggcggcggccagcgcgcccgcgcgtgcctcatcgcactcgcaagggaaagcggccagcaaccaagccaaaacaaagaaagaaagaaagaaagaaagaaagaaagaaagaaagaaagaaagaaagaaagaaagaaacaaagctttctggcccatcccatccaaagtgggtttctgctcgtgcgcgaccttgacctgatcgccatcatgcagcaccgcaaccccgtgctcggctcttggttgagtttgacccgttcagaatgccgcagcagcagcagcactacgaacgcgaccggacttggtctgatactctctgtccagcactagctactagtctactacgaagctaccaacactcttcctcgctcgctccctagcctacaactacaaatacccgctctcgtgcacccacctctcgccaccacaacgcaccacacaaagcgcagagcccgcccgagagacaagcagccaaatcaagcctttatttacgatccggccggccgggatctagaccacctctctctcctcgtacgtagtcgttgagtctttgaggtcaatcgagcgaggtaaaatggcgcccgtctacgctgccgcggaccacggcaccaacggcggctccggcctgaccctgaacccggtggcgcgccgggcgctcagcctcgtcggcgcgcccaccacgccgtcgtcgtccacgccgccggcgtacgggagcatcgtcaccgtgctcagcatcgacggcggtggcgtgcgcgggatcatcccgggcaccatcctcgccttcctcgaggagaagctgcaggagtacgacgagcgaccggacgcgcggctcgccgactacttcgacgtcatcgccgggacgagcaccggcgggctggtcaccgccatgctcacggcgcccaacaaggacggccgcccgctcttcgccgccaaggacatcaacggcttctacctcgaccactgccccaggatcttcccgcccggcggcggcgccggcggtcctctgggcctgctcaagaagctgtcggggcccaagtacgacggcaagtacctccacgccctcgtccccggcctccgcggcgagaccagggtcagccaggcgctgcagaacatcgtcatccccaccttcgacatcaagctcttgcagcccaccgtcttctccaaatacgatgtaaaaacattattattgctgccttgcatggtttgctcgccgattatatatatgctaaacgacgacgacgactatgtgcatgcacaggccatcaccgatgtttccaaggacgccctgctgtcggacgtgtgcatcagcacgtccgccgcgccgacctacctcccaggccaccagttccagaccacggacaaggacggcaaggcccgtgccttcaacctcatcgacggaggcgtcgcagcgaacaacccggtgagtcaacatgcatgtatacgtaccaacatgcataacataagggattaagggtcatgagatctactttgaattaagtagcttcagtctggatttaggatcccaataataatgctgagaaaatagaatcgagcgctattttttatgcatcgtctgcagtacttggagccagatatatatagatacctgtgtacgtagtgtattgtcaacgtacggcttgtattagataaagaagaaatgggttttactaacagttcagttaatttattagagtcctagtaggcttatatatctgctgagttgacttctctatgaatcacgaaatatgcgccgaataaactcgagaaactcttgcgtgcagacgctgctggcgatgacggacgtgagcaagcagatcctgctgggcaacccggacttcttcccgatcaagccggcggactacggcaggttcatggtgctgtcgctgggcacaggctccgccaaggccgaggagaagttcgacgccgtgcagtccggcaagtggggcctcctggggtggctcagcagcaaggacaccacgccgatcatcgacagcttcagccaggccagcgccgacctcgtcgacatccacgcctccgtgctcttccaggcgctgcactcggagaggcagtacctccggatccaggacgacgagctcacgggacagacgtcgtccgtcgacgtgtccaccgcggagaacctcaaccgcctcgtcgacgtcggcagggggctgctgaagaagccggcgtgcaaggtgaacatcgagacgggcaagaacgagcccgacggcaagagaggcaccaacgaggatgaactcgtccgcttcgccaagatgctcgtacgggagcgccgggcaaggatccagaataaagaagccagcaacacactctagacagagctagctagcagagacaccaacacaaagtgtctactacatcatagcctaattaagcctcatgtgttctacaatccagtcatgcatgttatgtgtatccacttcaatagttcttttcaagtgtcaaaaaaaaaaaaaaaa

SEQ ID NO: 9578 - DNA, 1585 bp, Zea mays
tttcgagccccgtctccgcttccgtccacctcacgtcggcgtcttccatcgaagtggccttttcggcggcgagtgagagggcgaggaataaaactcgcgtcgcgcacgcaccgcaacaataatatccttccacgcgaatattcgccgcttcccacctcccccgccccgcatatccttccgtccgtccgttcgtctcccccctttcccttcccctctatttcaccaccccatcagccgcccgccaccgcgacgatcaccggcgcaatccgttcaccccaccactcatccactccccctccgcgaatctcatttctttactgcggctaggaggaggcggcggcggcgatgaagttcggcaagagcctgagcggacagatcgtggagacgctcccggagtggcgcgacaagttcctgtcctacaaggatctcaagaagcgcctcaagctcatcggcgccgggaacggggctgagcggcagccgaagcgggcccgccgcgacgactccggggaggctgacgcggccgcggccgcggcggcaatgacgccagaggaggcggagttcatgcagctcctggaggctgagctcgacaaattcaactcttttttcgtcgagaaggaggaggagtacatcatccgtcagaaggagctgcaggaccgggtggccagggcggccgggcgggaatccaaggaggagctcatgcgggtgcgcaaggagatcgtcgacttccacggcgagatggtgctgctcgagaactacagcgccctcaactacacaggattggttaagattctcaagaaatatgacaagagaactggagccctgatccggctgcctttcattcagaaagttcttcagcagcctttcttcaccactgatctcctgtataagcttgtgaagcagtgtgaagccatgctggagcagctccttccggttagtgaggcatctgtctcaagtgaagatggaaaaggagactctaatgatgaagagaagctggcgaagccaagttcttccttggtaaatggtggtggcatgccagagttagatgagatcgagtacatggagagtatgtacatgaagagcaccgtcgcggcccttaggtcactgaaggagatccggggcaagagctctactgtcagtatgttctcgttgccacctcttcagggcaacaatgcacaggacagctaccagatccgggcagagcaactagatgaggagccggagaggtggagcaaagtaacagtgatagagcaggcggccaaatgacagaccgaatgggcaaaacatctgatggctgaacttaaaaattttagacttggacatttgctggagatgggactgggatcccaatctcccattcagaaatttgtatgaattcaggattcctaacagctgcgaaatggtggacatgttaaatcatagaattcccagcacaaccatcggacagaattgggctgattttattcactattgtgaattgatcatgtgtttttactgatatacaaccttatgattcgatgttgcttctgattgtgataatgaaaggaaaaaacaggttttggcttgctaaaaaaaaaagaaaaaaaaa

SEQ ID NO: 9579 - DNA, 5155 bp, Zea mays
ccaatactgtaccaagctatgatgataaacacgcaaaggtctaacagtcacatttccgaaaccgagtgattagtctccgaggtcgagtgtcgtaaaaataaaaggaccacgaaatttcccccagatccgacactagagatcccactcaagtacgcagaaccaccaaaccgatctaataatcttcgttgcaaaatagagataaccaagcactggaccaggacattcccaggtccaaaatcagcagatccagtcgcattgccggttacatcgcgaaaaaaaaacaatccagaacttggcaaacatcccaacaaaggtgccctaacatattacaagtgatgctgtgccgcagcacagatccaaaactcgactacgagggcagtttagaagtgcttacgaggtatgagacgatccgagctgcgggacaactggcggcgagcgagcgggatcgggtatgcgggcggaggaggccgggggcgagtgcggcgtcggcagcgcggggttaaatagccgtaggcggcggtggcagctgcgactgcgagcatccgacggcccgcgccctcccgttccgagcctttcctcgcgacgcacggcccagatctctccgccctacgtgattttcaaatttcccacgctgcgggggcgaagtacccgaactgccctctgtaaatatagccgttccgtcggggggcgcacagggaaaccaggtcgcgtgacccgtctaggctgttcccgagctgccccgggtaactccccgttctcttccccgctggcccgtgtctgtccgcgtagctggccggcacagcctagctccactgacaggtgggtttctctagatttgggtcccacaggccgtttgccgcggtgcgagaaggtgagacagggcagcgacgggcccccatgtccatgtgcggggcggggcgcgctgtcgtggcctcgtggggataggagcggaagtgtgtaatttggatctgacaggtgggtttcactattctggtcccgtggcctcatcatggttgtgagtatacgcgccatgacatgattgtactcggtgaaatgtccttccaacttgtttcacttcccagcaaaatgaaaaaggagaaaggaggagcatttgttcggtggtgtctccaattttttgtgttttgtagctggttctttccatgttggcgtgagcatttgaggaaatgacgaagtcgtcttttgctcaggcccagttgccgcttctaggaaacaaagtccaataggactcggaagctaggcctgtttgggctagtacacttgcaattgcaagttgcaaccctgaatctgatcgagcatgggcactgaacaatcagattgttctttctaaagaacgaacgaataaaataaaggaaaggtaaaggcattcggaatcagaattaccgttggatgggatgaccgaggccacagctgcttcccgcgtgctgccgtcgtgccacggtcccgcacgtcattcagagcatcgatgggaaggcacgttcacctcttcgcgcgcatccggataacgggcccacccgcacccgacccatacccactccactggctcctcacagtcccactccactggtgcggcgcggagcgaggaccacgtcaccttgtccagcccccgcccccgcccccgcccctgtgtaggagtaggtgtagccgcgtaagcggcgtaggcctcagctcggctcagcagccgcctcgctcgaaccagaggagccaagcagaggaagcgaggcggcgggggcggagatgtcggcggggctggtgaccgacgaggccaccgtggggcggctgtaccggatccggcgcacggtgatgcagatgctgcgtgaccgtggctacctggtggtggaccacgagctcgccaccagccgccgcgacttcctccgcaagttcggcgagtccttccaccgcgaggacctcctcatcaacaagtacaagaagaacgacccatccgaccagatatccaggtcttcagctcccgatccaatccgaatccactccacttcgccgcgggtcaacggcctcccctgctctgcttcctgccgctcctgatcggatcggacagcacggacgtctgtctgtggatagccgctcgatccagctcccttcgcctttgccgggccttttctcatgcatcggtgcttctctcccgctgattgctggctcttgcttgatcgaacggttcggtgtccgaatcgccatggggtgtcgaagctagctgctccccgtgaaaaacacaagcttcaaatcactgagaacgggacgagcctatcgtcagctaacaaattactagatcattccaaaccagcaagttcagagtcttcagactaaatacaactgtactggactgttgaactgtgaacctaccgcagtgtcactatgcttaatgcttgggcatatatagttcgacgtaggtttatgcttacttgtaagaacgaacaatcttgaaactcgagagacatccaacgactgaactacttacagcctgctaatttgaccgagaccagatagcagcaacactaattcctcagcaaatagtccagtactccttaacagcaaagttcaagtatttgaagctgcgcttggtagccctcgcctaatagtttcattgagttttttttatccttggatcagatatatgtcttcttccccaacgatgacaaggtagggatgaagcacatcaagaagtacgtcgaaatgatgacgcacgagaacgtctccagagctgtgctggttctccagcagaacctaactccgtttgcgaagtcgtttctcatagagctggagccgaagatccatctggaaattttccaggtcagttttttgcacaccaagaagaagctactactccaatttgaccggcagcaccgttgcttggtccgcgcgcgcatatgctgttgtgcaatgatctcttgtgttttgttatttctgataactgaagcaatcgacaggaggccgagatgcttataaacatcaaggaacatgtccttgttcctgagcatcaggtgctcacaaacgaggagaagaagacgcttctggagcggtacaccttgaaggaaactcaggtattggcgctcattcacacttacagatctttattactactactctcagccagtggggggcatcagaccaaacataaaagtttcaactttctatagcctgggccattttacgtagtgaactagtgactttcgactttcaaccgtcttcgctcatttttagttccaacataaagtctcgtccgtggcccaatattttatggtagaaaatagcctacttagacaaacataaataggtcgtctgttccacgagcaatcgagcatgcatgggttttactccctccaactagaaaagactcaattctataatagtgctcaaccgaagtatcttaagatgaactagatttatatgaaaagatattagtgttttttatactaaggccgtgttcgaaacctcaaagtaacggttagcagctaaaattagctgagtggttcagaacaggccagccaataaaccatataattgttagttatacctcttaaatagctttataacagttgttagctgctctaacccagccaataacttattagctgactaataattttaactctagaaggttggaacatggcctaaataagtatagttagatttggtaggaaatacattttcataattatctatttggagtatcaagtctagagctcgacctttttttgggtggagttagtttcacgcaagagcagtgtttaggagcgtatcacatgttcacaggccaaagtgatcactattatctcttccgagaaagaaagaggcagcaaatacaagggtcagagaaaactgctcgttggtttcccgcatttttcagtattttttatttttgccagcacgcctaattaacaacagaacggaccgtttttatgacagtctctgtgcatttttgccgtgcattccaagcaatatacacatcccttgaagtctgtaacccatccctttttttctgaacgaatcggaccaaacagcttccaagaatacagatcacggatcctattgctaggtactacggcctgaggcgaggccaggtcgtgaagatcatcaggcccagcgagacggcgggcagatacgttacataccgctacgttgtatgacagaacgtcagaacactgaagaagaagaagagaaccacagatatgtcaaaaaaaattcaagctacacataccccacgtgcttgcagacatcagtatcgcttttgtagcagcagccactggtaacgatctgtggctgatgtgtaagtggattgaataagctgagtcagagcatacgagaattctcatgttgtacacttgtgttttatgaaccgcataaacactcacgacgataaaagaagcctgttttcggagcgacagaagctcctgcgatcaggatttcggatttaggcatcgtgtgttttttttatctaccgaaacacaaaaggccggtcaaaattttggcgatgctttaattaatatagcaattttaaattttaaacctttataaatatttgctgaaacaccctttctataattacataatattaaagagaagtgaatccctaattacattttttttatttaccataagcgctggggattgaggtgaatgaaatcctcttgctatttaattttaaatagaaagtgatttcatccccaggtgtcttgagtgcaaatttttataaaaaaaggaaattctaatgggcagcattggtatagttttgcaaatctttatttgtatttttttaaaaaaaacaactgccaagccttggcagggctggcttatcataaaatgggcctttattttccttaattcttagctagaaatttggcgggctctcctaaggctcagggtctgcaggctgcagtggtgcccggtatgtgttttggtacttgataacatagaaagctttctaaaaaataaaacttgataatggaaacatttcatacatttgcttagtccggtataatctggatacagaaccatatcagtgctaccgaattgtcttcagggaagctccttatagcgagatcattatgatatttttagatacattggtattatgtctattattgtatatagtaatagttatgtatctagataagccagaatg

SEQ ID NO: 9580 - DNA, 1192 bp, Zea mays
cattgggtacctcgaggccggccgggactccactgtgctcctcacagtcccaccccgccggggcggcgcggagcgagcacgccgtcaccttctccaccccccgcccctgcccctgtgtgggagtaggtgtagccgcgtaagcggcagcggcgtaggcctcagctcggctcagctgccgcctcgctcgaaccagaggagccaagcagaggaagcgaggcggagatgtcggcggggctggtgaccgacgaggccaccgtggggcggctgtaccggatccggcgcacggtgatgcagatgctgcgtgaccgtggctacctggtggtggaccacgagctcgccaccagccgccgcgacttcctccgcaagttcggcgagtccttccaccgcgaggacctcctcatcaacaagtacaagaagaacgacccatccgaccagatatatgtcttcttccccaacgatgacaaggtagggatgaagcacatcaagaagtacgtcgaaatgatgacgcacgagaacgtctccagagctgtgctggttctccagcagaacctaactccgtttgcgaagtcgtttctcatagagctggagccgaagatccatctggaaattttccaggaggccgagatgcttataaacatcaaggaacatgtccttgttcctgagcatcaggtgctcacaaacgaggagaagaagacgcttctggagcggtacaccttgaaggaaactcagcttccaagaatacagatcacggatcctattgctaggtactacggcctgaggcgaggccaggtcgtgaagatcatcaggcccagcgagacggcgggcagatacgttacataccggtacgttgtatgacagaacgtcagaacactgaagaagaagagaaccacagatatgtcaaaaaaaattcaagctacacataccccacgtgcttgcagacatctgtatcgctttgtagcagcagccactggtaacgatcggtggctgatgtgtaagtgtaagtggattgaataagctgagtcagagcatacgagaattctcatgttgtacacttgtgttttatgaaccgcataaacactcacgacgataaaagaagcctgttttcggagcgacagagaagctcctgcgatcaggatttcggatttcgccaaaaaaaaaaaaaaaaaaaaaaaaaaaaaaaaaaaaaaaaaaa

SEQ ID NO: 9581 - DNA, 1150 bp, Zea mays
cctcgaggccggccgggactcactggtgccccccgggccggccgcaacgtcacctcctccagcccccgcccccgcccccgcccctgtgtaggagtaggtgtagccgcgtaagcggcgtaggcctcagctcggctcagcagccgcctcgctcgaaccagaggagccaagcagaggaagcgaggcggcgggggcggagatgtcggcgggactggtgaccgacgaggccaccgtggggcggctgtaccggatccggcgcacggtgatgcagatgctccgtgaccgtggctacctggtggtggaccacgagctcgccaccagccgccgcgacttcctccgcaagttcggcgagtccttccaccgcgaggacctcctcatcaacaagtacaagaagaacgacccatccgaccagatatatgtcttcttccccaacgatgacaaggtagggatgaagcacatcaagaagtacgtcgaaatgatgacgcacgagaacgtctccagagctgtgctggttctccagcagaacctaactccgtttgcgaagtcgtttctcatagagctggagccgaagatccatctggaaattttccaggaggccgagatgcttataaacatcaaggaacatgtccttgttcctgagcatcaggtgctcacaaacgaggagaagaagacgcttctggagcggtacaccttgaaggaaactcagcttccaagaatacagatcacggatcctattgctaggtactacggcctgaggcgaggccaggtcgtgaagatcatcaggcccagcgagacggcgggcagatacgttacataccgctacgttgtatgacagaacgtcagaacactgaagaagaagaagagaaccacagatatgtcaaaaaaaattcaagctacacataccccacgtgcttgcagacatcagtatcgcttttgtagcagcagccactggtaacgatctgtggctgatgtgtaagtggattgaataagctgagtcagagcatacgagaattctcatgttgtacacttgtgttttatgaaccgcataaacactcacgacgataaaagaagcctgttttcggagcgacagaagctcctgcgatcaggatttcggatttaaaaaaaaaaagtcgcccctctccaaaaataataa

SEQ ID NO: 9582 - DNA, 2138 bp, Zea mays
gagagatgcgtcgtcgcttcgcgtgcggcttgcccagctagctccttgtacaaagccaagcccacaaggcagccagagcgcggggtagcgattacaccttgacacctaaggccagagattggagagagaaagaagcagctgagtggagcaagaaagaagaggtcatggcggtgtagtctatcagctgagtgggaaagagtggagcaatggtggggggctgtgccagcggcgacggcgccgccgaagggacgctcgcgaggtggcggagggcggcggccaagcggatcggcctctcatgcgcctccttcttctcctacgccgcctctccctccccgcctccttccaagatcatctcccactccgcactgaatgcgcctgatggagagcagcaaaagatggaggaacccaccagcaccagagtggctgacaagaatctatgtgcaatatgtttggaactcctcagcacgagcatcagcagcgatgttgacagtggtgaggcggcagcaatctacacagcgcagtgctcccactcattccacttcctatgcatcgcctccaacatccggcatggcaacgtcagctgccctatctgccgtgcacaatggtctgagctaccacgtgacctgaaggttccaccattgctgcacaaccagtcagacccaatccttcgcatcctggacgacaacattgcgtcatcccgtgtgaaccgaaggtcctccatccgtgctgctcgctacaacgatgatgacccggtagagcctttcaccttggctgagcatgtggatccatgtctccgctttgtcctcatcccggcaccggtgtcagctcaccatcacgtcctcgggcattacccctgtggacgcatgttgccactgcaacagccatgccagtacagcggctcctccatgctttcaccaccgcagattgcttcgccaagtggtcaaaggcgagcctacctctctgtcagtcttgctccacagccagccatggacctggtcctggttgccagccctaacggaccacatctgaggctcttgaagcaggcaatggcgcttgttgtcttctccatgagggcaattgaccggttagccatcgtcacgaatgccaccactgcaacccgtgctttccccttgcgccggatgacgtcccatgcaaaaagaatggcgctgcaggttatcgaacacctttgctgtgttggtgggactgatccagtaggggctctgcacaagggcctcaagatattggaggaccgggcgcatcggaacccgagcaactgcatccttcacttgtctgatcatccagtccgcaactgtgttggtggtgtggacatgaaccactccagcatcccagtccaccagttccatgtcgggctcgggttcggtgtgcggagtggatttatcatgcatgagtttgaggagctcctcgcgcggttgcttggcggcgtgataggcgacacccagctgaggataggggagcatggcggaatggtcaggcttggagagctgaggggtggtgaggagcggaggataccgctcgaccttgcggcagattgtggcttcatactcgttggttacagttacctggagggtggaagagaggagcagctgaggacaggtgagatcgccgtcgggttcgaagagaaaggtgacaacgggtactgtggaatgagagagatggggctgagcattggcggcgagaggaggagctgctgcgccgagaggcgggactaccatgacccgttcatggcacggcgatgggcgaagcatttcaacgtgtacagggcctgagtagaagagcttgatcgtcagctgctgcgaaatatgagtcttgttggtttcttttctctctttttttccccattcctgcaagcatctaggtttggtgtctgctttttggcttcttttgttgtggatctgaatccctgtaagatctctctctctttctctttttgcatgaaatgtgtgggttctgtctgacaaaatctgcttgtgttgtgtgaatctgaacgtgaacagatcatactggagaaaaaaaagcagcaaaactagaaatattatttgattgagcttgcaaatttggaagccagggagttaaagaattattctttcgaagttgtaatgctaaaaaaaaaaaaaaaa

SEQ ID NO: 9583 - DNA, 654 bp, Zea mays
cattgggtaccccttcgaggccggccggggcggccggatccagtggccagaaccctcgctggtctgcgtttcccatctcgtgattctacacttctaccgttccactctcgtgcgctcttgttttcttctctccgttgccgccctacgtcaggtgcccaattctccattttcgggcccttctccagcgacgagcacccgccagaggattatggattggctggggcagaaacgcgcggagatgctgatgcaggtgctgctggtggcgtctgcggtggtggcgttcctggtgggctacgtgcgcgcggacttccagctcatgctgctcgtctacgccggcggcgtcgtgctcacggctctggtcaccgtccccaactggcctttctacaaccgtaacccgctcaagtggctcgacgctgccgaggccgagcgccacccgcggccccaggtcagcgccgcccccgcggcagggggtaagaagaggtccgggaagaacaagtagttggtcgatgtgtgtgttcttggtcgacctgactcaacctgtttaagatctattcgcagaactaatcaattataaaaagagatattgagataaaaaaaaaaaaaaaaaagcagacgagaacaactggggccgacaaaaaaaaaaaaggggcggcc

SEQ ID NO: 9584 - DNA, 666 bp, Zea mays
aacgacggcccggacccaggaggcccggatcctggtatgcgcttacctgccccctctctctgtctcgtggttctactgaacgagcactcgcctgcgctcttctctctctcgtggcgacgactgggtgaccgccggcgccccaggcctgaggcctccatcttcgggcccttcactggctacgagcaccaccagaggattatggattggctggggcagaagcgcgcggagatgctgatgcaggtgctgctggtggcgtctgctgtggcggcgttcctggtgggctacgtgcgcgcggacttccagctcatgctgctcgtctacgccggcggcgtcgtgctcacagcgctcgtcaccgtccccaactggcccttcttcaaccgtaacccgctcaagtggctcgacgctgccgaggccgagcgccacccgcgcccccaggtcagcgccggtgcggcagcagggggaaagaagaagtccgggaagaacaagtaatcgatctttcggagcgatatgtgttctttgtcgatgtgactcaaacctatgtaaagtgggatggtggcagaactaatgaatgatgaaagagctagagcctacaggttgagtgacagtgtgggatgtgacttaaaaatatgccggtggtgcctgggaaaaaaacaatataaaaggccc

SEQ ID NO: 9585 - DNA, 705 bp, Zea mays
gccggccggggggcccgccggcccgggccgggatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttgttgtgactgaaaaaaaaaaaaaaaaaaaaaaaaaaaaaaaccttagggtgaagggcccctaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttg

SEQ ID NO: 9586 - DNA, 2667 bp, Zea mays
tgccctctctggccccgtgtatcttgtttagttaactacttatttttgaaattaaatattttaacaatatgaaaatacgtaaaaaaaaggaaggtaaaatttggcggcttggcccaatcgttcacccttacggcccaaaggttaagaagaggaggccagacgccgagtcccgtcccgttctgcctccacacgccgccagaacgagaatccccctccccgtcccggcgtccccggctcccgagctccccctccagcctccccttccccggctcggccgcaccccgtccccggttcgttagagcgcgagcgcgcggcagccggccagccccaggcagccggcgccccgcggccaggttggctctcgctctcccctccggcacacctcgtccccggttgtccggctccggctccggatcagcagcgccccgagcacgagcgggaacgcgcgaacgccgggacgcggcagggtgcggcggggcggggcagctaggctctgaggcacggcagacggcttgcagtcaagatctctcaccagctgaattgccgattcacacatccagccatctcgacaacttgggtaagaaaatggaagtgctacttactacgtacattttgtgacatcaaagacggcatattggcgaacaatgaacagactattaaatcctccatgacaacacccatactggcgtactcatgttgacatttcttaccttcattgtttttacttgcttcttagtgaaatatgtttttgctttttgttttttactttgcaggtacacacgggacttcatcttaagagaatttagaacaaaaaaagagagcatgtcagacctgcttcctgaagatgtacttgtcaacatcattggtcgtcttgcaccacgctaccttgccatatcccggtgcgtttgcaagacatggtgcaccaccattgatgcccataatctgctgcgtatggatctactcccacactcagtgtctggactctttattaacttcaatgagttaagcatgtcggaattcttatcccgcccctcaaaaggaccagcaatatctggtaaatttgactatttgcctagcgcgggccaagtcatagaccactgcaacgggctcatcttgttacacgaatgtgtagttaacccggccacacgacagtgggcgctgctgcccccacgcccaagcccaaatatgcctgagcacttttgtcacgggatgtaccttgtctttgaccccacattgtcatcacattatgaggtattcctgatccctcaggtctcatacaattccaacttagaccctgcaatagaggaattggaatggccaccttcgccttgcatcgtacaagtgttgtcatcaaggacaaagttgtgggaggagaggttgtttgttcgagaaggagaggctgcaggtaatgtcgctgacattcggttggattttcaagctgttcaggagaatgctgtctattggcggggagtactttatgtaaattaccaatccaaatttattatgaggtagatactccattagcattgttattcatatttgaaggtgtttaatgagaaggttattgaattgtcttttttttttattttttgacttttgtaggatatcattgtcaaatgataaataccaagtaatcaagccacctgtagattttgaatggtttgaatttgaaaatgaatccaggctatccaaaaacctttatttgggaaaatcagagaaaggggtgtactgtgctttgcgttatccgtcaaccgtttccttttcgatttacattctcgatgaatctgacggcaaaacggagtggataatgaagcctcactattatctcgggagtcaaggaattgacgggcctggaccctggactctacaagatatcaactataactgggacacccagtatgaagacagtatggaggaaaagttcgagtgggactccgacagcgataatgttgtcgagaacagaagcaacggtggatatccttgccttcctcgtatagaacttcttgggtttcacccctacaaggatgttgtcttcttgagcgacacgctgagacgaggattggcctatcacctagacagctcaaagatccaagacctgggtaacctccatccaacatattatggaactgaacaggggattcagccatttctactgacggctttcccatacacaccctggaggggatggtttccagaagacacataatggtacatacagagtaccgaacgtaaggtaaggctaccctctgcactcctttgctccatcgaattcagatatgacatatctcttttttttcttcttcttctttcttctgcctacagacataaagaaggcattagctgatctgaaaccgaagttctgaccgggcatggcgaaggtccctccttcacggtttcctgatgctgctgccgctctggatcgacagacttcagcttgagagtagtttagccagctgcttagcgccgtggacgtggggatggacacgtcgcattgcgcgcttagtggctggttttgtgcgttgtttggctaagtttttttttttttggttagaataaaagggagaagagaaaccactccagctgcgcagcaccacaaccggttcaccactctcttgtcatttgttttgtttgttctcatcggggcgtgccaaaattttgctttttggc

SEQ ID NO: 9587 - DNA, 1298 bp, Zea mays
ccggccgggccgggaaaaaaacactcaagcagtcaagtagaacctccagccccccagcccccaggtggtcaagagacagagagagcatggccgctgctcccacggtggtgccgcgcgtgaagctgggctcccaggggctggaggtctcggcgcagggcctcggctgcatgggcatgtccgcctactacggccctcccaagccggagccagacatgatcgcgctcatccaccacgccgtcgccgccggcgtcaccctcctcgacacctccaacgtgtacggcccccacaccaacgagctcctcctcggcagggcgctccgggcggcaggcggggtgcgggagaaggtgcagctggcgaccaagttcggcatacgcgcggacgccgacgacggcgcctgggagatccgcggcgatcccgcgtacgtgcgcgcggcgtgcgagggcagcctccagcgcctcggcgtcggctgcatcgacctctactaccagcaccgcatcgacaacagggtgcccatcgaggtcacggtaggtgaactgaagaaactagttgcggagggcaagatcaaatacatcggcctgtccgaggcgtcggcgtcgacgatcaggagagcgcacgcagttcacccaatctccgctgtccagctggagtggtcgctctggtcaagggatgttgaagctgacataatcccgacctgcagggagcttggcattgggatagtagcctacagtccactgggcagagggttcttgtcgagtggtcctacgatggtcgacaagttgtccgatcaagatttccgcaaggagctgcccagattccagccggagaacctggagaagaacgccgtgatattcgagagagtcaacgcgatggcggcgaggaaggggtgcacgccgtcgcagctggcgttggcctgggtacaccaccagggagccgacgtgtgccccatacccgggacgacgaaggtcgagaacttcaacagcaacgtggcggcgctttcggtggagctcacgcctcaggacatggctgagctcgagtcttacgcgtcggcgggcgtccagggcgatcgctaccatgacttcctcaacacttggaaggattccgagacacctcccctgtcgtcatggaaggctggtgaataacctacggcttcacacacgtgacacgttgttgaggtgaccagatggaataaataagagccaataaaaattctccgcacaatataattttagcttgcttgctaaaaatctttatccaatcttttaaaactataaaactctcaaatgagatgttcatgagcc

SEQ ID NO: 9588 - DNA, 2057 bp, Zea mays
agtttggacctggaccttccatctcagcatcgttggagtggagctgaattctgggaagcttcctcaccagcgaagaaggttactgggaaggggtcctcagaggtgtggaagcaggaaattgtcgcctgcagctgcatataagttggaggctggaagtgtgtcatcggcgaaattgtaccatgtcactgaaatctcatctttcaaaacgaaagccgtcgtgtgctggtggttgtagtttgcagcagcagaatggatgtcttgaaaactttgctgtgagggcggctagctccttttgaaatgatgtttttttttctctctttcttttttctttttcttttttaggctgtgtacatattatgatgtagaagccaaaagtaatcatagtttaattgtatcatcttgatgtaattgtctaagattaataaagcttccattatctaaaatgcatctattagtgataataatgaggacaagctaagggcggctatttgccaacaaccccactaatggtggatattgatcaatagtgtatagctgcaatcatgggagccgcaagccgcctggtgacatacgtgcctttgggctttggcctacgatcttgcaatataaaagctactgagctgaggccccgcttcactcaacactcaagcagtcaagtagaacctccagctccccagcccccaggtggtcaagactcaagagacagagagagcatggccgctgctcccatggtggtgccgcgcgtgaagctgggctcccaggggctggaggtctcggcgcagggcctcggctgcatgggcatgtccgcctactacggccctcccaagccggagccggacatgatcgcgctcatccaccacgccgtcgccgccggcgtcaccctcctcgacacctccgacgtgtacggcccccacaccaacgagctcctcctcggcagggcgctccgggcggcaggcggggtgcgggagaaggtgcagctggcgaccaagttcggcatacgcgcggacgccgacgacggcgcctgggagatccgcggcgatcccgcgtacgtgcgcgcggcgtgcgagggcagcctccagcgcctcggcgtcggctgcatcgacctctactaccagcaccgcatcgacaacagggtgcccatcgaggtcacggtgagttcgtttgccttttcgtgcaattttacctagcctgcagatgagtaataagcttgcttttgacatccatccatccgctgcgctgcgggccacaggtaggtgaactgaagaaattagttgcggagggcaagatcaaatacatcggcctgtccgaggcgtcggcgtcgacgatcaggagagcgcacgcagttcacccaatctccgctgtccagctggagtggtcgctctggtcaagggatgttgaagctgacataatcccgacctgcagggagcttggcattgggatagtagcctacagtccactgggcagagggttcttgtcgagtggtcctacgatggtcgacaagttgtccgatcaagatttccgcaaggagctgcccagattccagccggagaacctggagaagaacgccgtgatattcgagagagtcaacgcgatggcggcgaggaaggggtgcacgccgtcgcagctggcgttggcctgggtacaccaccagggagccgacgtgtgccccatacccgggacgacgaaggtcgagaacttcaacagcaacgtggcggcgctttcggtggagctcacgcctcaggacatggctgagctcgagtcttacgcgtcggcgggcgtccagggcgatcgctaccatgacttcctcaacacttggaaggattcagagacacctcccctgtcgtcctggaaggctgatgaataacctgcggcttaattcacacgcggtgttgtcccattgaaagatggatgaggtgaccagatggaatgaataagagccaataaaatttcttcgcacaatgtaattttagcttgcttgctaaatcattctccaatcttttaaaactatataactctcaaatgagatgttcatcagccagcagaaaaaaaaaaaaaaa

SEQ ID NO: 9589 - DNA, 3250 bp, Zea mays
  misc_feature (620)..(620): n is a, c, g, or t
cgaataccagcacggcagcactgagtatagagggtgacagatgaggcttcgcctccagcagagaaggcgcggaccagtgctgacaagtgacaagacgcgcgccacgcacccgaatttggagaacggcgttgaaccagatctgacgcggcggcagcagcgcgatctgcaatctgttggacgaataaccggtggcggcggtttccgaaaaaaaaacgtgtgtctaataatcctagctctatattgattgttaggatcgtccgtgaaaaaaaataaagtttaacgtggaaaaaactgctacaatatagaggagaaaaaactcggaaaaatagatttattacgtgatataacgtacatggtacaaaagaacctatttatataggcgaagaaaataaaaatagagtcatataatcttatccaacaaaaccattcaatctagataagctgatgcataataagtctattccaaaaaattaataaaatgaagttatttctcgtatcattattaattattagactatgagaaataaaatagagatggatcaatttattccatccttcatttctcaaacggaacaagctaagaaacatttttcaaaccaaacatactataacagatatangacggaacacaaaatagtgagaagacaccctatgataatttgataaaggacagggataggccgggcgcgaactgttataaatacacgtacagaaggcacgaaccaagctgtgaaatgaactagaccaatttccttgcagagagtactgttttggcgatggacgttgccttaagcaccattgtgtttgtcatcgccattttcatcccggcactgctgacgctggtgcaaagaagccgtagccggcacgccggccataacccaccacctccgccggagcccagagccattcccctggtcggccacctccaccacctcctgagaaagaagccactccaccgctgcctcgcccacctcgctgagcgccatggagacgtcctggggctccggttcggttccagccgagtcgcagttgtgtcctctgcctcagtcgcccagcagtgccttgtcgcactggacacctcgttcggcaaccgtccacggctgccgtccgcgaggatcctctcctatgagtggtcgaccatgggccattccaactgcgggccgtactggcgccaagctcggcgcaccaccagcacggagttctcctccgtggaacgagtgcagcacttcgctgatgtccacgagcaggaggcgcgggccatggcacgccgcctttgtcgtgtggcacatgcttctgggggacgcgctcttgtagacgtcaagtcgcgactgttggagatgctaatgaacggctcactggacatgctcttcaggaggacaacctctcggagccggaggtggtgcgttagagatagcaatagagatttgattatcgatttttcgtgctattttttttctattagagcttatttagaagctgggaattggattgagtggattaaaattttctttctctactggaacaaggactcataaatttataaaaaaaaaatcatgtacgcaaactgaatgtgtgcgtgttggcgtgtcgctaaaaagatggcgctgtttcgtacacaattattgtgcttgcgcagtagtgacgaaaaggacgaggccgtggaagtgagcgaggaggcccgatgcttcatggccatggcggaggagacgatggagctcacgctgacggtgtgggacttcctgccgccactggcgcggtggctggacgtcgacgcggtgggccgccggttacagcgactgcaagcaaacaggacggagtttttgcagaggttgatcgaggaacacaaggagatggagaagagcggtcaagtcacacgcaggacgttggtcggggtgatgctggagctgcaggacaaggatcccgaagcctacacggatcagctcatccgctccttgtgtgttgtgagtattatattatacgtacattcgatccaccaatttcttatttagaaaaataagcatctgtgatatgttccagtatggtgggccttaaatttatctcattttgaatctgatggatctgtatattggatacactgctaatcatttgttttcaaatctatgtcattttgaagagtccaaaaaaaaaaaaaaaactcagtacaggctatacaatcgagtgggtgatgtctctcttgctaaacaaccctcacatcatgaagaaagctcgcgacgaaattgacgcatgcgtcggggaacccaaacgcctactggacgcgactgatctcccaaagctgccgtaccttcgatgcattatcctggagacgcttcggctgtaccctgtggtaccccttctagttcctcgtgaatcatctaccaactgcacggtcaacgggtttaatatcgccaaaggaacgatgcttcttgtgaatacgtttgctatccatagggatcctaggacatgggatgacccagaaaccttcctcccggaaaggtacgtacgctaggcaaggtagtagtatatatatacagttcttttcttctaattataaaatattttagattttcttgacatacagttcttattaagcatttagatgtacacactctttataaaaaagaatttatgatataaaaaagatataaaccatcttcttataacttagaactggcctgctgggtaactttctcactagtacaacatgactgagcttattactatatgttagtaatttgatgcacgcgcgatgtataggtttgaggatggcagtaaccaatcagggaagacgacgatggatctgtcgtttggcatggggagacgacgctgcccagcagagaacctggggatgcagtctggcaggcattgctttggggactatgatccagtgcttcaactgggaacgagtgggcacggagcttgtggacatggctgagggctctggcctaaccatggcaaagaaggttcctttggaggccttctgtcaacctcgtgcttctatggtcgatctccttgcaaacatctagactgctatatatatatatatatatatatacaagttgtactaccaagacaatgcaagcacacgtcatgttgaattctcgttgttattacagaataagtcaaaagcgctgctgcttttatataaaatccccctcgctatgtatgtatgttcatgtagaaacctactatcaaataatgtgtcgtgtacagcctcatagagcatgcagacgaaagtctcttgtgagccacc

SEQ ID NO: 9590 - DNA, 1716 bp, Zea mays
ctagaccaatttccttgcagagagtactgttttggcgatggacgttgccttaagcaccattgtgtttgtcatcgccattttcatcccggcactgctgacgctggtgcaaagaagccgtagccggcacgccggccataaccaaccacctccgccggagcccagagccattcccctggtcggccacctccaccagctcctgagaaagaagccactccaccgcaccctcgcccacctcgctgagcgccatggagacgtcctgggcctgcggttcggctccagccgagtcgcggttgtgtcctctgcctcggtcgcccagcagtgcctcgtcgcactggacacctcgttcggcaaccgtccacggctgccgtccgcgaggatcctctcctacgagtggtcgaccatgggccattccaactgcgggccgtactggcgccaagcccggcgcaccaccagcacggagttctcctccgtggaacgagtgcagcacttcgctgatgtccacgagcaggcggcccgggccatggcacgcagcctttgtcgtctggcacttgcttctggccggggacgcgctcttgtagacgtcaagccacggctattcgagatgctaatgaacggcttactggacatgctcttcaaggggacagcctctcggagcgggagtagtgacgaaaaggacgaggccgtggaagtgagcgaggaggcccgatgcttcatggctatggcggaggagacgatggagctcacgctgacggtgtgggacttcctgccgccactggcgcggtggctggacgtcgacgcggtgggccgccggttgcagcgactgcaagcaaacaggacggagtttttgcagaggttgatcgaggaacacaaggagatggagaagggcggtcaagtcacacgcaggacgttggtcggggtgatgctggagctgcaggacaaggatcccgaagcctacacggatcagctcatccgctccttgtgtgttagtgcactcgaagctgggacactcagtacaggctatacaatcgagtgggtgatgtctctcttgctaaacaaccctcacatcatgaagaaagctcgcgacgaaattgacgcatgcgtcggggaacccaaacgcctactggacgcgactgatctcccaaagctgccgtaccttcgatgcattatcctggagacgcttcggctgtaccctgtggtaccccttctagttcctcgtgaatcatctaccaactgcacggtcaacgggtttaatatcgccaaaggaacgatgcttcttgtgaatacgtttgctatccatagggatcctaggacatgggatgacccagaaaccttcctcccggaaaggtttgaggatggcagtaaccaagcagggaagacgacgatggatctgtcgtttggcatggggagacgacgctgcccagcagagaacctggggatgcagctggcaggcattgctttggggactatgattcagtgcttcaactgggaacgagtgggcacggaacttgtggacatggctgagggctctggcctaaccatggcaaagaaggttcctttggaggccttctgtcaacctcgtgcttctatggtcgatctccttgcaaacatctagctgctatatatacaagttgtactaataaggcaagcacgtcgtgttattctcgttgttaattgttactattacagaataaatcaaaagtgttgctactttgatat

SEQ ID NO: 9591 - DNA, 1822 bp, Zea mays
cacgctagtagaaatccccccaaagcccaaacggcacgacaccattacaaagatacaccgcctcccgcttccttctccgccatacctcgtgtccgacgagccctagggaacgcgagaccggccgtcggcgagagaaggactcgaatggagtgcgcaagggagttgcgggttcgctccacgtttacggcggcggccatggcgtccaagaagcaggtggggcctggaggcgcggttcccgctcaggaacagatgaacggcggcgatgccgccagactggtcaggaagccaatggatacatttccacagccagcggcggcaagaggccgtagggcacttgtcgacgttggcaatcttatgaatggccggccttctcttgtgaaccatcagaagcaagcggttgcggcagcggcaaccagtcataaaccactcaacgtcggcaacaagaagccacttgttcctcaggcagcagcaagaggcctgcgaccccttgccgacgttacgaatcttatgatcaaagaccgtgctgctcctgcaaatcgtcagaagcctgtggatgctgtgtttaacaggaacgggaaggcagtaaagctgaaggaatgcaaggtgaagcctgaagtcattgtgatcattccagattccgagaaggagaagaaaggcaaattccctggaggtcagagagtctgtaggagggtgccaacactttttgacaatttgacaaaatgcagcagggcctctgatgggattaccaccccgaagaagaaggatccatatgacattgatgcacctgattcttgcaatgagctggcagtcgttgaatatgttgaggacatttacagattctacaagagcactgagggcacctgccttcctctcagcagctacatgagctcacaggctgaaatcagtgagagaatgagagctatccttatcgactggattatcgaggtacagtacaggcttactctaatgccagagacactttacttgaccgtctacatcatcgaccagtacttatctatggagagtgtaccaagaaaggagctacagctcgtcggcataagtgccatgctgatagcaagcaagtacgaagagatatgggctccactggttaaggacttgatgtgcctctgtgacaacgcatttaccagagaccagattctgaccaaggaaaaggccatcctggacatgctccattggaacctgacggttccaacaatgtacatgttcattgttaggtacctgaaagccgcaatgtgtgacgcagagcttgagaacatggcattcttctactccgagctggcattggtccagtacgcgatgctggtttaccctccatcggtgaccgcagccgctgccgtctatgctgccaggtctacacttgggatgaatccacagtggactgatattctggaacatcacactggcctagctgagccacagttactggactgcgctaggcggctgatcagcttccatgccctggctccggaaagcaagcaaaaggcggtgtacaggaagtactccaagcccaagctcggctccgtcgcgcttcaatcccctgacaagaagctgttgtcaggttgaggctcgttgctgctcattgtattgtatatcatcgcttcgatggtaccatttgtttgggtcgtgtgctcttatgcttttctactgaagcagagcatgtgttggttagtcagtttgcttaaacgactactgaagcagagccttgtatgtgtgttgggagaatgtgatatgtgatgtcaagctcaaacttcttctcatcattggataaactacttgttggaggccaaaaaaaaaaaaaaaa

SEQ ID NO: 9592 - DNA, 888 bp, Zea mays
  misc_feature (880)..(880): n is a, c, g, or t
ctcgccggccgggccggggacccctccttcttctattcatttcgccgagaggcgagagaactgcttcgcacctacgttactgctgaagatccagccggcacaccatcggcgaagaagaggccggagagaggatgatactggccgtgctcttcgccaactccgatggaaacatccttgtcgagcgattccatggggttcccgcggaggagaggctccactggcgctccttcctggtgaagctcggatccgagaacctcaaagggtccaagaacgaggagctccacgttgcctcccacaagtctgtgtctattgtttataccacggtcggggatgtctgcctctacattgttggcaaggatgaatatgatgagcttgctttggctgaggtgatctttgcaattacatcagcagtcaaggatgtttgtgcgaaacctcctaccgagcgcctcttccttgacaaatacgggaggatctgcttgtgccttgatgagattgtttggaaggggttgcttgaaaacacggagaaagacagagtgaggaggttgattagactaaagccccctgtggagccataatttgcatgtaaagcttatgttggcgttgctgtaatccaaatccaatcccatttgcatttgtaggcaaattttcagagttttcatctgcactttgtatctacagaattatcatcacttattggaggattgcgtgtgtgacatcaaaaacaatgtatcatctgtgtatttgctatgttgataagtgtgttactgcgttgtattttatgaaaaaaaaaaaagctcccatgtacgcataccccttttatagctgatatgggcctttttaaaaaaggttggtggttttttttgtgagtactaaaaaaaanaaaaaagg

SEQ ID NO: 9593 - DNA, 883 bp, Zea mays
  misc_feature (9)..(9): n is a, c, g, or t
gggccgggnaatcatttcgccggggggcctcggggccgccccgcacctacgttactgctgaagatccagccggcacacacagacaccatcggcgaagaagaggccggagagaggatgatactggccgtgctcttcgccaactccgatggaaacatccttgtcgagcgattccatggggttcccgcggaggagaggctccactggcgctccttcctggtgaagctcggatccgagaacctcaaagggtccaagaacgaggagctccacgttgcctcccacaagtctgtgtctattgtttataccacggtcggggatgtctgcctctacattgttggcaaggatgaatatgatgagcttgctttggctgaggtgatctttgcaattacatcagcagtcaaggatgtttgtgcaaaacctcctaccgagcgcctcttccttgacaaatacgggaggatctgcttgtgccttgatgagattgtttggaaggggttgcttgaaaacacggagaaagacagagtgaggaggttgattagactaaagccccctgtggagccataatttgcatgtaaagcatatgttggcgttgctgtaatccagatccaatcccatttgcatttgtaggcaaattttcagagttttcatctgcacattgtatctacagaattatcatcacttattggaggattgcgtgtgtgacatcaaaaacaatgtatcatctgtgtatttgctatgttgataagtgtgttactgcgttgtattttatgctactgcggcaagctcccatgtatgcataccccttttatagctgatatgggccttttaaaaaaaaatagatgattttattttgagaaaaaaaaaaaatcaattaaaactatattataaa

SEQ ID NO: 9594 - DNA, 1397 bp, Zea mays
tttcttctttccctgccgggccccggcggcctctcctctcctcgcttgtccccaccaggtgccatggacgccggcgacgacgaaccccccgttctcctcgaccgcgccgcccgcgcctcccgaggcaagaggataaccaagctgctcgaggacgaggtcgagcaggacgaggctttctggaaccaagaagccctcaaggatgaggagaacgatgacaactacgtggaagagccggatgctggtgacgaattcgacagtgattttggtgaagatgaatctgaaactgatgatgagccggagaaggaagtacgcgagagattacctatcaagaaacggctaatgtttcctggcaagacgctgaggaagaccaacgtcaagaagaagaaggcgaccccaaaaccagaagatggcacaaaagccgacaagtctgctgataagccgagttcatccacacaagcagatcttcctgatgaactggaggctgagaaggccatccggaaatcatccagaacgtcggtcatcgtgaggcaagctgaaagagaagcgatacgtgctgaaaaagaagcaacggccaagccgattaagagaaaaaaggagggagaagaaaagcggatgacacaagaggagatgcttttggaagcagctgaaacagagatcatgaacatgagaaatctagaacgtgtcctggcaagagaggaggaagtgaagaaaaaagctgttgttcataaggacacttatgagggtcctacaattcgttttttctcaagagatggggaatcacgtctggaattcataaatggagcatcatttgggtctgaactttgtacaacatcatctccttatccggagaaacctgtttgtgtggtgacaggacttccagccaaataccgtgatccgaagacagggctgccttatgcaactatggaagcatttaaaataatccgggagagtttcctgaaagaggaggctgatagaaagcgtccgaacatgtcgaatatgggagagcttttcgaatcaataactggtggacacttgatgcctaagaagagaagggttgagataaggtctccgaacatgttaggaggctctaggcatggcgggcgtacctggcgaatacctgcttttgatatggtggacgaggactaacgagacagatcccgtggctcccaatatgtccaatatgagagatctttctaaatcaatagccggtgaagaggaagatggataggatgttgtatttagtgttagatcttgtgcttgtagttatcttaatgtatttttgtcagttgataaattcatggttattaaagtggtaaaacgttaaaatgttatgaaacaactttttaatattttaacgcttaaacgaacgttgaaacgccaaaaaaaaaaaaaaaaaa

SEQ ID NO: 9595 - DNA, 2554 bp, Zea mays
ggtacccgcgtctcgggccggaaaccgaacacgaccgtcgccgtctctactcccagtcccagctgccaaggtcttcgtcgcctcgtcgggctcgggtcctttgccggcgacgagcgcgtgcacaccagaagaatacagtggaagtggtatgcggttgtaaaacgatttcgattattccaagcggccggcgatggctcggagcccctgcgacctccgcctcctcctcctcgctgcagctgcagctttcatctacatccaagtgcgcctctttgctactcagtcccattatgcggaccgtcttgcggaagcagaaagatctgaaaatcaatgcaccagtcaattaaagtccttgatcgatcaagtcagcatgcagcaggagaagattgtagcattggaagagataaaggtacggcaagatgaagaacgtgcacatctgaggattttgataaaggatcttgaaaaaaggagtgtgcagaagctactagacaagaatgtggttcccgttgctgctgttgtcataatggcttgcaatcgaccagactatttagagagaacagttgaatctatcctgaagtatcagacatcagttgcttcgaagtttccgctttttatatctcaggatggagcaaatggagctgtgaagaataaagctttggaatataaacaaataacatacatgcagcatgtggatcttgaacctgtgcaaactgaaaggccaggagaattgacagcatattacaagattgctaaacattataagtgggccttggacaacctattcattaaacataattttgctcgagtaatcattctagaagatgacatggagattgccccggattttttcgactacttcgaggctgcagctaaactacttgataatgacaagacgattatggctgtttcgtcttggaatgacaatgggcagaagcagtttgttaacgacccaaaagctctttaccgctcagatttctttcctgggcttggatggatgttaacaaagtccacttggattgaattgtcaccaaagtggcctaaagcttattgggatgattgggtgaggctaaaggaggtacatggacatcggcaattcatacgcccggaaatttgtagaacatacaattttggcaagcatggatcaagcttgggacagttcttcgagcaatacttggagcccattaagttaaacgatgttcaaatcgattggaattctgaggatctgagctaccttagggaggataagttttcaaccaaatttggaaaagaggtggctagtgccactcctctccgtggatcagatgctgtgttgaaagcccacaatatggctgaggatgtaaggatccaatacgacgaccaagaaggtttcgagcagatagctcgtcaatttggaatattcgaagaatggaaggatggcatcccaagaacggcttacaaaggagtggtggtcttccggtacaacagtagtcaaaggcgaatatttctcgtcagcccagattctcttcgtcagctgggggtgtagcatgttgagaaggtagatttttacccttggaatggcaaatatcatggaattgcttaactggtttctgtgagcatggaggaaccgggatgcatggtgaagaaattttttttgagaagtgattgtgttgacccaaggtactgagtagtagaagcatgggcttggtttataggacatttgcaagatataatacatcgttgttatatctttctccgcatccggaaatgtttagtcagtatgggacttgttatccttgagtgtatttagggtttacacgatgcagttgtatgcgctcaaaagagtgtagcaggagctcactagctgacctgacgctcgatcctttttggtagaagaaaggtgtatctttatgaccaaatttttcttattgggcatcttggaatattaagatggaaggaaatcttgtgcattcgtttgttgtactgttttgtggtgacttcgcagatgtgcgacgagatgggagtgtaagcatccaatcaattccatcgagtttattgagctgtcttgttctgaatatgcagtgcgaacctgagtggttgatttggtttgtggtgcgcaagcttttcattcacctactaaaaccttggatggctcgtgtatacatatagttatatatatgcaacattctgaaattcttttttaagtttttggtttgtagaggacgggtgggagttcatttcatccaaatgcatgggactggttttcctagttgagacgggatttgagtcaaaattcaaatccccgttggttagtttctacgtatgttttttttcttttttatgtcgagcagtgtctggcattattctaagggtccattagccgtccgtgtatgcctttggagcttccaatgcgcattgccgaaagacactagtttcagagtgcaggtgtgcccagccatgccgcagcccaattgcattattagcatgggagaagaaaaagaaaaaaactaacaaagatgaagactagatacaggagtttctctctaaacatcaggtttcagctctgacaactatccggggg

SEQ ID NO: 9596 - DNA, 2656 bp, Zea mays
acttctccgaattgcagagtccaacccgcaaggcatggatggtttctggctgcagaagggctcggctcccccgcggccgcccggggagggctcccaggaggatgtgcaggagcgggcagctacgtcgcttgctacgtttgtagttatggatgatgagagtgcaaatgtggatcctgcaaggtcggaggcagtgatgcagaatgggggcatccgaatgttgctggaccttgcaaggtgctcaagggagagcgcacagtctgaagcagcaaaagctattgccaacttgtcagtgaataccaaggttgccaaggcagttgcagatgaaggcggcattacaatactcactgatttagccaagtcgatgaataggcttgttgccgaagaggctgctggtggcctttggaatctctctgtaggcgaggaccacaaggcggctattgcagtatctggtggcattaaggccctggtcgatctaatatttcgttggcctgctggaactgatggagttcttgaacgtgctgctggcgcgcttgcaaacctggctgccgacgacaagtgtagcttggaagttgcaaaggctggtggtgtccatgctttggttacacttgctcgatcatgtaaacttgatggtgccctagaacaggctgcaagaggtctggctaacttagctgcacatggggacaacaatgacaacaatgctgctgtaggtcaggaagcaggggctctggaggcactggtgcaactaacaagttctcaaaacgagggtgtaagacaagaagctgctggtgctttgtggaacctgtcatttgatgacagaaaccgtgaagccattgctgcagtgggtggcgttgaagctttggttgccctagtgcaacaatgtttgaatgcttcagaaggtcttcaggagagagctgctggtgcattgtggggattatctgtttcagaagctaatagcattgcaattgggcagggtggtggggttgcaccattgctcacattggcacgctcagaggttgaagatgttcacgagacagctgcaggggcactatggaatcttgcattttattctggtaatgctctccgcatagtcgaagaaggcggggttcctgttcttgtaaaaatttgctcatcatcacggtccaagatggcacgtttcatgtctgcactagcactagcatatatgtttgacggaagaatggatgaagttgctttggttggagcatcctcagatagcagttccaagagtgttaatgttgagggagctagaagaatagcatttaagcatatagaaacctttgtgctcactttctcagatccacaaatgttctctatggctgctgcctcctcagccccagcagcgctgtctcatgttgctgaagcagtgtttatacacgaagctggacacctgagatgcagtcgctctgagattggtagatttgtttccatgcttcggaatccttcaccaattcttcgtgcttgtgctgcctttgcccttcttcagttcacaatcccaggaggtcggcatgcagtgcatcacgcaggtctcttgcaggaagcaggggcaggtcgggtgttgcgcgcagcagcggcagcgacaacagcttctattgaagctaaaatctttgccaggattgtactcaggaacttggagcaccatcagttagggatgtcaacatgaacacccagcagaggttcatcctccaataaacaaaggcctctgcatcgatgggctgcttggccaatgcagaatcaaacagtttggccttcggagccttttgacatcacaacagttttggtctgtgcagacagtgactgaaggagctccaccgaaggtataacccacaactgtgaagtgactgaatgaaaacataagtggcgacccttcgcgtattggacgtttaaggttgagtgtgcaattttctagagttcattttgcgtgtacaagtaaaaacttttttagagtcgatgagaattataaactggcatatagcttaacttatggatatttattccttattcgttagcgttgaggtgtgtggcggcgtcatgtagaagttaggttattcctcctaggatacatgtaactttataaatgtactgttatgtattttcttccttatgattgattctgtgcatttatagatcgagttgtagattaccactcaacgaaacaaaacgagaaggggcccggcaccctgcgcatcagtaagcttattgagtatgaatcctcgtttatttttttttctaaaaataaacttacaaaatttttagtaatgctcttagaaaaaagcttactcagagaattctcatattttttagattttagaaaagattcttaaatctccatttaaaaaataaaaaatgtgatatttttgcaaaatcttttttaaaatagcttcattttacaaggtttcaagataaaaaacatagaaaaatgaacctatggttagattccgaacaaaaagagaattggggaagccacactcgattaatcagacgtgggttccattatatagctcctcaggagcaaatcagggattacaacatatcctataaccaaggaaactaatttgcagcgaccacggtggatagaaaaggcgaaatctttattggctttcgtggacgacaacatcgtgtagaggtgaaagagcaactc

SEQ ID NO: 9597 - DNA, 1480 bp, Zea mays
aagttacctattctgtttatccaagcatttagggcgtgtttggttcctccgactaaagtttagtttgtgccacgtcaaatgtttgaatatcaattataagtattaaatataggcttaattaggtttaacaaatttgtcttgtcttttagttgggtggaatcaaacacccccttaattacggagtaggtagtggaaaattgtaataacgatgcaattggcatctttaacggacaaacattgtggttgtggaacgttttccccaaggctgtcgacatagttaaatggagtaataagtgatgtgagcctttcagacaccttgtgatgttttttcttctttcgtttctactgtagcaaatacttgaagctgtcagtacaatacacgaggaacgaattgtccactctgatttgaagcctgcaaactttatgcttgtgaggggctcacttaaactaattgactttggcatcgccaaggctataatgaatggtacaacaaacattcaacgtgatgctcaggtaccatgttacacttatagcatttctttgttggcgtcacttgtatattaataatattaccgttatgagttatgtgtgttgtttttttatgaaaggctacttctggctctcaccgtgatgctcaggtagggactctcaactacatgtcacctgaagcgttcatgtgcaatgatacagactcggatggtaacattattaagtgcgggctcccctcagatatctggtctcttggctgtattctttaccagatggtgtatggcaagacaccatttgcagactacaagactttctgggacaaatataaaggagtgactgataggaaccacaagatcatgtatgaaccagttgacaacccatggctcattgatttgatgcaaaggtgtctcgcctgggaccgaaatgaacgatggagaacacctcagcttcttaagcacccttttctcaatcctccagttccaagggatttacctccctctgacgatgatccatataggttgctcattgagaggatcagagtccactgggataacccaatggttcaaaaacttcgtagtttaattgaagaactcgatggggatcagtaaaaatgggtttttaacaatcctgattgatactcgatcaaggcctgggtagtggtggcactagtgttttagtttctgtattgttcctgattgatagggtactgttgtaatttgtaattagagagtggcggcatcggttggagacgtcggagcatattatggtgccctggcatttttgcttcctcgtgtttggaggttgatgtgacactttgtcagaaatggcggctagttaacgttaagagtcaagatatttttgttgtctgatcagtggaagcatctccaggtgtaaatagttgaaccaattggtagtttgtgttttaccattaaaaaaacgaaaaaaagagccatgagcatttcgtctagccctacctatgggagctaataac

SEQ ID NO: 9598 - DNA, 904 bp, Zea mays
  misc_feature (16)..(16): n is a, c, g, or t
atgtatgttgcccagntttttagctcatcttggggacctcgagccgacccggcggaaacaaaacagttgtgaaccactgagtcctgccgctgtctgttataaaggcacagctcttctgtctccacgagattgttgaattcctctctgccctagcaccagccatggcgaagccgcagcttcttctctgtttcctactcgccgcctccgcgccgctaatcgtcgccacggccaagaaatccggggacgtgtcggagctccagatcggcgtcaagtacaagccggaatcatgcagcattcaagctcacaaaggtgacaaggttaaagttcactaccgtggaaaacttactgatggaacggtttttgattcaagctatgaaagaggtgacccgattgaatttgaattgggcactggacaagtgatcaaaggatgggatcagggtctcctgggaatgtgcgttggtgaaaagcggaagttgaagatcccatcaaagcttggctatgggcctcaaggctcgccacctactattcctggtggagcaaccctcatatttgacacggagcttgtcgctgtcaatggagaaccaaccaaccaatctgacgagctttagattcatcaaacaaatgaatccattcacctttttactcggaactcagcagatgtaatactttccaagaaatgagccttcattccctgccactttcatagtttctttcgctgttccacactgacatctatgatttttggagcaaactctgatctgttttgactagtttacacgtttgtgtgtggaatctgaagagctgttctgaaatgttactttccttttttaaatattagggctttggttcaggcttcatttgcaaaaaaaaaaaagcaccggcccccggttattttttcactttg

SEQ ID NO: 9599 - DNA, 1656 bp, Zea mays
aagccaagcaaggagagcagcagcttagcctagcactgctgcagcttgcttgctttgctttgcttcttcttggccaggcctcagagcagagctttggcttggctagtcgtcgtccgcggatagtctccgctacaccgtgtgcgtgcaagcaaggcaaggcaaccagccagccgcggcgacgaccgatcgtcaacaagctcgatcgccttggccggcggccgggcgggccaccgcaagccgcgagcgatggaggagcagctgggcccggtggcggtgacgcacctgctgcagcacacgctgcggagcctctgcaccggcgacgccccgcagtgggtctacgccgtcttctggcgcatcctgccccggaactacccgccccccaaatgggatctccctggcgccgcgtacgacaggacccgagggaacaggaggaactggagatcctggcatgggaggacgggttctgcaacttcgcggcggccagcagctctgccgccgcgtccgcgtgcggccaagagggggcagcggcagctgcggcggttgcatatgccggggactgtgaggcagctgtgcaggatgcggtgaagcaccagcaccagcaggcgcagggcctgcagcctgagctgttcttcaagatgtcccatgacatctacaactacggcgaaggtctgatagggaaagtggcggcagaccacagccacaagtgggtgttcaaggagccccaggagcacgagacgagcagcctcatctcctcctggagcaaccctgcagactctcatccgaggacgtgggaggcgcagttccagtgcggcatccagaccatcgccctgatcgctgtcagggagggcgtcgtgcagctcggctccatgaaaaaggtaacggaggacctgagctacgtggtgatgctccgccgcaagttcgggtacctcgagagcatcccgggggtgctgctcccgcacccgtcgtcggcgggcgtgttcgcggccggtgggtgcgtggggcccccgccggacatcgccgcggcgtggtcgtcgggcctgatgccaccgccggccgccggcgccgggccgccgctggagctctacgacccctacggcgccggcgcgatggccgccgggccaggcgccgccgccgccgctgcgtccatgcacatcatgccgtcgatgagcagcctggaggcgctgctctccaagctgccgtcggtcgtgccgccggccccgcagccagccgggtccgtgcccggagcagcgccgccgtccaaggacgacgattacgacgacgtgcagcagtgccatggcatggacgacgtggcggcgagcaacggcgcagcagggttcgtcgagagcgcgagcccgagcccgagcccgagcccgagcggcgctgcctccgcgcccatgtcgtcgtcgtcctactttgtcaacgtgggcagtagtattaatcccggcgatcatgggttttagctcgtcgtggcagcccggccggctgctcgtctcgtctcgtctgatggcatggccatggcgtgcttgttgattaattgtgctggtcttcgctagggcgaaacctatcgatcatatattaccagttgccgtcgctatatgctaattaattaatgtagttaacccaatgatttggcaaaaaaaaaagagaggggcggaa

SEQ ID NO: 9600 - DNA, 2727 bp, Zea mays
  misc_feature (2385)..(2385): n is a, c, g, or t
gcgggccgaaccacgcgtcggcccacgcgtccgcccacgcgtccgagcaaatccaatgcacctttttttgtctccgctttactgtgttgctcctatttaaatacgcctaataataaatgaagtaaacaagtaaccaattggatcttttgtccacgcaccttaatttgcatgcacaagtctaaatggacttatataagtctatggaagagtatctactgtcaattttgttataggcgaaaccgcaaaacagactacagtactgcacattgttggtttatcttatcaacaggaagccggaacagaaattgagcctatgggtgacctcaatactgaagctgagaaaaaacttggtcggcttgtcagggaaaagtacgtcacctttttggcccttttgtgtttcactaattgataatctgataacaatttcctttgttatttgtaagtatgacacagattttttcattatgtatcgatatcctttggctgtgcgtcccttctacactatgccttgttatgacaacccagcttacagcaattcttttgatgtctttattcgaggtaaggctgtctccaacaacgttctttaaattccatcccctaaaggaatattccctgtcctttacaacacactctaaaagattctgtcctctatatcttctcattctccagcaacgccccctaaattcgatcctttatatctacagttttaacagaatacataaactaccatatttattcattgtattttatatatttcaaattggttctaacgtatgacattaaaatgatgaaattaaatatttaccaatactaccattttttgaacgtatacatatttatgctgaaaaataatatgtgtgtgtgtatatatagtaaaataacgtacgacacaaataaaaataaataaatgatttgcgtcattgcggcgatattaccgagcatgaactagaaattagtaaaacatgaaaaaatcagaacggttttggcttgagcatttcatcaaaggccgcgctttcgtcgttcccagcaccggcggcggcggctgaaccaatataggccccagcagccccattactgtgctgcaatgatttcgtcgtaatcacctggatagcggatgcacagtgcatcactacgaatagaatgcgggacagcgtccgctactttagcgaacgatttgcagttcgttgctggaggctttacaggacggttcaatctctaaatttagcgtacagaatagtatagagttacttgttagagacagtctaagaccctactactgtgaatgttgttgctgatggcatgtaggctatattttatagttgttctattaatgtgttttatcactgtttatttataataaattgtgcacaggcaggatttgttctttcataactgttacaggcgaggaggtaaatgatctgaaccaaattcattgatattacaggcgaggagataatatctggagcgcaaaggatacacactcctgagctgttgaccaagcgtgcaacagagtgtggaatcgatgtcagcactatctcgacctacattgaagtcttcaggtatgttggggccacataacatgcccatataatattgaatactgatcagttggggtacccccccccccccctgtttgctgctcatgttgattgatatataaattcccctgcccccattgtagctatggcgcgcctccgcatggtggtttcggggtgggtttggagagggtggtgatgctgttctgcgccctaaacaacatcaggaagacctcgatgttccctcgcgacccgcagaggcttgtgccgtaatttactgagtccaatgccctgagtttgcagcagagcgtactggttgttttgatgttctttgagcatcgaacatcgctaacttgcaatctcagctactgaagccccggttaccgtggttcagagttcctgttaaattcacaaagctacttgtatctattagattgctgaaaccagcaagtacgatcctttttgggatttgatctggtctaattgttgttaagtggaggtattgctctcagtttttttgtgctctgtttgtcggcatatgccaagagctagggcttcttaagttctaagtttttagacgagtggattcctttttttttaagagccggcaaaagttctgccctgcacctgttaaaaatagatattaccctattccaattctaaataatatgacgagttgccttctagatatttatattatgtagatgtacaatatgtctagatacagatatagtaaagtaatgtatgtctttataaagagagaagaattgtgctgcgaatgaacccaccctctgtcaaatcccccgatcccaggttggcagcatgccttctgttttgaaatgataagcgnatgttttgaaatgagaagaattgtgctgagatacttcaggtgagtggcgctaacgtggtcatgctcatgccgcatgtgttttgtttgttgctaacacgagcatcttgatggatttctagaagatctagttataaactttagctttcaaattttaattttttactttttaaagctattcttatttttattcttacatacttaaattcatatcgcgactcatggtgttgaggtacttgacgcgacgtctaacttaacgtcttaacaaagtggtcatgctcgtgcacgtatatgtttcatttgtcgcccaatatgagcatctcgaaggatttcttgaaaatctag

SEQ ID NO: 9601 - DNA, 2082 bp, Zea mays
atcctccccgagcccggccgcgcttccattccctggcccatcgagccccccgacgcgagacgttaccctattctttctgctcaacttggcctcacgcacgatagccgccgccgtcgaccagagcactcccccgtcgtcgccacgatgtcgtctgagcctccacccgcctcctctgccgccgccggagaggaactcgctgctgacctttccgccgctaccctcagcaagaagcagcagaagaaggacgcgaggaaggcggagaaggcagagcagcgccagcgtcagcagcagcagcagcagcagccggcggacgccgaggacccgttcgcggccaactacggcgaggtccccgtcgaggagatccagtcaaaggccatctccggccgctcgtggtcccatgtcggcgacctcgacgactccgctgcgggccgctccgtgcttatccgcggagccgcgcaggccatccgtccggtcagcaagaagatggctttcgtcgtgctgcgccagagtatgagcaccgtgcagtgcgtgctcgtcgccagcgccgacgccggcgtcagcacgcagatggtgcgcttcgccaccgccctcagcaaggagtccatcgtcgacgttgagggcgtcgtatccctcccaaaggagcccctcaaggccaccacacagcaggttgagatccaagtgaggaagatctattgcatcaatagggctattccgacccttccaattaaccttgaagatgcggctcggagtgaggcagattttgagaaggctgaattggctggagaaaagcttgttcgcgttggccaagatacccgcttgaactacagagctattgatctacgaacaccctcgaaccaagccatattccggatccagtgtcaagttgaaaacaaatttagagattttttgttgtcaaagaactttgttgggatccacaccccaaaattgatttctggatctagcgaagggggtgcggctgtattcaagcttctgtacaacggtcaacctgcttgtttggcacaatcccctcagttgtacaagcaaatggctatctctggtggttttgagcgagtatttgaggtcggccctgtgtttagagcagaaaattcaaacacacacaggcatctatgtgagttcgttggtcttgatgctgaaatggagattaaggagcattattttgaggtctgtgacattatagatggcttattcgtatcaatatttaaacacttgtctgaaaactgcaagaaagaactcgaatcaataaacaggcagtatccatttgaacctctgaagtatctagacaaaaccttgaagctcacttatgaagaaggaattcaaatgttgaaggaagccggaacagaaatcgagcctatgggtgacctcaataccgaagctgagaaaaaacttggtcggcttgtcagggaaaagtatgacacagattttttcatcctgtatcggtatcctttggctgtacgtccgttctacaccatgccttgttatgacaacccagcgtacaccaattcttttgatgtcttcattcgaggcgaggagataatatctggagcacaaaggatacacactcctgagctgctggccaagcgcgcgacagagtgtggaatcgacgtgagcactatctcggcctacattgaatccttcagctatggcgtgccgccacacggcggtttcggggtgggtttggagagggtggtgatgctgttctgtgccctgaacaacatcaggaagacctccctgttcccgcgcgacccgcagaggctcgtgccgtaagtttctgattccaagcctgagtcttcgagtggtctacggagcagatccgatgttgttaccatcagagttgacttgcaatcttagctcctgaacctggcggttaccgtggatcagagttcctgttgaatttcacaaaagcctacttgttcctaatagattgctgcaaccaacaatattacgaccctttcgggcttttcttcccaaaaaaaaaaaaaaaaaggtctatacttgtttttaagtgcaagtattgctcagttaaaaaaaaaaaaaaaaaaaaaaaaaaaaaaaaaaaaaaaa

SEQ ID NO: 9602 - DNA, 2355 bp, Zea mays
  misc_feature (34)..(35): n is a, c, g, or t
attgggacctcgagccggcgggaaaattcgccgnngaagcactcgagaccgaatatcgagctcacttcccgttaacttaccctattacctttctgctcgtggtgagtgctgacaccacctcacgcacgcaagccgccggcggcgaccagaccgaccacctcgcgcactagccttgctcgcttctcgtcgccggctcgttgccggctcgtcggcacgatgtcgtcggagcctccacccgccccttctgccgccgccgcagagggactggctgctgacctttccgccgccaccctcagcaagaagcagcagaagaaggacgccaggaaggcggagaaggctgagaaggcggcgcagcgccagcaacagcagcagccggccgacgccgaggacccatttgcggccaactacggtgatgtccccgtcgaggagatccagtcaaaagccatttccggccgcttgtggtcccagatcggcgacctcgacgactcctctgcggggcgctctgtgcttatccgtggatccctgcaggctatccgcccggtcagcaagaagatggctttcgtcgtgctgcgccagagcatgagcaccgtgcagtgcgtgctcgttgccagcgccgacgccggcgtcagcacgcaaatggtgcgcttcgccaccgccttaagcaaggagtccatcgtcgacgttgagggcgtcgtgtccctccccaaggagcccctcaaggccaccacgcagcaagttgagattcaagtcaggaagatctattgcatcaatagggctatcccaacccttccaattaaccttgaagatgcagctcggagtgaggcagattttgagaaggctgaactggctggagaaaagcttgttcgtgttggtcaagatacccgcttgaactacagagctattgatctacgaacaccctcgaatcaagccatattccggatccagtgtcaagttgaaaacaaattcagagaatttctgttgtcaaaggactttgttgggatccacacgccaaaattgatttctggatccagtgaaggtggtgcagctgtattcaagcttctgtacaatggtcaacctgcttgcttggcacaatctcctcagttgcacaagcagatggctctatgtggtggttttgaacgagtatttgaggttggccctgtgtttagagcagaaaattcaaacacacacaggcatctctgtgagtttgttggtcttgatgctgaaatggagattaaggagcattattttgaggtctgtgacattatagatggcttatttgtatcaatatttaaacacttgactgaaaactgcaatcaagaactcgagacctcgctctcgcagtatccatttgaacctctgaagtatctagacaaaacattgaagctcacttatgaagaaggagttcaaatgttgaaggaagccggaacagaaattgagcctatgggtgacctcaatactgaagctgagaaaaaacttggtcggcttgtcagggaaaagtatgacacagattttttcattatgtatcgatatcctttggctgtgcgtcccttctacactatgccttgttatgacaacccagcttacagcaattcttttgatgtctttattcgaggcgaggagataatatctggagcgcaaaggatacacactcctgagctgttgaccaagcgtgcaacagagtgtggaatcgatgtcagcactatctcgacctacattgaagtcttcagctatggcgcgcctccgcatggtggtttcggggtgggtttggagagggtggtgatgctgttctgcgccctaaacaacatcaggaagacctcgatgttccctcgcgacccgcagaggcttgtgccgtaatttactgagtccaatgccctgagtttgcagcagagcgtactggttgttttgatgttctttgagcatcgaacatcgctaacttgcaatctcagctactgaagccccggttaccgtggttcagagttcctgttaaattcacaaagctacttgtatctattagattgctgaaaccagcaagtacgatcctttttgggatttgatctggtctaattgttgttaagtggaggtattgctctcagtttttttgtgctctgtttgtcggcatatgccaagagctagggcttcttaagttctaagtttttagacgagtggattccttttttttaagagccggcaaaagttctgccctgcacctgttaaaaatagatattaccctgttccaattctaaataatatgacgtgtcgccttctagatatttaaaaaaaaaaaaaaaacaatatgtctagatacagatagtaaagtaatgtatgtctttataaagagagaagaattgtgctgcg

SEQ ID NO: 9603 - DNA, 936 bp, Zea mays
gtcatattctccttgctcgatgatttgctggggatcagccagaaccactcccagaaggactacagaaacatggaagggtcacttgtgctcgccatgaagctggttgcgaaggtatacctccagctcttgccggaccttttcggcctaagcagtttctgcaagctgtggctgggggtcctgagccggatggagaagtacgtcaaggtcaaggtccgaggcaagcggagcgaccggctgcaggaggtggtcccggacctgctcaagaacatcctgctcgtgatgaagagcaagggcatccttgcgaagaggagcacgatcgggggcgacagcctgtgggagctgacgtggcttcacgcgaacaacatctcgaccagtctgctgcctgatgtttttccaagccaggagtacgagcaacagagcagcaccggtagcccaagagggcccagtcctgttgaggcgtagcggtcaatgttttaacttgtgtgcgaccgtgtgtgtatgttttatttgttttactaggtttactactgctcgtgccctaatccattgaaagtgtaaggtttcgatattgtgattgcgtttcgcctccacggcaagtactatagcatgtgccctaatccattgaaaaacatgcttatgtttctgtgaattatttagttactagtccataatcctatcagaatgctcatttttgctaggaagatgtcatgatgtacatctgaatataatataagaacagaacttcaacgggtaacccaaccgattagtttattttggctcagattttgttcactttcattttgtccttgctcacgcatcaggaaaaactttccaaggtaaactttccgattaatcacttattccaaaacacgtttaacttagaggtttaacttagagattttttcgagacatgctttaaaaagatatatcttatta

SEQ ID NO: 9604 - DNA, 1782 bp, Zea mays
  misc_feature (1592)..(1592): n is a, c, g, or t
atcccgctcggctcagcgccgcccccgccgccgctccccgttcccgtcaccgcgccgccggccgccaggatcgcccgccccaccatcctggctcatcagtcctcgccgcgagccccgtgcctggaacgccgcttgcgctaccacgccgcggtcccacgcccgctcccgttccagcgacagggggttactgagacgagatcaaccgtaacctgactgactcactgacggccttgcactctcagcaaacccgtggcacaagtgggcaaccggggaatcagcttgagccttcgctccaaacctccatggaggcggaggccaggaacatccttgaacgcgccgcggagtcttccttcccaccgctgcacgccgtccaccacctcctttccgtcggggtctgtgtgcgttgcatccttcgcctgctcggagcctatagcagtgcctgctcatatgcatgtcttacggcatcagttttgcattcgttccttgaagaacacgatgagtccataaaaggagggtcctgtccatgtctatcgatgaatgatgcatattgctctgtctgcttgggagtattgctcccaaccttccatcgaaatgaaggtctggagacacctaatggcatttctcatattgacaacatgtcttcagtgatatctcaagcagtgcacggggagagttaccaagttgatgagttttctctagaaatttcactaccgccggttatagccgccaatgagcgtgcagttagattatatatgaaacaaaaatatggcaatgagaattggttcaaggacaaaatgtttgcacaacaaacaatgtcagtgaaggaagccttgcgacttttgatagcaccagcactcgagaaactaatgaatgctaaacatggtaacaattcatttagaatccgcttaacatatactcatggtgatgcttcacaaaagcttcatagtttattgccaaatgagcacagccgtaaaaggaaaccagattcaagaaaaggaggtgatgcttctaatgaggcccataaaaggaattcagcagatggcaaccctatacatacaagtgaatcagattcattcatctacaagagtcttgagggcatccaagatcaagaattctgtaatgcatttcagttgcctcctgaaaaggtgttcaaaccctgccatcttttaatatcgtgcttgagatcacctatatatcttggtggaagatatttgaagctttcaaggaacgtcagtcagtcatgttggataatagatgatgagagaatgggtgaagcttcagttgaggagataattggggagaatgttcgtgccatctgcagaggtgatagctgcaagttccatgctgctgggagagaagacattgatgtacggatgcttggatctggtcgtccatttctagttgaagtactgaatgttcgatccattccatctgaaactgaagttcaacaaattgaagagagaattaacaactctgaaaagaaatatgtcatagttcgaaatctcaagttggtagataatgaaatatggaccatgatgcgtgaaggagaagcagagaaacagaagcagtacactgcccttatatggacttcntcgtgatctgacagatgatgatcttcataatatttctattatgaaggaaatggaaattgtacagaagaccccaataagagtacttcatcgtagaagccccttagagcggaagcgcatcatacactggatgggagattgaggaaatcacaggcagctcaaactactacttgctgcatctatgcacacaggc

SEQ ID NO: 9605 - DNA, 1305 bp, Zea mays
ccgggccaaaagtctctgggaaatatatttgtgcacaaaggcatgattaagcaggggtctgtagaggttggcaaggaagtagatgcttctgttgatgcaaaattgaggcagggggctaaggctcatcacactgcaacacatctactacaatctgctcttaaaagtgtagttggttcagaaacttcacaggctggttcccttgtggcgtttgaccatctccgatttgacttcaatttccatcgtccactttctgaagaggaattaacaacaattgaagcacttataaaccaatggattggcaatgcagcacatgttgagacaaaagtcatggctttgcaagatgcaaaaaatgctggtgcgattgcaatgtttggagaaaaatacggtgaacaggtcagagtcgtcgcggttcccgggatctcattggaactctgtggtggtactcacgtcagtaatactgctgagattcgtggtttcaagataatttcagaacaaggaatagcttctgggatcagaaggatagaagcagttgcaggtgatgcttttgttgactatgtgtgtgctcgggacaactacatgcggcgcttatgcttatcccttaaggttaaggctgaagatgtgaacagtagagtagaaacaattcttgaagagctaagagcaaccagaaacgaagcatcatctctacgcagcaaaattgcagtgctaaaagcagcttctcttgcaagtagagctacaactgtggagccccagaatgtcaggattgtggtcgagaacatgggtgatgtagacgcagatgggctgaaaagcgctgcggagcatctcatagacaccctcaaagaccctgctgcggtgattttaggatcaagcccaggggatggtaaagtcagcctggttgctgccttcagccctgcaatcgtcgaaatggggctgcaggccgggaagttcgtgagtggcatagccaaactctgcggcggaggcggtggaggcaagcccaatttcgcccaagctggggggcggaagccggagaacttgccggatgcccttgagaaagcccgagctgaaattgtggcaggggtatcaagttcgagctgattctccgctgcctcacacctgatactggaagtatagggataggattcatatgaaatgtatgtgtaattatcattggcattctaagcgaaaacacttttgtattctccctaccttgccgtgtatgctctctgcagatgacggaacaaattttgtcgcttgtaattgtaactagtggccgaacagaacggggaaaagataaaatcttcacacagc

SEQ ID NO: 9606 - DNA, 1855 bp, Zea mays
gggtaccctcgctcgaggccggccggggtccttctcgtaattattgtcggcagttccgactcctctgacaatccatctaccacgcgcggccaaactcctgttcttccacctgctggctgctcctgcctcccctgcgccccaaacccacccgcctcgccgtccccgcaggccgcagcctgctctcggctcccgccgccgtctaccgcgtcctgcggctgcggtgttgcgtcacctcgggttcgccttaacttccacaatcctcgccgtcctggtgctccgccgcccctccctttgtactcgcgctggagctgcagatccaccgcgacctggcgaccaattcctcctcccgctgaagaattggcgaccttggcctccgcccccgcggcgcggaggagtcaactgtggtagcaaccaccgcggaggctgcaagccttcggtaagggaggaaagttgacttgttggaagccggtccagggccgcgatgacgtcgaccgccgccggcgcgtcgtcgtcggcggcgaagagcgagtcctacctgcgggccgacaagatcgacctcgagagcctggacatccagctggagaagcagctggccaagacctgggagaagcacaaggggtcgtacaaccaggggcccagggaggactgggagatcgacctcgccaagctcgagattcgctacgtcatagcgcagggcacctacggcacggtgtatcgcggcacgtatgatgggcaggacgtcgcagtaaaactattggattggggtgaagatggctttgcgtcagaaactgaaactgccacactgcgagcatcatttaagcaggaggttgctgtctggcatgagctcaaccatccgaatgttacaaagtttgttggtgcatcaatgggtactacagaccttaagattccagccaatagttctaacagtggtgggcgcactgagctgccgccaagagcatgttgtgttgtggtcgaatatctcgctggaggatcactgaagcagtatttaataaagaacaggcgaaggaagcttgcatacaaggttgttgttcagatagcactggatcttgccagaggattgaactatctacattcaagaaagatagtacatcgggatgtaaaaactgaaaatatgctgctcgatacacagcgaaaccttaagattgctgattttggtgttgctcgtgttgaggctcagaatccaaaggacatgacaggcgcgactgggacacttggctacatggccccagaggtgcttgaaggcaagccatacaacagaaagtgtgatgtctacagttttggcatatgcttatgggaaatatactgctgtgacatgccatatccagacctcagttttgcagacgtctcgtccgccgtcgttcaccagaacctgcggcctgacatccctcgctgctgcccaagcccaatggcgaacatcatgcggaagtgctgggacgcaaacccggataagcgccctgacatggacgacgtggtgcggttcctggaggccctcgacacgagcaagggcggtggcatgataccagaaggccaggcaggcgggtgcttgtgtttcttcagagcccgtggtccttagaaccaaccaaccctttccagccatcctctacttgtctctgccctactacagtattggagccagatgtaggcctttgttgttcatcggataggggattgcagataacttgatgacaatctttgtgattggttgacacttgttatacgttctatagtgatgtgaataccagtgaggagtccataatacagagttatttcaaccacaaaaaaaaaaaaaaaactggtcggtttgtttgggaaaaaaaaaaaaaaaaaagcggcc

SEQ ID NO: 9607 - DNA, 882 bp, Zea mays
cattgggtacctcgaggccggcctggatccagctttgctttgtagttgtagcgctagcagcttaattggtctctgagctgaggtgcactactagctagctagtcgtgcaggaagaggaaggaatataatggctgagcgggaggtcgtcgaaggcgggacgacgacgggaggcgggctgtggcggaggtatgcgccgcacgtccagatggtgctggcgcagctgtgctacacgctcatgtacttcatcaccgaggccgccttcaaccaggggctcaacccctacgtctacatcacctaccgccatctgctcgtcgccgtcctcatctggcccttcgcatactacctggagaaggggctgaggcctaaaatgacgctcatgctgttcgtggagatattcgtgctctcccttctcggggtgagcttaactctgaacatgtacttcgcgagcctgaagtacacgtccccaacgttcgtcacttccgtggtgaacaccatcgcctcgatgacgttcgtcatcgccatcatcctcaggatggagatcgtggacgtgaagagcctccgcggggtcgccaaggtcgcagggaccccgggggcgcccgccgcggtgaccaccatgactctgtacaaaggagcggccatcacgagcctctggaagtcgcctgttcagatcgccggcagcggcagcggcggcggaggcgtcgcccacgacagctgggtgaaagggtcagtcctcgcagtggccagctgcgtgtgctggtccatctggtacatcatgcaggcgtcgtctctgaagagtacccggcccagctctcgctgacggcgtggatgtgcacgggtcggggcatccagtcgaccgtggtcacgctgttcatgcagcacgag

SEQ ID NO: 9608 - DNA, 503 bp, Zea mays
gatccagctttgctttgtggttgtagttgtagcgctagcttaattggtctgagctaggtgcactactggctagtcgtgcaggaagaggaaggaatataatggctgagcgggaggtcgcagcaggcgggacgacgacgggaggcgggctgtggcggaggtatgcgccgcacgtccagatggtgctggcgcagctgtgctacacgctcatgtacttcatcaccgaggccgccttcaaccaggggctcaacccctacgtctacatcacctaccgccatctgctcgtcgctgtcctcatctggcccttcgcctactacctggagaaggggctgaggcctaaaatgacgctcatgctgttcgtggaaatattcgtgctctcccttctcggggtgagcttaactctgaacatgtacttcgcgagcctgaagtacacgtccccaacgttcgtcacttccgtggtgaacaccatcgcctcgatgacgttcgtcatcgccatcatcctcagg

SEQ ID NO: 9609 - DNA, 2211 bp, Zea mays
accctgcaacggccgaggccacaggccacgcacgcaattgcatagctttccagatacaaacgctggcccaaaataaaccgaaagcatcggcactgctgctagtgcaagtctaccaggagcactgggatacatttcagcttcatctcaccgattaggagaacacaccatcagttttcttgcatctttctttttttgacacaagtaaacccagcttttgtagaaagcaaacagctagcgtctggattctgtaaccatctcctcctacaatcgtatagcgatttgcccggcacatccaagccgacgcagacaccacagcagcgacaagttccctgctgctgcttgttcaggaagccaagggaggagaagaggagagcagagcagagattcggaaatgctatgtcgccgtctggctgttgctgtgcgcgcgttcaggccgccgtagctatcacctgtcaggctatcgcgtactacgtccacggtgacagcaccatgcatgcatcgggtatttttattcaggcagtagtggcctgcgtgactgggtgggagcggatcgagcagaggggtagacgaagacttctcttcaccatcccacggcacggcacgtcaacacaacaaggcacagcacaggctgcctacctgcctatatattccggcccccgcgcccgcccccgacgagcgatccagctttgctttgtagttgtagcgctagcagcttaactggtctgagctgaggctagctagtcgtgcaggaagaggaaggaatataatggctgagcgggaggtcgtcgaaggcgggacgacgacgggaggcgggctgtggcggaggtatgcgccgcacgtccagatggtgctggcgcagctgtgctacacgctcatgtacttcatcaccgaggccgccttcaaccagggtctcaacccctacgtctacatcacctaccgccatctgctcgtcgccgtcctcatctggcccttcgcatactacctggagaaggggctgaggcctaaaatgacgctcatgctgttcgtggagatattcgtgctctcccttctcggggtgagcttaactctgaacatgtacttcacgagcctgaagtacacgtccccaacgttcgtcacttccgtggtgaacaccatcgcctcgatgacgttcgtcatcgccatcatcctcaggatggagatcgtggacgtgaagagcctacgcggggtcgccaaggtcgcagggaccgtggtgtcgttcgccggggtgaccaccatgactctgtacaaaggagcggccatcacgagcctctggaagtcgcctgttcagatcgccggcagcggcagcggcggcggaggcgtcgcccacgacagctgggtgaaagggtcagtcctcgcagtggccagctgcgtgtgctggtccatctggtacatcatgcaggcgtcgtctctgaagaggtaccccgcccagctctcgctgacggcgtggatgtgcacggtcgggggcatccagtcgaccgtgttcacgctgttcatgcggcacgagccggaggactggcgcatcggcttcggcgtcaagttctggagcatcgtctactcgggcctcgcctgcaacggcttcacggtgttcgtgcagctctggtgcaccgagaagaaaggccccgtcttcgtcaccatgttcaaccccctctccaccatcatggtcgccatcctggcctacttcatcttcggcgaaaacctatacgtcgggagcgtcgtcggaggcggggttgtgattctgggcctctacatgctgctgtgggggaaggagaaagaccaggagcgcggcacgggcaaagagcgggaacagctcgagacggactgcgagaagcaggcgaagaaggtcagcgactgtgtctacgaagcgcccaagacgacgaagtgaagcacggcgcgcgcgcatcagacggtggtgactgcggccggccatgggcggcagacggctcaatcaagcgccatgccgtgctccagttcggttctatatttgtgatgtacagagtcaccgatccggtctcgcctcatcagctatgtatatatatgcacatgcaatgcggcaacagacagacgtctggctcagtctgtgaaaccgtgaacctgccctgaagctggagttttttggaaccgtaatatcaccaacactgggcttctgaaaatcggtatcccgaacaacgcaattggaattttagtattataatc

SEQ ID NO: 9610 - DNA, 1713 bp, Zea mays
ctggtaataatactatcggctttgtcagtcttccattcacagataatgtggtttgttaggctacactatcttgatctggttactagctgtgacatgctagcagtcatgtactgtcctccacaatgtgttggtgtctaaaactgaaactcgcaaccaaaattctggagttaatgcacaattaagcttggctttcaagcaacggagcataactgcaggaaagatggaaatatcaggcctctatacttttgaataaaaccacttgcaccattctttcgcagagaaggtaaacggattgcttcatgactatgcataagccaaaaaccagtctgtgtcatcattcacttaatgaagtgtactgacatgaactgaatttgccttttgcagtatttggacgaaaataagcaacttattttggccatcctggaaaatcagaacttagggaagttggctgaatgtgctcagtaagtatctttcggaactattttgtgagacacctcatttttccgtactagtttatatctatcaattgataagggtgtctgaattagtttaaccgtaatgctgtctaaaattctgatcctttgacgtgttaagtcattttgccgtcattttacatacaagtttcagctgttagttgagaaggatgcatgggcatttacaattcataatattgatgcattaaaacttaaatgatatgtttgtaattagtaccttcaatctttttgatgacttaaccgtctcatgtgtacttgctatcttcttcacaatgtatttccaatagcgttcatttcgtgaacttgtaggtatcaagctcaacttcaaaagaacctcttgtacctggctgcgattgctgatgcccaaccccagcctccgcaaaaccctgcaggtcgccctcaggtgagccggccgcgctgtgcgcctcagaagaaatcctccacttgctgccctttgctcgagtcacttaaacctccattgctttgagtacagatgatgcagcctggtatagtgcctggtgcggggcattacatgtcacaagtaccaatgttccctccaagaaccccattaaccccacagcagatgcaggagcagcagcaacaacaacagtttcagcagcagcagcagcaagtgcaggctcttacatttcctggacagatggtcatgagaccaggcaccatcaacggtatgcagcagcagcagcctatgcaggctgaccctgcccgggcagcagcggagctgcagcaggcagcacctatcccagctgacgggcgaggaagcaagcaggacaccgcgggtggggcgagctcagagccttctgccaatgagagccacaagagcgccaccggagcagataccgaggcaggtggcgacgtggccgagaaatcctaagtcgagcagcctgggcagggcgaaaaataatgccttgtatactagcaacgaaagaaaaaaagagtctttgaatgacagctactagcccctaccagtttactgtgtggtttagatgatgtagaacaaagtttagattggtgatgatgtaaaccgtccaatattgatactgcgttcttacattgctgtagtcaattatatgaataatttcatataagcatgttgccctagtggattttacctatgttttatgagctgatgtaaccaaaaacactgagcagcttttaattcagtatggcaattctgcagagttttcaccaaaaaaaaaaa

SEQ ID NO: 9611 - DNA, 1103 bp, Zea mays
gcacgaggctgcggcacaagtagcttcggctcccggcagtaccgcaactcctcttccaccaaactccagaggcatccaacagcaggcgaggaaagcaagacacgcccacccacccgctccggcagccagcggctatgcagcagcagatgcccatgccgccggcgcccgctgccgccgcggcggcggcgcccccggcggccggcatcactaccgagcagatccagaagtatttggacgaaaataagcaacttattttggccatcctggaaaatcagaacttagggaagttggctgaatgtgctcagtatcaagctcaacttcaaaagaacctcttgtacctggctgcgattgctgatgcccaaccccagcctccgcaaaaccctgcaggtcgccctcagatgatgcagcctggtatagtgcctggtgcggggcattacatgtcacaagtaccaatgttccctccaagaaccccattaaccccacagcagatgcaggagcagcagcaacaacaacagtttcagcagcagcagcagcaagtgcaggctcttacatttcctggacagatggtcatgagaccaggcaccatcaacggtatgcagcagcagcagcctatgcaggctgaccctgcccgggcagcagcggagctgcagcaggcagcacctatcccagctgacgggcgaggaagcaagcaggacaccgcgggtggggcgagctcagagccttctgccaatgagagccacaagagcgccaccggagcagataccgaggcaggtggcgacgtggccgagaaatcctaagtcgagcagcctgggcagggcgaaaaataatgccttgtatactagcaacgaaagaaaaaaagagtctttgaatgacagctactagcccctaccagtttactgtgtggtttagatgatgtagaacaaagtttagattggtgatgatgtaaaccgtccaatattgatactgcgttcttacattgctgtagtcaattatatgaataatttcatataagcatgttgccctagtggattttacctatgttttatgagctgatgtaaccaaaaacactgagcagcttttaattcagtatggcaattctgcag

SEQ ID NO: 9612 - DNA, 876 bp, Zea mays
  misc_feature (691)..(691): n is a, c, g, or t
aaaaagagacctgggcaggacgacacaggcagagccgccggccctcgcttcttggtggggtctagtttctttctcgcctctgcctgtgcctgctggtggtaagtaataacagcgacacggtacccacgcgcggcggcggcggcggcgacgacgaagacgagttcgtgctggagcgacctcgacttctgcaagaagaccaagaactggtactgctacggcaaggcggcggcggagcgggcggcgtgggaggcggcggcggcgcgcggggtggacctggtggtggtggtgccggtgctggtgcagggcccggcgctgcagccggtcggtgaacgccagcctgatgcacgtgctcaagtacctgaacgggtccgccaagacgtacgccaacgcggtgcaggcgtacgtgcacgttccgcgacgccgccgacgcgcacgtccgcgtcttcgaggcgccccgcgccgccggccgctacatctgcgccggggccgtgctccaccgcgaggacgtcgtccgcaccctgggggggtgcttcccgggctaccccgtcccggagaggtgctctgacgaggtgaacccgaggaagcagccgtacaagatctccaaccagcggctgagggagctgggcctggagttcaccccggcggggcaggcgctgtacgacaccgtcgtgtgcttccaggagagggcgtnctcccttttcctgtgcccgccccaacgccgggttccccggcgccttggctatgtggtggagctgggcccgggaccccccggggaaaccttgtttggtccggccaaccggttttttttacggggggttggttttgttctttctgcccgtttggggttttttggggggggggggggcttctctgttg

SEQ ID NO: 9613 - DNA, 1482 bp, Zea mays
aaaaaagagacctgggcaggacgacacaggcagagccgccggccctcgcttcttggtggggtctagtttctttctcgcctctgcctgtgcctgctggtggtaagtaataacagcgacacggtacccacgcgcggcggcggcggcggcgacgacgaagacgacatgaccgtcggcgacgacgcggcggcgccggggcgcgggcagacggtgtgcgtgaccggcgccggcggctacgtcgggtcgtggatcgtcaagctcctgctcgagcggggctacgccgtccgcggcaccgtgcgcaaccctgacgacgcgaagaacgcgcacctgctggcgctccccggcgcggcggagcggctggcgctgtgcaaggccgacctgctcgactacggcgcgctaagggcggccgtcgccggctgccacggcgtcttccacgccgcgtcgccggtcaccgacgacccggaggagatggtggagccggcggtgcgggggacgcggtacgtcatcgacgcggcggccgaggccggcacggtccgccgcgtcgtcctgacgtcgtcgatcggcgcggtggccatggacccccgccgcgagccggacgccgtcgtcgacgagtcgtgctggagcgacctcgacttctgcaagaagaccaagaactggtactgctacggcaaggcggcggcggagcgggcggcgtgggaggcggcggcggcgcgcggggtggacctggtggtggtggtgccggtgctggtgcagggcccggcgctgcagccgtcggtgaacgccagcctgatgcacgtgctcaagtacctgaacgggtccgccaagacgtacgccaacgcggtgcaggcgtacgtgcacgtccgcgacgccgccgacgcgcacgtccgcgtcttcgaggcggccccgcgccgccggccgctacatctgcgccgacgccgtgctccaccgcgaggacgtcgtccgcaccctccgcaagtccttcccgggctaccccgtcccggagaggtgctctgacgaggtgaacccgaggaagcagccgtacaagatctccaaccagcggctgagggagctgggcctggagttcaccccggcggcgcaggcgctgtacgacaccgtcgtgtgcttccaggagaagggcatcctccctctccctgtccccgccccaacgccggcgtcaccggacgcctgagctagctgatgagctggcccagaaccaacgaagaaacatgtttggcacgcaaaccgctattataacagtcgctgcttcgatcattctgccgctagagatagaatgtggagtgtgtgctactcgttgtgggcgtaagagtgtcagaagagtgcagcagtaactatatcgatgcgactttttatatgttgctatatcatgtgtgacaatctcctaataataaatatatggagtatcgtcctacgtttctgtggctatgtagttcaccgggcttcttccggtgacaataattgtctgaa

SEQ ID NO: 9614 - DNA, 3997 bp, Zea mays
  misc_feature (258)..(258): n is a, c, g, or t
  misc_feature (3420)..(3420): n is a, c, g, or t
  misc_feature (3794)..(3794): n is a, c, g, or t
atctcagtgaaaaatgatgctttgatgttctctctcccggtgaagcatcaatttaatgactgtgactaccaatgtttctatagtcatcgaagctacaggcaactaagtgtataaaatatatattttaccagggtaactggttgtcagtacgaatctttgatttccacaaatctttacgacgaaggtagggttagtccgtgcttgcaaatcatttacgcatgactctaaaaaccatgtatgtggtctgtcagatgacanaaaaatgtgcaaacagaagcatgttctgagaagcagaaacaatgtgaaattatcaaagcataagacatgtaacaatagtataatgtataactgtctaaacaatgattgctggtatacatttatatataaaccaataacatcatcatgtctaaaaatctggttaagctcaaggagacggcgtcggcgaaggagcagaagcaggagcgtcgtgtgcctcaccggagctctggagctgtgacatggcacgacgagggttggcacggtgtacctcgcacagctctgaaaaagctacgcctgccattgtaaatatacatatatgtttgaattagttcaggcatgttcccaattactatatatataggcaccaaaacttataaagtaatactgagggtgttcctttgtgtagagcaccattttactgttgtactagcagcagcatttggcagaagcagccacaactttagcacaagtgttcaaatttagcttttgtaacgcgtctatggagagccaacattcctaactttatagattctttaattaatttagatatatattgcaacctttacagaactaaagaaagagtaacagtctttgtgttttactcaaaaatatatactaattccgttcacaaatatatgacactgttgatttttttaaaaaaaactttgatcactcgttatttttaaagttaagtacaaactaccttaagtgataaaataaatcataaaaataaatgataattcattattttttaaataagacaagtagtcaaagtttttaaaaaagtcaactatgctatatatttataaatgtagagagtacgaagtactgctgtgtgtctgcatatgctgatgcaatgcagaaggacggatctcagaacatgtgcgtgtctacgcgatgatgatgatgatgatagcaaaacaagttcttgcaagacttgcgaagccggccggccgtgttcggtattccgtggacgcattcgacacccacatggagctagcaccaaatggcaaatgccagcttgaaaccaaataataaatggcatatccggcctgaaattaagatatgccttgccggccggtcgattcgtgtgcaaggccgcatccatcattcatccttataaatgccaagctccacttgacagcaaaccacgcgcattcgcttgccctccctccctctgtttacatctaattcttatcgatttagctatagcaggtctcgatcggcggccatgagcggtagccgcagcaagaagtcgtggccggaggtggaggggctgccgtccgaggtggccaagcagaaaattctggccgaccgcccggacgtccaggtggtcgttctgcccgacggctccttcgtcaccactgatttcaacgacaagcgcgtccgggtcttcgtcgacaacgccgacaacgtcgccaaagtccccaagatcggctagctagctagctagaccgaatcgttttaattagctaatttctttctttcataaataaaagtcctctctcgtacccggactgtgatgttttcctagttgtctcgtacgtgttgtttctgtcttaatggatgccatggctcccgcgcggcctccatcgtgaagagattgaaataatataaaactacatttgaaacgctgttaatatatatagtcgtcatcttttgactggaaatgcaagcagctcaacaaccgcgccacaagttcacagcactattaatgtacggatcgagtgcgtggttacccttaccctctccggcagcgaggttggcgtagaggtcgacgatgttggggcatccccggaggcaggccgcagagcagacggcgccggcgacgcgcgggtcgaggagggagtcggaggagatgccgacggtggcgcggtcgacgccgcacgcgcgcacgcacgcgtcggtctccaccagccccgacagccgcccgtccgcggccaccacctccgacgtccggcactcgtactccgtcggccgccccgcgcagtgcgtggtctccagcacgcaccgccgcgacgtcgacgacaccgcgaacgcgcacacctccgccgtcagctgctcgcacaccaccctcgcccctgccaggaaaccgaacagccagcaacacaacaagagtaagaagaacagcaggccgtgctagctagctgccggacatataccaccatggtccatggctaccgtcgtaccaagtgcagaggagaggagaagcgacacggagaagacgaaagccggaagctttgcgtgcaggacggaagccatgatggatacgcgctgatgctgctcgagctggtggacttgagcttaagacttgtgctggggtgaacgatgtatatatcagtagactagaaggggtttaaagctgtgccggcccgtgttcaaagactgcctaacatctccggtttgagtcaagctgattgtcgttacctccttcgttctttgggtttccttgttgtaaacctaatacaagcgtttgtgcgtcgtcggaacaggaaacaactattaaatatatttgtaagtttcatttatgtttaaatataaagtatagatccgaccccgactaggcggggatagggatgaaaattccaccgcggggatggcggggtggtgatccaaaatttaatggggcgaggacaaggataaaatttccccctagagatatgagggagaccctaattaggagttagaccatcttcttatgcggactatgaaggttgaatccaataaatcactttaatatgatctcatataaatatgcaaaatcatcactcactagctttaatccatttttttattcggttaccgctcacccacatgacaatccttgtttatctatgtatattataatatttctactcaacaattaatctccattggttccatgtggggattgggtacctagtggggatggggatgaaaccctccccattaacactgttgacatccttaatgtgtaaccaatcatggagccactaagggtgctttgtcttcctgttccctatcgttattgtcctatattaaccactaattttccatctttttctcgtattcgccccctctcgattcttccgcaccaccatagagcacatcgacattccccgccgcaagggcaacaacaaccaagggagaggaggaccggctatagcgttggtgggcgacggngcgtcaggggacgacggggagggtggaggggacgatgttggggtggcacggaggccgcacactgcgaggcactggatctcaaatttagttttgtattagttgttggcaaataacttgtgagatataagtcgatgataatatatttattacttattttatgtaattgttgtatactaatattttatcgaatatttatgtgtcgttgcaacacatgaacattgtactagtgaaaacagaaggtggagtaacatgagacaccaaaacaagagaaaatcggaaaaacaaacgatgtaaaggaataggagatagaaaacaaaaaaagaaaattggaaagaaagggataaaaaaacaacaatgcagacgaatctatatgnggttatatgggtcggcacgagacacgaccattttagcacgacacaggcattgatacggcgcgatagtaaccgtgctcaaggtggcacgaggcccatcatagttcgtgcttgggcttgctacaagcccatttgacgacacgagcatggttcgtttacagtcggccaatttgacccaatactaaacatgaatagcccatcaggcc

SEQ ID NO: 9615 - DNA, 792 bp, Zea mays
caaaggtcaaattgttggtatccatcagagacctggtgattttgcgacctcgggccgcccgggaaaggctgctacaaatgttcgttccaacaaagaaactacagtggttcttgatgaacctttaagctacagtttggatgactgcatagagtttatccaagaagatgagatagtggaggttactcctgcaagcatccgtatgtgcaagaacccaaaagtctcgaagaaaaagtaacataatcgcatccatttgtcgtcaatgcatcttctacacatagaagctgcatgctccgttgccaggtctcgtatgagtgacggctgcacggcgtcctcctcaagtcagtaatcaggatatttttggtggtctacagacaaagactaaaggtcgccagattaagatagaggattatatggcagttttgtgatgaataaatcagccgatacctggagtagtattatttggccacggataaggcgggcactgtttctcatctactcccctgttcttttttatttatcctgttttagttcaaaaatgaactagacgacaaatattcgagaacagagttagtattacacatatattgtgtaggtcatacgtaggactataggcattgtacacgattctttcggcgctagtaaagaccggaacaaagctttagcaaatggattagcacacaactgctgctacagactcttatttatttgtaattcaagccagtctacaagttgaaacaaactcctgtgcaattttgcaattttgaacagaaaaaaaaaaaaaaaaaagcggcc

SEQ ID NO: 9616 - DNA, 3391 bp, Zea mays
tagaggagataacaagtttgttgtttgtttataaaataaaacgataatactcgtgtataaatattgagccaaatccgtaccttaaaggctagttcggaaacttcatttttctaagggatttctattttctaagggaaaataaaataatttttcttagaaaaaaaaataagttggaaaaattgagttctcaaactagttttaatggagtaaaaatctatcgggtttcaggttttgttagccattgcctttccttgttccttttgtgctcaacaactccgtactcgttctcttttactagcaaagacatattctttttttttcgagagaaaataataaacgatggaaggaatgccatgcatatactcatggtaaataaaatggaaaaaggcgataaataatttactcggcgccggcggccgacgtggcttcccttgcagcggcacactcacccgagacctgtagccggtggccgctatccgcgggggctccaccgccactcccgactcccgctcgccgcccgccttacaaaaccccacaaccccatccgcagccacccgccgcggcaccccctccaccaccggccaccatgcagacgcagaccctcatcctacgcgctggcccctccgcccgacgctccacgccgccgccggccagcaccgtgcacctcgccgcctccggaaggtgcctgctgcgtgctcccagctcgctccgacgccgaagaacccgctctctcagggcctctgcctctctcgagcaggtcaaggaagtcgccagctccccagctccctccgcagggaagagtagtcaagcaactagaagagatgtgaggaatatcgcaattgttgctcatgttgatcatgggaaaacaactttggtggattcaatgttaaggcaagccaaggttttccgagataatcaagttgtgcaggaaagaataatggactccaatgacctagaacgggaaagagggatcacgattctgagcaagaatacatcaataacctataagggcactaaaatcaatataattgatactcctggacattcagattttggtggggaggttgagcgtgttctgaacatgggggaaggagttcttctagtggttgattctgtagaggggcctatgccacagacaaggtttgttctgaagaaagctctagaatttggacatgctgttgttgtagttgtaaacaagatcgacagacctactgctcgtcctgagtttgtggtgactccagcccgggcgctatttattgaattaaatgcaactgatgaacagtgtgatttccaaacagtctatgcaagtggaattaaaggaaaggccagtctatctcctgacaatttagctgatgacctaggacccctttttgaggcaattcttagatgcataccagagccacgcgttgagaaagatggtgccctgcaaatgcttgtatctaatactgaatatgatgagcacaaaggaagaattgcaattggacggctgcatgcaggagaacttcagcgtggcatggaggtcaaggtttgtacaccagacgatgcttgcagggttggtaaagtgagtgagctttttgtttatcagaacttcagccgtgcccccgttgaatctgttagtgctggtgacatttgtgctgtatgtggaatcgatgatatcatgatcggggaaactatagctgataaagttacaggaacaccattgcccactatcaaagtggaggagccaacagtcagaatgtctttctccatcaatacatcaccttttgttggacgggaggggaaatatgttactagccgaaatctccgtgacaggttgtatcgcgagctcgaaaggaatttggctatgaaagtagaagacggggaaactgctgatacatttcttgttagtggcagaggcacactacatctcacaatattgatagaaaatatgcggagagaaggatatgaatttatgattggacctccaaaggtcataaacaagacagtcgatggaaaactactagagccttatgagatagctgctgttgaagtcccagaggagtccatgggatcagttgttgagcttttagggaaaaggcgtggacagatggttgacatggaagctaacgggacggagggaacaacattgctgaaatacaagattcctaccagaggccttattggacttcggaatgcaattcttacagcttctcgtggcagagctatattgaatacaatctttgacagctatggcccatgggctggagatcttagctcacgtgatcagggatccttggttgcttttgaagatggaagcactacttcttatgcacttcttaatgcacaagaaagaggtatgttgtttgtccaaccagggcaggatgtttacaaaggtcaaattgttggtatccatcagagacctggtgatttagcaattaatgtgtgcaagaaaaaggctgctacaaatgttcgttccaacaaagaaactacagtggttcttgatgaacctttaagctacagtttggatgactgcatagagtttatccaagaagatgagatagtggaggttactcctgcaagcatccgtatgtgcaagaacccaaaagtttcgaagaaaaagtaacataatcgcatccatttgtcgtcaatgcatcttctacacatagaagctgcatgctccgttgccaggtctcgtatgagtgacggctgcacggcgtcctcaagtcagtaatcaggatatttttggtggtctacagacaaagactaaaggtcgccagattaagatagaggattatatggcagttttgtgatgaataaatcagccgatacctggagtagtattatttggccacggataaggcgggcactgtttctcatctacttctccctgttctttttatttgtcgtgttttagttcaaaaatgaactagacgacaaatatttgagaacgaagttagtattacacatatattgtgtaggtcatacgtaggactataggcattgtacacgattctttcgacgctagtaaagactggaagaaagctttagcaaatggattagcacacaactgctgctacagactcttatttatttgtaattcaagccagtctataagttgcaacaaactcctgtgcaattttgaactgcggagtgggggcccgggccccccattacacgaatgggcccatagatttagaggtactgtaatggttacattagggctagtttggtagtccaaatactggaggggttaaaatcccctccttagggctagtttggaaacttaaatctccttggggattgaaggagattggagaggaaattagtttattttcacctcaatcttctccaattccgaaggggatttaaggttcccaaagtagcctttattcaaggagggattttagtccct

SEQ ID NO: 9617 - DNA, 3330 bp, Zea mays
tatcacacgtacaatggcactcgcaaatgggcttcaactttacaaatactagaaaacttggttagccgcccaggtcaaaagcgcccaacacaaaacagaatcagccgccttttaaaaaaaacagaactagaccacgacttcgtctctgcaccagcagaaacaaaagccaacttcgtcctccttataaaccagatgataattagcagatttttcgaataacttaaagtaccaattgggcttacccatagcaaatcaaatcaaatcaagaaatatggaactacaaacccgagggatggccagcacgtaactgttcagaagccgaaaaaccggattgatccgaacgagaagaacttggccccgtcccctcctcctgaatggcgacatcctcctccccctcaaatctctcctctttatctcccccagtccccctcctcctcgtgcgattcgccccgtgctcccctctcaaaaccctagccctaccacagccgcccctccatggctgcggatttccgcaccccagaccgcctccttcccgccacggctgaggagccgacgaccccgcagggccgccctcccagtccggtgcttagcagccccgccgtccccgacgctacccacgatgacctccgcttctggcagtacatgctcgccggctccgtcgccggcgtcgtcgagcacacggcgatgttccccgtcgacactctgaagacgcacatgcaggccagcgcgccgccgtgccggccggctctgtcgctgcgggcggccctgcgcaacgccgtggccggcgagggcggcgccctcgccctttaccggggactcccggccatggcgctcggcgcgggccccgctcacgccgtctacttctccgtctacgagctcgccaagtcggccctcaccgaccgcctcggccccaacaaccccgccgcgcacgccgcctcgggggtcgtcgcgaccgtagccagcgacgcggtcttcacgcctatggacaccgtcaagcagcggttgcagctcaccagcagcccctacacgggcgtagggcactgcgtccgcaccgtgctgcgcgacgaggggcctagcgccttcttcgtttcctaccggacaaccgtggtcatgaacgcgccctacaccgccgtccactttgccacctacgaggcggccaagcggatgctcggggacattgccgccgaggaggagtccctcgccgtacacgccactgctggggccgcagccggggcgcttgccgcggcggtcaccacgcccttcgatgttgtcaagacgcagctacagtgccaggtgaagatctagtctacttgatttgtaatctgatcaaagctctgatttttaatgctctgcaacaatattagagctgatctgagtgatttctgatggtttacccaccaaaagggagggaactcttataggatctagttatcctattcatctctaagattattggaaacagttgtgcgatgaagttagtagcctcttgtcatcttgtgttcgtttgatgtgctagtggtgattactgctctaaggatgcccggtggcactactgtggaagcatagtgacatagcaacaaaactattttagttctgccgccattgaacagtgagatgtaattttgagagcctgtttggaatgcagaaatttcacaggaaaaatgtagtatttgggaagaagtcccatgtttcaaaatgggatctgggccacatgtccgtctaaggactagattcatgttgtatcaagaagggcagacccattgcactgacgggagctgtctcagtgagtaactaggtcatgggtttgaagcagcctctccgaaaacacttgccacttatgtgggagtctccggcactaaaaaaaacttggccacgaagggaaagactgtcctcctggtattatattaagaaaagatcgaaacatggtcccgatcgagaaaatccccgacccccatcactagcaggtcgtcatcgtccactctgcaacgacccagccggagggtggcgcgtcagacgtaacccgagagcgggcggggcacgacgatagggctggaaaaaagctcgaagctcgcgagccgactcgagctcgaagcggctcgcgagccgagccaggtttttgagctcgttgaggcaacgagccgagccgagccgctctggctcatgagccggctcgcgagctgcacaaaaataattaacctacacaatgatgatggatattggataattttatagatatatgactcgtttcttagtctttaatgatgtatatataacaattataatttaaattacttgtaatgtcatgtgatgattatttatttcatatttatagaccattaattcactatataatgcaatattagttttcaaggtgcagctcgcgagccgagcctctttttacagctcggtgagtaggcgagtcgagtcgagctggaggtgctacttggaagccttaatcattacgctagaggcccttttgcagcctccggcactaggtctatcttttttattcatgttgtatcaattttggatataagaattaagagagatcaatgccaaagcgataggtataattgtttgatgctatagagatgtgacctgcaagtttgtgatgaaaatcaaagggggatttcctagaaaccaactttgaagttcaaactttgggccttcaaatatgtttgactaacctgtctagtacttaacacaacatcaatttagaattctagattgcagtctccactgattgtgtgttctctttctagtgtactcctttgtttttaccctggtgaaatatgttgtttggttgtcgtatcacttgcggcatgtgttcaaagaagtttaaatgtatgattgtctggctatgtttaagttaaacattcttgttaataaccagttgttcttgttgacttatccgtctgtgtttctctttcggtagcttacgctttctacattgattccaccagcttccatgatctacattgattatgctagcttaaacatgatataagaaaaaaaaaacaatggatacacatgaaaagaacatgaaaacaacctgggaaggcttttcctgtaacatatagaccactgtgacttgtttgaatattgttttaaatgctttttatttaatttttgaattgtatactgaaatcatagtgtttcctattctactggaactggaagttatcaagtgcaaatgcaccattaagtggatcatgaaatgtttcttggtttgggtgctgcaaaataaataattttctgacagataaagaatgctggtaaaagacgtgatttggtagttatcgtttgcaagcactcgtgattagcttccgc

SEQ ID NO: 9618 - DNA, 2271 bp, Zea mays
gggtttatatttgaacccattaacaaacctattagtatataaaaattagctcaaacctatatcctaatatagtaaaaatacactggttttaaccagcggatacccattgctatttttatagaccatgacttctctgcagcagaaacagaagccaactttgtcctccttagagcaactccaaaaggatgttaaacattttaccctaaaaattgattattaagagcaggctaaaaaaatttaagagtgaattatgatggatactccaacagttcatttaaatgtgacatgtggcgcaatctgtacagtcgtcggaggccgtggatgatctgatacgtagaggagtggattggggagggatggaacacaccaaaatatgagggagaggaggctgtggacgcgggacgctaatttttttggaggaagaatgagggagctgttggagtaggaaaaatcactattattgactaatatctgttttagggttaatttacacgttcttttggagttgctcttacaaaccagataatatttagtattttttgaataattaaagtccaaattgggcttatacacagcaaatcaaattaagaaatatggaaaaataaatccaatggccccaggacgtagctgctaggaagccggaaaaccggattgctcgaaacgagaaaaactcggggaagaaactgcgaaaggaggcaggatggatgcagcgagttcggtttgaccaccagctcctcttcctccccgtcccctcctcctgaatggcgacatcctccttcccatcaaatctctcctctccatttgcatctcctcctcgtgcgccccgtgaccccatcaaatcgcctcgccccgtgccccctgctcaaaaccctagccctgccgcagccgtcctccatggctgcggatttccgcacccctgaccgcctcctgcccgccgcaactgaggagccgacgaccccgcagggccaccctcccaatccggtgctcagcacccccaccgtccccgacgccacccacgatggcctccgcttctggcagtacatgctcgccggctccgtcgccggcgtcgtcgagcacacggcgatgttccccgtcgacaccctcaagacccacatgcaggccagcacgccgccctgccgcccgacgctatctctgagggcggccttgcgtaacgccgtggccggcgagggcggcgccctcgccctctaccggggactccccgccatggcgttcggtgcgggccccgcccacgccgtctacttctccgtctacgagttcgccaagtcgtccctcaccgaccgcctcggccccaacaaccccgccgcgcacgctgcctccggggtcgtcgcgaccgtagccagcgacgcggtcttgacgcctatggacaccgtcaagcagcggctgcagctcaccagcagcccctacacgggcgtagggcactgcatccgcaccgtgctgcgcgacgaggggcctagcgccttcttcgtttcctaccggacaaccgtggtcatgaacgcaccctacacggccgtccactttgccacctacgaggcggccaagcggatgctcggggacatggccgccgaggaggagtcccttgccgtacacgccactgctggggccgcagcaggggcacttgccgctgcggtcaccactcccctcgatgttgtgaagacgcagctacagtgccagggtgtgtgcggctgtgaacgcttctcaagcagctcaataggagacgtgtttagaacaatcataaagcgagatgggtattccgggctcatgaggggatggaagccaagaatgctgttccatgcacctgcagctgcaatatgttggtctacatacgaggcctcaaagtcatttttccaaaggttcaacgaggaaaggcggaaatagtctgggggcattacttttagacccatgtatttttttttcttgaagtcaatgtacttctatacggaagcattctcgctcagctgaatgagaagacgcagctccaggatacgtttgttggtgatccttgagcccaagagctgccagcggggaactgagatctgtctaatgaagatctgtctgtgcccctgtgttccttttcagataattcgatgtatttatttttctcagcctcggggtgaggaaataacactagaatattccttttccagtttgatcagtcacagtcagcaagcttatctgtactgttgtatggcctcctgccgtgtttcagatttttttatataattcaaaggctttggtttcgttgcaaaaaaa

SEQ ID NO: 9619 - DNA, 1532 bp, Zea mays
tcctccttcccatcaaatctctcctctccatttgcatctcctcctcgtgcgccccgtgcccccatcaaatcgcctcgccccgtgccccctgctcaaaaccctagccctgccgcagccgtcctccatggctgcggatttccgcacccctgaccgcctcctgcccgccgcaactgaggagccgacgaccccgcagggccaccctcccaatccggtgctcagcacccccaccgtccccgacgccacccacgatggcctccgcttctggcagtacatgctcgccggctccgtcgccggcgtcgtcgagcacacggcgatgttccccgtcgacaccctcaagacccacatgcaggccagcacgccgccctgccgcccgacgctatctctgagggcggccttgcgtaacgccgtggctggcgagggcggcgccctcgccctctaccggggacttcccgccatggcgttcggtgcgggccccgcccacgccgtctacttctccgtctacgagttcgccaagtcgtccctcaccgaccgcctcggccccaacaaccccgccgcgcacgctgcctccggggtcgtcgcgaccgtagccagcgacgcggtcttgacgcctatggacaccgtcaagcagcggctgcagctcaccagcagcccctacacgggcgtagggcactgcatccgcaccgtgctgcgcgacgaggggcctagcgccttcttcgtttcctaccggacaaccgtggtcatgaacgcaccctacaccgccgtccactttgccacctacgtggcggccgagcggatgctcggggacatggccgccgaggaggagtcccttgccgtacacgccactgctggggccgcagcaggggcacttgccgctgcggtcaccactcccctcgatgttgtgaagacgcagctacagtgccagggtgtgtgcggctgtgaacgcttctcaagcagctcaataggagacgtgtttagaacaatcataaagcgagatgggtattctgggctcatgaggggatggaagccaagaatgctgttccatgcacctgcagctgcaatatgttggtctacatacgaggcctcaaagtcatttttccaaaggttcaatgaggaaaggcggaaatagtctgggggcattacttttagacccatgtatttttttttcttgaagtcaatgtacttctatacggaagcatactcgctcagctgaatgagaagacgcagctccaggatgcgtttgttggtgatccttgtgcccaagagctgccagcggttgattgagatctgtctaacgaagatctgtctgtgcccctgtattccttttcagataattcgatgtatttatttttcccagcctcggggtgaggaaataacactagaatatttctttttccagtttgatcagtcagcaagcttatctttactgttgtatggcctcctgccgtgtgccagatttttttatataattcaaaggctttggtttcgttgcaacaaaaaaaaaaaaaaaaaaaaaaaaaactcgagggggggcc

SEQ ID NO: 9620 - DNA, 1496 bp, Zea mays
  misc_feature (1430)..(1430): n is a, c, g, or t
  misc_feature (1445)..(1445): n is a, c, g, or t
attgggtacctcgaggccggccgggaaaaaccggtctgatcgaaacgagaagaacttggccccgtcccctcctcctgaatggcgacatcctcctccccctcaaatctctcctctttatctcccccagtccccctcctcctcgtgcgattcgccccgtgctcccctctcaaaaccctagccctaccacagccgcccctccatggctgcggatttccgcaccccagaccgcctccttcccgccacggctgaggagccgacgaccccgcagggccgccctcccagtccggtgcttagcacccccgccgtccccgacgctacccacgatgacctccgcttctggcagtacatgctcgccggctccgtcgccggcgtcgtcgagcacacggcgatgttccccgtcgacactctgaagacgcacatgcaggccagcgcgccgccgtgccggccggctctgtcgctgcgggcggccctgcgcaacgccgtggccggcgagggcggcgccctcgccctttaccggggactcccggccatggcgctcggcgcgggccccgctcacgccgtctacttctccgtctacgagctcgccaagtcggccctcaccgaccgcctcggccccaacaaccccgccgcgcacgccgcctcgggggtcgtcgcgaccgtagccagcgacgcggtcttcacgcctatggacaccgtcaagcagcggttgcagctcaccagcagcccctacacgggcgtagggcactgcgtccgcaccgtgctgcgcgacgaggggcctagcgccttcttcgtttcctaccggacaaccgtggtcatgaacgcgccctacaccgccgtccactttgccacctacgaggcggccaagcggatgctcggggacattgccgccgaggagtccctcgccgtacacgccactgctggggccgcagccggggcgcttgccgcggcggtcaccacgcccttcgatgttgtcaagacgcagctacagtgccagggtgtgtgcggctgtgagcgcttttcaagcagctcaataggcgatgtgttcagagcaatcataaagcgagatgggtgttctgggctcatgaggggatggaagccaagaatgctattccatgcacctgcggctgcgatatgttggtctacatacgaggcgttaaagtcatctttcggaaggttcaacgaaggaaggcggaaatagtctgtgcgtttctctaagccccgtgtattttttccctgaagtcaatgtacttctatacagaagcatacatcatactcgctcagctgacagagagacgcatctccaggatgcatttgttgtgatgttgtgcccaagaactatcacgaggaattgagatgtggcacatcaatatgcaatatctgtcgaaaaaaaaaaaaaaaataccatcttttccttgccagaataatttgancgtactattttttcncagccttggcccttggggtgaggaaataatagaagagaatactccttttcc

SEQ ID NO: 9621 - DNA, 1811 bp, Zea mays
gcgaagagtgctgttagttgatggatcattgcataacaagctgttcccttctacaacttcattgcatcaagagcttatttgttttgatcttccatcgttacattcaactttcttggatttgctgaatgcaactattaaaggcatgcgaagccaactcttacctcatggtgctagtatcatacggcttataacagagtacttcaaaatagcaaagctgcctactttgaggacaaaaacttatagcattttgcagctgttgctgacctccatgggtgttgggacgtctctgcacctgcttgaggcaacagtcagcaatgcagttgctgatctgaatgatgatggtgaaattaacatgactatgatcaacacaaattcatcgcaattgaccaatgaatcatcatcaaaagtttattcgaagaagaggaagcaagaaccacagatgcaaaactcaaccatctcaggttcagagaaagtagcaatcagcccaaggaaaagaaaaggttcttccataccaattgcatcaaagggagtggcccctgaaagtacaggagatgttacactatcaactccacattctgtcaaaatagctgcgcttgaaacattggaagttcttttgaatgtgggaggttcattgcggatggatcgctggaggtcagaagtggacatgctcttaattaacgtggctagaagtgcttgcggcatgggagggagttatgagcaaaagccatccacatttggggagccaaacatatcggacttccaacttgcttcgcttaagggcctgctggcatcttttctttcttctcatgcccgtcctccttatttagccaacggaattgaactcttcagaaaagggaagctagagataggcactaaggttgcagagttttgttcacatgctttgcttgctttggatgtccttgtccaccctcgagccctttctctggaaagaacagttcctgcaagctctgggttcaactacactgcacagaaaaaaacagtttttggtgctggtacacaccagatctcaccatttggggaccagcctcaagcaatggaggtcgaagacatgtacgatgactggctaatatccaacaacaatgaaccaccagaggttccagtgaacggtagtgatgctgtggtaagtaaagatgtgtgctggtggaggatggaaagcagctcaatcccatagcagaagatccaaaagtcgacccacccagaatcacagacgcagcacaagatgcaccagcatccaccaagactgatgtcaaggtggtcgatgcagctgcagccacagctgccaagccaaacacagcggagaatccttcgagttccaatgctgtcccctctccagtgggcacaacagattctgattcacgtaagcatgcgtcatttcccgagcaggatagtcctcgtgagaacaaaagcccagccgtccatccaggtgaagcttctgcgactccaggtgttggttcaagccaccaccaccatcaagcacctgaggcccgttcagccagcttcacggaattgttcggttctgagtctggcatcgaatcagagtccgaagacttgatgccagatatcgtcgacggggaccctgattctgactaggtttggttacagttcgttttttttggtaacatctgtatggctcgatccgttttgtggactagtgacaacattgtcgtcgtcatttgtgacatggcaatggaaattttgtgatgttcctgttttgttttgagcaattgtacgacattgccggctgacagatggtgcagtatttgattgatagatagagatggagctgtgtt

SEQ ID NO: 9622 - DNA, 4105 bp, Zea mays
cgctctcgccaactcccctgctccacagccacaagcccactcggatcccaatccgagccctactcgtcgtcgacgacgcgacggccccgcgtgcgaagccagccagccagccagccagccatcgccgtggaccggggagcccggagggatggaccccgagaagcgcggctacgagctccaaaattttgtggcgcatgatgcggaagttaggtccctgtctattggcaaaaagtctaggcgtgtgttcatcaccggtggcaatgatcgcaaggtcaaactgtgggccattggcaagcaaactccacttctgaccttgtccggccacacaagtgcggtggaggctgtgcagtttgattcagcagaggtgcttgtgcttgctggctcgtcaaatggttccatcaagctctgggacttggaagaagctaaagttgtgcggtctctcactgggcacaggtcaagttgcactgctgttgaattccatccatttggcgagttttttgcatctggttcgtcagatacagacctgaagatatgggacataaagaaaaaaggatacatacacacatataagggtcacagaggagcaattaaaacaatcaggtttacgcctgatggacgatgggttgtcactggtggggaagataacattgtgaaggtgtgggatttgacagctggaaagcttctacatgatttcaagttccatagtggacaaatcaactgtattgattttcaccctcaagaatttttgcttgcaacaggctctgctgataggacagtgaaattttgggatcttgaaacttttgaattgataggttcttctgggacctgagggtaccggtgtacgttctatggtctttcacccagatggtaaaacccttttctgtggattagaccaaagcttaaaggtaggtcgtattctgatcaatgatttcaagtcgcctggtcgcctggtcgatccctgggaccgaccaggcgactagtcgcgattaggcgactagtcgcgattaggcgacgactagggcgattagtcgactcctagtcgttccctggtcgtcctagtctagtagttatacttatatagctatatatataaatgtacatgtatgcaactacattatataaattagaaagtcactacttagcacaggcttaggattagggcagccagcaaccatccactaatttggcagaactgcagagaagggggagatggggcagagcatgaggaaccttgagatgacgagctcatctcctcaatggtgcaggtctgctggagcttgggaaggggcagggtggagactgcagctggtgaaccttaagacagtctccgcatgtggagactgtagcaggcgagcatgggaaggggcagggtggtgtagccgctgatgatgtagccgtcggtgagctgtaggtctgaaggggcagccaccggcgaccaagtgtgaataagggctggaacagtcgagctagcaagagaggagagtaggagacgtagtgcactgtttggcggctaggtattacagaggagaggagagggtagtctaaagtatactgtagatgggttgaaaatggcccaataacaaaaccctagccaggacgaccaggaaacagtaatcgggcgattagtcgccctaatcggcgattagtcggccgaccagcctatctagtcgagtcgtccagctaatcgagcccaaatagccgaccagcccgactaatcgcgactaatcgcgattagtcggacgacttgaaatcattgattctgataggttcttgattgatatttatttgcttggtacttgagaacatgaatatttccaggtattctcttgggaaccagtaaggtgccatgatgttgttgacatgggttggagtaatttggctgaccttagtatttatgaagggaaactcttgggatgctcctaccatgagtgccgtgttggtctatgggctgctgatatatcagtgagtgtcattttttctatgccatgtgtttttttcctgcctcttctaacttccattcatggatccagctcattggaccctatgctcttggtgtattgcccaaagcgaatttttttgctgagcttgtgcagtctatggaagataatcctgtgaaaccagttgatagcactgcaaattctcgtcctgcttcagcaatggcacattcaagaagttcatacaaaatcaaggagtctgggattgctcaaagcagggttcgtggctcacatttgactccagcaagtacagataagaccaagaaagataggagcagcactattccacgaagacctgattcgtctttaaagtcatctgttcagagtactaccctgatgaggcgtatgaagcttgttgatagtccttccaccaacacaaaaaatgtggaacgtaatgttgggcagagagacatttcattagcgtctcgtgcagtgatggctaataattctgcaactgctaagaaaagcaatcttacagaatcagctttagtgaaagatatttacactacatctcaggctgtttcagcacctattgttgtgcccagagacattttagaggacaaaacagtaagcaatgttcgtcgagggactggagagacagctgcagtcccagatgattttcggatccctgttcacagaagaaaaccctcacttagtggcagtgctgctgatagtgatagctcatcaagatcagtgttcactgaacctgatgtttgctcagagggtttgtctagcttaaaattctcctttgggctaactccatatcacaagaaagaagaatttggcgatgtggataatgaaggtattgcacaaatagcagaaaagatggaaagaacagtgtcgctggaccattctcagcagttaaatgatgataaatcctttgaatcaccatgctcaacaacagagactgccaaggtcaaatatgttagaggagttgctgtgccactggggaaaacaaagtctcttgttgagagatgggaaaaaagagagacttctagcactgattattcaccacaaactggttcttgtggtgatcgggcatcgagaaatgacaaccatccattccatctggcggaaccaagtacaacatttgaaaaggacctgtcaactgtagatgaagcgatggctcctgtcaatttagtgcggaaccatgatgaattcctaaatgctgtaaaacttcggctgacaaaactagagatgatgcggcatgtctttgaacaaagtggtattaaaggagcaattgctgcagtggcaaagctacctgacaatgctgttcaagcagatgttgttagtgctctcaaaggaaagcttgatcttttcaacctggaatttttctcaaattttctgcctgttcttgctgggttactgtgtagcaagactgaaaggcatgctatggtctctttggaaatgttgttggatcttataaagatttttggaccagtaattcattcagcattatcagcaaatttaggcgttggagttgacattcaggctgagcagaggttgcaacgttgttcacggtgctttaaccatttgcaaaagatccaacagagtctgaatccattgattctgcggggtggtcaaacagcacaacttgcacaagaactaagtctttcattgcaagatttggtggtgatctaggcaagatgatgtacaatgtatacgacagagtagataccattggttttggcgaaaagtgcccacagttgtgtagcttgtaattttgtcatagctttgcaagtgggttttgcaactgtgttttaacattgggctggcattcagcctggtcccctgttgtaaatgtgagcctagccgtgaatgagtctgtaattagccagccacatctgctgtgtgagcagccctgaacaaaaagactagttgaaaggaaacaaccgcaaaggggatcattttggttacaccccaggtggtaggatggctcatgtagcatgcggtgattggcaattccattctttgaaagcatctgtgtttaacgtatattttgtagaagtaaattgagttatgccatagtaacgatgactgattgggctaatatgccttttgtttcttcaactgaccaagaatactaagagtcggctagttttaagtgtccg

SEQ ID NO: 9623 - DNA, 1181 bp, Zea mays
cggccgggattcctacacatatcatcgtctttggcggtcgagattcaccgactccagcagcagcatggtaggaggagcagcaggaggagaagtcatagggggcggcggctgcagcggcgaggtcgtggtggtggtcgtcggccgggccgagatcgacaccagggcaccgttccgatcggtcaaggaggccgtggccctcttcggcgagagggtcctcgccggggagctctccgctggacgacgaggaccactctcctccgtcaccgagactacccgatcatcgattgcacagaatcgagtggcggcaacaagacccaagcaccacgccaagagtcctgccaccggcgcggtcaccacggctgcgctgcgcgccgtgccaccggtagtcgtcacagcggatcagctggaggaggccaagcagaagctggagaaggagcgggaggagaagcaaaagatggccgggtgcatccagaccctgcaggaggagctcagccacgccatggaggaacttaagaggctcaaggcgcgggacgacaggaggccgccggaaccaaggtcatcgacctggagatcgacgagggcctctacttcaccgaggccgccgagaagcaaatggcgccgccgccacagggcgctgccggcggagcaggcgagctccagaagaagaggtacgtgacgttcgctgacccgccgacggtcgccgccaccgccgccgccgcgtgccgggcgccaccgttgccggacgtggtgatggaggtgcaccgcgcgccgccccaccagctccaccagccgcacccgcattactaccgggagccgcggttccagaggcagatgtcggccgggcacgaggccgccaacgcgatggcggatgagggaaggaagaagaagaagccgctcatcccgctcgtgggcgcgctcttcatgcggaggaagaagagcagcaaaagttgccacgacgacgtggcgttttgatccatcaatacatgcatacgtatatgcatgcatccatgcatggagtgatggaggtgcttttattttcattttttaatatatatgtctagataatggaatgcgcactgttaatgcatggatctttgcaaaataaataaatatatccaatacacaaatatatcacactggaaaaaaaaaaaaaaaaaaagggcggccgccaccgcggtgga

SEQ ID NO: 9624 - DNA, 1154 bp, Zea mays
attgggacctcgagccgccgggtcgcccatacacatatcatcgtctttggcggtcgagattcacctatagctagctggagtccagcagcagcaacatggtaggaggagcgggaggagaagtcatcgggggcggcggctgcagcggcgaggtcgtggtggtggtcgtcggccgggccgagatcgacaccagggcaccgttccgatcggtcaaggaggccgtggccctcttcggcgagagggtcctcgccggggagctctccgctggacgacgaggaccactctcctccgtcaccgagcctacccgatcatcgattgcacagaatcgaatggcggcaacaagacccaagcaccacgccatgagtcctgccaccggcgcggtcaccacggctgcgctgcgcgccgtgccaccggtagtcgtcacagcgggtcagctggaggaggctaagcagaaactggagaaggagcgggaggagaagcagaagatggccgggtgcatccagaccctgcaagaggagctcagccacgccatggaggaacttaagaggctcaaggcgcgggacgacgaggaggccgccggaaccaaggtcatcgacctggagatcgacgagggcctctactttaccgaggccgccgaaaagcaaatggcgccgccgccacagggcgctgccggcggagcaggcgagctccagaagaagaggtacgtgacgttcgctgacccgccgacggtcgccaccaccgccgccgccgcgtgccgggcgccaccgttgccggacgtggtgatggaggtgcaccgcgcgccaacccaccagctccaccagccgcacccgcattactaccgggagccgcggttccagaggcagatgtcggccgggcacgaggccgccaaggcgatggcggatgagggaaggaagaagaagaagccgctcatcccgctcgtgggcgcgctcttcatgcggaggaagaagagcagcaaaagttgccacgacgacgtggcgttttgatccatcaatacatgcatacgtatatgcatgcatccacggagtgatggaggtgcttttattttaatttttttaatatatatgtctagataatggaatgcgcactgataatgcatggatctttgcaaaataaataaatatatccaatacacaaat

SEQ ID NO: 9625 - DNA, 1721 bp, Zea mays
agtctttacttccaatccatgtcataaatgggcggagtttggtcagattgttatacaggtcagcctccccgatgagactatttgcattggatacaagaaacctttcggtaaacaccgatacaaagagtacagaattgtgtgcagtcgtttacaactctttatatacttccgcatgtactatcgccaaatatagcgggtgcatatcattctggtagcagtcttatccatatcaaatcctgtgttatatagataaaaatatagaagttagataagagtgaatataatttaccgtagttgatatagatgaaatatatagagaaatatgagtggggaagattataagatagagtgaaaatatttttttgattgcctcatccttcctatacaagttgtagcatctgaactcaaatactacacacgctaaacacacaacgtaaggctgttcgcagtcacggactctatgcactacacgatttgagatagagtaaaaattcagctgcagtagacaactggatgtagtactccattttacgctcacaaacgacacattcagcatacgtacggaagccaccctatccaatgtagtgagcaacatgcagcaggacgtgtacaaaaagagatttgaaaataataatataatactagccggttgtccgtgctttgctacggtttttatatatcatataaatatgtattaagatatttattcaagtataattattgtttatttttctaaataataagatatgtatggtctgttggttagcctcaaatttctgaagttgagggtgtgcgtttaagtgctcgctctgtatttttttttcgcggtgtggtaattacgtgtgtagggtttatttgatatagggttgagatatgaaataaatatgactacaaataattataatatcaactaaaaaattttattgataaggatataacatttttaaggtaatattttagagttatatgactgcggatagcctaaaaatatggagtatcgtacgaggctcataccaactgcacaccagcggatccacacccaaccgccgaattcgatacacacacccgtccacactcaacccgacccaatatacacaccgaggcccgaaacaataataatagtgtagtaataataaaaggaaatctccaaatttccccacccagtccgctgcgcaggccagacatccgcggcgtccgcctccccggccccgatcgatcggaagcttcggcttcccctgacacaaggccggcgcgaaaacgcccccacaaacaaacggcggaccgttgccgcgcgtcgattcgaacccgccggggaaagcgccgacgcagtctcaccccgcggaggcgaaaccctagcgatggcggcgtccgtggacgctgcggcggccctggcggtgacgccccccgctgtggaggaggcgggcggcgctgttgagcaggccaggacgctcatcggcgcgctcaacctgctctcccgcaacctgccgctgccccccgacgtcctgcgcgcggtctcgtccatctaccacgatgggggtgcgggtgacgatgaggaggaggaggggggagagcgggaagcggagaaggaagggaatatggagatgacggccgcggaggagggttaccccgttgacggtgcgaccaaggtgcgtgtgggtggttcttcgcgtctgggtggggattgccccccttctgttcgggtgctggggactgcacctgac

SEQ ID NO: 9626 - DNA, 5729 bp, Zea mays
  misc_feature (83)..(83): n is a, c, g, or t
  misc_feature (258)..(258): n is a, c, g, or t
taaaaaaatttctcgcgtgtttccttttctcggttctcaggggcctcatgttgcacggcaacttggggtcacgggagtacggnacgtggggtttgacgagtatacggagagcgaccggcccccatgcaggttttttagggaaagctcttcttccggcgccatgaaagttcacaaggacgttccacggttgtggggatgcaccaaggtaaggagaattgctttcgacagatgtggcaaggcggaacgggtaggcgaagncggcactaatagctagccatttcccatctccgtccgtaacgaaggtaagaaaggcggggggccggcaggcacaggcgcaccgcgcaccggccggggcgctctggccggcgctggctcgcggacgttggcacacaccaccagctcaggcgccacccggcaggcacgttgccgcgcgacacgtacgccagctgggggctggcgtgaagcgtggcgcgtcgcagcacactggtgaacctgcagcgtatgcgtcgtagacccaagttccggaaaaatgaaccgaagatacagtagctcctcagcgcaaccactcggccaccgaactctttcttcccctcctcgttgtccgtccgtcccacactcgccggtgcaccctcgccgcggcgcggcatatccggcccactccggcgcgccgaatggcggcatcgatccagtcgctcgcgtgcagaggatgcgtggactgcggggtcgcgcgcggaggaagaaggcgccgcgctggagacctggaacgggcgaatcccgccgcccggcccccggcgcagcgccccgcgcggcaggaggattcgcagcgtggcagggtgaacgttgcggcgttgcagtgcgtggggacaagaggctttattccggggtatttggaacctgctcggcacagggcgtggcatggatagttggatccttctgcgctgcgcgctaaccggggcatttgtctcgcacgcacaggcacaggcaggcacactatgctccgagcgggacatgccaggaacggaattctaccgtttctttcacaggtaggataattggatccattcaagtacgtacgtattgctagctacctagatctgtcgtcttctcgagccatgcatgcgcggttgaatttgtagagagctctaccagatatatagttgcacttttcatcgaaataaaagtggagttatagcatacgatcttaaaggagaatcataaaacccccagtttttatcggagtcgatctccacggcaaaaaaaaataattcctttaaaaaccaaagaaagaatggacgaagggattggccacccccacaaaaaaaaatgattgccaaggtggcggaagatacgcatggttactcttggaacttgggagcatctacgccatacgcatgatctgttcgaaatcagaaacgcagcggtaaccaatttgatggcccgttttctttcttccattccttcttcgtttctctcccacttgaatctactgtaaatttaaagaccatctggactatggtctgttcacttggctttaatctatacgggtatctactgtgttttatcgttcagcagcagtgtaacgcaaaagtattgagcgagaaatttatgttctaattagccagcaacaagccacagccccccacagctagaccaaaaccagacagggaaaatgtcaagttacttatatacaaggccttgataagtagaaacggataaaccacaccattttgtattgcggacagtgtgtgccacaagggaatcacttccagatgagtacaacttaacaatacatttctctccataaagtttcgttttcaacggttttttttttttgaaatgcccgaatggagtgcgcatatgtcaccgaggggccctcagaaaggcgaaggtatttgtcctccccatgctagtgggtggcagtggtgggtgtgggtgtgcggtgagcagagagaggctctggggctctgggccggtgagcccgagcgctccccctcggcgccctacaaataccccgccgctgccgctcctcttcttatcgtgtgacctcccccgatctggagctgaagtgcttgacgccttccgcttccacttccacggcagcacgagccttcttctccttctcgcttagcggctatagcgccagccaaaggagaagtctgcgggcgagtgcgatagatagacacagagaaaccgatagatcatcaaaaaacgagcgaaaaaatcggtccaaaccccaggccggacgcgcgttagagtctccaaagcttatccttccatccactccccgcagccagcttctcttctcgttcccggttatattaataacgcggcggcgtgctctgcttcctccggtttgctctgccctgcttcctaaacacaaacgcgctctgcaccaagaactatatacaacgtagaaactagccgcgccgtcactcccttttgtggcaacctgcagcacgcacttgctgagacaggggtagccttgctataggctagctagtgtcacttgccgaggacaagcaagcaggccggggagacatggcactgacagtgttcgagaccaccgagcagcagctcctcccgtgccagcaggccgtcgagcagggcgctggcgatggcggggccgccgccgccgcgggcgccgagaaggctaccgtcacgctgaaggagacggaccgcggcggcgacgacgaccggccggagagggacgacatatggaacatgatccaggcgcagaagccgccgccgccgcccgccgcgcccaggcaggcgccgtacgtgcacccgctcgtgcgccgctcgtccagcctgctcacccagaagagcctggagatctgcaccgagagcctgggctcggagaccggctcggacggcttctccgacgccgacggctccgcgaccgagcactcgtgccagggctccgacgacgagcgcggggagggggaggaggaggaggaggaggtggtggcccaacgcgcggccccgcccagggcgttcccgccgccgctgccgtccctggcgcggcgcaaggtggagtctaccatggagatgaggcagaagcgccaggacggccgcctgctcgtcaaggtcgtgcccgtggcgtcgtccaccctgttccgcgcgcagcgccgcggcggccgccttctcctgtcgttcgcggacacggccgcccccgcgcccgcgcccgcctcggatgagccggagaccgagcagcaggccgacgaggaggacgacgaggaggacgaggtcgaggtcgtggacaggggcaccgtggtggaggtgaaggtgagcgcgcagccgcaggcgcgcagcgggaggggcccgcgggtgcaccgctccgcgctcgtcatcaacaagttcgtgggcgccgagccggtcacctcctgcgagatcgacggcgacggcgacggcgccacggctccgcagcacccggtggccaggcgctccactgggtccaccaccacagcggtcgcggccctggcagcggcctcggcgctgagcgcggccgcagcgccgccggacagtggcgacgacgccgtccccggcgccacgtgcggcgagaacaagctcctgatgacggcgaagcggcacagcagcaaggaggagctgatgaagcacatgcgccggtgcagcggccagctcagcccgtcgcttttcgtctgggaggggtgcatcgcaacctcctcctgaacgccgcaccgcagcccagtccacgcgcccgccatcgcccatccgttccgttccatgcatgctttcgacctgctgctgtttgtttgctctgttggttttgtaacgttcgtaacgtagtgctgtcgttgttgctcgcaagtgatgatcgtcacgtcacgtgattggcttagctgtgtgtgtgagagaggtgagggagggacagagagctagcactattggtttggcatgccaccttgtgcgtgccctgcttattgcatctactactctaccaccattttacatttgcatttgcacgctgctgctgctgctgcttctagtgaccgttgtccggtaataagatggactatcttatggccaattgtctgtgtttttttatggatcggagtcagtgcatgattctctttaattatataattgatcgataacaagctggccgcgacggcttcctggaaatggaatagaacaaagactgatgttgtgccagattggagactatactagtagctatcagatgacaagttagttctcatgatcgattaagaagatttcgtctcacgaagataatgaacgaggtcaggtaattagtagtctcctatcgaccatataaacgatagacgatactccgtctgtttttgaaaaaaaaagatataactatataactttggttaagttaatagtaaatattattaaaacaatatatattaactagacctaatattactttataattaaataaatattatttatcttgtactataactattagtatttatgtgaccttggtcaaacttcaaatcatttaaaatttttttgataaagagagtatatgaaacatctatctctgagtggatagttatcctgaggagattcttggaaatattttttaagaaaaaacaaatagtgcaaggaatatatccacatacgtatactgggtaattgggataaccatcggtttgagcatggacgcagcggggtactctacagcgcggagatctgaagataagcatatcagcgatatatataatgccatcaattcagttgaaatcttttacatactgttctcaatcgatttatctccattctttaaaatatgtgtttagttaaaactttagtttaagtacatcatcttctgttgtagcccatgcgtcgtgatcataaatctagacgtcataaattgttttatctagattctaaattgaaatttttagtgttcgcagtatttttatttaaaaaataagatttttattttattttattaaatatacatattttatggatgcactcttagttaacatgatcacataagaagttatttaacatgttgaatttccttaccggaatattttgtctaattagtattttttattaaaataaacaaataaaattacctaaagaaacacaacttacttaaggtattctcacgaagtattaacatcgttctaaattaactaccgatgttagaaacatagaaacatatatttaccactcttacatgcacgtatgttttggtctatggggtggcgcatattatatatatgtttattactctcaactagctttttatgtattgaccgtggtagatgtgggtacttcaaatattaagacaaacttcaggattatagtgatagatgttagtaacatagaattttgaggagaaaatttaatggcaacggtagattttattgatgccaatttaggagttacttcgtgaattgctatggtctatttatatcaaattagtagactttgttttaacaaaatataaaaatatgagtgttctattgattatgtgagtatgaatgtggagctaataaccaaggtttgaatcctcgatttcacaattataatttttttttagcataaagcatggaggaaaaagatgacacacaacgacctgtataaactaaactggtccatattatattaataataatatcgaaaccagccctcacgtttgtgaagaaggtctaaaaatatgagattaatctaaaagtagaagaatatgcatcgttggatttcaggaacatctaagggtctat

SEQ ID NO: 9627 - DNA, 1251 bp, Zea mays
cccccgcttgcttctccccgtctctgttctccgccagaccaaacctgaccaaccccacccactggaccggcccgcgcccgcttggtccagcgccggccctgcctgcagccagccaccgttgtccgttccctcccgcgatccactcctctcgagctctaggggacggaaggaatccggcgggggtggggtgcgagcagggggagggagaagagcagccgcccgccccgcgagggggcaacagctgcccaagaacctgaccggaagagttgtgggagcggcggcggaaagatggggcaggccctgcgcaggctcttcgactccttcttctccaccagggagatgagggttgtgatgcttggtctggatgcagctggtaaaacaacaatactgtacaggcttcacatgggagaggttctttcaacagtccctacagtcggttttaatgtcgagaaggttcagtataagaatgtggcattcactgtgtgggatgtgggtgggcaagaaaaactcaggtcactgtggaagatgtacctgagtaattctgatgcactgatctatgtcgttgattctctggacagagaaaggatcagagacgcgaggcaagagttccagaccattatcaaggaccctttgatggcaaacagcataatcttggtatttgcaaacaaacaggacctgagaggcacgatgagcacggacgaggtcagcgaagggctggggctgcacgacctcaggaacaggatctggcacatacaggggacctgcgcgctccgcggcgagggcctctacgacgggctcgactggcttgcgtccaccctgaagcagctgcaagaatcgggccacgcgacttcggtcgctggcccttccatctgatccagcgcaagtgagctcagtgcctcagccaactgacagcaagcccacaagaatatgctccagcgcgagcgcattcctttggtgggtgtggctgcccgctggtggtggtggagttccttcggtcggtgttgccgtgttggtatcatatgagccagttgttcatccggcagggactcgcgtacttttttttctctcctgagattgtttgtaaattgttgaacggatgcaatgccggcgatgttgatcttgtgtgctggtggtgcacgtggttgttttgtctacttttttttacaataaaaaagagatcgtctgcggttctggtgattaaaaaaaaaaaaaaaaaaaaaaaaactagttcgccctcgtcaccgcggtgga

SEQ ID NO: 9628 - DNA, 609 bp, Zea mays
ggcacgaggccggccccgatcgatcggaagcttcggcttcccctgacacaaggccggcgcgaaaacgcccccacaaacaaacggcggaccattgccgcgcgtcgattcgaacccgccggggaaagcgccgacgccgtctcaccccgcggaggcgaaaccccagctcagcccctcgcttttcgtctgggaggggtgcatcgcaacctcctcctgaacgccgcaccgcagcccagcccacgcgcccgccatcgcccatccgttccgttccatgcatgctttcgacctgctgctgtttgtttgctctgttggttttgtaacgttcgtaacgtagtgctgtcgttgttgctcgtaagtgatgatcgtcacgtcacgtgattggcttagctgtgtgtgtgagagagaggtgacggagagctagcactattggtttggcatgccaccttgtgcgtgccctgcttattgcatctactagactactactctaccaccatttgccacatttgcatttgcacgctgctgctgctcctgctgctgctagtgaccgttgttcagtaataagatggactatcttatggcctaaaaaaaaaaaaaaaaaaaaaaaaaaaaaaa

SEQ ID NO: 9629 - DNA, 1155 bp, Zea mays
atgattgggccgaatttggattgtcacgggtccgcgaccgcgaattgggctcggtttgatttagccgacatagtagtgaccgacccgagccggcggcgagccaaaccgagcggacgccgccatggatcgcgagtggggctccaagcccggcagcggcggcgccgcctccgcgcagaatgaggccatcgaccggcgggagcgcctccgccgcctggccctcgagaccatcgacctcgccaaggacccctatttcatgcgcaaccacctcggcagctacgagtgcaagctgtgcctgacgctgcacaacaatgaggggaactacctggcccacacgcaggggaagcggcaccagaccaacctcgccaagcgcgccgcccgcgaggccaaggacgcacccgcgcagcctcagcccaacaagcgcaagcttgccccccgcaagtctgttaagattggcagacctgggtataaagtaaccaaacaatatgatcctgagatgaagcaacactcgtttctttttgaaattggttacccggaaatcgaagataattgcaagccaaggcaccgtttcatgtcatcatatgaacagaaagtccaaagttgggataagggttatcagtacctactttttgctgcagagccctatgaaattattgcattcaagatacccagtacagagattgacaaatcagcgagcaaattcttctcttactgggatccctgacaggaaggaatacctgactgccactgcacttcaagccaaggccgccagaaggtagtaaaccaccaccagctcctcctggaactttgcctaatgggactggggctcctggtgctccaccaaggccaccggggcaagctcggacactatgctcgctacaaattccacctccgcttactgcacctatagcaatgcctcctaggattcctccagcacctataggggatgtaaaacctgcgccagctacatcactagcggaaaatggtttgccgctcaatgattgcaccgccacctaacttaactcccagatcaccgccacgcggaccctacagtgcaaggcttttctgggcaacaggagtagttgactgcttagcaggcaatgttccagtaattggcacccagggcatgtgtgaagcttgtgtagactattgcttttc

SEQ ID NO: 9630 - DNA, 1311 bp, Zea mays
tttagaaagactgataataaaaaagctcaaccaaagggcctctactgttgtgggcgtacgcgaccagtgaggtgcggttggccagccagcggcgagccaaaccgagcgtacgccatggatcgcgagtggggctccaagcccggcagcggcggtgccgcctccgcccagaatgaggctattgaccggcgggagcgtctccgccgcctggccctcgagaccatcgacctcgccaaggatccctatttcatgcgcaaccacctcggcagctatgagtgcaagctgtgcctgacgctgcacaacaacgaggggaactacctagcccacacgcaagggaagaggcaccagaccaacctcgccaagcgcgccgcccgagaggccaaggatgcgcccgcgcagccccagcccaacaagcgcaagcttgccccccgcaagtctgttaagattggcagacccgggtataaagtaaccaaacaatatgatcctgagacgaagcaacactcgtttctctttgagattggttaccctgaaattgaagataattgcaagccaaggcaccgcttcatgtcatcatatgaacagaaagtccaaagttgggataagaggtatcaatacctactttttgctgcagacccctatgaaatcattgcattcaagataccaagtacagagattgacaaatcagcgagcaaattcttctcttactgggatcctgacaagaaggaatacctgctgcaattgtacttcaagccaaggccgccagaaggtagtaaaccaccaccagctcctcctggaactttgcctaatgggactggggctcctggtgctccaccaaggccaccggggcaagctcccccaccacccccgccacaaattccaccgccccctcctgcacctatgggaatgccccctaggattcctccaccacctattggggctgttcaacctccgccacctccagcacgagtggcaaatggtctgcggccaatgattccaccgccacctaacttcactcccggagcacccccaccgcgccctccaatgcaaggctttcctgggcaacagcagtagttgactgcttagcaggcaatgttccagtaattggcagtcagtaaaagtttcaagcttgtgttgactattgtttttcggcttaaaactttgtatgttgtctgggactatactcaaacggcagcttgttggatttttttgtatccacatttattcaagtgcttgtttaaaaatagctagtttgcgtgtattcggcttcacaaacatatgataccgttgattttttttccaaaaaaaaaaaaaaaa

SEQ ID NO: 9631 - DNA, 2561 bp, Zea mays
ttcatccatcgccatgaacgaagctgccatcgggcctttggaagaaaggcctccattgtgtaatacagtctatactcgtctattccagcccaaacaaacagggcccaattttagttctcagccgaccccgtgcccggccgcaagtgccaccacgacgctactcgtcctcatccagtcacgaaaaatcggaatctctgaaaaatcctccgtaccatgaagctccggttgcgatctatgcaggcgcgcggcggctccgccgccgtggagacccaccgcgtggacctgccgcccacggccactctggccgacgtgaagaccctcctcgcgtcgaagctctctgcggcgcaacccgtccccgccgagtccgtccgcctctccctcaaccgtagcgaggagctcgtctcgccggaccctgccgctacgctcccgtccctcggcctcgcgtccggtgatctcgtatttttcaccctatcccccctcacggccctagcgccgccggctcaggccctgccacggaaccctagcccgagctctggcgctgcagcgtcgatcgctgaggctgccgaccgcgggaagggttcgaagcaatctggtactggagatttctcttcctcgtcactggcgcaggctgtggttgtgagccctagctttccggtcgcttccggtacgcgggatgtggtgatggaggaggaggccgtcgatgccacaaagggctggtcgagttttgtgcttagggatctcaagagggagatggacaacgtcggggccgcggagggaaccgccgcaggtcgcctggttgcggccttgcatgcagctctgcttgatgccggttttctcaccgctaaactgacgggctctcacctctcgctgcctcagggctggccgtcaggtgctttgaagccattgaccatcaagtatactataccagagctttcatcaatggtatctgtgactgaggaagggaaggtggtggtgctgaactactccttgatggccaatttcgtgatggtttatgggtatgttcctggggcacagtctgaggtttgccggttgtgcttggagttgccggggctggagcctctactttatctggatggcgatcagctgaatggagtgcatgagaagggagttcatgatctgtggagagtgctgaaggatgagatttgcctgccactgatgatatcattgtgccaactgaacggtctgcgcttgccgccttgcttgatggctttgcctgctgatctcaagactaaggtattggggtttttacctggggttgatcttgcaaaggttgagtgcacatgcaaggaaatgatgaatcttgcatcagatgatagtatctggaagaagcttgtatccaagtttgaaaattatggcgagggctctaggctggcaggcaagaatgcaaaggccatatttgtagaagcttggcaggccaataagagacggcagaagaggcccaatccaaccttttggaactatggctggggaaacagtccttatagccgcccacttaggctgccattgattggtggggactcggacagacttccttttattgggaatcatggttctgttgggcgccactttggaaatcaacgaaggaatatctcaccgaactgcattcttgatggtcaccgtcataacttcctttgaagccatgtcaatgagttttacttgtatgttaagagtgttttataaggacttcaatggtgcatatacggttagaccgccttgttcatatcgtcaagtcgcacacttatgcttgtgcacagcactcttatgatcttatcctaatatatccccttagtatcttagatcgtatctttactatctttttttggtaccaaatgtaatccagtgtcctagtaataaagtacccttgttctattctcaaaaaaaaaaaaaaaacacggtcattgtaatttggttgaatgtgtagatagatgtattcgtgtgtaatagctttaaacttcagggtgctgcttaaatttatttgcattaaatattcaatctataacattgatagctttatctccacatcttcatgttttccccatatcatgatgtcaatatgatttacatttttcttattaggtattttcctttgacatacatgctactttcagtagctcagtgataaatagaataatcaggttcttctattatactattattctgtcatcagtcttggtctagagctgtatgaaataatggaagcatactactccctccgtcccaaattagtattcgttttagcttttgatttttatgtctatattcaaatagatgatgatgaatctagacatatatacaaaacacatgcataaattattgtatgaatctattaaaaggctaaagcaaattttaatttgggacagagggagtattattaaggtgctgttttgttttatttaaaacagcgaaatatcactgatgccgagaactgcgtagtaatcttgtatacaaattagagctaaaacatcaaacaatctgatacagtttttgttttaatatctaccactagatggcgtatgcatgttttttttttaaaaaaatcc

SEQ ID NO: 9632 - DNA, 2890 bp, Zea mays
actttgtgagtataatgtacctaataatccttgatggacatttcatacaaaagagtatggggaggtgtgtgtctatatcttaacgttcacaaattgttagtactactatttgagaaatcatgaccgaatgcgatgcgagcgcgagcagtgagcaatgccagatctggagtggtacaccgcgccgagcagtgagcaatccccgaacccgacacggctcggcctgccggctgccccgagcccccgaagtccggttcggctcggccgttcccctcccattcttctcgtacgcgatcgattgcgagttgcgcccctcgccctcgccccccactcgcccagtccctcgcaggcgcaccaccgaaactgctccgcctccacgcccgctcgcactgaccacggcgatggccgccgccgccctccgctcctccgcgcgccggctcctgcgcctcgccccggcagcctcgtcggctctgtccgctggttcccggcccaccgccggggctgcgccgctcacgcgccccatcgccgcgctctcaggtggcaacaatcctatctcatggaaactgagacggttctacagttcaaatgaaaaacacttgcccgcaatatctgatccagaaatagaatctgcatttaaggatttgttggctgctagttggaatgaacttccagattctcttgtagcggaagcaaagaaagcagcatctaaagccaccgatgatagtgctggtcaagaggctttgaaaaatgtatttcgtgcagctgaggcatgtgaagaatttagtggaactttggttaccctaagaatggctcttgatgatctttgtggcctgactggcgaaaatgtgggtcccttacctggttatattgaagatgctgttaaagctgcatataatcgctacatgacatatctggagtcctttggtcctgaggaaaactatctaagaaagaaggtggagactgagttggggacaaaaatgatacacctcaaaatgcgatgcagtggcataggttctgagtggggaaaggtatgtcttctgaatgttacttgtccctgtggtacagttttacttcagtatcgtcttatgctggtagaaaattagaaatattttgcctgatatttttgtgattcttgatgtgtgtaaaagtttctctgcttttaattgtgccatatttccttttaagatttaaaaactcgacctgccgggagtaaaaccgcccccatggcattatattaagaagatgttctcttccaggtcgagaaacccctgccccacccatacatagcggcaccatagtctatgtgagaatgtccctagtctacacaacggcaccgtagcacatgtgagaacgaccgtaaacaggaccggaccttaggcgtggggacatatgaggggattttttaacctcaacctgaaattcgctctcacgaggattcaaacttaggacctaaggagtgctccttagactacctaaccaattcagctagaggccttttcgctccttttaagattatgttaaagttttttgttccatatgcagtcttactgcgtttttaatagaattttgtcttgtttattgcttgattgatttttgtattgttgattgaattttccatgcttggtcttttgcctatccgaagaaaatctattaaaacttgaatttgtattttctgcaaattataatagttttgtatcttcttttttaccatctaatcttttaattttaagcaaattatgaataacaactgaccatagctgactggcttgctgtgagtgttcatgcaccgagtgtcatggcaagatctggcaaagatattaaattaatttgtcttgtatgtaatagaactcatggtaccagaattgcatccaattgtgcgttgcatgtgaaatctgaagtaccaaatatgcccttctgtctgtggcgaggtgacatcaactggttgttttgttacgaccacggacaagctaacatcaatcctctccgcttgtaggattttgagaaaaaagtgtatcggacattttggtattggtgatatatgagttagactttgctttattggttcagggtaattttgttattttcaagttggtaaatatttttttggtctctcctactttcaccataaaccagcaaaacaagtatgcatttgggctgattcctggccaatattgtctggtctcctccctccatcatattttgctcagggcattactagcaggcaagcagctttataagaatcacatgcttgtgctttttcaaacaccttgtgcacataatcagtgttgcatttatgaaaatgtatattctcctttagtttttttttcatttggttattttctgacaatgaaaatgaattatgtcctgctcacctcatagcatgtatggacttgcgttctcatttcggtacatgtcaagcctgcttgtcgtgtcaggactgaagctagtgaaatagcatatatatatgtaggcctcctgccgcggcattggttccgagtggggaaagatctccctgattggcacctcggggatctcaggctcctatgttgagctaagggcatgatgtgaagcctgcagatcagaaccatggaaattatcgatgagctgaggaagtctgtagatcagaatatgccgttctacattttcctttcccctttgtagctaccatggcaataacaatgagaccatcaaacagctgtgcattttaagtatggaaatactcccgtctgtgtctgtaataaggacgtttcatgtggctgaaacctgccaattctgttaatttttgcatgacttcttgttcaactggtgtgaattgtatacgttgttcacgaagcactgatcataaaaaaaaaaaaaaaacaaaaaaaaacaatagaacacaaataatatacct

SEQ ID NO: 9633 - DNA, 1689 bp, Zea mays
cattgggtaccgcgacccccgccgccggcctacgcggccgatcgcgaccctcgcccccccccccacggggacgcaccgaaactgccccgcctccgcagcacactcgtcctccccgcgccgcctcggggacgtcccggtccgcgacatccctgaccacggcgatggccgccgccgccctccgctcctccgcacgccggcttctgcgtctcaccccggcatcctcgtcggctctgttcgccgcttcccggcccaccgccagggttgcaccgctctcacgccccatcgccgctctgtcaggtggcaacaatcctatctcatggaaactgagacgcttcttcagttcaaatgaaaagcacttgcctgcaatatctgatccagagatcgaagctgcatttaaggatttgttggctgctagttggaatgaacttccagattctctcgtagcggaagcaaagaaagcagtatctaaagcgaccgatgataatgctggtcaagaggctttgaaaaatgtattttgtgcagctgaggcatgtgaagaattcagtggaaccttggttaccctaagaatggctcttgatgatctgtgtggcctgactggcgaaaatgtgggtcccttacctggttatattgaagatgctgttaaagctgcatataatcgctacatgacatatctggagtcctttggccctgaggaaaattatctaagaaagaaggtggagactgagttgggcacaaaaatgatacacctcaaaatgagatgcagtggcataggttccgagtggggaaagatctccctgattggcacctcggggatctcaggctcctatgttgagctaagggcatgatgtgaagcctgcagatcagaaccatggaaattatcgatgagctgaggaagtctgtagatcagaatatgccgttctacattttcctttcccctttgtagctaccatggcaataacaatgagaccatcaaacagctgtgcattttaagtatggaaatactcccgtctgtgtctgtaataaggacgtttcatgtggctgaaacctgtcaattctgttaatttttgcatgacttcttgttcaaaaaaagagaaaaaaaagcttcctccgcccggcactgatcatatatgccttcgctcgcagtcgcaactcaacttccttcagcattgcaaaaactacggtgaactgccattttttaatgcaagggtttaacaatctcaatatgtgatttttattcactaactagtggattgtagcatgttaaatcatcaccttttgtttaaatcccaatatccacgataaaagttagacgtaataaaggattaattttgcataaaaaattaactgaatattgattcagctaaaatatattccttccgtccctgtatataatacgtaactacctctagttcaaagattaagaaatgtatttaattctctctatatcattgtatgtgtgcatagatagaacacgccttatattatagaacagtaataaaaaaaatagttataccatatattatgggacggcttgctcagaccgagaaaggtgaaaaaaaacgagccatacgagttgccacgaacacgacaggcataggacgtataaaggagacaactaggctagatatagattgatgccatatgcgaagatttgctcatttaatactatgtatagatttatactccctc

SEQ ID NO: 9634 - DNA, 941 bp, Zea mays
cattggcattggggacctcggcgccgccccccattcttctacacggccgatcgcgaccctcgccccgcccccacacggccacgcaccgaaactgccccgcccccgcagcacactcgtcctccccgcgccacctcggggacgtcccggtccgcgacatccctgaccaccgcgatggccgccgccgccctccgctcctccgcacgccggctcctgcgtctcaccccggcaccctcgtcggctctgttcgccgcttcccggcccaccgccagggttgcaccgctctcacgccccatcgccgctctgtcaggtggcaacaatcctatctcatggaaactgagacgcttcttcagttcaaatgaaaagcacttgcctgcaatatctgatccagagatcgaagctgcatttaaggatttgttggctgctagttggaatgaacttccagattctctcgtagcggaagcaaagaaagcagtatctaaagcgaccgatgataatgctggtcaagaggctttgaaaaatgtatttggtgcagctgaggcatgtgaagaattcagtggaaccttggttaccctaagaatggctcttgatgatctgtgtggcctgactggcgaaaatgtgggtcccttacctggttatattgaagatgctgttaaagctgcatataatcgctacatgacatatctggagtcctttggccctgaggaaaattatctaagaaagaaggtggagactgagttgggcacaaaaatgatacacctcaaaatgagatgcagtggcataggttccgagtggggaaagatctccctgattggcacctcggggatctcaggctcctatgttgagctaagggcatgatgtgaagcctgcagatcagaaccatggaaatatcgatgagctgaggcggttctgtcttccgttttgccgctcttcgttttcctttc

SEQ ID NO: 9635 - DNA, 3056 bp, Zea mays
  misc_feature (1535)..(1535): n is a, c, g, or t
gttcccctcccattcttctcgtacgcgatcgattgcgagttgcgcccctcgccctcgcccggtcgccccccccagtccccgaaactgctccgcctccacgcccgcgcccgctcgccctgaccacggcgatggccgccgccgccctccgctcctccgcacgccggctcctgcgcctcgccccggcagcctcgtcggctctgtccgctggttcccggcccacagccggggctgcgccgctcacgcgccccatcgccgcgctctcaggtggcaacaatcctatctcatggaaactgagacggttctacagttcaaatgaaaaacacttgcctgcaatatctgatccagaaatagaatctgcatttaaggatttgttggctgctagttggaatgaacttccagattctcttgtagcggaagcaaagaaagcagcatctaaagccaccgatgatagtgctggtcaagaggctttgaaaaatgtatttcgtgcagctgaggcatgtgaagaatttagtggaactttggttaccctaagaatggctcttgatgatctttgtggcctgactggcgaaaatgtgggtcccttacctggttatattgaagatgctgttaaagctgcatataatcgctacatgacatatctggagtcctttggtcctgaggaaaactatctaagaaagaaggtggagactgagttggggacaaaaatgatacacctcaaaatgcgatgcagtggcataggttctgagtggggaaagatctccctgattggcacctcagggatctcaggttcctatgttgagctaagggcatgatgggacgtctgcaggtaaccatggaaatcatcgatgagctgaggaagtctgtagatcagaatatgccagtactgcattttcctttcccctttctagctagcatggcaataacaatgagatcatcaaacagcggcgcggtttaaggaacttcagatactcccggcccttgtgtctgtgtctttgtctgtaataagaacgtgtatatgcgtgaaacctatcagttctgttattttttggcatgcgcctgacttcttgttcaactggtgtgagttgtatgctttgttcatgaagcactgatcaatgatcatatgccttcgcccgcaacagaacttccttcagcactgcaaaaatacagtgacctgccatttttttatgaaagggtttaacaatcactatgtgattagtgttcactaactagtggattgtagcatgttaaatcatcaattaaaaatgtgtcatgtacttaagatgatgtgaacatgagatttaatgtgtagttattgcaagaataatatgagtttacttgcccccgtttaaatcctaagatccacaataaattttagacataataagtgattaattctgaatacaaaattaactaaatattgattcagctaaaatagatatactacttgttatgaggtcgaaaaaggtggaaaaacgagtcatacgagttgcaacgaatatgggctaatcggatcagagtcagaccacaacatgcgnggtgcatacaagacagctaggctagatataggttgtacttgtatgccataagcaaaaaaatgctcatttcaatactatacaaattgaaggtgttatttggaagccttaaccactaggctagagatcatttcgatagaataggtgataggatgggttaactgatggagacaacttaagtggcctggaattatttgatacggtttatgaaacctatctctattttacatagtaatgtatcactagtacaaattctttctatatataatgtatcgagagcataactgaactgcataactgaactgtacttgcatccgactttttccgcttgattggttacccgcatcatcttgttctgactgcgtgcgttgactttatacgagtatatatttgattacatgtatgtggaagacccgaactatatgagtggatacaaaataatttattttaagatcatttgactgtctccatccatacggtagaaacgagggtattggcccagttaggctcacgcccacctggcttcgcacacccagccatccaatcatgtatttagattcttagccactcgatcatatttaacggacacaattcctcgacgtattgttagacatagatgcagatacggttcccttgtagcttctgtaacaaacgtgagagttctaaaagacaatctaatgaccgatggggaaaaggggaaaaagaaaagttgtattcgattgcaatgacaggacaatttagataaggttttttgtttagagtaaggggttagggcatgatcatcctattgttgtctctagctatctattagaattggactcatgaaaggggacttccctgactatcatgcaaccaaacatacataaagagtgcaaagcgtgtcctaatatactatatgtatatcattgattcatcgagcagagagcattggctcattgtggtgtaattcaacaagcaaacacaaaaaaataaaacatattgttgtgtgccaccaaccaactccaagcatattaaaaaaaatcattgcttactgctgcactaaggccattctaaatagatagttccatcacactgttttcaagactgccatgtaaatatctgtttaggaaatagtgcatccaaagttttgtccccataaaactttcttatcttttataaaactcgttcatatatctcttcattaaattatatgacatgtcatcttatttacttatgtaacatgtcatttaaagaatgaaactccttttaaaaatgacctaattagagtgaaggtgttttgtcctttagccaaggtccatggaaggctgtcactaatcctgactatgcaataaccgtcatcaaatgagcacgagcttcccttggaaattctaaacttttaataaatccaccaagctcgacaagaagccagaattgctaaaatcatctgtttgtagcttccatcacaccatcatttcctcatcacaataaagcagtaaggccaaaataactctcgatggttctatagttttcagagcatgaacatat

SEQ ID NO: 9636 - DNA, 2629 bp, Zea mays
  misc_feature (1594)..(1594): n is a, c, g, or t
acgaaaacaagcacagagagagagagaaccccagcgggcaaacgcctccctccccctgcctccaggccccagatccggccatccgggtagctccagaccttctccaatggcggtcaaggtctacgtcgtgttttactccacctacgggcacgttgccaagcttgctgaggagatgaagaaaggcgccgcttcagttgaaggcgtggaggtcaaagtatggcaggtcagtgtctgtcagcaacggtgcaatcttcgagttagctagaaccaatgtgttgtgtgagtctggaatggtcaccgccaaattcccatcggtttcactttcacacgcgaaggtcccggagattctgtccgaggaggtgctcggcaagatgggcgcgccacccaagaccgacgcgccggtcatcaccccgcaggagctggcggaggccgacggcgtcctcttcgggttccccacgcggttcggcatgatggcggcgcagatgaaggccttcttcgacgcgaccggcgggctgtggcgcgagcagagcctggccggcaagcccgccggcctcttcttcagcaccggctcccagggtggcggccaggagaccacgccgtgagcagccgtctcctctccttttttcacaacatgtttccttccccttgcagcaccaaccgatcgaatcgcagaagcagtgggtaacgtttcccccttggcgtggcggccaggctgacggcggtgacgcagctgacgcaccacgggatggtgttcgtgcctgtggggtacacgttcggcgccaagatattcgacatggagagcgtgcacggcggcagcccgtacggcgcgggcacgttcgccggggacgggtcgcggtggccgacggaactggagctggagcacgccttccaccagggcaagtacttcgccggcatcgccaagaggctcaagggcggctccgcctgatatcgctcgcaccctcctatacgtatacataattattatagggaacatatctggtgcatatataaatttagtgtacatggtgcatatattaaatcagcattactcattttagatataatgtctctagttgttggtatattttgctaagaacaccctccgacgtggtgaagtatagcggtggaaaatattatttataaattgcaatgatcaactagagacgttaaatctaaaataaatagtgatgatttaatatgtgcaccatatatactaagcttccatgtacaccagatatgtcctcgttattacatgtacacgaggtatgatatgcattccatgttttcgtggtggtttcgattgtattgttgtgtgaaatttggtaatcggacccatattaattaataattatggcgtcattcatgtaaaaaaaaaaaaaaaattcctcctgcttggtatcgaatggaacaagtgtcttcattgtttcggcccacatagcagggcgttcggaagtaacctatagtccatcgccggctcggtcaagtgttcatgtatggcgtgtctcggcctgcttacttgggccgtgccacgtagaagactggaaggtgcaaagggcatgccatcggtaacttgtttacagggttaaaaaaaagncattggtacggataggggatgtttggcacctactgtaggatttttacatggatcatgttaggaattactgcaaaacacaacaacatgagaacacattcccgtattgcaaataggttcctagaccatctccaactccaagtccatattttgattttttttttagcagaaataaaaaatctcatccaacagattggtaaaatagttgtttaaaaacagatgtcctttttccaacttgtaggtttttcgcaatcaagaggaatcgtatatccgctttccgttcaacttttgttctctggaaatctacgcaagttgcacgtataaattaaggaaataaagagatctaaatgaaaaaaaaatagtgctccctacgtaccaaaatatagttcgttttagtttgggacggaaggagtaagagataagagagctcgatctccattatgtctgtgagtgcccaatcaaataaagcccggagatctaccctatgtcatctccaaaccaaacgtgcagcaaggcgcaagcagacgacggaggtcagatgaacggccggctggagacggagtttagagctgagctaatgggtgtgggactagtaaattatctgcctgattgacccctcgccaaaatcttagtaaacgatagtgagaatacacaaccctggtccctggtcggttctcctctgtcattgctggtctctactctctcgtctcttccttccaccgtgaaaaaaaaaactagtacctaacgtgcgccctgcgcgcgagaaataatttatttctttgaaggtatttgatagcgagataattggattttcagtttacaaataattaccatgaacaattacagtgagttgtgatcttcaaaataaaataacaatcttcgaacttggtttataggaacagatgtgatcctaactcccaagtttatagatttgacaaagtaccaagataaatgtcattcaaaattattggtttgacaaatatcttaagaggtaacacattattagtgcaataaaaattaacgataaaaactaaaaaa

SEQ ID NO: 9637 - DNA, 940 bp, Zea mays
  misc_feature (9)..(9): n is a, c, g, or t
ctcgaggcncggccgggggtaccctcgggttcggccgggatccacgaaaacaagcacagagagagagagaaccccagcgggcaaacgcctccctccccctgcctccaggccccagatccggccatccgggtagctccagaccttctccaatggcggtcaaggtctacgtcgtgttttactccacctacgggcacgttgccaagcttgctgaggagatgaagaaaggcgccgcttcagttgaaggcgtggaggtcaaagtatggcaggtcccggagattctgtccgaggaggtgctcggcaagatgggcgcgccacccaagaccgacgcgccggtcatcacgccgcaggagctggcggaggccgacggcgtcctcttcgggttccccacgcggttcggcatgatggcggcgcagatgaaggccttcttcgacgcgaccggcgggctgtggcgcgagcagagcctggcaggcaagcccgccggcctcttcttcagcaccggctcccagggcggcggccaggagaccacgccgctgacggcggtgacgcagctgacgcaccacgggatggtgttcgtgcctgtggggtacacgttcggcgccaagatattcgacatggagagcgtgcacggcggcagcccgtacggcgcgggcacgttcgccggggacgggtcgcggtggccgacggaactggagctggagcacgccttccaccagggcaactacttcgccggcatcgccaagaggctcaagggcggctccgcctgatatcgctcgcaccctcctatacgtatacataattattatagggaacatatctggtgcatatataaatttagtgtacatggtgcatatattaaatcagcatcactcattttagatataatgtctctagttgttggtataaaaaaaaaaaaaaaaagggcggccgccaccgcggtgga

SEQ ID NO: 9638 - DNA, 1126 bp, Zea mays
ccccctcgggtcgacccagcgtccgcacatatgtgtagagaccccacgggcaaacgcctccctccccctgcctccaggccccagatccggccatccgggtagctccagaccttctccaatggcggtcaaggtctacgtcgtgttttactccacctacgggcacgttgccaagcttgctgaggagatgaagaaaggcgccgcttcagttgaaggcgtggaggtcaaagtatggcaggtcccggagattctgtccgaggaggtgctcggcaagatgggcgcgccacccaagaccgacgcgccggtcgtcaccccgcaggagctggcggaggccgacggcgtcctcttcgggttccccacgcggttcggcatgatggcggcgcggatgaaggcgcttcttcgacgcgaccggcgggctgtggcgcgagcagagcctggccggcaagcccgccggcctcttcttcagcaccggctcccagggcggcggccaggagaccacgccgctgacggcggtgacgcagctgacgcaccacgggatggtgttcgtgcctgtggggtacacgttcggcgccaagatattcgacatggagagcgtgcacggcggcagcccgtacggcgcgggcacgttcgccggggacgggtcgcggtggccgacggaactggagctggagcacgccttccaccagggcaactacttcgccggcatcgccaagaggctcaagggcggctccgcctgatatcgctcgcaccctcctatacgtatacataattattatagggaacatatcttgtgcatatatagatttagtgtacatggtgcatatattaaatcagcatcactcattttagagtatagtggtggaaaatattatttataaattgcaatgatcaactagagacgttaaatctaaaataaatagtgatgatttaatatgtgcaccatatgtactaagcttccatgtacaccagatatgtcctcgttattacatgtacaccaggtatgatatgcattccatgttttcgtggtggtttcgattgtattgttgtgtgaaatttggtaatcggacccatattaattaataattatggcgtcattcatgtgaccaaaaaaaaaaaaaaaaaagcggcc

SEQ ID NO: 9639 - DNA, 4694 bp, Zea mays
cagcctatcatatagatagctcggctcgcaccccgtcggctccccgccacggccctttcaacccaaaagacccgtttctcggacgccgcgccccgcgcctccagcttaaaccccgaagggcagttcctagtgcatcgccgccgcggccgccgctgagagtagtcatgtgcgagtgcgccccggcgcagtcctaacggtacgtaggtctctccacggtggtttagtgaagttaagaacaccgccatggtgacaggccaggtcaaggcggccatgggcttccagcgcagccccaagtcgcaggtgccggaggcggcgtctccttctcgggcgcctacgtcggggtccgtgtccaccgccgggtcggcgccgtccaaggcgtcggcgctcgcgcggtccttcggcgcgtacttcccgcgctcttcggcacaggtgcgccccgccgcccgcgcgccgccgcaggtcgccgagctgctgcgcgccatcgagcagctccaggagcgggagtcgcgcctccgcgtggagctgctggagcagaagatactcaaggagaccgtcgccatcgtcccgttcctggaggccgagctcgcggccaagaaggccgagctccagaggtgcagggacaccgcggagcggctggaggccgagaacgggcggctgtgcgccgagctcgacgccgccgcgctcgaggtcacgagcaggaagcagaggatcgtcgagctggagaaggagatggcggagctgaggacgcggcaggacgcggcagcggacgccgacgactgctcctcgtccgcttcggcgccgagcgagcgtctcgagagctccagcgctgcgccaaagccaaaccgcgcgagtttagctcagcttgatcctccagcgccgccagcgccagggccagcgcctttgaagtccaagtcctacttctccgcgagctcgtcgcacccttcgcccgcaagctcgtcgccgccgccctcgccgtcttcctccacgtcgacctcgtcttcgccagcgcactcccgctcgtcgtcggacacggcagccgctccaaggccccgcgtggtagagctctcaaagctcccgcccatacctccgccgccgccgccttgccctcctccgccacctcccagcaggagcaagagatcctctcccccgaactcagccagcgtggacggaagcgcagccgccgctccgcctcccccgccgccgccgccgccgccgcctccccctccggcaaggaggcagttcggcgccgcgccagcaccgcctgcaggggcatcgtcggggcagggcgacgtgaggcgcgtgcccgaggtggtggagttctaccactcgttaatgcggcgggagtccaagagggacggcagcggcacagcaagtgaggccgcgaacggaggcggcggcggcgcggcggcgacgcgcgacatgatcggagagatcgagaaccggtctgcgcatctcctcgcggtgcgtaaagctgaagcatccatccatccatccatccgtaatcacctcgttctcgttttccgaaccgtgaccaccgccgccggtacgcagctactacgcgcgttaggtcgggtagataggcgtcctcttcagctgctagccttctaaccactgtccgaatggaacgacccgaagaacgcttcgtgtaggttggttggttggtttggtgacgcacagtcgtggaacagtggaggcgtcgttctccgtcgtcatttatgacaatattacaagcggtctccgtcgtcatttatgacaatattacaagcggtctccgtcgttattacaagagaagcggtttggttgggtagatatacggctgctacggtcaatgcatgcatgatccgtttgctctcgagttatcctcctcgatgtccatgccagaaatccaaatgcattctcattgctgaaatgttgacggtacattgtgctgatactacgggcgggctggtaaactagaaacgtagtacgtgatccgaggtggacgtgtcgaattctgaagcagttcgacagaaaaaaaaagaagtaaactataattgcaaaaactgaccgccacagactctgctctggcagatcaagtcggacgtggagaggcagggcgacttcatccggttcctgatcaaggaggtggagggcgcggcgttcgtggacatcgaggacgtcgtgagcttcgtcaagtggctggacgacgagctctcgcgcctggtgcgttcaaggtagccgacgggcccaccggcaggcttcagcctttgctaacaatccggcactcgtggccgcccggggggccgagcgcgcggtgctgaagcacttcgagtggccggagaacaaggcggacgcgctccgcgaggcggcgttcggctactgcgacctcaagaagctggagcgggaggcggcctccttccgcgacgacgcgcgccagccctgcgccgcggcgctcaagaagatgcaggcgctcttcgagaagtaagcgggccgggggactttctttttctttttttgatcgcaagggggtttcttttttttttttgggtctcaatgcgcgtgcggcgtgcctgtgccccgactggaatttcaggctggagcacggcgtgtataacctcgcccgcgtccgggacgccgccaccggccgctacacccggttccagatcccgtgggagtggatgaagcaggacaccggcatcgtcagccaggtaacgtacattcactcgccgtgggttgggtccactccgtgtagatgtagagactgtacagtaggatgtaccttttccgtagagtgagcgagtgagtgaattctacgcttggatggagaggacaaaacaactttctttttcccccgatgccgtccgcacatgcgtgtcgggtgtcacgtaccgacgtactccgcggtacgcctacagcccccccggctggcgcctgctgtgcccgcgcccgcgccgcgcgtgatccggcacgcctctgctagttcacgtgcagatcggagcccgtagaacggcggtgcgtacagcgtaccccccatcccgtgccggtcccagtacggtacacaacaaaaggagaatccggggtggaaatccggaacgcgacggccgtgtgtggcagaagcgggcgtggtctctctcgtctgtttcagcgtgggcgtctggtaggaatagcggatgtggcgtgggcgtgcaccggtgtgcacgtgagccggctggcggcgcatctcgtgagcgtgccgacgtgcgcccgtgctttgcttgccccgttccccttttctctcctgccaccgctgcagcagctacagaacaatcccgcgacgcgacacctcgggagccgcgtccgttctgcgggggcaccggttgctttagccagattcctattggcgctagtacgtagcgctagcgattcggtggtgcggtgcgtgatccgctccctgttgtcttcccgtgtgccgtgttcggcagagcactgtccgtgtgccaggcaggcgtgctctcgtctctttgctctgcgtcgactccttcaccatccattgaccctgatgtatgtattaaccggtagatttgaaagattcactcattcttcagtcttcacttcatcaacgaaaatatgtaaaagccgcatggatacccggacggagagtgatgtagccgtaggcccactgcattgattgcttgcgccgcgtacttttacaccggggtggttgtgcctgtctctgtttccactctcttgcgtctccctgccaagcccagtaatatccatgtaggcaggcactgacgagagcggtggtgtacatacagatcaaactccagtcggtgaagctggcaatgaagcacctgaaacgggtttcctccgagctcgaggtgatcaagggaggccctgaagaggaggagcaggagctgatgctccaaggagtacggttcgccttcagggtacaccaggtacaaccaaccgtgtgtgcggcagagaatagctaagaatttcatgcttccattccacgtaaaaccgttacgccggccgtgccaaggcacctgaacctgacgctcccacgcgccgctcctttcagttcgcaggtgggttcgacgtggacaccatgcgagccttccaggagctcaaggagaaggcgtccatgtgccgggtacagcggcagaagcagcaccgtcacctgcgccagcacaggctcgttgccagggcctgagaggaggagactgaggagtgtgtgaggaccagagcatgcagttcttattttttatatggtcggattatctatacgccatcatctcgtcgtcgccgccacagtgccatagtatgatttgttcattgttttttttatttgcgagaaatagttgatcgtgtattctgctgtaaacgctccagtactgtaactaatgaacagcctttgtaccctttttttaggagaaatatgtgtttattctctttcgttcttccgatgggttagaaaccagcttagaaaacttagtcatgtttgagttggacttgtgttgctctcatccgggtcagactgtaaataggcaattcatcaaaattcttgatccgtcgtagtcttcacgtacgaggagactatggattatgctagaatcgtccaccgtgtagagtgtagacccaggaatcaaagataaaggttgatcaagataaaagttgattgagtcgtgaacatggtgacgatctttatgaggtccatcgggcttctaagcatt

SEQ ID NO: 9640 - DNA, 2561 bp, Zea mays
cgaccaatcccgcctcccccgcccacggccgcgcctggagcggcgggccgcgcgcggccaccctcgcggcctcgccgtctcgacgccaccgctgggagcgcgatgcccacccgcgcaccgtgcgcaccctcccccacgtgtcccccctgccgcccgagggccccgcctgtcacccaccgtccccggggtgggcagccgaaagcgacgcgtgaagcgctctgccctgcctgctgccctcagcgctcgcctctcggcacgagaccattacctagaacatcctaatcgaaaaacaacccccgatgcgatgggtgcccctgcccctcgatagccgcgccgctctcctgcccccgttccccatttgcatcctcgtccacctccctgccctagcaccgtcctcccctattcgacccaacgccgccgccgcctccgccgccgcataggcctcgccgcggcctctgctccgccccgcggcctccggaggttctactcgcgcgcgatccgccgctgcgtccgttgctccgccatcgattcggtggcgcgtggagtatgtctctggtgcaagagtgctgaagatgaaggagaggagctctttatgcgaaagtgcagccgatggaaactggggtttgaaatataaaaggaaaagaagcaagttaacagttagcccatctaatgagaatgaggctacctcaccaacatctgactctcgaatgagccatggttccaccaaaaagaagttgaagcatgacaataacatttctccatcagccaagaagataagagggcacgatgggtattttttcgagtgcgtagaatgtgatcttggtggcaatttgctatgttgtgatagctgtcctcgtgtttaccacttggaatgcctcaatcctcctcttaagcgtgcaccccctgggaagtggcaatgtccaagatgccgtccgaaaaaagttagcttgaagctgttaggtaatgcagatgttgacacttctaaacgtgaaaaaagtacaaggacatatgcaagtacggcatcagatagtccaccttcgcatacaaaagtctcctttaagaccaggaactccacacaagacaaaactggattaaacgaacaaggaaaagagtcatctggtggcacaatgaatgggggtgaaaccagtacgaagaataatgaagttgagaaaaagaagacactgatattacatttgaagaagcgttcaaccaaggaattgtcagagaacactaaaccctcgaagtcagaatttgttgaactttcagaagagaaaattgtaaaacatggaagtgttttgaaactcaagaaacatccacatcgtatggacttgtctccaagtaaatctaaaaccaggaggcaaagtagccagagagagagtaaaagatctggcacaaaaaagattaaatattccatgtctgatgatgacagtgtttcctcatcagaaccatcgacatctcttgataacagtgaatcaccaccaaaaagaaaacactcagatggaaaagcaccttcatccagtaccaaaaaaaaaaaaaaaagtgaaatttgttgagaaaaagcactctgaggagcagggcgtggtaggtgacaaaatgatgactacccaggaggatcagcaggtcgatcgcatcctaggctgccggcttcagatgagccaaatcaacccgccgtcccatgcttcattggagcagtttgaatcagctaatctccaggtggatggtatggttcttccacatgcttccgctggcattcctaataggcctcatgatggaacagagtcttctagaaatggtacaattgaggatatatgtgctgatgaatcagccaatcatagtggtcacaatttagaaatgcgaaaggatacggacagtaaatcccatgaaaaggagtcacataagcgagaacaagtcaagaagatattatcagtatgttctggtgatgagaccaatataatgagagatgatcaagtagtcagagaaaatgtttcagcttccaaaaaaggtgaagatgagacatctgatttgccagcagaaaaggatgataccatacttccagtcaccagagcttgtacaatgatcaggaccaatcaagatcatacagatgaaagtaaacagcatgggaaaatagaacaaataacaaataaggactacaatgatgctggatatgagttcttgatcaaatgggttggaaaatcaaatattcacaacagtggggtttctgaatccgaggtaaaaatattagcaaaaaggaaactagaaaactacaaagcgaagtatggaatgagtttgataaacatttgcaaggaacagtggtgccagccacagcgagttattggtcttcgtgcttctgtagatgaagtggaagaggttttaatcaaatggtgtggtcttccttatgatgaatgcacttgggaaagatcagatgaacctaccctgatgaaatatagccatttggtcactcagttcaagaattttgaatgccaggctttggataaagatgtggtaaaagattatgcaaatgcaaggaaccgacatgagcttaatgtgttagttgatcagcc

SEQ ID NO: 9641 - DNA, 2400 bp, Zea mays
  misc_feature (1431)..(1431): n is a, c, g, or t
cttgtcttcacataacaccaatagtttagataattaaggggaacacctcacaccctttttttttgggggggggagttgacttcaatatatgtagtcaaagtccaacttatagtccaagtccctaccttcataccagaaagaatgcaattctagatggattgactttcatatatatagtcaaagtacattttggaggacaagtcactacctccgtcgtttgtcccataaaaaatgtatatgtgcatccttggttagtgtctaaaatttgaccaaatatatagataaaaatattaatatttatgatgtcaaataaatatattatgaaaatgtatatgatgacaaatctaatgatacttatttgatgtcacaaatatagttagtcaaatttaagatactttaatttggtattgtgctagaatttaattcttttctggacagagggactgagggaatatttccaatcaagaggccaattgttttagccaccgcataagtaactttcaacttgggcgtagactgaaaaaatgctatcgactagtttgttctcttaattcattccacacttgttttataagtcatggttggaacaaaatgtagtttcgtggactgccagcttgacaaatgttatttggctggaaaaattaagagtaaattccggatcaatttgatggtgctaatatattattttcaacccttcaggtaaagtaccacccctttacaaaggaagagcagctggaagccctagagatggaaaaacaagccatagaggagaggaagcgtctgaaggaggctgggataattggtagcacaatggatgctgttggttctggtgttggatttgtgggtactggcattggcgctggcctcggtttcgttggttcaggaattggtgctggcgcaggccttgttacctctggtattggtgctgtcagcagtggccttggtaaagccgggaagttcatgggcaggactgtgacagggcctttcagcatgtcccgcaagaacggcagcagctctactgctccccagcatgatcaaccttcggcgtagtatgatgtacagtgaaagacaattgtcatatttgtgacagggttgccattctactctgtatacgtgctatacctaggactatacgtagcacttcgtttttgtttctgccactgcctggtgcctggttatatgaaatatgttttcgtcgttgtattgaaacgaggatctttcaaagtaaagattgctgtaaattgcatcagctttcccgaactatatgaaatttgtgcagtctgttgaagtaaaaaaaaaaaaaaaaaaactgatggcctagtctagtgctagtctattgtccattcactgatgtcctttagtttgtttatacccggagtcagtagcatgagaatcttttttttcctataacgtacagaaatcctgaaaatnagcgtatttatcttggaagttccaggagtccaacacaaacattgtaaatgatgtttgaagggcatctttatatttaagcttctgtaaagctaatttgtgtgaattttaatagcacggagcaacgttcaacaatttggtgtgtcaaatatgtttagcatcttcagcttccgtttgggttcggtacaagcattgatgcagggggaaaccaaagttgatgtcaattaaatgcaattaaggacgtagggagagcaatggattacatataagacatactattactatttaggtccacgttagacacgttttaaatggctttcatgtacacgtcgggaaaaagacaaaccgtttacaacaaagatggaagcgcgcttgtgattttagggtttttttaacgaagatcacattgggcatgttctattgaaggtacttgacggcgtgaaatataggggcaaagtcataattaatgaacatccaaaattaaaagtaggggcaaaacaataattgtaaacaaaaaacaattatgattttgccttttgttgagcaccatatatgacattgtaagattggacggtccggacatgtggctcggacggtccggtcatgtggttcggacggtccgcgtcctagacagtccgcggggtagcccgaacggtatgtgctaggattaacttaggtgaaaatacttccttttttgtacgtgtttatccatgtaattacgtgaattctgttggggaacatctaagaacatatctagatctctcctatatatatgaagggatatgatcgattgtgcacacctacaatcgaaccaattaatcaaacatatcattttctttactttcttgtcctaagagtaccagtaattagcctagtattagtctttttcgacctatttcttcatccctaggcgactctgcgccatctagggatggcccaggtggactgccaaccccagagcaccctcctaaa

SEQ ID NO: 9642 - DNA, 2232 bp, Zea mays
  misc_feature (2217)..(2217): n is a, c, g, or t
gtgccgctgcgagcagactggaataagcctcgccccgttctcgctacaccgtggagttggatcgttcaattcaggactaactgtgaggcttggtctttgtcggatttgagtttcgttgcgtgtctctctcttccttgctgtaggctgcggatatcaaggtgcttgggtctctcagcagggacgacctcaggaagctgtgcggtgataacttcccggagtggatatccttcccgcagtttgagcaggttaaatggttgaacaagcatctgagcaaactttggccttttgttgtagaagctgcaacagtagtggttaaggaatccgttgaaccactgctagatgattaccggcctccaggaataaaatctttgaagttcagcaaattttctcttggaaatgtgtcaccaaagatagaaggtattcgtattcaaaatcttcaaccaggtcaaatcatcatggatatagatttccgttggggtggtaatccaagcataatcctagctgttgatgctgtagttgcatcactgccaattcagctcaaggatcttcaggtctatactgtcatacgtgttatatttcaactgtctgaagacatcccttgcatttctgctgttgttgtggctctccttgctgatccagagccaaaaattcagtacaccctgaaggccattggaggaagcctaactgcagttcctggactttctgacatgattgatgacactgtcgattcaattgtttctgatatgctcttgtggccacacaggcatgttgttaaacttggtgtcaatgttgatacgagtgacttggagcttaaacctcagggaagactttctgttactgtggtaaaagcaacttctttgagaaataaggagatgatcggtaaatcagacccttatgtgaaactgtatgtgcggccaatgtttaaggtcaaaacaaaagtcatagatgatgacctgaatccggaatggaatgaaacatttgacttgattgtcgaagacaaagaaacccaatctgttatttttgaggtttacgacgaagacaaacttcagcaagacaagagactaggtgtggcaaaactagcagtaaacactcttgaatctgagattacccaagacgccactctgaagctgctacattcactggatccaattaaaaataaggacaccaaggataggggcacattacatcttaaggtaaagtaccacccctttacaaaggaagagcagctggaagccctagagatggaaaaacaagccatagaggagaggaagcgtctgaaggaggctgggataattggtagcacaatggatgctgttggttctggtgttggatttgtgggtactggcattggcgctggcctcggtttcgttggttcaggaattggtgctggcgcaggccttgttacctctggtattggtgctgtcagcagtggccttggtaaagccgggaagttcatgggcaggactgtgacagggcctttcagcatgtcccgcaagaacggcagcagctctactgctccccagcatgatcaaccttcggcgtagtatgatgtacagtgaaagacaattgtcatatttgtgacagggttgccattctactctgtatacgtgctatacctaggactatacgtagcacttcgtttttgtttctgccactgcctggtgcctggttatatgaaatatgttttcgtcgttgtattgaaacgaggatctttcaaagtaaagattgctgtaaattgcatcagctttcccgaactatatgaaatttgtgcagtctgttgaagtaaaaaaaaaaaaaaaaaaacgacacacagagcagcatttcgagtaacacagttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcatccctgtcacggtgttcatcacagacatgaactacgagnctatcgctccctaca

SEQ ID NO: 9643 - DNA, 1495 bp, Zea mays
  misc_feature (15)..(15): n is a, c, g, or t
cattgggtacctcgnagccggccgggccgggctgcccagatcgctgtgaagttgaccccgcttccctcccagctcagcgacctccttgccgattacgagtgccgtgtgtgccccgctccagtaagccaacagctcattcctcctcaccacgctgctcgttactaaccaagcaatcaatttcctcctctttccattctcccagccacaaatcgatcggaaacgcacgcccctttctcttcgccttttcgcgtcgtccagatctcagtcgttcttcgctccatgagctaggaatccgaggtgtcctctaggctaagcgaagttggccggcggcggctaggatggggttgatatccgggatgatgatgggggtcattgttggcgtcgccatcatggccggctggagccgcgtcatgcgccgacgcagcacgaagcgcatcgccaaggctgcggatatcaaggtgcttgggtctctcagcagggacgacctcaggaagctgtgcggtgataacttcccggagtggatatccttcccgcagtttgagcaggttaaatggttgaacaagcatctgagcaaactttggccttttgttgtagaagctgcaacagtagtggttaaggaatccgttgaaccactgctagatgattaccggcctccaggaataaaatctttgaagttcagcaaattttctcttggaaatgtgtcaccaaagatagaaggtattcgtattcaaaatcttcaaccaggtcaaatcatcatggatatagatttccgttggggtggtaatccaagcataatcctagctgttgatgctgtagttgcatcactgccaattcagctcaaggatcttcaggtctatactgtcatacgtgttatatttcaactgtctgaagacatcccttgcatttctgctgttgttgtggctctccttgctgatccagagccaaaaattcagtacaccctgaaggccattggaggaagcctaactgcagttcctggactttctgacatgattgatgatactgtcgattcaattgtttctgatatgctcttgtggccacacaggcatgttgttaaacttggtgtcaatgttgatacgagtgacttggagcttaaacctcagggaagactttctgttactgtggtaaaagcaacttctttgagaaataaggagatgatcggtaaatcagacccttatgtgaaactgtatgtgcggccaatgtttaaggtcaaaacaaaagtcatagatgatgacctgaatccggaatggaatgaaacatttgacttgattgtcgaagacaaagaaacccaatctgttatttttgaggtttacgacgaagacaaacttcagcaagacaagagactaggtgtggcaaaactagcagtaaacactcttgaatctgagattacccaagacgccactctgaagctgctacattcactggatccaattaaaaataaggacaccaaggataggggcacattacatcttaaggt

SEQ ID NO: 9644 - DNA, 2429 bp, Zea mays
gcacgagaccattacctaggtaccctccgattcggccgggagcacagctagagacctctcttcgtctcatcagtagagagaaaggttaataggggggaaactaatgaagacctccgtagtcgttgctgctctagcagcggtgctgttcgcagcacagtcgtatgcttccctcgccggcgccagcggccccagggtcatcatcgtcggcgccggcatgtccgggatctcggcggggaagacgctgtgggaggccggggtccgggatctgctgatcctggaggcgacggggcgcgtgggcgggcggatgcacaagcacaacttcggcggcatcaacgtggagatcggggccaactgggtggagggcctcggcggcgaccagctcaaccccatctggcccctcgtcaactccacgctcaagctcaggaacttctactccgacttcgacagcgtcgtcggcaacgtctacaaggagaacggcggtgggctgtacgacgaggagtacgtgcagaagagaatggaccgtgcctacgaggtggaagagctgggcgccaaccttaccaagaagatgcaccccagtggccgcgacgacatctctgtcttagccatgcaacggctgttcaaccaccagccgaacgggccgacgacgcctgtggacatggcgctggactacttcatatacgactacgagttcgcagagccgccgcgcgtgacgagcctgcagaacacgcagccgacgcccaccaacgccgacttcggcgaggacaactacttcgtggcggaccagcgggggtacgagtccatcatacactccatcggcagctcctacctctccaccgacggcaacggcaagctcaaggaccgcaggatcctgctcaacaaggtggtgcggcagatcacctacaacaaacaaggggtggtcgtgaagacggaggacgggtcgtcgtaccgtgccgactacgtggtcgtctccaccagcttgggcgtcctgcagaccgatctcatacagttcaagccacagctgcccttctggaagatcgcggcgatctacagtttcgacatgggggtgtacaccaagatcttcctcaagttccccgagcggttctggcccgtgggcgaggggaagcagttcttcatgtacgcgagcagccggcgcggctactacgcgctgtggcagtcgttcgagcgggagtacccgggcgccaacgtgctcctggccaccgtcaccgacgacgagtcgcggcggatcgagcgccagagcgacgaccagacgaaggcggaggtggcggaggtgctgcgggacatgttccccgccgccgacgtgccgggccccgaccagatcgacgtctacgtgccgcgctggtggtccgaccgcttcttcaagggatcctactccaactggcccgtcggcgtcagccgctacgagtacgaccagctcagggcgccggttgggagggtctacttcactggtgagcacaccagcgagcgctacaacggctatgtccatggagcataccttgcaggtatcgactccgcaaacatcctcatcaactacatcttcaagaacgaggagtacaaggtccgtggcaagtacgacgtcgacgacctaatcgcacaggctagatgaacgacgacgagtgcacacgccggatgccctgcgccacgatagagacagaataaactgccacggctttatttgccctgtggagcgatgcatgcttcccccttccctttcgagctagagcaaccccagcaggcgccctgcaccgtctggcgtctgctgttcatgtcccgtgtctctgtgtgtttttggattggatgccaatggaacaagaacgtaggctcgaggcctctgttctgtttggtgtttgtggggtcatctatgcacgtcagtttcacatcagatcaaaatttacaaaaaaaactctttatcaaaaaaaaaaaaaaaaatttatatggatcaacagcttgtatatgtgaggggctctaaaagatattctttacattcgatatgtaaagaatttttttcctcactagtggtggtgggaataccggatcacttcggggacgacggcgagcccagccagcgacatcaacgcgaaacatccgatgattctctctcacaaagctaatgatatttcagtccggtagtcgccaccgcgatcgatgccggcccgtcattaatgggctgggcctgggcaccaccaccccgtgcgtcatgggccgaatgggggcacccaaacaagatccggagggtggtgaaaatgaattcttgggacaggcgcacgaggcggcgtcatcgctaggcgctatggataaaaactggacggggaaaaccacctatctgacgtttctgtttctacattctttttttacgagaacgagatcgccttccaaaaggccggatcaaaaaacgcaactttaactgaaat

SEQ ID NO: 9645 - DNA, 1976 bp, Zea mays
gggccccctgggatacggacggacacctcacaaggacaaccagtcccctcactcaggaagcttcccggggaaagaatgtgcgggtgtgcggccctcgtcgccggagcccggccgccacggcccgtcctcccccgcaggctccgtcgccgtcgagggagctccgtccgagcagaggtctcaccaggcggtgagtcccagccgaagaaggtcaccgtcgcaggcgccggctgggccggctttgccgccgcgcaccacctcattaaacaggggtacgatgtcacgcttcttgctgcggagagtggcccaacggaggaggttggcctcagaggattctggcaaccgtatcgcaacatcttcgctttagtcgacgagctggggatctcgcctttcacgggctggaataaagcagcatactattctacggagggccttgctgtcgaatttcccatatttcataaccagccccgattaccagctccctttggagtctttgcatatccagaattccctaatcttcctttgagtgataggctgacatcaattcctgtcatagctgcagtcattgacttcgacaacactgacactgcttggaggaaatatgatgcaatgactgcaaaagagctttttaagatgtatggttgctctcaaaggctctacagggaaatttttgagctagttattcaggctgccctgtttgctcctggtgagcaatgtagtgcagctgcaacactggggatgctgtactattatgtgttgtctcatcaggaaaattctgacttcttgctgtgccgtggtgaagtagaagaaaaaattttctctccttggctgcaatcattggagcttaaaggcttaaaatttgtagaaaataaagttccaacaagtttgactacagatgtggatagcggatgcatctcttccattgtttgtggtgatgatgtgtacgaggcagatgcatttgttttagccatgggactctcttctctacagtccatcgtcaaaaacagtccattcctacggtctgatcgagaattcaggaatcttcttcacctatctacagtcgatgtgatctctgtaaaattatggtttgataaaaagatcacaattccaaaggttgccaatgtgtgttctggttttgatgattcatctggctgggcattctttgaccttacctcagtatatgatgattattgtgaagaatcaataaccattgtggagtataatgctagccatttggtactcttaagcgatgatgatattgtctatgaagcttcatcacatcttatcaagtgcatacaagattttgagggcgcaattgtgataagatattcaatcagaagatctcctaattctgtaatcaactttcttccaggctcgtacaagtacacacttagaggatcaacttcctttccaaatttgtttattgctggtgattggattgtcaaccgacatgggtccttttctaaagaaaaagcatatgtgactggacttgaagctggtaatagggtagtagactattttgacattggggactttgccaaaataattgcagttgaaggagatgagccccatatagagacattgcgaagtctcaacagaagagccaatgaactgaagtcacaaatcccattctcagaattctttctccaataattttgttaggatttttctgtgtttgttgagcattgccattgttgtaggcattgttattaaggcggtaaggtaaagcatggcggcccagccctttgagtcgactagacgcttaaggcgtgcggcgaggtgtcgccatacatatgtcctatcctacaggagagcaatagaaacataccttgttgatgccaattttggagctccagtttcgcttgttccatgtagcatgtatcccccttacagattgcaacatgaacatgttgtgaattataattaatgtaagaaacaatttataatgcaatgattgaatgaagcatctgtgtaaatat

SEQ ID NO: 9646 - DNA, 1855 bp, Zea mays
cccagcgtccgcgcagcccgcagccacccgcgcatcctcagtcctcatccgccactccgtcgaacgcccctgcgcacgctccagctgctatgctcctccgcccgcgcccctccttcttccgagccgtcgtgccgccgccgctcacccgtgcctgtgtcccctcccgtcgcacgctttcagcttctgcagaggcgggaacagcctccccgaaggatgcagcgtcagcgccggttccggcggccacgcgcaagaaccccaggaaggccgggtcgccacctatggggatcgtgaagacggcgctgtttctgccgcccggggtggagcgggatgcgttggtgcccgcggacatggtcataccggggtcgaacatcgtggtcggtccctacgcaggggacgcgagggtgaagggtgctgagttcgtcaagagcagcgcgcgcgcacgggactgccccaatgacgaccggcccgagttcgccgtccttggccggtccaacgttggcaagtcctcgctcatcaacgccctcacccgccgcaaggaagccgcgctcacttccaaaaagcctgggaagacccaaacaatcaatcactttttggttaataagagttggtaccttgtggatttgcctggttatgggtttgcagctgcatcccaatcagctcgaatggactggtcttcatttaccaagggttacttcttgaacagagataccttggttggcgtacttcttcttattgatgccagtattccacctcagaaaattgatctagactgtgctaactggctcggtcgtaacaatattggattgacgtttgtgttcaccaagtgcgacaaagtgaagaaaggtaaaggagggcggcctgacgagaacatcaaggagttccatgaaacaatcagcgggctttatccagatccaccgccatggatcatgacaagcagcgttaccggattaggccgcgacgggctactcctccatatgtcgcagctgaggaactactgggataatgaagcagtctaggtggagctacatagatcaagtgccactagcaacggtagcagtacgtgtatgggaacagtcatatggcctaaactttcatcgatagatgtcgcttctcatggggcttcttgttcagttttgcttccgttttttttttctgggccttttgatgtatagttgaaatgcagttgctcctagtttctgtttcactcaccctgtacaatgcccagtctcagcgggagcttcatgacattgttactaagactcacaggtattgaagacagtacaaactagttgcatcctcgtaaaacttatgaaactttcactgagactggacaagggccagtttcagtgggagtttcattgcgggtttcatgtctactgaatagattaccaggtcagtattttgtcagcattttttttaagatatggggatacatcaatagtgagagacgcgaaatggttttatgatgataaaatcatgtgtaggatatttggtatcgtgcgtggcttaggaaacaacgaagacgaaaccttcgtcacttgtagtaagttaattgtgcgatgaaatctcgcgttgcgaatggccgagccctagccgaagcccgaagctattatgattcctgcttgtactacatcataaatgtcggatctggaattacacatttatggaggcgaaggcactcgagagaattcaatatacgtacactgtacatgtacacattcaatgagacggaagccacgaagctgaaacccgacaggctgcaggtgcatttggatgatttattatactactatactatatgtgccaccactagtacgtatttcctctttttctttttaattgtcgctggatagtt

SEQ ID NO: 9647 - DNA, 2422 bp, Zea mays
cgagcctcatcaatcgatcacacgcgacgcgagtacgagtacgagtatacggccacgagcagacgagctcctccgccaccagtgtcatcgcgcagcctcgcgctcgtccatggcgtccgtgtacacggcgccgcgcgccccgctcccgacggtggcgtcctcctcgtcatccgcgcggcaggtggatccgaaagtggagctgggagaggtggaagcggcattttgctctcattgaggagagcgagcgtctcgttgatgagctccagttgcaactccaggcgtctgtttatagagaagactacagaagtgctcataagctgaggctagctattgctactatagtgaaaaatgacactgtgggtagagctgtctcggacttaaatatggccatagatgaggagcgctacaaggatgcagcatatatcagagatcatgctggcgcaggactgctggggtggtggtctggaatttccggaaatttgtccgatccatatggtcttattattcgtataagtgctgaacatggtcgatatgtggcaagaagttatgatacaagacagctggcttctgacagcctctggtctccctatatttgaaatatactttgcagaggcaaatggtggatacaacctgacaggcagtgcatctgaaaccagatggtagcgattctgaccaagtgccaaacatgttaagggagaaacttggcatggacagtataaatatatctagcagttcagtagggtctaaccatgaagaattcgatggaagtgtaaacatggatgataaagatagtgatgatagcaacattgatgctggccctggttcgaaagacttgtcaagcgggccccccgcggccccccggcttaaaatcttgaaagtggtacccatgcagaatgttgacaaagactacataatcaatatttttgatcagatttcagaggaaaatgatgatcctgaagttgaaaatgaatcttcagaagatgctggtgatgaagataacagtggagtagcagaaacagtttctgcagaagagaacggtgatgaatctggtgacgaaagtgatattgaacccttggtttcaattgattttgtcattgagaataacgatgactatgcttctcatccatctgctgaagcttttgaacgaatgccagctagattagaaaaaagagaccgcttctcgttttccttctatactgaagaatatagtaaaaaactagatgctggaaaggcccagcagacttcaaagaaaacagttcgtttgcataccgatcagcaggattatgatggttttgtcgagcttgatcgtgtaaagttgagcggcagcaacaaaaaactttcgatactacaacttggcatcaaacgaaataacaaggttcagaaaaaactgcatggagttacccactttagtcgtattcagatgcctatatcttcagatcctcttaccggcttatatttgaccgcatcaggatttgactcagaaattcttagtttacaacgaaaatttggtcaatggcgggaggatggtccatctgaggagcatagtgacctattgttctatgagtatgttgaagctgtaaaattaacaggggacaacctcatgccagctggtcaggttgttttccgtgcaaaagttggtgaacactatcggctccctcataagggaattatccctagagaacttggagtgattgctaggtacaaggggcaaaggaaaattgcagatcctggtttccaaaaccctcaatgggttgacggggagcttttgatactagatggaaagttcatcagagatggtcctgtgatagctttcttttactggacatctaatgttcatcttttcgaattctttagacagttgaagcttcctgactagttcccttctaaaagtagttaaaggccattataatttcagcatagctgcgtttggagccaaccggagttgcctggcatcgagtacagattctgatgtggagaacagggcgcctggcatgaatcagtggcatctccacccaactctgatagcttgccacaagggtggaaaagagatcgcagtcgcaagaggaatatcatcctgccaacatgggtgagccgcgggcgcatcatacttactaattacgtttctcctctgctcgtccaccgccagtttctgtgtttctcatagcaagtagaactaaagcacctcaaagatgtaaagttatgtatgcagtcgcaaatagtttaggattttgagcacatattgataatttttatacatggagagtcagtatgtatgtgaaatagtacgagcaagagttttgtgcagcgtgatcaagctgtggcctaatgcttgtacatgtgtcgcaatcagcagcagaggcgtagagccaccacggttacacagattgttagggggtgtttggtttaaggaatcactacattt

SEQ ID NO: 9648 - DNA, 731 bp, Zea mays
gcctgggccggctgcatctttctcctcccaccatcacctcctcctctttatccatctgccagggcgcacgaggagaacggcggcgtctgagatcgcgaggccgaggcttgtcccgtcctcgctcggctccgctcctctcacccacggtttctggaggacaattctttgctatctagccttcctcaaaagtaaaaagggtaaatgggatcagaaggaccttcagttgtgactgtccatgttactggatttaagaagttccatggggttgctgagaacccaactgagaaaattgtgaccaatcttaaatctttcttggaaaagcgagggttgccaaaaaatcttgtcctcggaagctgcacagttctcgaaacagcaggggaaggggcacttgccacattatataaggttttagagtctgctgttgcagacagaggaactgggtcctcggcacagggacaagtaatttggatccactttggggtcaacagtggcgcaataaggtttgcccttgagaaccaagctgttaatgaggctaccttccggtgtccagatgagctaggatggaaaccacagagggtccctattgtgccctctgatggaagcatctcacggacgagagagactaccctgccagtcaatgaattaaccaagtcactccggaagataggctacgacgtggtgccctccggcgacgccggtcggtttggatgcaactacctgtactaccactc

SEQ ID NO: 9649 - DNA, 1579 bp, Zea mays
ggaatgcgagaggatgcgcttttaaagggggcggaccgggctcgcctcgcctcgcctgggccggctgcatctttctcctcccaccatcacctcctccacctcctcctctttatccatctgccagggcgcacgaggagaacggcggcgtctgagatcgcgaggccgaggcttgtcccgtctccgctccgctccgcccacccacggtttctggaggacaattcttcgctgtctagccttcctcaaaagtaaaaagggtaaatgggatcagaagggccttcagttgtcactgtccatgttactggatttaagaagttccatggggttgctgagaacccaaccgagaaaattgtgaccaatcttaaatctttcttggaaaagcgagggttgccaaaaaatcttgtcctcggaagctgcacagttctcgaaacagcaggggaaggggcacttgccacattatataaggttttagagtctgctgttgcagacagaggaactgggtcctcggcacagggacaagtaatttggatccactttggggtcaacagtggcgcaataaggtttgcccttgagaaccaagctgttaatgaggctaccttccggtgtccagatgagctaggatggaaaccacagagggtccctattgtgccctctgatggaagcatctcacggacgagagagactaccctgccagtcaatgaattaaccaagtcactccggaagataggctacgacgtggtgccctccggcgacgccggtcggtttgtatgcaactacgtgtactaccactctcttcggttcgcggagcaacacggcatcaaatccctgttcgtgcatgttcccctcttcttgacgatcgacgaggaggtccagatgcacttcgtcgcttccctccttgaagtcatcgctttctcatccaactaggaacagcagttggaagatcagcgtctggattcctatctcaaggatggatgtaaagctggaatgctgcatgtaggctgaataaggtggtgtggtcattggcgatagatgttaatcttgctccacaggttgtgtttgggaatcgggagggaaaaaaagagaggtcattggcgatagatgatgatcttgctccagagggtgtgtttgggaattgggaggggggaaaaagaggaaattgctgcatagagtcagacggtgtatcagcttgtacgccatcaatcaagtgctgtaaacatgcctgggaaataattggggacctggatttgaataagatttgagttgttgggggcggacgcgctacaaaaagacttgttcggttattcccaaaaaaaaaaatatatatggatcggatgagattggaaaaaattaagaaaaagtttgacttgtttgggattcaaacccatccaattccactcaatccatatggattaggagctaaccgaacaagtccttacgtgatttacgtgcgacgggatagaaatcatgtatgttgacgtggataaatgtgctactagtctaggctgtttaatttttagggactgatttttagtctatccattttagtacctaaattgatgaacacatagactaaactagaggt

SEQ ID NO: 9650 - DNA, 2171 bp, Zea mays
cattgggtacctcgagggccggccgggacgcaaagagtaatcacaggtcaaaccacgcggaagtttttttcccaaccaggcgatctccggtccttgcccctcgtcacctcgtgccggccgggaaaaaaaaaaaaaaaaaggtgggtcattggctcactgcttcctgcaacctccaaccgggcgggcgcgggccactggaccagcgacacatccggggagaagaaagctcggaggatccgaacgacgctgacggcgaggccgtaaccgcagagcagcggttgttgggatctcctgctcctggtcctggatgctggcacttgaattccagcatgaggtcaaagaagatatttggtttatccatttcccttgtactcatcaacctagcttctatattggaacgagctgatgagaatctcctcccagctgtttacaaggaagtcagtgctgctttcgatgccggtcctactgatctggggtaccttacatttctgatgaactttctgaagtccatagcatctcccttggcaggtgttcttgctcttcactatgaccgccctgcagtgcttgcgatagggactgcgttctgggctttgtcaacgggggctgttggtgtcagccagtattttgggcaggttgcattctggagagctattaatggtgttgggcttgccattgtaataccagctcttcaatccttcattgctgatagttacaaagatggcacacgtggagcgggatttggtttgctatcacttattggttcagtaggtgggataggaggtagtgttttggcaaccatcgtggctggaggggattattatggttttccaggatggcggcttgcatttatatctgttgcatttgtgagcttcttaattggacttcttgtatacctttacactgttgatcctaggaaattatctccaagccattttggcggtggtgaggacaatgagaggttacatttggtcagcaatggtatccttcctccacattccatctggaaggattcgtggatagcggcgagatccgtaatgaaagttcggacctttcaaatcattgtgttgcaaggcattgttggctctttaccatgggctgctgtagttttcttcaccatgtggtttgaactcattggtttcgacaacagcagctcagcggcgctgaatagctttttcgctattgggtgcgccagtggatcatttctgggtggtgtgatagcagatgtcttatctagatactatccagattctgctcgcgtcatgtgcgctcagttcagcgccttcatgggcatccctttttcatggatcctcctcacagtcattccccagtctgttgattactggtctgcctatgccgtcacactctttttaatgggaattaccataagctggtgcgctacttgtgcaaacaaccccatgttcgcagaggtagtccctcccaagcaccgcacaatgatctacgcctttgaccgcgcatttgagggttcatttggctcgcttgctgcacctgctgttggattagtgaccgaaaagatctatggctacaatgcaaaggccgtcgatctatcacatggatcagtggatggagcttatgcactctctagaggtctattgactatgatgattgtcccttttgctctgtgcctcatgttttacaccccactgtatacagtgttcaagcgtgaccgagaaaatgctagattggccagcatcaaggagcaggaacttacttgaaaagctttctaacaaggagtactgatgtagtttggattacatagtctacaacaccgccaacctggaggttttgattgaagtactttggttgatgtctaggatactcaggttttatgtttcttcagtcggatatcatttaagagtacacattttgtacacaagcgatagattgtttgatctcgtcgtatgtaactggttcagtatacattcggaccttaacctggagagtggagacagggtgttgcagctttccattgaactttcagcatatagatacagttctttctcgttttgttactatttacggtctgtaatcttgttttgaactgcctgaaccatcacgccattccaatgatgatgtcatttgcagaactcttgtaccagtttcagtttatatcattataagatcaacgcttttctgacaaaaaaaaaaaaaaa

SEQ ID NO: 9651 - DNA, 880 bp, Zea mays
ccccactaccagaactcctcacctcacttcagcctcaacgcctaccaaacttacgcagcctctccataactgcgagctgttgctcctcctcccgagctaccattctccgtcgatctcctccaggctgtagcgcgctgccacgcccgcccatggcctcgggctcgaaaccggacagcgtggagaccgaccatcctggcggcggcctctccatcgccgtcgagcacaacccaccggagtcgcgcctgcagcagctcggcgtcaggtcctggcccaagtggggttgcccgccggggaagttcccggtgaagttcgacgcgcggcagacgtgctacctgctcaagggcaaggtgcgggcgcacatcaaggggtcgtcggagtgcgtggagttcggcgccggcgacctcgtcgtcttccccaaggggctcagctgcacctgggacgtcgccgccgccgtcgacaagtactacaagttcgactcgtcctgacggctgacgcacatcgctcccggcccggctccgctgatttggtcccgattattggttcggctgctcgcttaattgtgatgattagcttaatttcctagctaatttggttacatatagcccatagccttctctgtcgtgtaaaaaaactgggagggatgcagcgcatctagctcccgcgtagcgtagcgcgtaggccagtagatattcatccggcaactgaaaaaagaaacccggtcaatgcaggggctgttcaaagtaccccttgtttattcgtccgagtgcaatccatcttggatgcttctttgaccagcgcccttggcctgcgttgttttttttaataatacctctatcttaaaatagtagtcattttatctattgtaaaaaaaaaaaaaaaa

SEQ ID NO: 9652 - DNA, 5009 bp, Zea mays
  misc_feature (356)..(356): n is a, c, g, or t
tgattttttaagttttgtaaattaattcagttgcacatgatatatcccctctccaaatcgattagcgcttgtccgttttcgaatatttatcgtctactgttttatttttaaactaaactccgataaataaaaaagaaagtgagtaattttctcaccgcctcgtcgcgacaccctatcaagatactgtatgcaccacttatttcgaataaagttgttgaattaaaataaatttaaagaaatataaaaaaatcacgtgttaaatcaaaattttgtaccagataaacaggttcacatgaagaatcttttcgcaccttagaacactcacaaacaaaaattaaatagtttatatattcatngattaagactcttttactagacaaaataataatgcgtcattaaattttaaaagtaaataaaatatgtcagcacgagtattgaagagatgcgagtatgtgacatacaaatagatgatagagacaaaagacatgtgattaaatttttttacagaaatatcaacacttttgatataagtaaacaagttactgccttataatttctgaattgaattggaactgtcctcttcgaatatttattgtcctcaataattaacggactcaaagttgattaaaagcatgtttcgtgcaagtggttgacactttgactaataattacatagaatagcacgtgatagcacaaacatattttcctcggttactccgaaggtcaaagaggattattacatttctgaaagatggaataggtggacagcatatactactacgagcagtccatatcatgtgcgcaaagaatagctttccaatctcgaaaaatcagaaaaccaacaaatggagcaatacctagactgaacaaaatacttgtccctcgtgaactcgctcgactcgtagtcagctcggtttgacttacctcgactcgttgcaattttgtcacgagctaagctagcatcttagctcagttttttgacaagccagctcgagccgagcttgagccaactcgttctagctaccatttgtcagtaaaacaaagctcgaacttgtattaaattaactaataagtgatgaattgtgttaatttgatgttgtttgtaaaaatgtgattattattactcttttctagtgttaaattagtctagaattaactagtaattgattatattgttatatatatatttatatattgttttttattctggcttgcgagctaaacaagccagctcaagcttgcacacgagttgagctaattgtttggctcggttttttaacgagccaaaccgaactagctcgttaacttaacgagcttcgacgaagccaagccatctcgatatccagcccctagcaataccctataaaagtcaaccactcaatgtcagtgataaatactctccctattaaactagtattggttttagatctttgttttatgtatatatttaaatagataatgataaatctagacatatataaaataaatacatcaattattgtatagatccattaaaaatgtaaaacatatttttatttaggacaaaggaataagttaagtactctcttcgttcttttctaaattataaagtttcctattttttgaagtcaaagcacttaaatttaaccaaaattatagggaaaaaatacaaatatgctcaataattaattttaaccagaattatagagaactacaaaagaattatgataaaaatctaatatggactaacgctataattttaatatataaaattaatattttttttttttttttaacttttaaaaataaaatgacttataatttgagagaaaggggaatacaagtcaaattttcaccaccttttttttccctgtagccataataagaaacactaagagaagcagaaaggctcaaagcccagcaaagaaacaacagaaactaagcctacattagctcatccagcccattttttggcccaatcaaattccacacaactaacggcccaattagaccacacgtttacctgtcagctctttttcccgttcgtcccgtttacgcgtcagccctttttcccgttcgtcagggcggccgccgcgctgcctccgccaccgccaagcattgcggcggcagagtcgacattggtgaggagatattcgtagatcttcttccttaaccgctctatcgtctcctcgggcacgccgcagccgtcgttcggggggacaggggcggtgctcgtggtggtcgcctcaccgtccgcgtcggcaggcggcagcgactgagtctcgctgcgctttgcgatctcgccgagccagtcgttgacccgctttagctgcgggagcatcctggccgcacgctcgcggtcccacggcgcggacgccgccacgtcagcgtccaggaaccgctccacgaagccgaggaaccaaccccttgactcctctccgagccgtttcgccagttcgcccctctcctctgccccttctcctctctcccactccgtcggcgcggacgtcttcgtcagcgccgctgctgctgccgccgcagcgcccgtcctcgctttccccttcgcaggggacatccgcgacttcggcgacggcgatgatttcgtagccgtggctgcggccgtcgccggcttcgcggactcgtcgacgacgaccacggccagcggcgaggagacggtggcggggaccggtttgaggtcgtagatgccgaaggcggactggtccgtagcgagagcggcgctcacccaggacgtagctcggcgccggcgctcggctgtgacggcagcggtctcctcgtctgtagcggagcccacagttccagcgtcgctggctgccgagcaatctggcgatcccgcccggccgccaggctccctgtgggtgtcggtgatcaccgtggcgcgcgaaagcgcggcgcggagggtgaagaacttctctacggctggctgcgggttgtgctcctccgccgtggagctcacctccgcgtacgagctgctccggccaatacatacaatgcagccagatatatgtacggttcctccctggaagcaacattggtagcaaaaaaaaatgctgcagctctgccgtgaactttccaacacaaataatcgcggtaagctaaaagtggcaggttcttctgactcaagacaccaagttgaaatctatacagtgatttcgagattatcaaccattggattaactggagaatatacagctagcaatgtaaataaacaggtactttcagtagaagacaacagcatgcagctacaagtacagcaggagaaacttcctgtacagcatctgtaagcatcattatgcagtacaatagcattcggagacagttcagaaacgtgttgatccatgtcctggaccatctgcatgccaacaagcaaagctaacatatatacactacaagccaaggcatcaactgtatgcaaacatgtataccacagtactccgttcttattcaaaatatatgacgactttttttgaaactttgaccactcatcttattcaaaatatgtattcaaaaatgtaaaattttaaaccatgctcaaacaaccttaaggccttgttcgtttccgtcggattggtggatcggaacgattcctagccggatcgcttctctaatttatataaactttgatgagctggaacgattccgggtgcaatccgacgtaaacgaacaaggcctaagtgataaaacaaatcataacaaaataaattataattcgtgattttttgaataagaagagcagtcaaagtttttttttaaaagtcaacggtgtcatatatttaaaatatattttaaaataaatttaagaacggagatagtacaagatttctctttcactgttctctgggttggaccttctgcaaggttgtactttctagcatgtccagatgggcaattcacaaatgttcacatatagtagtaactcagaatgccaattattaggtttcgaacttcaggtcttcggtaaagtctaggttaacctatgcgatttaatcttatgtgtaaaaagcatttttttatttgaaaaaaacattctgtatgtgaaaacattcatagctaacgtctgctctcagatcagaaaaaaggaagatggatagcagtgaccactccagcatgggtctcgagctccaaaagggaggaaccgagctggttgataacactattgcaacatgctagacagctcgaactgagacatttgggccatgagattgagacctacgggttattcatgatcttgcccccagtgaggtgcaatcagaaaccaaccatgtgacaatgaacagcaggctttgctaaaagcacaggtggtgccacatgttctggttccagatcaccatgccctgtatctagcatgttcgtcagcacggggacaggcaatcaaggctgtccacggccagatgcatgtgatctttgaaggcttcacaaggcttgtccttggagcatagttgactcatttctatcgaatgatttcaagaataatggaacggcatgagagcgcataagtgtaagttcaatgtggaaatttggcagaagattgatttatgaggattttttttcctaatttgaattaactggaagcagagtacgctgataccagtaggtgccacatcatctgcatagctggatagaagctagcaaaatatggcaggtttccaaatcaaaccataagattctcttctactttattttaatagacagatcatcaagcatgtgatgccatctaagtatcaaacatacttttatagttatctatagaagctaggggatgctttgaccaatttaagtacataataaagttgctgtttagaaaagaatacaagcattaggagctacaagatagggatcaaggaatggatcggtcggagtcataggaaatatatcaaacagtatgtcgtagtagtctaccaataagaaaatgtgcctagaacttgttagaaaacatacaaaacttgtcataaccataggacttgtatccggaagaaaaaagtacctcaaacatctgagcaagctctctgcag

SEQ ID NO: 9653 - DNA, 1956 bp, Zea mays
ttttttttttttttttcggttagtaactggaatcaacattggtagcaaaaaaaaaatgctgcagctctgccgtgaactttccaacacaaataatcgcggtaagctaaaagtggcaggttcttctgagtcaagacaccaacttttcaacaccaagttgaaacctcaaacatctgagcaagctctctgcagcggaagcttcttgcatggcttcagcagcagctatttgtgccgattccctgtacttaagaagctcctttcctagtttggcaagtgatggagggagtgatgtccatgaagtgctaatatctgttagtttttttgcggttgggaggaatcttcactagatttataacattcgagtttcctaagaccccagatgttctctttacagtaggaatatgcttcttagctgctttgtcagcgtcatctgagggagcacttggggtgctcttcctagcagctttctggctatcatctttaggtggcaccttctggtccactggtgattttcgtctaggagtcattggcatcttgttatcagacttcttgtcaggtttggctgtctttgattctgaattgccttttcctttaatatccgtgtttccttcccagcttcttctcaaggcctttggccctgatccaatacttaacacagagctactgatcgaattggcagcagagggctttctcccggcactagtagccttcaaaacagaagcagccttttctaacaaggaaagcctagaagatgaagctttctctgctccttttactctgttcctctgtttcagatcattagagaatctgtcgaacgacgcaggtaaagaatagacactggttggtgatgaaggtgtagacctggtaatagctggcttcacctttaatttaaccgcttccttcttatcaccaatcacattcaaagcttgtcttgacagtgaagagtttgatttggtgagcatcggcttcttattttccgtcccggtaagcttacgtgaagcatttattttctccaatttgctcgtttccttttctagcgacaagatgctggcatccttcgttccatttgatggttgcgctttcttgctgccatgaaaactggaggagctggtcaccacaagatcctcaggggtgccaacgcaagcatggcgacccggaactgggcgaactcctctaaggatgggaacaggagtggcagcctctagacggtctacatggatgaactggcccagctgaatcttgtcgctcaagatgagatcatgctgttcctctggaagggaaacgtaggtcgcatgggatgaatccgacaccttgaggtagaagcctttgttggtgaaaagatcgctcccggcgagcgctgggacgatgctgacaacctgaaggagcgaggagcgatgctcgccggcgacttttacatccgtgttcatatgctgaaggagcttcacgaggacaccgggcaccaatgaagccattgtcgtgaatccttaagcgcatcactctctcggagcaaatccttgccgcgcctagtggtttcttcttcttcttcactctcgtctcctcatcgggctttgctgtgggcgcacggagggggaaaaaggctggtttggatttggagcagagaagagcagggcgggcggggtccttccaccggctcaccgctggcgggatacgcagctccgcgctggtgcggtcgcagggcacgcaggtccggtcagcggagtggggagaggcgcggccgcgcgcgtctcatccggtcagtcgtcacatccaaggggcggaaaaaacaagtcaaggatggtctcccgctccgcggctccggtgtccggtctccactcgttgccttcggcttggctgtggctgcctccagccctggagtggaccgctcgctccagccgagaggagcagagagctagagacgagtctctctacacctctttctccagccaagttggctgtgtg

SEQ ID NO: 9654 - DNA, 2285 bp, Zea mays
tgattgaagtacttaaacatgtttcatctgttgctttgacatttgatatatggtctggtaaagctaaagaggactatataagtgttgttgctcattttgtgaactctgattggtgtttagaaaagagattacttggtcttagacctatagaggtagctcatacaggtcttaacattgttgaacgtgaattttgtaaatctattggtgcaggactgaagaggatacacggcctatctgctagaaaaaaagaaacgagtcattaataggagtataatgaagcacgagcaattaggagtctgcaagcaaaatgtgcattagatcatcaccacaagccatagagattaggtctgttgaagatttttcctattgtttagactaagtctattcctattatttaggctaaaatagttcctattgtttagattagattggtttttatcttcagttagagcaggcatatataaacatattgtacgctacaggaaggccagagaaaaaagggaaaatccttgttatcgtttgtttcatctgtcatctaccatttttttgtttttctttggtgttttgccgagaaaaacatccgagtgatctctacgaaagtgagagccatccaatcaacatcatcgctggcaaattaattgaaaacaacagatttggcgaccccgctagggagcgatttctaatcgtttcacggcggcaaactactggtgattggcatcctcatcgccaatcatagtcgtggctatggaggacaagacaacgaagaagacggcaccagacaaatctgaagttcatcccttgaacatgatcaaaggcacgatggaagatcttacagaggcagacaggaaggagattgaagatgaaatcgcacgagagatggaagagaaacggaacgagaggttggctttcttccgaaaaaccaacaatggtgtgatcaaacagaccgttggggcaagcacgttcggcaagaaggtaagttcatctatcacttgcgaagagctagctcatatgattgatacttctgtagctagcaagtatggggctgatgtcacagaaattacgcgtatgatttctgagggagtgcgtaattcttttgatgcgtttagatcttaatttaagcaagatataagcaacaacatgcctagacagattcgatctatagttcaacagatacaagaagagagtcatggtaaacgtgtagagtattcgccagtcacacctagcctcggaatagcagctgcacccaacaccatagatgcatcgactaaggatacgagtgggagtgcagtagcaaattataatctgtagcagccatattaccaaagtgtggcttatggaccatctatccatcccataggaaacggagtgccgcaaggatctgccccaaacaggcatgtggcaggggcgcagggagcattgtgttcagccccttttgtgacacctatgacttatgatggtgaagcatttgaaaatgttagggagcaggtagcaaggactcttagggaatttggttttgagcctaaagggcatactagatcctataagaagccttaccctgatttttttgatacagtgccatatcctcgaggttttagaattccagattttgtgaaattttcgggagaatattcgaaaaccacctatgaacatgtaggacagtacttggcacaagtaaatgatataggtataactgatgcccacaaagttaaattgtttcctctatcattgtccagcactgccttcaattggtttacatctttagcaccgaattcaattagtacttgggcgtgtttggagaaaaaatttcatgactacttttattgtggtgagactgagcttaggttatcacatcttactacagtcagacagaaatataatgagactgtttctgagtacattaaaagatttagggaaactaggaataaatgttataacttaactctaggggaaagggacttggccgatttagcttttgcagggttgtcgtcttatctgaaggagaagttagaggggctagactttaacgatataaaccaagttatgcagcgcgctatcacccatgaaaatcgtgttagggataaacatcagtatagccgatttagagacacgaatagtagggaaaaggagaaacggggggttaacatgttggagcccaatactgatagtgatgaggagacggatgtatgcgtggctgaatgggtagatgtgccaaaggggtaggcctatggcgtgtgcttttttaaagccaagtccagggaaaagggaggagatgaaatatacatttg

SEQ ID NO: 9655 - DNA, 740 bp, Zea mays
gcacgagaccattacctagaacatcctaatcgaaaaacctccaagggcgtgattgcagtcgaccatctccttttctttatttgctatatatatgcatgttgtgatcttcaagcagatcggccgatcaagctcatcaaacccatagcaaccccaccaaactaaaggtattctctagatcattacatacacatatatatgggggcctcagcaagacgggcggtcgtccacggcgaacggcggcacggcggcgaggcgcaaggaggctgccgcgaagcaggtggtgcggtaccgcgagtgccagcgcaaccacgcggcgtccgtcggcgggcacgccgtggacgggtgccgcgagttcatggcgtccagcgcggacggcacggcggcggcgctcacgtgcgccgcctgcgggtgccaccgcagcttccacaggcgcgaggtggcgacggcgacggagacggccgccgacctccgcgaccgcgcctccaccacctccgggtgaagtggtgaactcgacgatgagtcgtgatgggcattggaatggttgttacagtagttgttcttggatgattttttgagtggatttttattgcgtgtactatatgctcgatgcaattaacagcatgcgtgtggatcgtcgttcgtatatatatacgtacggtgcttgtaactgatgattgtggaccgtggacgtgtatataaattaaataaagtgagtggttcttccgaaaaaaaaaaaaaaa

SEQ ID NO: 9656 - DNA, 785 bp, Zea mays
  misc_feature (758)..(758): n is a, c, g, or t
  misc_feature (768)..(769): n is a, c, g, or t
  misc_feature (778)..(779): n is a, c, g, or t
cccagcgccgaagcccccaccctcctccactccacctccaagggcgtgattgcagtagagcatctccttttctttatttgctatatatatgcatgttctgatcttcaagcagctcggccgatcaaacccatagcatcgccaccaaattaaaggtcttctctagatcattacatacacatatatatggggcctcagcaagacgggcggtcgtccacggcgaacggcggcacggcggcgaggcgcaaggaggccgccgcgaagcaggtggtgcggtaccgcgagtgccagcgcaaccacgcggcgtcagtcggcgggcacgccgtggacgggtgccgcgagttcatggcgtccagcgcggacggcacggcggcggcgctcacgtgcgccgcctgcgggtgccaccgcagcttccacaggcgcgaggtggcgacggcgacggagacggccgccgactgccgcgaccgcgcctccaccacctccgggtgaactcgacgatgagtcgtgaggtgagacgatcgactaggatcacgcacggcacgcgtgatgggcattgtaatggtcgttgttgcagtagttgttcttggatgattttttgagtggatttttattgcgtgtactatactatatgctcgatgcaattaacagcatgcgtgtggatcgccgctcgtaaatacgtacgatgcttgtaactgatgattgtggaccgtggacgtgtatataaataaagtgagtggttcttccaaaaaaaaaaaaaaaanaaaaaaaaannaaaaaaaannaaaggg

SEQ ID NO: 9657 - DNA, 4541 bp, Zea mays
actcctcctttctgcctaatactcatcaaccttctcatggccctcgggtactcttcgacaccaaacttttctagcacaagcctagacaagtttctccaatctcccaagccttgcttcaacctgaccacctgcaaccaacatgctgcagttccttcaaaattcagagatgccaccatggattttacgaaatcagggactcgatagaagttgaaatagtcttcacattgaatgatccaaataactaggtctgttcctccaaactttgggaaaggcatcttcagaatatgctgctataactgttccccatatctttcttatcgcccagaactctcctctcttcctccctgaatcctaccttctctattctggggaattcttctgttaccccctccctctacatcttcatgatgatccatatctctagccatggtttccaaccgaagaagagaaacagtcttacccgtctcctccacttggttgcgaagcagtatcctctccttttccatgacatccaccttccctgtcaacctttcgatagccagcatcatcttctcccaacgagcttcacttttcttggtctccatagtgaaggcctcgatcaccaaccgggactgtgccgacggcttgactgacggtgccgtgatgaaaaaaattatgagcaccctttctcccttcaaacttcttggttacgccgacttcccgccaacttattctccgatgatacaatggctttgataccaatacaacctcgtgtccttttcgattaatgtgtgcgactattttgtggtcaccatgtgctccattgaggattttttattaccatttgcagaacgtttttagtgtgtacatcctggctagcctcttcgtgatgatgccacgggggaggacggaaggggcactcctggcggataagggggagcgaaccttgctggcggctgggcttggcgcgcgccgccgcctacggtctgggccatgtgggagacgggaggcggcgctcctggtggcacaacgggagggggtgaggcgctgggaggagcggagcacggtggcggcgttcggggcgtcgagggtggggggtgcaggtctcttcgctcttgtcggtgtggttgtctgaactctggaaacttaatgtaaggtggaggccgtttcgctgggatcagagagctagaaagaaataggatgacatggaaattcagctttgctcccactgttaatatataaaatagaatataatagaatagaatagaaagaatacagatagaaatagcagctcaggtccaaccaagataggagcgagccaagctggcggaaagggaagagggcttcagttgcacgcgactcctgctccccccttcacgctttgacgcttcacatgcaaggtgactcacatcccatccggcgtccgtcgttccctggcaaacggacgccagccagccaattccatcacccggtggcgcatatgcattcatcaaccactactgttgcccacacccacatgaaatgaattgaagccaacgattggtaggggacctccggacctttcctggcttcttcttctaccatctaccaatcatggcttcttcttccatctgtttaagtgttagtagattattgttccaaaccaaaaaaaaaacaatttagctttcccttttatttccgtttcccaaatagacaataggacatgaataagaatgatgacatcctctgatttaagttggtgccatcggttttgcttgtgtactcatttttatcgttagtcatgttttttttctcagttttgttcttctgctctatagtactggacggacaaaactgagaaaaaaaacacaactaaaggtacaaacgaggacacctgcaaaactgagggcaccagctactattacgagaggagatggataagaataatggtgtcccgtacctggatatatatgtgttcccatttcatctgggaaagttgtctagtagagtaggtacttattataccatccttttgtgagtacaacacctggtgaagcgtgaatatatgcttgcttagtgtttattgtttctgagagaacaaaacatttttctgttatcttttgtcttctctattggctttggcttgggttttgttaagtaaaattaaaatgttttctgtgctcaagacttggaatgctggttttggttcttgcctacctggctttgaagaatgtgaacttgtgccgtgccagatatatggtccggatgatggacaatctacatccaccacagaagtcaagtttgtctactgaaaacgaccattctctgtatcttcttccccaacgatggatcagctctatctattccatctaccggtctagtcaattcaaccgcggtacggtagatctagtcatctagctgctggttccccgcctgatcactctcaactcaacgccgacaaagaagaaatcaataatcatgcgttttgcctttcacgtacccgttccagcctcacactcttggccctagctagctatacattccatctgttccatgtcccatttacttaccatgtatgtatggaacaatctgcctaaagttcctagctacgctggattaggtttcgggcagatcagacacacacacacacgcatgcgtatcacatggtggttttcagatgcggccaaataggcacacgggacctgagctcgatctgaagaagctaatggcggacatactataccccggcccacaaacgctgtagctacccccacctccgccaggaacgcatgcattaattcaagtgagctagctgttcatgtcacgcagctatacagcaccacgcgcggcatcaattgattgaccaaatggtgacccggtgagttggaggagcacatgagcaataaataaatcgaacagtccaagtgatcggatcggatgtcaatcaggagggagaaaatagatagaggggaggtggtacaagcaaagcgtacgttgagtagaagccggaggaggaagaggagggggagcaagagtcaattggagaggagtgcttctctgtccaacctctcagctcagaatgtgcatccaaagaaacatgcatctttcgtctcatgccgatacatatatgtccttggttttcttcttcttgtatctctctctctctctctctctctctgtgtgtgtgtgtaaaactgtgctcctacacaattctctggatctccaaaatctgaccccggccggggggcgaggcccgttgcgtttcatgtctccctgtcgagacgagacgtcgtcggtgccattaaacggaaataaacctttcccggcatatatgagcagctagccttcctcttccacccacgtcctcctccatatatataaaaagtcccacaccctcctccactccacctccaaggccgtgattgcagtagagcatctccttttctttatttgctatatatatatgcatgttgtgatcttcaagcagctcggccgatcaagctcatcaaacccatagcatcgccaccaaattaaaggtcttctctagatcattacatacacatatatatggggcctcagcaagacgggcggtcgtccacggcgaacggcggcacggcggcgaggcgcaaggaggccgccgcgaagcaggtggtgcggtaccgcgagtgccagcgcaaccacgcggcgtccgtcggcgggcacgccgtggacgggtgccgcgagttcatggcgtccagcgcggacggcacggcggtggcgctcacgtgcgccgcctgcgggtgccaccgcagcttccacaggcgcgaggtggcgacggcgacggagacggccgccgactgccgcgaccgcgcctccaccacctccgggtgaactcgacgtgatgggcattggaatggttgttacagtagttgttcttggatgatttttgagtggattttattgcgtgtactatatgctcgatgcaattaacagcatgcgtgtggatcgtcgttcgtatatacgtacggtgcttgtaactgatgattgtggaccgtggacgtgtatataaataaagtgagtggttcttccaaaaaaaaaaaaaaaaaaacaactactttatagaattatggtagaacatgcatgttgccttcttatttgtactgaaagcgaggagtccagtttgttttgttttagctgaatgaatgagatcatatcagcaggctatgagcactatctctagtgctagagctcgatcgatcatgttcgtacaactgggtcggaggactctgtggaccatccttttcctccgatgccttggttgatgaacagaaaccatttgtccggtgctgttcatgcatgacccagtgcaatcggatcaaggaaagtggagctagcactgtgcagtagacctgccggccgggccattgccagtctgatgtgcactagctagctactggatagatatcgacggatgattgctatgcttgcgttctatagttgccaatgccagctagcaaattagcttgctgggctgggagcctggcctgctagctgggacagcagggaccctggcggctgctgatgcggtccatggatctgcattg

SEQ ID NO: 9658 - DNA, 1358 bp, Zea mays
tactctcgagtttttttttttttttaattagtgaaaagttcgattatgcatagccaataaactaattccctggcgtcgccagctgtttagttttatagagtatcaaacactacaacgaccaattgggacacgactaatctggaaaaaaactatcatcggagttcagttcttttactagtgtacactgcaaataacagaagttaaaaacaaacaattgtacacgttttatgtagctaaactctctaacaaaagccctggttgcgttgctgtaacttttatcttccgataaccatctaaaactttgctccaggagaagtggaagacggatgagatttactgacgtgattcaacaatgcttcagagctcagttttgcttttgctggatttggcaggcttctttgcccctttccaccatttctttaccataccggacaccttgtttacatgccctttcaacttcttgctggtatccttgaactgctgcacgacttgctgtttcaaatctttcttttgagagcccttgtttttcagagctttccccaagttctttgggaagttgtcatcctcatcttcatcatcctcctcgtcgtcgtcttcagtaccaaagttatttttcatcagatcgtccctggagtacattttcatgcttggggctcccggcataccctccattgatctcaatatcttttccatctcagcatcctttgatggcttccttgcaaatggttccccagggacacgatcttttggaactggcggtgggtccttggcacatgctttcgaaagatctttgcagagaaatttcataagctgatcgaccgaggggttatttttgtatacaaactcagcaacatcggtatcagcatatcctatcacctcctgacatgcacgctcaatggtcttgcattctgcattgcaatgcccttcctcatcttgctcaacaagctcgagcttgtcgcctttctcgacgatatcgatccggagcatccaatccgcctcctgcttcttcaggttgcagacattctccgcgacctcgatgatctcgatctccggtaccttcttggagggcgggagcgcctggtgcttcttggcgacctgcgcggagatctcgcgcgcgatccgctcgcacacctggcaccggatgtaggggatgtcctcccgcctcgcggccgtcgccggcttcttctgccccgccgcaacctccgccgtatgcaggagcacggtcgcgagcgcgacggcgacgagcaaggcgacggcgcgacgggccattctctccccacccctcactggttgggctcgtcgcagctgctctgttcggttcttgcagcagccgaactaaaacggtcagggctggtttt

SEQ ID NO: 9659 - DNA, 1405 bp, Zea mays
aatcagtccaatcatatcccagcacgaagagccgccgcaatcctcctccccgtcccctaccttcgtcggtgctctcacccgccgctggtcgccattcctccagatcggcgcccagctcgcagcccactaggcgttgcgctccctctccaaacccaacgaaaccccaggggaaccctcatccccctgtcgtctcccttattgggggccagacatggagagcaagcaatgggggaagacgccccaggaggtggtgggcgcaggcggcggtcgccaagtggatctagatgaagaggatgacctggaggagttccggctgcccatgggccaccgccccaccgagaacctcgacacggaggggctccagcaggcctctgtctacacccagctcaccgcgtccaacgtcggtttcaggctactgcagaagatgggctggaagaccggcaaggggctcggcaagaacgagcaaggtatactagagccaataagagctgacatgagagatgcaaaattaggtgttgggaagcaagaggaagatgacttcttcacatctgaagagaatgtgcaacgaaagaaattgaatattgaacttgaggagactgaggaacatataaagaaacgggaggtcatagcagagcgtgagcacaaaatccgcagtgaagtcaaggagatacagaaggtgtttttttgcaacctctgcaataagcagtacaagctggctcatgaatttgagagtcacttgagctcatatgaccacaatcataggaagaggtttaaggaaatgagagaaatgcagagcagcagtggtagtcgagatgacagacagaaacgtgaacaacaacgagaagagaaggagctggcaaaaattgctcaacttgcggatgctcataggaagcagcagaaggataagcaagaaaagtcagagacggaggatgcggcacccaaaaacatggcagcctctagcaaccaggatcagaggcaaaccttgaagttcggattctctaaaatggctccttccaaggttctagttggtagtgccagcaagaagccaaaggttgccacgaaagtttcttctgtctttggcaacgagagtgatgaggactcgtgacctttgccagagggtggcagttgcttcttctgtcgtggcatttggtctggggacttgataacagcatcgagaattgtatgaacttttgagggtacactgtataaggaaatctgtactgttgttgctggattttggaagctgtttattaaccattcgcccttgtaggcaggcaatacccttcagtttgggacacacctttgtattgtaggctgtactatcgttgttggcttttaatgttaaaaaaaaacctttgtattcgaaaaaaaaaaaaaaatgctacagtggtgtcacattttgtct

SEQ ID NO: 9660 - DNA, 1932 bp, Zea mays
  misc_feature (1908)..(1932): n is a, c, g, or t
tatgcctttctacgccgcgccgccgccatgtcctccccctcctcctacagccgcacaggctacccccgccctcgccgcggctactcgggaaggccctcgccgccgccgccgccgccgcccccggccgcggcctccgagatcgtcagcagggattaccatctcagtgccgtgcacgccgccaacgaatccctgcgtcgtggcggcggcggcgacatccgctggcctccaccgccatacaggcaggggcctcaccctcaccaaccgcactatggctatggctatggctacggatacggatacggccaaacgtggcagccgggtccatcctatgggtttgtgccgtacaactacggccacccgcagcagcagccgccggggcctcagtacggctacggggctccgaacccgtacgttcacgggcacctgcagccgcagccgcatgtgcgtggggcagcgagtccagggttccgtcctggcgcgccccagctgactccgaggctggcagattacctccgacggtggcgctttgcaaagcagaggccgccacatcaagctgggaggtttattattctatcacccacgcgtccggcggactatctggcccaggagcaccgctttctttatgaaaaaatatcaccttttattttggattggaactggcgcaaggataagttactgtttgagttcggtctgtggtctccagacattctatgtcttcaggaggttgacaaatttacagaccttgaacaagaaatggcaagccaaggatataacggtacatggaagatacggactggagatgcagctgatggatgtgctattttttggagaacaacaaggttccagttgcgttatgaagaagacattgagttcaccaagcttggacttcgtgataatgttgcccagctctgtgttttagagtcggtgggccttcagtatgtgcaaactgactctgttagtttatctacaagttctaaccatccacaacaagctaaacaagttataatatgtaacattcacgttctttataatccaaagagaggggacatcaaacttggtcaggtcaggacacttctggataaagctaacgctctatctaagatgtggaatgatgctccagtgatagtttgtggagattttaactctacacccaagagtccattgtataattttatgttggggcaaaagttgaatttgtctggccttgcgagaaatactatatctggacagcaaattggtggtagttcacaggggctatatactggccctaatatatctgggtggacaccagaagaaatcaaagctgccactgggaaggatgaatgcactttcatgaaacacagtttgaaattaaggagtgtatatactgacgtcgaggattttgaaggaacaaaagacgccagcaaggaaccactggtgacaagctacaacagaaaattcatgggaacagtagactacatatgggcctcggagggtctgcatactgttaaagtcttggacacatttcccatagagattttgaaaaaaacaactgggttcccgaccaagaaatggggaagcgatcacattgcccttgcctgtgaattggcttttacaaaatgacgccttttatcaggcggagagggcgcctgcatagttgctagtgaccaaacacacctcaagagaaagaatactgtctacaggacgattaactgaaccaaacctcgctcttttagagctcgttaatttatttcattttttttttcgacacacctttttgaattgtgcgtgagtatggagaaccggagtacatcatttgggtccaattttagagcattgttcctgtttgattggctatggagagtgtattttggtgtgctgccactctacctgcggccctgccatcccctggcccaatgacttgtccgnnnnnnnnnnnnnnnnnnnnnnnnn

SEQ ID NO: 9661 - DNA, 2267 bp, Zea mays
ggtgacactatagaagagctatgacgtcgcatgcacgcgtacgtaagctcggaattcggctcgagtgttaattgggagatagatgcttcagaaactcaaactactattcctggaagtagtgaggtgcaaaatgaccatgcaggaaagaggacctctactgtggatgatagctcatcgtcttgttcatctgactcagtgccttcagttactgtgaatggatcatataaaggaggtgcctggacaagcgtcagatcctcatccaataggggaaacaacaggaggaataaggatactgaagcacgggcaggatttgcacaaggtggatcatgttcatcgcataatggttttataggatctggcggcagtgcctctggccactcaaaggaaagatacgaacctgaggatgataaagttgtcatgcagaggaagcaacatgcacggcacattgatgtcattagcccctccaagtcaagaatggcagtgtcttcattttcttctgtgagcccggttaagaagcaacctcaaccaaattttttgctagaaagcaccaatagtttgaatcaccgtggaagcgaagcttctggcactgtgacttccactacaacagcgggtgcctcttcaaccccggccactcagttagttttgaataaaggacctgtatccagtgctgcaacccagaatgagaagccactacctctgcaggtgcttgtaccatccaaatctgaagtgcagaagcaggcttccctaactggcagtgcaactaccgaggccgtttcagtatcaaggcccttgactgccccacaagtccctgcagcaaaacaaagtgcaccagtcacttcaacagctcagaatgcaccttttctttctcgttcaatgagtgctgttgggcggttggggaatgaaccatctgccaatgctcctagtttcgttccccgttcacgaacatatcgcaatgccatgatggagaaaagttctggtggtggaagctgtttcacacatcagcaaggttcatcggagcaagcagttgcaccatggcaatcgatgtttacatcgcaacctttcattcggccatcagagaccttgtcttggaaagaggaaacattattgagatctgggtttacatttggaactgtgaagcccgagtcactgaacccatatcagggcagagaagagaactcacagcaagcgagcagcaacagcagtgattgtgcgccatcgagttcaaacatcagaagcgagatcgagaagctgaatttgagcggaagaccacgaagcaagcaactgttgtcagaaatttcgaccagatttactccctatcagccacaaggcttggtcgctgatgagttcccacacctagacatcatcaacgacttgctggatgaggagcagagtgacagaagaagggttcttcaacctgattttgttcaacagtcctatatgcctcatggtgccagcacacctgattatggtgagccatacttgtttgaccagtccgagcaatacttcgatgaggagcctccaaggttttatagtccattgagcagtgctcctcggaggttgagggacctgagctattcgcactttgatctcccatcacactccagcagcagccagtttgatgatctgatgatgagtcagtggccatacagccgcactgacatctccatgcctagttttgggtcagacacaagtggctacccctatcaggtgtgggatctcgcgaatggatcaagcaggtacccatcgtatcgccctgccaatgggcattgagagttttaatgattgcattgacaataatgtgtggttaagtccatgatgttcgcttctgagctgagtgtaattgtaatagttccccatagcagtgatataaagaattgttcctcagtttccttgttcaatcaatagttatatgacccccctcctccctcttttctctagttcagttttgcccagtggtaataaatctaagtcggctaaaatgatctggctaatcgtgttgtgaaatgtgtatgatgcaagcaaatggtagggtgtttttaagccatgccagtgcttcagctgatactacattaaactgggagtattctttgtttctccctctgacgagtgacgacgtgttattgatcgtctcatgttctctttgtatatttcagagtaaattctggatatagcccatggacataaattaattatttgatgcaagggcggccgccgactagtgagctcgtcgacccgggaattaattccggaccggtacctgcaggcgt

SEQ ID NO: 9662 - DNA, 1436 bp, Zea mays
ctgatgatagacggcttatagagctcttgttggaagacattggagctttttgccttgactcatatatttagccgaatagaagtggcacatcaagaggctgtggctttgaagcgccaagaggaactcattcgtgaagaggaagcagctgggctagctgaaattgaacttaaggcaaagcgtagtgctgctgaaaaggaaaaacgtgccaagaaaaaacaggcaaaacagaagaaaaatagtcgaagaagtaataaagggaagagtggcaagtctgacatcaataaggaaatacttatgtacagcagtccttcaggtgatagaatcctggatgatttttctggacaaacggaagaaatgtcctcaaatgctgacaaccctgaagaagtttctgatatatctgacagcagagacgataattcagatgcgcttcatgttgatattgaagaccgtgaaagtagccctgttaattgggagacagatgcttcagaaactcaagctactgtgcctggaagtagtgaggtgcaaaatgaccatgcagggaaagaggacctctactgtagatgatagctcatcgacttgttcatcagactcagtcccttcagttatcgtgaatggatcatatacaggaggtgcctggacaagcgtcagatccttatccttcaggggaaacaaccggaggaataaggatactgaagcacgggcagcacttgcacaaggtggatcaagttcagcgcataatggttttataggatctggcggcagtgcctctggccactcaaaggaaagatacgaacctgaggatgataaagttgtcatgcagaggaagcaacatgcacggcacattgatgtcattagcccctccaagtcaagaatggcagtgtcttcattttcttctgtgagccctgttaagaagcaacctaacttgtctcatcagccaaaatttttgctagaaagcaccaatagttcaaatcaccgtgcaagcgaagtttcaggcgccgtgactgccactacaacagcaggtgcctcttcaaccctggcagctcagttagtttcaaataaaggacctgtatccagtgctgcaacccggaatgagaagccagttctagttacaaataaacccctgcaggttcttgtaccatcaaaatctgaagcgcagaaacaggcttccctaactggcagcgcaagcactcaggtcgtttcggtatcaaggcccttgagtgccccgcaagtccctgcagcaaaacaaagtgtgccagccacaacagctcagaacgcacctcttctttctcgctcagtgagtgctgttgggcggttaggaaatgagccctccgccaatgctcctagcttcattccccggtcacgaacctatcgcaatgccatgatggagaaaagttctggtggcgtaagcagtctcacacatcagcaaggttcatctg

SEQ ID NO: 9663 - DNA, 1195 bp, Zea mays
  misc_feature (1092)..(1092): n is a, c, g, or t
ttgggtacctcgaggccggccccgccgcggccgtggccaacaatcagtcagtcacaagaaaggaacaacatgaaagtgatctccatgttggaaacctaaaaacaagggagagaaaaaaaaaactcgcatcgcgtccttggttcctcgcattagccacccactggattttcttgccaacgagcttcgactacaccaacgccgcttcgtcccagtgcttgctaatcatcggctcctcttaattgcagcaaccaccacgcttcgtgttttcagatcaaagaagtgggggaacaacacagatttggagcggcacgccagcaatacggaccgggggtgacctgaggcgtggagatttttggccgctgcctgcatctccacgtcgcggtcccaatcaagatcattatttctttctccttccttgtccccgcccaaatcgcaaggcttcgttgcgaatcgcccttggcgtggccccaggattcgacgccccagcgccctcgctggaatcgtgggcgctgtggaggaggactcgaggcggccgtcgcgcttgtctcgtctctcatcaatctcactctctctctggtctctctctttttttaactgcggggattcgccctgatttagaggagcgagttgctggtctcggcgccgtctagctcgtcccggaccgacgatttggggcagggcaggtccaaaggcagcagcatcatggaagattgagaaaatttggaggcatctactacaaggttttcctgtgtgccctcaagacagggcgctgtgccgtgtgggcctcctcttgggcatccatggggttcctcagccttgtgggcaactcctttgggtgctctgcttccggtgagcgtcttgtctcagctgcccgcgacggcgacctgcaggaggcacgcgcactcctccaatacaaccctcgccttgcccggtactccacgttcggcggccggaactcaccgctgcactatgccgcggcgcaggccaccatgagattgtctctctgttgcttgaatcccggtgttgaggtcaaccttaagaattacagggggcagactgctttgatgcaagcatgccaatatgccacttggngaggttgttcagacactgatactcttcaatgcaaatgtgcacaggacagattatctgaacggtggaactgctctccattttgctgcactgcatggtcatgccc

SEQ ID NO: 9664 - DNA, 1450 bp, Zea mays
  misc_feature (1332)..(1332): n is a, c, g, or t
  misc_feature (1367)..(1367): n is a, c, g, or t
  misc_feature (1379)..(1379): n is a, c, g, or t
  misc_feature (1420)..(1420): n is a, c, g, or t
cccacgaaaaccaaacgcctccacgtagcctcgccggctcccttgcgtgtctccgcttttcgcgccttccctacctatattagggcgcaccaacgtactcgaccggatgcgcgcaggcggttctcacagcacggaggcactcatcagtcatcactagtacttcactagttagctagcaatattcctactcgctaagtagtggagaactggagatcgacatgagccaggggcagccgaggaggcggcagggcgaagagggcatgcacgcgcaggacaagcccgtcaagttcggcgacgtgctcgacgtctcaggcgagctggccgaccagcccgtggctcccagggacgccgcgcggctgcaggccgcggagcagtccgtgctcggcgggacgcagaagggcgggcccgccgccgtcctgcagtccgccgcgacggtcaacgcgcgagcgggccacgtaggcagggctcagaccgcgtgccccgtcgccgacgcgggcgccaccgtcaccgagaccgagctcgcgggccgccgcgtcgtcaccgagtccgtcggcgggcaggtggtggggaagatggtgagcccggcgccggtggcgatgacggacccgccgggcgcgctggagaaggacgccgtcacgatcggccgcgcgctggaggctgtgggcgcgatggtcggtgacaggccggtcgagcagagcgacgcggcggccgtccaggtcgcggagctgtgcgccacggggtccgactccaccgtccccggaggcctggccgcggcggcgcagtcggcggccgaccagaacgcccgcgccacgcgcgacgaggacaaggtcaagctccggaacgtcctctcgaacgcgagggagaagctgccggcggacaagggggcgacgcgggaggacgccgagagggtggtgtccgccgagatacggaacaagctggacatggcgaccacgccgggcggcgtggcggacgcggtgactacagcggcccggctcaaccaggagcgcccgaggccataggtcgtcgtggcctttatatcccatgtggaacagtggaagcgtgcgatcagaagcctgcgcgcggatgagcgtgcttaatagcacagtagcgcgtgccgttttttttttggacttactaagaaaactacgtacgcttgtaaaaatgcgcgaacgacaccgtgtccgcagtgtatatagcaataaaatcgttgcgcgtgaagttccgtgggaaaaaaaaaaaaaaaaaaaaaagaaggggggaaaaaaaaaaaaaaaaaaaaaaaaaaaattaaaaaaaaaaaaaaaaaaaaaaaaaaaaaaaaaaaaaaaaaanaaaaaaaaaaaaaaaaaaaaaaaaaaaaaaaaaangggggggccccnttttaggagaaccaaattttactaccgctgggttgggaaanaaaaactttttttttggggcccctaaaatt

SEQ ID NO: 9665 - DNA, 833 bp, Zea mays
cattgggtacctcgaggccggccccgattctctctccgcacgacgaactacgaagacccgacaggccgacacccgctcgtctcccctggcacgtaggcgggggcggcgcaaccggaccccctccccctccagatcggtgctccgctgggagatctcctcgtgcaggcgccgaatctcttcgtcgtctcttccaagcacggttggcagcacaatagatctgtttgcaagcattctttggtactacttcaagcgacgatatggcctcccgcccaaagctgtctggtattcagaagcaggttttggcgctgtacaggggattccttcggacagcacgtcttaaggcccctgaagagcgccacaggatcgagtctgttgtcttggcagagttccgtgacaaggcaaggagggttgaccgtaggaactttatacatatcgagtacttgttgaggagtgggaagaagcagcttgagcagctcaagaatcctggtattactggacttgctacccttgtagtaaagaaatgaggtccattcattgccagaacaaagcatcatcatggtaccggtgtttctagtatgaacatttgggacctgccactgatggtgtccaaataaaacaaatatgaccatacattacagatttgatatccagggactttctggggttttctaattagcctattggaatcttaagataaatcttgtagcccctgtccagtgactcagagtaatattgttttactgtcttttggtgtaagcagaggttagcattaacaaaacaatgtgattggtctgaacttgcccgatatgcacccctgggtttacaacaacttg

SEQ ID NO: 9666 - DNA, 859 bp, Zea mays
cccattctctcaccagagtacgaactacgaagacccgacaggccgacacccgctcgtctcccctggcacgtaggcgggggcggcgcaaccggaccccctccccctccagatcggtgctccgctgggagatctcctcgtgcaggcgccgaatctcttcgtcgtctcttccaagcacggttggcagcacaatagatctgtttgcaagcattctttggtactacttcaaggctttgatgattgctttacagcgacgatatggcctcccgcccaaagctgtctggtattcagaagcaggttttggcgctgtacaggggattccttcggacagcacgtcttaaggcccctgaagagcgccacaggatcgagtctgttgtcttggcagagttccgtgacaaggcaaggagggttgaccgtaggaactttatacatatcgagtacttgttgaggagtgggaagaagcagcttgagcagctcaagaatcctggtattactggacttgctacccttgtagtaaagaaatgaggtccattcattgccagaacaaagcatcatcatggtaccggtgtttctagtatgaacatttgggacctgccactgatggtgtccaaataaaacaaatatgaccatacattacagatttgatatccagggactttctggggttttctaattagcctattggaatcttaagataaatcttgtagcccctgtccagtgactcagagtaatattgttttactgtcttttggtgtaagcagaggttagcattaacaaaacaatgtgattggtctgaacttgtgcgatatgaagcaatggattcagttcaacttgacttcaaaaaaaaaaaaaaagcccctag

SEQ ID NO: 9667 - DNA, 850 bp, Zea mays
  misc_feature (808)..(808): n is a, c, g, or t
attggtcggacccgcgtggttctcccgtgtcctctctctctagtggcgacgagtgggcgaacgccgccaccgcctcggtcgtcaggcgctctgcgctcaggttttcatcttcgggtgcccttcaccggcgaccagcacccaacaggctttgatgattgctgtacaaggatgatatggcctcccgcccaaagctgtctggtattcagaagcaggttttggcgctgtacaggggattccttcggacagcacgccttaaggcccctgaagaacgccgcaggatcgagtctgttgtctttgcagagttccgtgacaacgcaaggagtgttgaccgtaggaactttgtacacatagagtacttgttgaggagagggaagaagcagcttgagcagctcaagaatcctgatattactggactcgctacccttgtagtaaagaaatgagcaacagttgtcgaaatttacaggtccattcattgccagaacaaagtatcatcatgataccggtgtttctaatgtgaagatttggaacctgccactgatggtgtccaaataaaataaatatgaccacagattacagatttgatatccagggactttctaatcagcctattagaatctgaagataaatcttatagcacctgtccggtgacccatagtaatattattttactcttgctgtaagcagaggttaacactaaaaaaagtattgtgattggtctgaactttttgtgcggtataaagcatgtgattcagcccaaatagacttttccaactttaccgagcatatacaattgtgattaatatagagngctcttaaggtgtttaacaaaaaaaaaaaaaaaaaagcggcc

SEQ ID NO: 9668 - DNA, 3129 bp, Zea mays
cccgcgtgctcgcgcgctcgcgctctctccgcgacgactgggtgtgggctaccgccgccctacgccaggtgccgaggcttcgtcgatctcttcgccggcgacgagcacccaccaggatgcaaaagctctcggggcttcggagcctcgaggggttccgatccctcgttggatccacctcgacagccatgaaggtcgcgaaccccaggccttccccggatactgggggtatttcgtatgggagcttcgccaaccttaagatcacagcagagaaattagtcaaggagcaggcttcagtgaagactgatctagaaatggcgcatgtcaaattgagaagagcaacagaacagataaacattatagagggaaaacttcaacaagctttgaatgaaaatgcaaagcttaaggtgaagcagactgaagattcgaagctctggcagggattagattcgaaactctcctcaacaaagaccttgtgtgatcaactgactgaaactcttcagcagctagctagtcagacagaacaagctgaggaagacaagaagttttttgaggagatgcttgggaagaattccaaagctctagatgaattcaactgcctgttgcgtgatttatcaacaaaactggagtatgcggaacaaaagataatttcagggagacaggagatgttgcagatcaaacaagagaaagaagagatggatcgaagttacaagggacaactgtattcaaatgatactacgataaaggaaaaagattcgctcatcaagcagttggagggttcacttgatgataataaatcccgcttgatatatcttgactcccgcttgcaatgcatggagcaagaactgaagctaaaagatgatgtttgtatcagcctgaaaggaaacctagctagcagtgaaagtgaaaagaacagcttggagcttatgaataagggacacattctggaaattaaaaaactatgccaggacaataaggatcttaatgaattgtttagcagcttcatggttaaagtaactgagctagataaagaacatgcctctatgtcaagtcatgtgtctaggctgatttcttcatttgaaagattctatgaaatggcccaagaagagaaaatgctaatggcaagatcttctaaggataaatttgaacatcttcaaagccagtatgtagatttgacatcagaaaacaatgctctcaaaactgaaattgaagaactgaagtccagactcatagagttgcagagaactcaagaaattgttatggttcaacatgttgaagaatgccaagtggctgaagataagatcagaagattagagtctgaagctgaagtttctgcctccaacataaatcagttagaaaaattagcttcagaactacaagggagaattcagaagttactagaagattctacctttgctgaaaatcacaagcaagagttgcttcaaaagattttgaagctagaatcagataatcaggaactcctaggacaaatgcagtccattatggaagagaaatcaaataatgctgaatctctgcatggagagataactaagcgtgaccagcaggttgatacacttgagaatcagatcaaccagcttcgtagtgttctggatgagaaggagcaactctacctttgttctgtacaaaaagagaagactttggaggaacagaaattacaggtcgaagcattgctttctgcaacagagtgcaaacttagtgatgcaaaaaaacagtatgatctgatgcttgaaggcgaaaagatagagctatccaagcatttgaaagagctatctctcaaaaatgaccaggcgatcaatgaaatccgtaagaaatatgaacttgaaaagattgaaattactaatgctgaaaaagaaaaggcagaaaagctcataagggaaattgaaaacaaatgcaacgaaaagatatcacagaacaagcatgattctgagaggtatttgatttgccttaaggaggaacatggcacaacggtggcgagaattcagcaggataatgagcataaagagtcaactctccgggcttatcacaaagaagaactgcagcgcattcaatctcaggctgagaatgaaatgagggagaggttgtcattgctcagaaaagagcatgaagttcaaataaaatcactaaggatgcatcatgaggaagaatgccagaggatgcaggaggaactggagcttcagaagtccaaggaggagaagcaaagagcattgttacaattacagtggaaagtaatgggagaaagtcaacgagttgatcaagaagtgaactctaagaaggaatactctgtttcgtcgattaggaggagcgacccatatggaagaaaagaacaagaggtccagttggtaagtccggagaccaatcggaaggacgtaaacttacctgggattttacaatcaccaatttcgaacatgttgagaaaggtagagaaagtgtctcaggatattcctaaacatagaaaggtaacccaccatgaatacgaagttgagacagcaaatggaagaatcacaaagcgcaggaaaactaggagcactgtcatgtttggtgaaccgaactctcagaaaccattgcataatactactgacaaagatgttaaaaaactaaaaaaggttcctacaagatcccgtgcacatcctgcaaacattggtgaattattctctgagggttccttgaatccgtatgctgacgacccttatgcttttgactagaagctcacgcctggaagtatcatttttgcaagcacgatgacgaattctggaacacacaattaccaccaccgtgttgggtcaatcctacggtttttccctggtcatccgtccatcataatgtacatgactgccgttgactcatgtatctctgaagtattgctactgcaacaaccatcacgattgtcggatatgtaggtgtagatttatgaatgaactgtacatgccataactacggagtaactgaatatcctcagataaaacgctttgtacgcgtcgtgcgatgctgttggattggaatcgtgtttgccctttcctccagatgccaaggcccggtcgagtagatgggctccggtctggaagtggggcacagcatgtggatacaggattaatgccactgggtgtttgcatc

SEQ ID NO: 9669 - DNA, 1070 bp, Zea mays
tcagagtcaaccggcccaaccctctcagtctcggcctctcgggtcgccagtcctcgcctaggtttaggcttccagcggccgcagcctccacaccaagagcggaaggagatcgccggaagaggggggaggcgcggagatgagcgggagcgcgttcaacgcgttcaagtcgcgtgtgccggtggcgtggagtccccggctgtacatcacgctggtgcggggcctaccgggcacgcgccgcctccaccgccgcacgctcgaggccatgcgcctccgccgctgccaccgcaccgtcgagcaccgcaccacgccgtcgctgctcggaatgctcacccaggtgaagcgcctcgtcgccgtcgagaccgaggagatgtacaacgcgcgcaagcaggccgaggcggagaggcgcgcgcccagacccccgctcgtcgtctcccaccaccagccaccgccgccggctctgaagccggcagccgccgccgcggagggtgccgctgccactgcgccatagcctctgggcatcagaagactttcattacagttcagcaggataataattaaactgccctgtgttttgggtctgctggtctccactctccagacgatcgcattggatcctcttgctcacaagatctgacaaccgatatgtctctagatcgttgtatggtgcgacttgcattggccctacacaacgactgagggcatagtttcccaatgcttttatctagaatcaagttccgtggtttggtttcagttaccaaattccttgaaaatgctttttaagggcttgttcggttgcggcttgcgcctagttcgaaggagattaccttcttttaattttgactagggagggatttaattgtctctaatccgaagtaaccgagtaagccttaagatatgtaggttgtggcttcttgtgtaactgaaccagaggattgctagcgtctgaatttttcgttgttcggagtagtagtttacagtctgaaaggtacgaggatgcgggatgcgggatgcgtacggttggaagctattggggcgatgctggagcaaataaagtgatgcagtttgcttgc

SEQ ID NO: 9670 - DNA, 1599 bp, Zea mays
accggcccaaccccgtctcagattccacggcgccggcacccctcgcctaggtttaggcttccgaccgccgcagcgtccccgccacgaccacgagcgaaaggaggtcgccggaagagggggcgcggagatgagcgggagcgcgttcaacgcgttcaagtcgcgggttccggtggcgtggagtccccggctgtacatcacgctggtgcggggcctccccgggacgcggcgcctccaccgccgcacgctcgaggccatgcgcctccgccgctgccaccgcaccgtcgagcaccgcaccacgccgtcgctcctcgggatgctcacccaggtgaagcgcctcgtcgccgtcgagaccgaggagatgtacaacgcgcggaagcaggccgaggcggagatgcgcgcgcccagacccccgctcgtcgtctcccaccagccacagccgccggctccgaagccggcagccgccgccgcggtgggtgccgctaccactgcgcagtagcctctggtgagctgctcctcgagtcccgatttcgtcctggtgcggtctggttttccattttgtttgtttgtccattcaagcgtttgatgcaatgactcaagtcagtgcgcgtagattggcagtcaatatacacaatgaaatgtcttagtttcctggtgggttattatagttcttccttagttctccatgtaacaaaatggaaggtgcagctctaaccacattagagcaactccaagagttagtctaaaattattagcctctcttggttgttggtgtgatttgctagagtatccaagcagctgatgtggatatatcaattattatttctaattctttggcaccctgctttgggagcactcatccagtcaggtcaatccagccccagctcctcagatttgaatgcctaggattagtgctgcctggctgggacaggcttcctagggcttgatccaagaaaggcatgcatcatgctttgaattttgtaattgatatgagaggaaatttcctacagtgttttgacatgttctattaactggcatagagtaatttaccatctgttctatgccattgcccattgcttttcaaaattggacacctgaatgccatcaccgtcagcttgatgatgccaagtacagtaacacatggaagctggaaggataacagcttcttcacgcgatggttgaatgatggggatttcatggagggcatcattcatgcaactgtacagtaacacatggaagctggaagggtaacagcttcttcactcgatggttgaatgatggggatttcatagagggcatcattcatgcaactgattatgtatatgaggggatcagttttgactgatggtataatgggaaaccctgagttatcgttacttgatccctaatattttactcgtggtgatcttgtagggcatcagaagcctttcatcacagacgaccgctttgggtcttcttgctcaacgagatctagcaacggatttgatcgatcttctcaagatcgttgtgtggtgcaacatgcattgaccctgtgttttagattgttttatatggactaggcgcacgattttccaatgcttttgtctaagaatcaagtccaat

SEQ ID NO: 9671 - DNA, 929 bp, Zea mays
cccacgcgtccgcaaccggcccaaccccgtctcggattgcacggcaccggctaccccgtcgcctaggtttaggcacccgaccgccgcagcgtccccgccgccacgaccacgagcgaaaggaggtcgccggaagagggggcgcggagatgagcgggagcgcgttcaacgcgttcaagtcgcgggtgccggtggcgtggagtccccggctgtacatcacgctggtgcggggcctccccgggacgcggcgcctccaccgccgcacgctcgaggccatgcgcctccgccgctgccaccgcaccgtcgagcaccgcaccacgccgtcgctcctcgggatgctcacccaggtgaagcgcctcgtcgccgtcgagaccgaggagatgtacaacgcgcggaagcaggccgaggcggagaggcgcgcgcccagacccccgctcgtcgtctcccaccagccacagccgccggctccgaagccggcagccgccgccgcggtgggtgccgctaccactgcgcagtagcctctgggcatcagaagcctttcatcacagttcagcggcataataattgatttgcctgtgtttgggtctgctggttttcagacgatcgctttgggtcttcttgctcaacgagatctagcaacggatttgatcgatcttctcaagatcgttgtgtggtgcaacctgcattgaccctgtattttagattgttttatatgaactaggcgcacggttttccaatgcttttgtctagaatcaagtccaatgatttggtttaaattactaaattctctgtaaatgctcttcaagatgtgtaggcggttaaggcttcttgcgtaattgaaccagaggattgctagcgtctaaagttgctcggttgtgattgttggttcttagcgaaaggatttatcttaaaaaatattttatcaatctggg

SEQ ID NO: 9672 - DNA, 1665 bp, Zea mays
atggcgatccagcctcggcccctccacgtcgccctctccccagctgcttccgccgcccctccccatcgcgtcgcccgtctgcaaactgccgcctttgccgatccgcctccacatctccgcctggaagacgagaaacgaggaagacgatcccacctcgcctggaaaacgcatcccaagacttcaaccttcctttccggccggagatccgcttcgcatctccgcgacagatccgggcaaacgggccgatgcagttcttcggcggctcgtcgctgacgtcggtcgcgccggaggcgaccccagccccggcggcgccccctggtacgggcacgggcgccagcgcgcaggtcctctacgtcttcaaccgcaacggcgtctgcctgctctaccgcgagtggcaccgccccctccgcacgctcgaccccacccaggatcacaagctcatgttcgggctcctcttctcccttcgctccttcaccgccaagatcgacccaaccacggcagaaaagggaaatcttggtgtgccactactgccaggccaaggttgttcgttttatagcttcaagacaaacacatacaaactgaactttacggagagcccttctggtataaagcttatactaattacacatccaaggactggtgatcagcgagactcgctaaagcatatctacaacctatatgtggaatacgttgtaaaaaatcctctgtatgctcctggaacaccaatcaagtgcgaacttttcaacaaacatctcgatcaatacgtgagaacaataatttgatgtcattgagacaatgggttggtgaggcaaaaaaaggtccatttcatgttctttagcgtgatatcaccatttcgtggatggtagacttttctggtggaaaatttgcacagccgcaccatgggagctgcagtattcttgtgtaccgacctcaatttgacagctctactgtgacaacactcctgtagcctgtttgtttgatcgttacggatgcattcgacagggaagctgcattgtgcattgtcgcttctagtgtgacgtgtacatgattaatccatgggttattgcgtcaccgttcaagggggttcatggtcaagtagtaattatttcatatttgaaccggtcgccttgtcagatgactagactgaaacatcatgttttccgcttgagacattgtatgatttgtatggttggctgctaggataaagtcatatcaggaaacgtgatactaaaggtcttcatgctaggcgatttcggtctcggtcgtatccggtagtctccagattatcagaatgttgactgcatgaaatgcatatacaccatcctaactgttctaataagtcaagtttttggcgacacaaaaaaaaaaaaaaaacaacttcaaaagaatatattctttctattctcttagaacagagattttagatttttttagaaaaatgtctttcaacagtttatctaaatggttattcaaatgtaatcatcttctattccgacggtagttaaagatataaaatgtgaatgacgctaaagtgcaaacaagataaaaaaactgttgaaaattgaaaagatatagaaagtagttttcatgtaaatgaatctctaaattaccatttaaagagcaaaatttagaaagactcaatatgttctgacgtgtctgatggct

SEQ ID NO: 9673 - DNA, 1526 bp, Zea mays
atttgggtcgtcgagtttgggtccgaacaaaaaatgagcccaacggcaccaccgggaccgggaccgactggagacactgcttgcaattgcgccacgcccgccaccccgccaggccgccactagggtttttcggggcctcgtcatcgtctccgaccccgtgtctccgaacaacatcgcgcggccgccgcctcctcccagtcgccatggtcaggctcaccgctgacctgatatggaagagcccgcacttcttcaacgccgtcaaggagcgcgagctcgacctccgaggcaacaagatcgccgtcatcgagaatgtcggagccaccgaggaccagtttgacacaattgacttgtcggataatgagattgtgaagcttgaaaacttcccatacttgaatcgtcttggcactctactagttaataataacagaatcacgcgtatcaatcccaatcttggcgagtttttgccaaagctgcatacgctggtgctcacgaacaatcgtctgacaaatcttgcggagattgatcccctggcatctcttccaaagctacagttccttagcttactggataatactgtaactaagcagccagattacaggctgtatgtgatccataaattgaagcatttgcgtttgctggatttcaagaaagtgaaacaacaggtttgttcatttcctttggaatggctccaaaatatgttttgggatggaccccagaagtgctggcagcaaaagagacaaacaagcaactcttttgactttggattttcacgaattagatgcattaacaccatggaatgctttggctgacatgttttccattatccagtctgcacatgttgcttttgtttctgaattttcttgggagattttttttttttttgctttggtaggagagaggtgccgccgccgaaaaagttccactcaagggaagcagaggaggaggcaaagaaggtgcctgccaaaacgtttactcctggtctgcctgatgctcaggacatcacaatggagccacaaggtcctaaagtagttgctccaactcctgaacaaatcacagctatcaaggctgctattgcaaatgcccacactctcgaggaagctgcaaggctagaacaggtactaagcactggccaagttcctgctgaatttgcagtgcccaggcccgatgcaaacatggccgaagcttcagatggagccgagaagatggacacagatggtgagaaccaagagggcggtgaggctgatgggcagaaacaaggcgaaggaagcaccccaattcaggaggattgaaggcatggtgacatgggctgggtcatccattgtctgagttaggtttgccagttttcgtgggggtgcaggaaagagctagagccttgttgccgcagaactccccctctatggatcgcatgtggatgctaacaagattcttgcttatttttgcagtagatggtactgagaacagaatcagatgttgtaaactatacatacagtcgtgcatgttgccgaatggaccattgtttcggtcgt

SEQ ID NO: 9674 - DNA, 1512 bp, Zea mays
gcacgagagaaaaaaaacatttgggtcgtcgagtttgggtccgaacaaaaaatgagcccaacggcaccaccgggaccgggaccgactggagacactgcttgcagttgcgccacgcccgccaccccgccaggccgccactagggtttttcggggcctcgccatcgtctccgaccccgtgtctccgaacaacatcgcgcggccgccgcctcctcccagtcgccatggtcaggctcaccgccgacctgatatggaagagcccgcacttcttcaacgccgtcaaggagcgcgagctcgacctccgaggcaacaagatcgccgtcatcgagaatgtcggagccaccgaggaccagtttgacacaattgacttgtcggataatgagattgtcaagcttgaaaacttcccatacttgaatcgtcttggcactctactagttaataataacagaatcacacgtatcaatcccaatcttggcgagtttttgccaaagctgcatacgctggtgctcacgaataatcgtctgacaaatcttgcggagattgatcccctggcatctcttccaaagctacaattccttagcttactggataatactgtaactaagcagccagattacaggctgtatgtgatccataaattgaagcatttgcgtttgctggatttcaagaaagtgaaacaacaggagagagttgcggcagcgaaaaagttccactcaaaggaagcagaggaagaggcaaagaaggtgcctgccaaaacgtttactcctggtctgcctgatgctcaggacatcacaatggagccacaaggtcctaaagtagttgctccaactcctgaacaaatcacagctatcaaggctgctattgcaaatgcccacactctcgaggaagctgcaaggctagaacaggtactaagcactggccaagttcctgctgaatttgcagtgcccaagcccgatgcaaacatggccgaagcttcagatggagccgagaagatggacacagatggtgagaaccaagagggcggtgaggctgatgggcagaaacaaggcgaaggaagcaccccaattcaggaggattgaagtcatggtgacatgggctgggtcatccattgtctgagttaggtttgccagttttcgtgggggtgcaggaaagagctagagccttgttgccgcagaactccccctctatggatcgcatgtggatgctaacaacattcttgcttatttttgcagtagatggtactgagaacagaatcagatgttgtaaactatacatacagtcgtgcatgttgccgaatgaaccattgtttcggtcgtagcgcttgtgtcggtgcctgactgcagtctgcagagcgagatgtcgccctgccgcctatccttttctcggagtgctttattacaagtttgagtgatggaccctgttgagttgaggcggatgatcgtcatctattgctggatgtttcgtttttttaaaaaaaaaaaaaaaaaaaagggcggccgctcgccggacgcgtgg

SEQ ID NO: 9675 - DNA, 1699 bp, Zea mays
  misc_feature (19)..(23): n is a, c, g, or t
gttatatggatttttaccnnnnnaaaaaaaccttttcactgctccatgctccagggaaggcacacaagccgccgctggtcatcttcccgcagttccatcttccgctcactcccttcatcgcgctcggcacacaggcgacggcggcggagctcatgctagggctctcagcgaaggcatcagctgcttcccctcccgcctctcgccaatcgcctcccgtcctccgcacaccggccggtgatcctgcgtcttttcattcgtaaatcatactccaggtatctgcatcgcaggggaaatggcaagcaaagcaggtggtgatggcaaagaagccataaacgagcaagtagttgccaacacttatgccaacatgcgtaccgaaatgaaccagctctataccaagatcacagagctggagatggaggtcagtgagcactccctcgtgattggtgcgatcgagccgctggacccctcaaggcgctgttacaggatgattggtggggtcctggttgaaaggaccatcaaggaagtcctgcctgctgtgaagcgcaacaaggagggccttgaagaagtgattgctcgcatgcatgaggcactggagaggaagaagaaagagatcaccgagtttgagcttaagtacaagatcaggatccggaaggctgacaatgacgcagaggacgaaggcggcaagaaggaaggcactgcacagggagtccttgttgggcctgctggacagtaaaacttaattagatggattttgtgtaaaagatgaggaccgatgtgaactgaagtagtttctttgttacctcttcgggtgctgcagcaatccaagtttctgtttgttattgatgacacatcgcaaatctcccaggactagaatctctgttcgtgattccttttactatattctcaaaataattgtggattagtcatctgcatgacttcatttcaactgatgctgaaatattgtggtgcttggtggctggtaaattcctgtaattgagctgtttcaatggcataccagcttgttgttccaaaaaaaaaaaaaaaaaaaaccccccgtattttgcttgagttttctccataagcttggttctgttatctgcctagctccaatatggtaggaagtgcatgaatcagtttatataacttataagtgtcatgctccttaatatgaatcacccggcaattatacttctgtgttttctcatccaagaaagtgcatgaaacataaccagacaaactataacacccatacattgatacatatactctgaaaaagtgttttgttctctttgttcattatctgaaattggacatggtttctaactaggaactttaatcatacaatttgcagtgttatatgaagcaaggtcaaacacatgttttgttctctttgttcattatctgaaattggacatgattacaaaagaaagaagctttttcaggtgaagcattgatgctacttgcattagtagagtgacatgtttcatattagaacacccccttggcttttgaaggcaccatgcatctttagctagaatataattttagattatgtgaagtaatagtaatcaaatacaattattttgtttatcgatttgtttttataagccatctgatttcaccttagtgcttgacactattcactgacttttatcttcttcttttaggaatataccactaatccattttaagcatttct

SEQ ID NO: 9676 - DNA, 1674 bp, Zea mays
acctctgttcagccaaagccacctccccaaacccaatcccgtcactatctcattcccctgaccgccggaacaccctaggcaatggagcccaaatccaccacccctcccccgccccccgtgatgggcgcgcccatcgcgtatcctcccccgcccggcgccgcgtaccccgccgggccgtacgtgcacgcgccggcggccgcgctctaccctcctcctcccctgccgccggcgcccccctcctcgcagcagggcgccgcggcggcgcaccagcagcagctattctgggcggagcaataccgcgagatcgaggccaccaccgacttcaagaaccacaacctgccgctcgcccgcatcaagaagatcatgaaggccgacgaggacgtgcgcatgatcgccgccgaggcgcccgtcgtcttctcccgcgcctgcgagatgttcatcctcgagctcacccaccgcggctgggcacacgccgaggagaacaagcgccgcacgctgcagaagtccgacatcgccgccgccgtcgcgcgcaccgaggtcttcgacttcctcgtcgacatcgtgccgcgggacgaggccaaggacgccgactccgccgccatgggagcagccgggatcccgcaccccgccgccggcctgcccgccgccgatcccatgggctactactacgtccagccgcagtaacgaatttgcttccttatcatggtttcgcttccatgcagcctttgcgggtttttagtaaactattattattactgagagtgccctgttgttacccatgctctgttgttgccacccaataactcgatgacctgatgatcatctgatgtgcctcccgttccgtaacaagtgattccatttctgattacagagagatggctgctcgtaattaagagtgaggctgtgtgatggttatggtacatgtcatgcttgtcgtgattattaatcattagtgctggtactcttatggcatgtttggatgagtcaatagtagttactagttggactaaaaatcagcttaaactagccaaggttggatatcactaacagccaactgaagagttgtctaaaaaattagcccatctattagccctcctgtttggatgaactagagctaactagggttaatttttagctagccagtggttagcccctgtatccaaacaggcccttaccttgtccaactcccaactaccgtaaaattactcatgtatacttgtgttgagcaatgtcatgctgctctttagatttttgtaggctagaaaagcaaccgtttccaattgtaatgctatgggggcttcatgtaatctcaagcttgttggtagcacaaatatttgattagtccccattctctgtatcattaaattatttgttttttcctggtgttccttcttggaataatttcagggaccttatgtttgctcattttccagagtatgaatgtgttccctgattcatcttggaatatattcaggctggtatattttgccgaatttccatattgtagatggatgtatatcatgttcctcgttgggttgggatagtttgagtccactgttgtggtagccgagctatggagagtttacttccttgcagtgctctttgcggtggcagctatgcaaagatccggagtttgtgtttgctatggaaacttccatacattttctggtgctt

SEQ ID NO: 9677 - DNA, 1136 bp, Zea mays
tcggaatctcgtgagatcgctcatcgaagactggaaacacacagttgacgtgtggattgctcaccgcagagatgctgttgtttggattagttgcttcatcgatggttctgtaacagatcaaacacctcagtccatgggtccttcaagcttggagcaggaggatcgaggggcggcttccacccacatggatgaaggcgacctcttcgcaacgccgagcactacaattcggctgtccgaggagaacatggatggcgatggaagcatcatgaccaatgacagtagggactgtggccagcggtacccgatgatgaaccaagaaccggctagaaggcctccgccaatgggccagcggtacgacccagagccatgctggaggcagtcccggccgccgcaggaactgagcaccgggcagacaaaggagcagttcgtcgcggagatgcttgccagaccctcgagcgtggagtcgggccccgggagaccgcaggcgaggcctaggcagcagcaccaggacaccccagcagctcaagccaggccgcagccggctgcgtccgagaaaccggcggctcaactcgacgcgaactctgtgcgagcgaagctggagctcgcgaagaacgccaagctcgaggcgaccaagaggaagctccaggaagggtaccaagaatccgataacgcgaagaagcagaggaacgtacagatggtgggtccgcagaacctgcccaagcaagggaacacgaacaacaaccgtagtttccagcctagcggtagcggcaggccaaggagtagcggcaacgtcaatagcaacaggaactggtcaagatgagaggcaccgattccaattccgattccaattccttcaagagcggcaggatcccttttctttttctttttctttttctttttacatcggctacaacaatttttagtctaggccagtagtacataaacagcaataaggcttgttttcggaattgcatgtttggcatgtcacaatgctcggctggctggtctttgccgatgaaacctgtaaagataacactaccaaattctgatcttgagcttactatccatgctaaaaaaaaaaaaaaaaaaaaaaaaaaaaaaaaaaaaaaaaaaaaaaataaaaaaaaaaaaaaaaa

SEQ ID NO: 9678 - DNA, 4146 bp, Zea mays
aaatctacacatgttttgacacaagcaagcaggtcagcacgaagagaacctctggaccaactcatacctccctttggaacgctggtgagctccggcagcagagaacctctggaccaactcatacctccctttggaacgctggtgagctccggctgctgccagcttgccacgcgcgcgtgtctatcctgcacatgtgtcgtgccaaaacaaaacggagagcccccgcggtcttggcttaccgcttcctcctccccacgggccacggcagcgcacgcccacgcacccggattgcggcgctgcgctcgcgagcgaatccgcgagcaatcgcaacagcaaacaaacaccgcaacacggcccaccaccgccccgacggcccgacctcgccttctctctctctctgccctctcgtatcgtcgtcgtcgtctcgcttttgtgggggcaggtcgggagggcgccgggagataggcacaggtagaaaggacaagcatcagaattagtcacgcacccacccgggaggagcccaggagagagaacatagaagggaccggaggaggaggaaacccttttcttcgccctcgccgccgccttctccttcgccggtcgcgtcctcctcgggttctctcgtgacctcttgaatccgcccgcgagttgttgcgtccgagcgtggcaatctgcatctcttttctctctccccccctgttcctgaacccgtgtaacagaaccgaagaaagaagacccccaatcaatcgaatcgaattggaaaaaaaaaggaacgtaaaattaatctgctactaggagaggcacaagtgcgtgcgtgcgtgcgttcgtccggggctccgggctgtgccggccgggcgatcgatcggcgatggcgccgccgtcgagggactactggctcggcttcttccgcggcgcgggggacaacatcttcgacgccatcgaggcggccatcaccgtcgccgcatccgaccacccggccgccctccgggagcgccgcgacggcatcgccgagcgcctcttcaccgcgctcctggtcaccagcgccgcggcagcggcggcgggggcggcggccccgggaggaggagcagcggggggaacccccgtggctggggcgcccactccggcacagctccaccccgagggcgccgccagcgtgcccagcctctgcagctccgaccgcgccgaggccatcgccgacgacgccgcgccgcgctgcgacgatcctgtcctcgccgagacggagcgcatcaaggccgtcctcctcagcgaccaagagaaggtcccctcccctcctcccctctgcacagttctgccgccgccggttccatactggtaactcgcactgactcttctccgcctctcacgttacagccggaggccgagttgctggagctactcccgcgcctgcaggagctggacctcgcgttcgacaccttggatgtgagccaccttcctccgccgtatccgttgatgacggattagattgattcctccaaccttattggttcgttacgtttgataggccaccgcgattggcaaagcagttgccaacttccggaagcacagctccaagcagattcggaatctcgtgagatcgctcatcgagtacgtttccacttccacgcgtatcattcaggaagcctttcggggttgtttttttttcttgccgtttctctatgctgacatgtttggtgtgaatcccagagactggaaacacacagttgacgtgtggattgctcaccgcagagatgctgttgtaggtaggtaacaggcagaaattagctcaccgttagtagtgctgcacttggattagttgcttcatcgatggttctgtaacagatcaaacacctcagtccatgggtccttcaagcttggagcaggaggatcgaggggcggcttccacccacatggatgaaggcgacctcttcgcaacgccgagcactacaattcggctgtccgaggtacgtggttcacaacaaaatcaatcgactcagcatgcatatgaactactatagcgcggaaaaaaagttttgcatggtccatggtgtgatctgacgctgctccctctcgtcattcctcaggagaacatggatggcgatggaagtgagtgatcagattctcgctctcatcaaccaatcccctccctccctctgaccattcttggttaggaatttgtatttaccatctcggtcggtttgtgaattccaattcaggcatcatgaccaatgacagtagggactgtgggcagcggtacccgatgatgaaccaagaaccggctagaaggcctccgccaatgggccagcggtacgacccagagccatgctggaggcagtctcggccgcaggaactgagcaacgggcagacaaaggagcagttcgtcgcggagatgcttgccagaccctcgagcgtggagtcgggccccgggagaccgcaggcgaggcctaggcagcagcaccaggacaccccagcagctcaagccaggccgcagccggctgcgtccgaggtgagcgtctcgtgcctccgtcgttaaaaaccgtacgtgctgatccgaatctgatcgccgcgaagtctggttgtctgagttccgctcgatctgtctgcagaaaccggcggctcaactcgacgcgaactctgtgcgagcgaagctggagctcgcgaagaacgccaagctcgaggcgaccaagaggaagctccaggaagggtaccaagaatccgataacggtatgcgtgctgctgctgctgctgctgctcctatggctataggatatccatccttcattgtgctggtggtggttcatgcattgtgctgtgctgcttgatggaccgagaatctgatctccatttcttttttggttctctgcttcgcgccaccgcagcgaagaagcagaggaacgtacagatggtgggtccgcagaacctgcccaagcaagggaacacgaacaacaaccgtagtttccagcctagcggtagcggcaagccaaggagtagcggcaacgtcaatagcaacaggaactggtcaagatgagaggcaccgattccaattccgattccaattccttcaagagcggcaggatcccttttctttttctttttctttttacatcggctacaacaatttttagtctaggccagtagtacataaacagcaataaggcttgttttcggaattgcatgtttggcatgtcacaatgctcggctggctggctggtctttgccgatgaaacctgtaaagataacactaccaaattctgatcttgagcttactatccatgctaggagtctaggacgctgcctgtcatcggaatgaggatgttctctgcttgctttgtcgcgctgctgcacccggctttttcaggcgcgggcgccttttgggagtagggccttttcgctgaattcagcgtagcttgtctcctgcagaggctgaagaattacgatggcaatataccatcatggcctgcaactgcaagtgagacgattcgttcgcgccgcctagagattcacccgcacctgacctgcctttctacaggtagcaccggtagcattttattgtaaagatcggtcaagttcctagtcttaagacagtggatgtttgaaatttctagttcggtcgatggttttagtcaatttcagagggtggcgtcttcagaggactttgctattagagcaaattaataatagagcctacagtggaatctaaatccttgctacgtaaccaacaataaaaacattcatatctcctttgaaatgtaggattagtaaaatatagtgatagaaaaaaaataggaatagagttgcatgaggccttcaatttcatatgaaaatttccaataggttggaccccatgtaaaaaaacccccttcaaaatctcactataatgctccatcccatagcgattttataggatatgtagcagttcaatcctttgtttcaaagtgctacgtaggaaaactttctataggatttcaatccttcaaaattcccagtagcagcggtagcattttcttgcaaagattggtcaagtccctagtctttccaaacaaggcaggccctggtagtttgaaatttctagttcggtcgatggttttagccaatttcggagggtggcgtttttggggactttactattaggccccgtttgtttggttg

SEQ ID NO: 9679 - DNA, 1464 bp, Zea mays
gcacgagaccattacctagaacatcctaatcgaaaaacgttgtcctgcccaccgccagcccctcctctgccccccgccggccgcccacctccagccccacctctacccgccgccctcctctggccgcctcccctcctctggccgccgcccaggcacccaccgccagccgtcgaggcctgcaccgccctctaatcaccgcccaggcgtccacctctgactgccgcccacctccagccgtcgaggcttctggtggaaactcgtttgctaagatggaagagggcaatgactactatgttgttaggaaaggtgatgtggtggcagtttacaaaactctaagtgattgccagggtcagatttgctcttcggtatctggtcctgctgcaagtgcctacaagggtcactcttggagcagaggaaaggaggaatacctgtcttcacggggactaagtgatgctacatacgtaatcaatgcagccgaactcagggaagatatacttggcccccttgtgccctgtagtttccaggacatacttggttctagttcaaatcaactggctccaaatcatataggcttccataatgttatagcatctcagactggagcacaatatgttgatctgaaccatgaagccagatctagttcatccagacatatctcaccagcaaatttcaatcataccggaactgttgatgcacaacctatctcaaaacaatacatggtgggtattcttcattttgatggtgcttcaaaagggaacccatgtaaagcaggtgctggagctgtgcttatgactgaagatggaagagtgatatctcggcttcgtgagggtcttggtgtcgctactaataatgttgctgagtatcgaggcctgatcttaggactgaaatatgcgattcggcatggattcaagagaattaaagtacatggggactctcaacttgtctgcaatcaggtgaatggtgtttggcaaacgaagcagccgaatatgatggagctgtgcactgaagcgagaaagctaaaagagaacttccattcctttgagatcatccatgttcgacgggagtggaatgctgaggcggatcgtcaggcgaacatcggtatcacgcttgcaagtggcgccgtgtttgaggagcgtggtgacatctgatacatagctagcaacgtatgtatttaactaactagcttgacctttgacttgcacctttgtcgagcttctatgctgctctgcagcagccatcaggagctgaggtgatggcctgccgtctagtaggcactatatccaattactttacactagttggacctatttcaccatcaagctgctacggaagcctgatttctgctatggggcctcagtttgatgtgaaactgtgctttggaagcttgatgttgctcgataagttgatctatgaatggagaattttaatttgttaaaaaaaaaaaaaaaaaaaaaaaaaaaaaaa

SEQ ID NO: 9680 - DNA, 1941 bp, Zea mays
  misc_feature (43)..(43): n is a, c, g, or t
  misc_feature (1922)..(1922): n is a, c, g, or t
gggaccctcgaggccggccgggggctaagagagaagtattacngcttggcccaacgtttattaagctcgggcagttatcctccactaggagctgatttatttcccagagaatttgtggacgagcttgcgaaactgcaggacagagtacctgctttttctcctgagaaggcaaaagctttcatagagaaagaaatgggttgttccattgatgttgtgtacaaagaatttgaggaacgcccgagtagctgctgccagtcttggtcaggtacaccgtgcaatgctccacaatggagaaagagttgcagttaaagttcagcgacctgggctcaaaaaactttttgatattgacctaaggaacttaaagctagtagctgagtattatcaaagaagtgaaacatttggaggcccttcaagggactggattggtatttatgaggaatgttccaaaattttatatgaagaaattgattacatcaatgaaggaaagaatgcggacaagtttcggcgggatttcagaaatataaagtgggttcgcgtgccacttatcatgtgggactacacaactgaaaaggtgctaaccctggagtatgcccctggtattaaaataaacaatttggatgtgcttgacaaccggggttatagtcgctcactaattgcatcacgtgcaatagaatcttacctaattcaatctgaagactggattcttccatgctgatcctcatcctggaaatcttgctgtagacaaggatggttctctaatatattacgattttggaatgatgggtgagataaaacagttcactcgggagagattactctccctgttttattctgtgtatgagaaggatgcaaacaaggttatgaaagctctaattgatatggaagctctccagccaacaggagatctctcaccggttaggaggtccatacaatttttcttggataatctgttgagccagacaccggatcagcaacagactctggctgcaattggagaggacttatttgctatagcacaagatcaaccttttcggtttccatccacatttacatttgttataagggcattctctactcttgaaggaattggatacatattagatccagaattttcgtttgtcaaagttgcagcaccatatgctcaagaactgttagacttgaaacagagacgacaaactggacctcaattggtccaggaaataaggaagcaagcaaatgatgctcgtgattctacaatatcaatgccgtacagaatacagagaattgaagattttgtaggacaacttgagacaggagatctgaaacttagggtcagagtactggagtcagaacgtgctgcacgtaaagctactgttcttcagatggccaccatgtatacagccttgggtggtactctcttgaatgttggggtcacactgaatagtcaagggaaccagataattgcaaacggctctttcattggtgcaggaatatttttggcattgctggtcagatctatgcaaagagtgaagaagctcgacaaatttgagaccatgatataattatcctattttgtaaagacgtgcaatcgccggaattacatgcgagctgcgcgtcccttcgaggttgatagcctatgcatagtgtatatagtaaatgatattctttctggaaacaacctaacgtgttgctcttgtaaatctttacaaactatatcattctttagccagttaggcacatcgatcaccaaggagtcgacaaaacaaggaaatcaagataattgtaacatacactacacaaaacatttatgttagggtggcggtggaaagatcaaaaaaaaaaaaaaaaagttggatgtataaggagggatgaaagaagaagtcatattttctatattgtttggatgagagtcacgccggggagagtgaacaccggagcaattntggtgggcggcgtggtccc

SEQ ID NO: 9681 - DNA, 4981 bp, Zea mays
  misc_feature (853)..(853): n is a, c, g, or t
  misc_feature (943)..(943): n is a, c, g, or t
atgtcccgcacacgtccgttacattgatcaggtcaggtcggactgagtttttttccagtcgatcaggtcggattggtaggatcgggtaacccataatcaggtatactctctctattttaaattataatgatttttttctaagtttgactcatcttattatttttttataattaatattaattttcattgtgatattttttgtcatataataataataatatagtctttgaaattttaattatttcacaaaatttttaaataagacgagccaaatcaaacgaaaggctaacactgtgacacacacgtctcctgtctctcgctttggcttccccagtcatcgcagccgaccagccgtcggccgtgcgcccgtgtttcgtacgcggcttcccatcccacgctttgccgagaccgagagggaacctcccaccgtcccacgacggccgcgggcggggcaagaacatatacccgcgtcactgacacacggcatcgcagcctcgcaggcaccacccaaagcaaaaccccatttgttcgcttgtctttctctagatccacccccgaagaaaatggcctcctacgatggcgacgaggactccggtcgccgccgcccttcccagcaccgcccgtccggcgggggcagcggcgaccttgcctcgagcgcgaagtcgtggcggaggcggcaaagctggccctccaggaccacagcctggagaaggtggacaagggccgcgtcgccggcgcggcggccgacctgctccacgccgcctcccagtacggcaagctcgagggcaagcccgtcggtgggtacctcgagaaggccgaggagtacctccaccagtacggccgcaaggacggnggccggcggcaagcatcagggggacggggaaggcaagtacggtaagaatcccggcggtggccacggagggggaaggtatgaggaggaggnaggggtacaagaagaagcctagtggcgggaggtatgaggaggatgagtacaagaagaagcctggtggtggtagtggatatggaggtggaaggtacgaggaagaagaaggctacaagaagaagccaggcagcggtggctatggaggaggaaaatacgaggatgaagatgactacaggaagaaaccaagcagtggtagctatggtgggggaaggtacgaggatgaagatgattacaagaagaaacccacaagtggtggctatggtggtgggaggtatgaacaagaagataattacaagaagcctacaggtggcggctttggtgacgggaggtatgagcaggaagatgaatacaagaggcctctgagtggtggtggcagtagctatggtggaggcaggtatgaagatgatgaatatcggaagaagccgagtggtggtggctatggcggaggaaggtatgaggacgaagatgattataggaagaaacctagtgctggtggatatggaggtggaggaagatatgaagatgagtacagcaagaagccagctggtggtcatggcggagggaggtatgaggaagatgatgagtacaggaagccgagtggtggtggatatggttatggagcttccagtggtggaggtcatggaggaaggtacgaagaagaggactacaagaagaagcctagtggacactcagggggacgctatgaggaagaggaggggaacaagaaggctagtggctatagtggagggaagtatggcaaggaggaagacgacaagaagaagaagcatggcgaggatggatcagagagtggtggtattggagattacctgaagttggcacagggtttcatgaagaaacaggatggggaaggggacagtgggggcggcatgggagactacttaaagcttgcagaaggtttcttgaagaagcgctgattaatcttccatatcatgattcaggaaggacttgtttggttagtcacttgtcctgtttattgtctccaagtagtgacattttcgaggtttccatcataggatgtaatacaagtgcattgcttatgttgtctgtgtgttgtgacatgaatgcttaatgtgctgctgggataataaaagcttggatgctctgctattcatgttgtatattagttctgactaaaataatatgtatcctatgttatcgtgcttacaataagtgaaactcttgaatacattttcattgattatctattgctgttaaagtcctattgtttgaaatttctgtgctgatgtgttggttcttgatcttatcatactgagtactagtgcatggatgtgcttcttttcctgaacttgattttagttttgctgaacctgagacagtgacactaatcagccatgaagatacaaataatttagtatctaaatcaaactaatgtcttggaagtagacaataagtcatatagacgagaggctaagaggattgttgaatttgaaccacaggtggtcttatgtcatcggcttcaagcagtgtcagaactattagtattttacctttcctgattccatagcaaacagaaaatgcacaagtctatggaatattttcgcaagtgcacccatttcagctgcttatttattcaatcaagcagttttttgctcctctttgtatgacctctcaggctcacaataccttgattccaatgcgctcattcatctatttgataaaaaacctaggactctttaagtgattgaacacctatggctgcagaccttatgtatcctttcaacccagcggttttgaatctcctaccagtcattcagactttttttttctgaactatgaacctttcttgaatggttatcgggtgcgctaccccaattggcttcactcatgataaaaaagtttctcttattactgatgatgacaaagttcatgggattgaaacagtcaaacaaccaagatattacttgtaacacgtacatatgtgcatcagccaatcaagtttctgagagatgattggcataattgcatgtttttttttggtaattgggctggaatgcagtcacacttcaacaggatacttaatcttttgccatctttacgggcggcgcacacacaaatgccagttttaaaggggactcaacaaataattaaatatttaaatatccacacttcatcgtggaaggaaatctgggacagccgttcttgaagaagcaaggtcaacatgctggcatggagtcggaaggggaacagaatgattgtatgaataccgtgggcagtggacttagcccaagtgtctggtgaaaaaacactcagatcattttcctcaaaagatgcgatggccgagattttggctcttgtatgtctgcaaatactatatttgtattaactcgcataaagaggttgcctgattatgtatcttctttggttaataaaattgatgtggcggatggaatttggtactgagtattataatgtaacttccagaagatattcctcctgttagtgctatagaggatgatcttctgatgcaacctgtttgtttgacgataatcttcatctgtagtctgtttactagaggtttggtctgccacaagtatactatataataccattaataatccatgtattttatttacattggctttctgtactgaatctcatcatccagaagtttatgcttccctcagatgtagtttgattctcttcaaaaattagccattgtgcattaatgtctgttattgttagatcgttggatcgatccattactcactttttttatcatggaaatctccattacgcataaactgaggccaaatgttcggccaccaggtcatggatacgtacaatttggaatagtgtccaagaccgagacattacccggacgccggactcagttgcccctaaggctgctacaccatgggctaccaaaattacaagagcgtggactaagagcaactacatgagaactggagtataatgcattagcaatttgcaattcctttaatttcctagactgcttgtccagtaccattgcggcattagcaattcctttaattttctagactgcctgaaccaccattgcggcatctgtctccagtatcaccttctaaatcccaagatcacctgctcctctgcagaggcaatcacatctgcatgaaacggttccagatcgctccccagtctgccatatgagcaactcgtcccctaaaaaaatattcccaaacactatgtattggggcctcactaaaaaatacttccccaaaatcttatctatacatgatacatcagcatatttggatccatctggtactggtcgattctttttttttgtttcgttttttttgtaatagatgaacaagctctgaacttcggttaatgtctgattgtctggtcaaaggttcgatgcagccatgttgccatgcagttacgtcgttgtcttgtttatacggtgtcacaaatgctgaaactttccatgaacttttaaatatttatgctaaagacgaggaaataacgcgccaactgaggagattgggggcagctctctcgccaatatttcgagctccttattgggaacacagaaaaattgagaagtgaaaggggagctgttggaggcttcggaagatgatttttcaccctaaaaactcttttgggttggtctccctaatttgttggagttgaatgcaagtaggacgagatgacgaattgacgacggatccattactcagttatagtacatgcatgcaagtaggacgagatgaattggtaattttttatcttaatggaaaagtcgttgctctttggtttatatatattttttccagttctctttgaaggcaccattttggcctacactattctttacaaataacatgatgatgtagcgaaggggctcacgccgtagtggcaaaggccactggtcgtctaacttacagtctcgacataatccatccatgttcttgatttacaaataagttgatttttggccatccaactattgtccatatttgattttacccgtgcgactctaaagttagaattttgtgacaaccaaactattag

SEQ ID NO: 9682 - DNA, 1388 bp, Zea mays
ggtacccccgccgccgtccggcgtatgcgcctcgcggccgcttcggcaggccctcgcgttccatttgcttcggctcatctcagatcaagctagcgcacctgacacccaccacctccctcccagatccaccaccccagccatggccaccgcctttgactccccgacctcctcccccgccgccgcgcccttccacgacgaccctttcctccatttcgacggctcggcccccgccgccgccgacggcttcccggcctccccggacgcctacgcgccctcccccttcggcatgccccactccaacggcgacctccacgacgaccctttcgccgcacctgctgactccaacggtgggcccatccttccgccgcccaccgagatgggccgcgaggagggattcctgctccgcgagtggtgccgacaaaatgctattcaccttgaggaaaaagagaagaaggagaaggagctgaggagccaaatcatcgttgatgctgaagagtttaagaaagcttttgttgagaagagaaagctcaatgctgagacaagcaagggccaaaaccgtgacagggagaagcttttcctagcaaaccaggaaaagttccatgctggtgcagataagcaatactggaaggcgatatctgaacttatcccacatgagattgctaacatcgagaagagaggggcaaggaaagacaaggagaagaagcctgggatcgtggtgatccagggaccgaagcctgggaagccaacggacatggcacggatgcggcagatattgctgaagctgaagcacactcccccaccacacatgaagccacctccgccacctgccgcagctaccggaaaggatggagcaccagctgccgccgggaaggatggagctaagccagcaaccgttgccaacggcagtgtccctgagatggaaaaggctgctgcggaggcatcagtgccagcggcagcaccaccagcagcaactgagccgatcgcagctgcttaatctaatcatctgtggtaggaggatgtgaaaaatctcttattggagttgttgcagaggcggtggtggtgagtgaaactgaaaacgtgtgaatttccggcatggtggaggcatgcactgtgtatttgttacctcgattcatttacattactgctactatatattgttattgcattttgtagagaaggggcgggcgtatcctggttcatggtaataataaggttgtattaggaggatgtttggctgtattatgtttcttcttccaagtgtttgtaaatttcccttttgttattaaaactgattgtattgttaaatttttctttgttattaaaactgattgtattgttaagctactatctgctgcatatacggagtatcttttatgatctcgtgcgaa

SEQ ID NO: 9683 - DNA, 1497 bp, Zea mays
gagatgtcagatgtcaaacggcaacccctccagctcctatccccaaactcgattgcagctcgtgcaccacacacggacacgaatcctcctccggtcctccctctgggaaaccaggactacctcggatcagatgcagtgcctaccctgcggaccgtccaccaacgcgcccgctgcgcatgccgcggccaggagcgtcagccgtcggagggttgtcgtcgagggcgtcacctcggcaacccacgacagcgaggaagcgcctccaaggtcaatgagggcaacaggtgaccgtggtgctatgtcaggcaaaaccttatggctcgtgtcaaagaggaagcttattgctttgtcagccttttgtcttagcttacattcttcaagcatttgctttgggtgatacgtctgtcaaaatcgaggatgtgactcctaagatttttccatctgggccattatttccaactgagaaacggattgcagagctatttgaaataaatacttactcagttgtgaacatttttgatgcaacactacggccgcagcttaatgttactggtgttgtggagttgttggcagtgctctttcaaaaaatccgaagcctggtgatgttgttgcacgcgtcaacattcttgctgctgaagggatacagaaaaattttgaaggcaaattggttggtgcagatcgtgctaaagatcttgctgttcttaagtggtttaaatcgagatattttaagtcaggctggggtgacaattggaggcggaattcaaacagatgcagctattaaccctggtaacagtggtggtcctttgcttgactcaaaggggcatatgattggtattaatgcagcaattttcacacagacagggacatccgctggtgttggcttcgctatcccatcatcaaccgtacttaaaatcgctcctcagttaatccagtttggaaaagttcgccgtgctggcttgaacgtggacttggctccagatccaattgcgtatcagcttaacgttcgcaacggagctcttatactcaaggtacctgggggcagcgccgcagccaaagcagggcttgctccgaccagcaggggttttgccggtaacatcgttctcggtgacatcgttgtcgctgtggatggcaagcctgttaaaggcaaatctgacctgctgagggttctagatgactacggtgtcggagaccaggtgagcttgacgatccggcgaggctccgagaccctggaggcgacgctgcctttagaagaggcagacatgtgagcagtttgtggaaaatagaacccacgtataccgagctgtccacgactgtcgtcccattggaaacaattccatttcactaggaattattgaagtgtccttttcgctctggacattcccttccatgcacgtgtatgagcatgatcatgagcttcacttctcgtgcttggcattgccttaaagatcattgctgagccagtctcaaaaaaaaaaaaaaaatgacctgttagttggattc

SEQ ID NO: 9684 - DNA, 1695 bp, Zea mays
ctcgagccggccccaaactcgattgcagctcgtgcaccacacacggacacgaatcctcctccggtcctccctctgggaaaccaggactacctcggatcagatgcagtgcctaccctgcggaccgtccaccaacgcgcccgctgcgcatgccgcggccaggagcgtcagccgtcggagggttgtcgtcgagggcgtcacctcggcaacccacgacagcgaggaagcgcctccaaggtcaatgagggcaacaggtgaccgtggtgcaatgtcaggcaaaaccttatggctcgtgtcaaagaggaagcttattgctttgtcagccttttgtcttagcttacattcttcaaggtactttccagcatttgctttgggtgatacgtctgtcaaaatcgaggatgtgactcctaagatttttccatctgggccattatttccaactgagaaacggattgcagagctatttgaaataaatacttactcagttgtgaacatttttgatgcaacactacggccgcagcttaatgttactgggtgttgtggagatccctgaaggaaatggttctggtggacggcggcacgattttggacatatccgcacgggttatcatgttgttggcagtgctctttcaaaaatccgaagcctggtgatgttgttgcacgcgtcaacattcttgctgctgaagggatacagaaaaattttgaaggcaaattggttggtgcagatcgtgctaaagatcttgctgttcttaaggttgatgctcctactgatctcttgaagccaattaatgtgggacaatcctcggccctaagagttggtcagcaatgcttagcaattggaaatccttttggttttgaccatactctaacagttggtgttatcagtggtttaaatcgagatattttaagtcaggctggggtgacaattggaggcggaattcaaacagatgcagctattaaccctggtaacagtggtggtcctttgcttgactcaaaggggcatatgattggtattaatgcagcaattttcacacagacagggacatccggctggtgttggcttcgctatcccatcatcaaccgtacttaaaatcgctcctcagtttaatccaggtttggaaaaagttcgccgtgctggcttgaaacgtggacttggctccagatccaattgcgatatcagcttaacgttcgcaacggagctcttacacccaaggtacctgggggcagcgccgcagccaaagcagggcttgctccgaccagcaggggttttgccggtaacatcgttctcggtgacatcgttgtcgctgtggatggcaagcctgttaaaggcaaatctgacctgctgagggttctagatgactacggtgtcggagaccaggtgagcttgacgatccggcgaggctccgagaccctggaggcgacgctgcctttagaagaggcagacatgtgagcagtttgtggaaaatagaacccacgtataccgagctgtccacgactgtcgtcccattggaaacaattccatttcactaggaaatattgaagtgtccttttcgctctggacattcccttccatgcacgtgtatgagcatgatcatgagcttcacttctcgtgcttgtagttgccttaagatcagacagcctgatgttggagaacaagctgacctgttagttggattctgttgtcatctcattcccgtc

SEQ ID NO: 9685 - DNA, 741 bp, Zea mays
  misc_feature (713)..(722): n is a, c, g, or t
cctcgaggtctcggccggaaaaaaaaaaaaaaggaacagaagggagaaagaaaagcagtcgagcagcggtagccggtaggcgagagagtcaggattcaggacgcggcgaggccaccatgagcactctcaagttctgccgggaatgcaacaacatgctgtacccgcgggaggacaaggagacgcgcaccctcctgtacgcgtgccaaacgtgcgagcatgaggagattgccactgatacttgtgtgtacaaaagggttatccgtaagcctggtggtgagcccaaagatgtcctgaaggatgcagcaactgatcctagcctgcctcgcaccagaagcgtcagatgttacaactgcaaccatccagaagctgccttttttcaggccccgactaagggagaacaagccatgacgctgtacttcatctgctgcaacccaagctgcgggcacaggtggagggactgagaaggatctggcttggtcttcgctgcaaacctgccgtattgttagcctaggtacaagttgtgccgtcaactgacgtttgctgcaagcttataagctactataacctcgtaacaaaacgatggtttggctggagacgaaatctgttgttcctcatgataagaaacagaaacagctatgaactaccagtatcatctcgtctcatgtactcataaacacagagtaatgcattacttccgctaaaacccgcggccnnnnnnnnnnaaaaaaaaaaaaaaaaaaa

SEQ ID NO: 9686 - DNA, 4596 bp, Zea mays
ctgcagaagaaggagacacccttgctcacagaaggtttcagtcggatcatgtgctgtaatgatgatggcgacattaaaaaagcagttgacttgtataatggtttagggccttcagatagtcttccatcaggagtttttggtcagaagagcaaaagacccgtacaagttggtataatgaagtttctaaagaaaactgatgcttccgttgttgagacatctagcggacctaagcaggcattgacagaaataaagccagcgcagcaaaatcctttgccaaaacaggaaaatgttgaagctggttttgcctgttccatggaagttgagaagggattaaatgacaagatggaaaatgaagagcatgctaaaggaagtgattattgtgatgttggttcccgtactctggcatttccatctatttctactgctgacttccaatttgatcttgacagagcatctgatattatagtggacacagctgctaatttcttgcagaagtttgataatataagactagttcttgtagacctgagtgagaaatcaagaattttgtcattggtcaaacagaaggctgctaagaagagcatcgactccaacagatttttcacatacgcgggagatatcactcagttgcacacaaaaggaggtcttcagtgcagcgtgattggtaatgctgccaattggtaatgatcttggttatttaaatattacgtttcctcgtctataagggaatcattatgtctaaatatcttccttttgttgaatcatgtgttgttatgtttcttctttttgaacaagttgtgttattatgtttctgggcgaaccaaactggctgtttcgcttttggagaaggtcagtaaccttattacacacagggagatgatatttgtgcccttttgacgcaggaggctaaaacctggaggtggaggggttaatacagcaatatatagtgctgctggagaatctttacaacatgctactaaaaaatgtgctgatgcactgaggccaggaacctctgtagttgttccacttccatcaacttctcctctgcatcaacgggaaggtgtgacgcatgtcatacatgtgctcgggccaaatatgaatccaatgcgaccagactgtcttaagaatgactataccagagggtctaagattcttcgtgaagcatacacttcactttttgagaattttgcatctattgtgcagagctacatgggaaagcagaacaatgagtctggagcagaaaagtcaccgtctggaaggatatcgcccaatgacacaaaaatgaagcgagaggacagccatgaatctgaaaggatgaaaaaacataagttgtttcaacccatcatgactgcaaagcgacagcatgagtgtactaaggttaatgctccaaattgccatgataatgccatgacttcatctgctgctcctagccaaactagacaagtagacaacaaaaggaatgatgtggttaccagtaagacttggggatcctgggctcagtctctttacgaacttgccatgaacccagaaaaatacaagaactcagattctattctagagacatcagatgaatatgttgttctgaaagatctctatccaaaggtttattacggaattttctaatcacaccttttctgttgtgtacgttttaatgatattcagtgatccacttgtcattttaacaaaactctttatatacgcaggccaaaaggcatgttttggtgatagctagaatggatggtcttgactctctagcagatgtcaagaaagaacacttgcctttgttgaggaggatgcattcagctggggtgaagtgggcacataagttcctagaggaagatgcggctttggaattcagacttggataccattcggtatgatcaaactcaagttcgcttccttgaactttccttgagaagtagagtgttttaatttgaggaactgcctcatcttttgtgaactggtccatcattgcatgtcatcatccgtaactgtagtgtgataacctcattacttaatttcacatgtttttttgttacaggttccatcaatgcgacaattgcatcttcacatcattagccaggatttcaactctgcaagcttgaaaaataagaaacattggaactccttcaccacatcatttttccgtgattctgttgatgtgattgaggagattgaacaaaatggatcaacaaccaccagcagtgatgaaaaggtactcgctatggaactccggtgccacaggtgcaggagcgctcatccaaacatcccgaaactgaaatcccacatcgccatctgtaaatctcccttcccttcacatcttcttcagaaaaacaggctgttgttgtcctcgacgatgcatatggaccgcacgtagatgcttgaactcgatgatcagttgtccttgcacgcacattttgcatgtcgtgcttgcctaaggatagtgttgatcgattttttttttacctaatgcggactagtggaaacttgccttgcttttcagagaccattacctgtgttggcgtgcttactgaagattattggggatggaagctccatttgacttgggtcattggatcgatattaaaattttctaaaataaattagagtgcgtcaggatctagattctcgtagaaatattttggatccagattcttttaggaagatcagtcagaattaattttataagaatggactagattatgattcataagaaaatatatatttactaaaaatcatataaataaaaacgcataaaaactgaaccttttgatacgacatatcttaactttgaactttaaaaaagactggttggtgcagactgcagaggagaggccagaaacgggaagagggaggtgggcctatcaccggcgtcctctcctctgtacttcactactatcttagaccacagagctaaaacttaatctatcttacggaaatagattaatcatgagccaattacagagtaacaacaagtatccatcattagcttttgttagtctagaattaatccagtcttttaaatgatatttaaaaacatgggctaactgttagtcgcatgtatgtaaggccatgttctaaacctctaaaacaggacaactaataaaacgggatgactaataggccaactagttgctaactatatctcttattaaacagctattagttattactgtctacattgtttatagagtgaagtgtgaaataggatattgaaataaacaagacattagagatgtatagctgactaacaattagctttagaggtttgtctgccctagttcgttcagaagttgtagtctcggatgggcgtttggcggttgctcaatatctgtcgttgctcccttgacatgggtgtcgtcgttgctctcttcgagctaagcattggcgggtacgctgttcataagcaaggtgaacccctttcaagtttcaaataaatcgatcctcccttttctcccgtctggatctggccgcgggctggcatgacgattgacgacgatgctgttgccggaggatatgacgatacttgttgaactctggcggcgacccaaccaccgcgtcgacgggcgacaggccgacagttctttgctcacgttggtcatggtggacgacgcggggctctgttccgcggcgttcttcgcgcactgaggagttggccgtggcggattcggcgacggagcgccaatcctgtttgtgggtccaaccgctaagacgtgtaacacatgcctgcttctgaaggtctggtccgaaagacagctgtccaagcagcatgctgggttcatttcctgctgccgatttcggtctccatcgatcgattccttactccgaggtggtgtctacaaattgttggagattcttccatgcagtagatggaaaaccaacccagttttttttcttttcttttctttttagtcttcacgacattttcgtcgagctttcgcaggatttgtaatctaatcaccttcttctcccgggacaaagagaagggacctgataagatgttcagggaattaaacgtgcaaagcttttaatctaacatctacttattcttgttttttgtttggttcataaatttgcatatactaccgttttcttcacgggttaataattagtattattatagaagatagagctattctacttaatttaagaaatagacttgtgatacaaatcatctcgtcttgaatagagtgacatgccgttttttttataatgacttcaacattttttcgttccttcttctatatttatctccctgtccaaagacttccgaaagtatacgattacgaaggtctttatatagtcatctctcaaacaaaaccttctataatttttccatcgtgtgtgttgtgacgctctcaggtagcgacggagaatcgttttgaaaccaatgacaccctatcagtattccgccgtgtcgacctggagagtcgttttgagccagattgagagtgagctttgttttggtggcttgggggtaccctgtttggctccgattcaactgatccttatgagaaacagaaacgagttatgctgccactccctacctgcatccttactgacagcgcacttccatcctgtagcgtcctcattcag

SEQ ID NO: 9687 - DNA, 1663 bp, Zea mays
ttccgggattgacggatggatcccaagctcaccgctcactcacaagcacgctgcgaaacacagacgcagagacccgcgcacagatcgaagcggaggatgaaggtggaggtggtggagacgacgctggtgccgccgagcgaggcgacgccgcggcacgcgctgtggctgtccaacctggacctggcggtgcccaagacccacaccccgctcgtctactactacccgaggcccgccggcgccggcgccggggaggagggaaagggagagggagaagggtcgttcttcgacccggcgcgcctgcgggaggcgctgtccagggcgctggtgcccttctacccgctggcggggcggctggcggccggcccgggcggccggctcgagatcgactgcaccggcgagggcgcgctgttctgcgtcgcgcgggccgacttcaccggcgacgagatgttcgccgacttcgagccctcccccgaggcgcgccgcctgctcgtgccattcgccgcgtccggcgacccgccctgcgtgctcgccatggtccaggtgaccttcctcaagtgcggcggcgtggccgtgggcacgggcatgcaccacgtgacgatggacggcgccggcgcgatccagttcatccgggcgtggacggcgctggcgcgcggggaggcccccgcgtggacgccgtcgcacgaccggacgctcctgcgcgcgcgctccccgccgcacgtccccgcctgcgagcacccggtctactccccggcctacctcaacggggcgccgcggcccttcgtgacgcgcgtctacgccgtgccgcccaagctgctggcaggcatccggtcgcgctgcgcgccgggcgcgtccacgtactgcgcggtcacggcgcacctgtggcgcgccatgtgcgtcgcccggggcctcccggcgggcagcgacacgcggctgcgcgtcccggccaacgtccggcagcgcctgcgcccgccgctcccggcgtcctacttcggcaacgccatcgtgcgggacctggtcaccgtgcgggtggccgacgtgctgtcgcagccgctgggcttcgtggcggagcggatcaagcgcgcggtggcccgcgtcgacgacgcccgcgtgcgctccgtcgtcgactacctggagcttgagtcggacaagggcaaccaggcggcgcgcggccagttcatgcccgagtccgacctgtgggtcgtcagcttgctcggcatgcccatccacgacgccgacttcggctggggccgccccgggttcgtggcccccgcgcagatgttcggcagcggcacggcgtacgtcacgcagggacgcgacaaggacgaccccatcaacgtgctcttcgcgctcgagccagagtacctgaacaccttcgagaaggccttctacggggagtgaccgtgacgcgaccacgaccagccatggcgaggagtccgatgacgatggaatgggactgtgatgccattgtgatgccatgccgttgtggcatctcccgtggtgtgcactgtaataccatatcatattgcatgtttcggaatgcaagtcaatgcttactgggtgtgtgataaggtgcttcattccagctttgtactagtgtcaccaagcacgtaaataattgaatgagaaactggaacgtgcacggctgggaaaaaaaaaaaaaaaa

SEQ ID NO: 9688 - DNA, 1674 bp, Zea mays
cacctagctcaccgctcactcaagcacgctgcgaaacacatacacacacagatcgaagcggaggatgaaggtggaggtggtggagacgacgctggtgccgccgagcgaggcgacgccgcggcacgcgctgtggctgtccaacctggacctggcggtgcccaagacccacacgccgctcgtctactactacccgaggcccgccggcgccggtgccggggaggagggagagggagaaggaggagaagggtcgttcttcgacccggcgcggctgcgggaggcgctgtccagggcgctggtgcccttctacccgctggcggggcggctggcggccggcccgggcggccggatcgagatcgactgcaccggcgagggcgcgctgttctgcgtcgcgcgggccgacttcaccggcgacgagatgttcgccgacttcgagccctcccccgaggcgcgccgcctgctcgtgcccttcgccgcgtccggcgacccgccctgcgtgctcgccatggtccaggtgaccttcctcaagtgcggcggcgtggccgtgggcacgggcatgcaccacgtgacgatggacggcgccggcgcgatccagttcatccgggcgtggacggcgctggcgcgcggggaggcccccgcgtggacgccgtcgcacgaccggacgctcctgcgcgcgcggtccccgccgcacgtccccgcctgcgagcacccggtctactccccggcctacctcaacggggcgccgcggcccttcgtgacgcgcgtctacgccgtgccgcccaagctgctggcgggcatccggtcgcgctgcgcgccgggcgcgtccacgtactgcgcggtcacggcgcacctgtggcgcgccatgtgcgtcgcccggggcctcccggcgggcagcgacacgcggctgcgcgtcccggccaacgtccggcagcgcctgcgcccgccgctcccggcgtcctacttcggcaacgccatcgtgcgggacctggtcaccgtgcgggtggccgacgtgctgtcgcagccgctgggcttcgtggcggagcggatcaagcgcgcggtggcccgcgtcgacgacgcccgcgtgcgctccgtcgtcgactacctggagcttgagtcggacaagggcaaccaggcggcgcgcggccagttcatgcccgagtccgacctgtgggtcgtcagctggctcggcatgcccatccacgacgccgacttcggctggggccgccccgggttcgtggcccccgcgcagatgttcggcagcggcacggcgtacgtcacgcagggacgcgacaaggacgaccccatcaacgtgctcttcgcgctcgagccagagtacctgaacaccttcgagaaggccttctacggggagtgaccgtgacccgaccacgaccagccatggcgaggagtctgatgacgataggatgtgattgtgatgccatgccgttgtggcatctcccggggtgtgcacactgttataccatatcatattgcatgtttcggaatgcaattcaatgcttactgggtgtgtgataaggtgcttcattccagctttgtactagtgtcaccaagcacattctgtcctaacatctacgtaaataacggaatgacaaactggaacatgcacggctggaaaaaaaagccatgtagatgtagctgcaaataactgtgtattttatt

SEQ ID NO: 9689 - DNA, 1958 bp, Zea mays
gcatgatctagaagaacaatacaaagaagcaaagtctcccgggcttgaaaaggagtttgtcatatttaatcttctgaaatcagaaaaatcattagtggactgtgcatataaccttcgtgcggagctagaaaatgcagcagcagatgtttctgggctattctccaaaatagagcgcaaagacaggatagaagatgggaacaggtcgatggtgcagagatttaggtctcaactgacccatcagctggatgcattgcataaaactgtatccagttctgtcatgcaacaggaggaccaccttaatgaaatggaacatgatatgcaatcctttgtttcttcaaaagatgaggctgcacaagggctaagagagggtgtgcaaaagctcaaagtcttgcatggttccggtatcactgctctggatgaattagcaggtgaaatcgacatgaactcgcggacaacatttgagagattaaattcacagatacagtcacacacatcagcccttgagaactgtttcggaggaatcgcttcggaagcagataacttgttagatgagcttcagcgcagcctatcgaaacaagaagagaggctagcccatttcgcagtgaagcagagggagggacacctgagagctgtggaagcgtcacgttccatctcaaagatcactgctgggttcttccactcgctagatgtccatgcatctaggctcaccagtattctggaagacacacacagcgtgcaagaccaacaacttcttgaccttgaaaagaaattcgaggagtgcgcagctaatgaagaaaaacagcttctagagaaggtggcggagatgctggcaagttccaacgcacggaagaagaagctggtccaaacagcagtgggcagcctccgggagagcgccgtgaacagaacgagccacctgcagaaagaaatctcgacggcccaggacttgacctcgtccgtgcgcgagaagtggggcttttacatggaagagaccgagaagaattacgctgaggataccaaagcagtcgacagcggaaggtcttgcctggccgaagtgcttgtagaatgcaaggcgaaggccaccgtgggtgcacagcaatggaagaacgcggaggattctctgttcagcctcggcaaaggaaacgtggagtcagtggattctatagtcaggaccgggacagaggccaacgaattgctgcgttccaaactgtcgtctgcggcatcggcaactcttgaagatatcgacgttgcaaacgaggctctcctttcttcaattgacagctcgctgaagcttgaccgcgacgcgtgcgcgaacatcggggcggtcctcacgccgtgccacggggagatgagggagctgaagggggagcatcaccacaaggtcgtggagatcagcgaaagcgccgggaagtgcctggaggaagagtatctggtggacgagccgtcgtgttcgacgcccaggagaaggcggatcgacctgccgggcgtggagtcgatagaggagctgcggaccccgggctacgccgagcttctcaagtcgttccgggaggcgagggggagctggaagctggcgaatggagacgtcacagggcatttgccagaggcggctcaggatccggcatcatcgccgccgccggccgtgggttcaagaacccctctcgtaggaagaaactagatttaccgaaaccatgtagaaagaaaaaggaaaaaaaaaggaggaagaagaggaaggcatgtgtctactagagtacctttttcgtattggtgttgatagtggtgttggttaactactgctgctgcttggttgattgtttgttcgttcttaggtggtctccttgtatagtgattagtgagtcatatatacttgccgtcacacatatgccggtgtacatcaggtgtgctcagcatgtctattctaaagcactagtgtttgtctctctctaggaaccaaacaacaaaaa

SEQ ID NO: 9690 - DNA, 2654 bp, Zea mays
attgggcaccgcgacccccgccggcccgggtcccgattaaaatatactcccaaagaattcggcagcgccgaatgaagaattaaaaagcccccctaaaactgcagaaaaccagggaaacccgagaaaatcgagtatactgaagccatcgagagcagctttcttgcaactcccatggccctataaggcagagagagatagagcaagcgagcggggagaagagattgagcattgctggtggccctgtgctttgagagaggagagaggacttgaggaataggcaggaggctttgtggtggagcaatggcgacagcggcctgggccgcatggctgctcatcctcacgtgcttcggcgcttggaccccgcggcaaatcttggttgctgcagccaccgacgcgaatgatgttactgccctcaacacgctgtttaccagcatgaattcgccgggacagctgcagggctggaaggtgagtggtggcgacccatgcggcgaatcgtggcagggcatcacttgctctgggtcctctgttactgcaattaaattgccgaacttgggcctctcgggaaatctggcctacaacatgaacaccatggattcattagttgagctagacatgagccacaacaatctcggtggtggccaacagattccatacaatcttccaaataagaagcttgaaagactcaatctggcagaaaaccagttctctggatctgtgccatactcaatttcaacgatgcctaatattaagtacctaaaccttaatcataaccagctatcaggagatatcacggacatattttccaacctcccaagtttaaccacagtagacctttcctccaattctcttactggcaatctaccacaaagtttcacttctttgtcaagcctgaaaacactgtatttgcagaacaatcaacttactggttcaatcaatgtacttgcaaatcttccccttgatgatctgaatgttgcaaacaaccgcttcactggttggattcctgaggagttaaagaagataaatagtctgcaaactgacggcaactcttggagcacaggctcagcaccaccaccaccaccatttacagctcctccacgttcgcgcaaccgtcgaaagagcccaggccagcactccaatggaagtaacaactcgagttcaggtggaagctctagcataggtgctggagccatagcaggcattatcatatctgttcttgttgttggagcacttgttgcattcttcctgataaagagaaataaaagaaaaagtgcaatgccagaacactatgaacaacgccagcctttcaattcgttcccttcaaatgaagttaaaaatatgaagccaattgaagaggctaccactgtagaggtggagtctttgccttctcctgctgcagttaacctgaaaccacctcccaagattgagcggaatcaatcatttgatgatgatgattttgcaaacaagcctgttgccatgaaaagtaatgcagcagcagcaccagttaaggcaactgtttattcagttgctgacctacagatggcaacagatagcttcaacatggacaaccttattggagagggtactttaggacgtgtgtacaaggcacaatttagtgatggaaaggttctagctgtgaagaaattaaacagtacaacactgccaaggcaatcatcagatgatttctatgagctggtgtcgaacatttcgaaattgcaccatcccaatctcagtgagcttgtgggctactgcatggagcacggacagcacttgcttgtttatgatttccacaggaatggttcactgcatgatatgctccatctctcagatgattataacaaaccacttagttggaattctcgtgttaagattgcgttgggctctgcacgtgcactagagcatcttcatgaaatttgttctccatctataattcacaagaactttaagtcgtccaatattttactggacaccgagctcaatcctcacatttctgatgctggacattcaagttttgttccagatgctgaattccaggcttcagatcaggggtctgggtatagtgcccctgaggtcgagatgtccggtcagtataccctcaagagtgatgtctacagctttggggtcgtcatgctggaactcttgacaggccgtaaaccatttgacagttctaggccccggtcagagcaatcacttgtccggtgggcaactccccagctgcatgacattgacgccttggaccagatggttgatccggcgctcaagggtctttaccccgccaaatccctttcccgttttgcggatgttattgctctgtgtgtccagcctgagccagagttcagacctccaatgtctgaggtggtgcaagcgctggtgcggctcgttcagagggccaacatgaccaggagaatgctagatggcgaggaggcttctcggcggccggatgaccaggaacaggaattcgtctaacaagctactgaaacaatatacacatcatgtgctgtacctgcaccatcttaatgttgtgactgttgataaaacagggaaaacagctttgtcgacttccattcagtatatattacaggttttatttcatataacgaaatatatatgttattttttagataatgggaattgaaagtttctggcctttgtttcac

SEQ ID NO: 9691 - DNA, 1549 bp, Zea mays
ccggccgggagcccccgccccccagcctccttccccccccccactccaagcatgcagccccgctcggcttccgttgccaggctgccacgccgtcgccgtctcgccgcctaaaacctccctcccccccctcgcaccactccgctcacctctcttcacgccgccgtagccggcgagtagcagcgggtacgtgcctttgcggtgtaccttattggctgagccttccctttgccgaggaagagcacagaagcagggaggtcggcatggcggaggtgcatctaggtctgccaggtccctgggcggcggattacagggagatggccgaccactacaccactaagatcggtggagtccctgattggccaactggtgatatgggcttcaagcccgagactcttcagtgcagcttatgtgggaccaagctttgtcttgttgctcaggtacatgcgcctgtggcaaagctaaacattgaggagaggataatctatgtgcttgtttgcccgacaccagaatgtggacctaaacctcaaagttggaaggttctaagagttcaaaaatgccataatgttatgcaaacagaaggtggtggtgatgaattaggtcaaccgaatggaccttcttctacaagtcttccagaagaacagaatgataaaaataaaattcctgagacaaatgatgacgattttgatctagatgccttagccgaagcacttgaacaagctgcaactttggcatcaaactcaaagaagaagaacaaatcgaagcatgctaatgctcctgtaaaacgtcctgtattgaaggagcaagcatgtgatctgagcatacctgtccttccttgtttttacatacattataataaggaactatatgggggcaaaggcgctgtgggttcaagtagcagtgagttggttttggacaaagaaatcatggatgccgcaaatgacgaagaagaaaaatgggaaggagaaaagtatgagtacgatagagctattggtgctgacagaacttttttaaaattcaagaaacggctggatgcatatccccagcaatgctttaggtattcttatggtggcaagccactgttggctacaacaaaattacaagatcctggcacctgtaggctgtgtggttcaccacgccagtatgaactgcaattgatgtctcctttatcatactttctccatgaagctggagacggttcctcaaattatgcacccagcagctggacttggctgactgttataatatacacctgccccaagagctgctgcccgtcctcatgcggtggaaagccccagagctgttgttggggagcagcggaggaggagatcctgattcaggaggatgaagtcctttaggatctaaccagtgctggttgagaaactattcccgatttgaacatgtaatatgcagtttttttttgttctccaatggttagagttgtaaagctatctgaaattttgaagtgtgttttgttattgtgccctggtatactgcagaactgtcatacttcacacagtatcatatcagactagtaagatttttttttcga

SEQ ID NO: 9692 - DNA, 1447 bp, Zea mays
  misc_feature (1343)..(1343): n is a, c, g, or t
agctctaggggagtgctcctcctcctcctcctcctcctcctcgctccttcccctaccctccccgcgcgcagatcccgacgcgggacgcctgcattcccttgcgcgggacgcgacaactccacgctacacagttcacacgccaagcgagggccgcatctagatccgcgccgccgagctgacttgactattgcaagtttgcaacccaccgccacgccttcttctccccccgcgatctacccggcccgggcgccgttgctgctactgctattactaatactactaccgcgtcgtagcggaggcagggacttgaggagcgggtgggttgcgatggccgctgcggggaggaatgcgggcgtcctcgcgctcttcgacgtcgacggcaccctcacagcgccgcgcaagggggtgacgccagagatgctagagttcatgaagcagctgcgccagcatgtgacagtgggcgtggttggcggatccgatctggtgaagattaccgagcagctcggcagtacagttattactgattatgattacgtcttctccgaaaacggcctggttgcacacaaaaatggccaactaattggaacccaaagtttgaaatcatttatcggagaagacaagctgaaggaatttattaacttcactcttcattacattgctgacttggatatcccaattaaaaggggtacattcatagagttccgaagtggaatgattaatgtatctcctataggaagaaactgtagccaagaagaacgtgatgaatttgagaagtacgataaggtgcataacatccgacctaaaatggtgtcagtgcttcgtgaaaagtttgcacacatgaacttgacattttctatcggagggcagattagttttgatgtatttccccaaggttgggccaaaacttattgcttgagatatcttgaggaatttcaagaaatccatttctttggggataagacctacaagggtggcaatgactatgagatatttgaatctgaaagaacagttggtcatacagttaccagccccagtgacacagctcagcaatgcagatctctctttttgtcgaagtgatctccagcttatttccaacacatatttattaagtcatctttgactgaatgccttttggtatttttttcaagacaatacatgccaccattttttctttgaataattggatctataccattaaaagattgcaactttagatatatactattggctccacatatcattgactcatgtgaaccatacatgtaagtgagataacaatgatatatatttaaagttgtaatcctttaatgatactactgctccgtattcacaaattttcaganttacatgtatacaactggcgaaaataaatcagatttacctgtttttactttacgccgtgttaattgagatgcttctgggaaaaaaaaaaaaaaaaaaaaaaaaa

SEQ ID NO: 9693 - DNA, 1826 bp, Zea mays
ccggccggggtccttcccctaccctccccgcgcgcagatcccggcgcgggacgcctgcattcccttgcgcgggacgcgacaactccacgctacacagttcacacgccaagcgagggccgcatctagatccgcgccgccgagctgacttgactattgcaagtttgcaacccaccgccacgccttcttctccccccgcgatctacccggcccgggcgccgttgctgctactgctattactaatactactaccacgtcgtagcggaggcagggacttgaggagcgggtgggttgcgatggccgccgcggggaggaatgcgggcgtcctcgcgctcttcgacgtcgacggcaccctcacagcgccgcgcaagggggtgacgccagagatgctagagttcatgaagcagctgcgccaggtaagaattgagaccactcttcctcttggtcctggtgtatttttttttcgttctatgacgagaaattacatcttcatatttttttgggagcttcaccctttttttaataaaatttgggcgcagcatgtgacagtgggcgtggttggcggatccgatctggtgaagattaccgagcagctcggcagtacagttattactgattatgattacgtcttctccgaaaacggcctggttgcacacaaaaatggccaactaattggaacccaaagtttgaaatcatttatcggagaagacaagctgaaggaatttattaacttcactcttcattatattgctgacttggatatcccaattaaaaggggtacattcatagagttccgaagtggaatgattaatgtatctcctataggaagaaactgtagccaagaagaacgtgatgaatttgagaagtacgataaggtgcataacatccgacctaaaatggtgtcagtgcttcgtgaaaagtttgcacacatgaacttgacattttctatcggagggcagattagttttgatgtatttccccaaggttgggacaaaacttattgcttgagatatcttgaggaatttcaagaaatccatttctttggggataagacctacaagggtggcaatgactatgagatatttgaatctgaaagaacagttggtcatacagttaccagccccagtgacacagctctatgcaataggctgatattcttatgcctgtaaatttgtaatgtcacctaacaaaaatgacatagcttaagtgagatattctaagttcttcttagaaaataaaaataaattggaaaagagagcatcagtgcaaaatcacacgtcagtattcaactggatatgttattaaccttggatcaaacttagacggcaggttcccacaatttaattttagtgttaaacgatacctctttcatcatagtagtagttgcatattacaattgtgactcaccaagtcaccattgctgtcattcccgtactgattccatatcattttgatttgcagttaccagccccagtgacacagctcagcaatgcagatctctctttttgtcgaagtgatctccagcttatttccaacacatatttattaagtcatcttcgaccgaacgccttttggtatttttttcaagacaatacatcgccaccattttttctttgaataattggatctataccattaaaagattgcaactttagatatatactattggctccacatatcattgactcatgtgaaccatacatgtaagtgagataacaatgatatatatttaaagttgtaatcctttaacgatactactgctccgtattcacaaattttcagattacatgtatacaactggcgaaaataaatcagatttacctgttttt

SEQ ID NO: 9694 - DNA, 1415 bp, Zea mays
ccgggatccttctcaactcaatctcacgtggcacgcagtcatcatccagccactccgctccaggctccagctctaggggagtgcctcctcctcctcctcctcctcctcctcgtccttcccctaccctccccgcgcgcagatcccgacgcgggacgcctgcattcccttgcgcgggacgcgacaactccacgctacacagttcacacgccaagcgagggccgcatctagatccgcgccgccgagctgacttgactattgcaaggacttgaggagcgggtgggttgcgatggccgctgcggggaggaatgcgggcgtcctcgcgctcttcgacgtcgacggcaccctcacagcgccgcgcaagggggtgacgccagagatgctagagttcatgaagcagctgcgccagcatgtgacagtgggcgtggttggcggatccgatctggtgaagattaccgagcagctcggcagtacagttattactgattatgattacgtcttctccgaaaacggcctggttgcacacaaaaatggccaactaattggaacccaaagtttgaaatcatttatcggagaagacaagctgaaggaatttattaacttcactcttcattacattgctgacttggatatcccaattaaaaggggtacattcatagagttccgaagtggaatgattaatgtatctcctataggaagaaactgtagccaagaagaacgggatgaatttgagaagtacgataaggtgcataacatccgacctaaaatggtgtcagtgcttcgtgaaaagtttgcacacatgaacttgacattttctatcggagggcagattagttttgatgtatttccccaaggttgggacaaaacttattgcttgagatatcttgaggaatttcaagaaatccatttctttggggataagacctacaagggtggcaatgactatgagatatttgaatctgaaagaacagttggtcatacagttaccagccccagtgacacagctcagcaatgcagatctctctttttgtcgaagtgatctccagcttatttccaacacatatttattaagtcatctttgactgaatgccttttggtatttttttcaagacaatacatgccaccattttttctttgaataattggatctataccattaaaagattgcaactttagatatatactattggctccacatatcattgactcatgtgaaccatacatgtaagtgagataacaatgatatatatttaaagttgtaatcctttaatgatactactgctccgtattcacaaattttcagattacatgtatacaactggcgaaaataaatcagatttacctgtttttactttacgtcgtgttaattgagatgcttcttgggacatgagtgatgtaataaaaatggtaattgtgct

SEQ ID NO: 9695 - DNA, 2356 bp, Zea mays
ccccttgggatattttgtgttttttagctacacatggactgtacgtggaaatgagaatggactttacggagagaggggaaatgagaaagacataacagggaatgatgacaataacagactagctagacgtgtcttgtacgtgagaatgagaatgaactttacggagggagaacatgaaacgcagaaggacagcaaaattccgaaacaacccctcactcagcccgttctcttttcccccattgggtccacgcaggccggccttcgtcttcccgcttccagcgcacccccatcttgagtctcgccgccgcaagcttgtgtaaggtgtaaccctaaccctaaaacacttaccttcgcctccagcaccacgcttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggttccgtggcgtccgtcgtaggccgtgggggcgctgggctgcggagatccgcgacccgcacaaccgccgcagactgtggctcggcaccttcgacaccgctgaggaggctgccaacgcctacgacgctgcgaacatccgcttccgcggtgtcagcgccactaccaacttccctgcggcccgctactcgccccctccaaagccagcgaagcctatcatctcgctgactcctgaacccggaaaggtgatcaccttgccaccggtacctgtgaagccaaccttccctgttcaggtgaaggaagtgggtgggagctggggcggcctggtcaagggagctaggtcggaggtcaaggcgtttgcaccgaagccagtatggaagatgatccccagggtgcaccagaagtttccgggttgtgccgatggctctggcctgcgtgccgtccatgctgcctccatctacgtggaggaggttggcggtggctgatggtccaagtatctgcaattactatcgctagaggttttattgtctatctccatggcatcattataacctggtactgtattattttggttagtgttaaactgttgatgtggaaacctatgactcttgctgtgttatgatcggtggtaatataatgtgtatatggtgacatttggtaataaaaaaaaaaaaaaagagcggcacgaggctgtgctttgattgtgggatcaaacctgtcatatagtagtacaatctagatcctttcacatgaacagtgatacctagatgtatttgatggttatttcagttgaattatttgtctggtgcgtgtgtgtcaggttcacggtatatttgtttggtaattataatatacatgtcctgtcgtatctctgcatgttcatgtaaccatgatgtgattgttcttcttacactcaaatggcttttagaacttttgtttcttggtgtcatgttcggattatacctcgtgttcaatcattacttcctagtagttgcatatttacattaacaaaatgttctgctactctggtctctttttgtttgacatagtttctcttgcattcaatggcttccttgtccatattatcacttgtgttcagtcattacttcctagtatttgcatctttatattaataatgttctgctatttctagcctctcttttttttggcgggtgtctgtaaactcgtagcctctttatttggtagatgtctgtgttacagatttggcagatgtcggataatgttctgctactcctaagtctctttttgttcggtaggtttctgtgttacagatttggcaggtgtctgtgttacggatcacttctgatggttgaatgaataatctgcctaaaccttctatttggtacatgttcactttgtggtatatgaagaatcctaagcaaattgcatcttatgttatggttatttaaatttcagtatatggttgaatgaatgaattatattttacttcttaattgtcattgattcttaattagtatgctatagttcttctcttgagttacccatggagtgtgattcgatttcttatgattcaagcgccgaacagaacagaaacctcagcaggcaaatttctggccagctgagcacgctacagtctgcataatgggttgcgaggcctgacactagcaaagaagaaaatgttgccatgacacaaggtc

SEQ ID NO: 9696 - DNA, 1687 bp, Zea mays
agaagtcggaggaaaaaggagtccctcccaacctcgcatcgctgttcccccaaacccaaatccaaagcaagcacttcgtcggcgggcggcggccgagggcgaccatggggcagggcactccgggagggatgggcaagcagggcggcgctggcgaccgcaagcccggggacggcggcgacaagaaggacaagaagtttgagccgccggccgcgccctcccgcgtcggccgcaagcagcgcaagcagaagggcgccgaggcggccgcgcgcctccccaacgtcgcgccgctctccaagtgccgactccgcctcctcaagctcgagcgggtcaaggactacctcctcatggaggaggagttcgtcgccgcgcaggaacgcctccgtccccaggaagacaaggccgaggaggaccgatccaaggtcgacgacctccgcggcacccccatgagcgtcggatccctcgaggagattatcgacgagagccacgccatcgtctcctcctctgtcggacccgagtactatgtcagcatcctctcctttgtcgacaaggaccagctcgagccgggatgctccatcctcatgcacaataaggttctttctgtagttggtatattgcaagatgaagttgatcctatggtatctgtgatgaaagttgagaaagcacctttggaatcttatgctgacattggtggactagattcccagattcaagaaattaaagaggctgttgagcttcccttgactcatcctgagttgtatgaagacattgggatcaggccacccaagggagtcatattatatggcgaacctggaactggaaaaactctactcgccaaggctgttgccaattcaacatctgcgactttcttgcgtgttgtcggtagtgaacttattcaaaagtaccttggggatggtcccaagctagtcagagaattgtttagggtggctgatgaactttctccctcaatagtcttcattgatgagattgacgcagttggaacgaagaggtatgatgctcattcaggaggggagcgtgagattcaaagaactatgttggagctgctgaatcagctagatggttttgactcacgtggagatgttaaagtcattctagcaacaaaccgcattgaaagtcttgatccagccttgcttcggccaggccgtatagaccggaagattgaatttcctctaccagatattaaaactagacgacgcatcttccagatacacacatcgaaaatgacattagctgatgatgtgaacttggaagagtttgttatgaccaaagacgagttttcgggtgctgatattaaggcaatctgcacagaggctggattgcttgccttaagagaacgcagaatgaaggtgacccatgcagatttcaagaaggcaaaggagaaggtgatgtacaagaagaaggaaggtgttccggatggtctctacatgtagccaatctattcatcatgccgaacaagttacccgattgtgtgtgtactagcacatctcttcatcatgggagatatgttaccacaatacttgttgcatactgtgctaagtggtcaggagaaccttgtattaattaattatcctttcattgtctcaaagtaaaaatttcccttgcgctaaaaatatgcatccgttcagcatcaaaaaaaaaaaaaaaaaaaaaaaaactcgagacctcgtgc

SEQ ID NO: 9697 - DNA, 1725 bp, Zea mays
  misc_feature (1702)..(1702): n is a, c, g, or t
cattgggtaccccaaacctcgcatcgcatttccccgcatccgcagctcacatcgctcccccgaacccgaacccaaatcccaagcaaccacttcgtcgaccatggggcagggcactccgggagggatgggcaagcagggcggcgccggcgaccgcaagccgggggacgccggcgacaagaaggacaagaagttcgagccgccggccgcgccctcccgcgtcggccggaagcagcgcaagcagaagggcgccgaggcggccgcgcgcctccccaacgtcgcgccgctctccaagtgccgactccgcctcctcaagctcgaccgggtcaaggactacctcctcatggaggaggagttcgtcgccgctcaggagcgcctccgcccccaggaggacaaggccgaggaggaccgatccaaggtcgacgacctccgaggcacccccatgagcgtcggatccctcgaggagatcatcgacgagagccacgccatcgtctcctcctccgtcggacccgagtactatgtcggcatcctctccttcgttgacaaggaccagctcgagccggggtgctccatcctcatgcacaacaaggttctctctgtggttggtatattgcaagatgaagttgatcctatggtatctgtgatgaaagttgagaaagcgcctttggaatcttatgctgacattggtggactggatgctcagattcaagaaattaaagaggcagttgagcttcccttgactcaccctgagctgtatgaagacattggtattaggcctcccaagggagtcatattatatggagaacctggaacaggaaaaactcttcttgccaaggctgtggctaactcaacatctgcgactttcttgcgtgttgttggtagtgaactcattcaaaagtaccttggggatggtcccaaactagtccgagaattgtttagggtggctgatgaactttctccctcaattgtctttattgatgagattgacgctgttggaacaaagaggtatgatgctcattcaggaggagagcgtgagattcaaagaactatgttggagctgctgaatcagctagatggttttgactcgcgtggagatgttaaagttattctagcaacaaaccgcattgaaagtcttgatcctgctttgcttcggccaggccgtatagaccggaagattgaattccctctcccagatattaaaactagaagacgcatcttccagattcacacatcaaaaatgacattagctgacgatgtgaacttggaagagtttgttatgaccaaagatgagttctcgggcgctgatattaaggccatctgcacggaggctggattgctcgccttaagagaacgtagaatgaaagtgacccatgcagatttcaagaaagcaaaggagaaggtgatgtacaagaagaaggaaggtgttccggatggtctctacatgtagtagacgtctcctgccttgtcagaacaagttatcctcgtctctctcgtcatgggagatttgattgccacggcacttgttgcacacctataagtggtctgagaacgtgtattatgctttgattgtttcaagtaaaatttctcttggagaacgctggaaagtttgtgcatcggctacctaccagcatcctcgtaaacacccattaatcagtttgtgcatcggctgcctcacacgtgttggctgctcaatcccatggatganaataaaataaaaaaaaaaaaaaa

SEQ ID NO: 9698 - DNA, 1541 bp, Zea mays
acataggtgccggactcgtcccagcgaagaaccggacgagcgagcaagaggcctcctcctcaagcttcgaatcctccccttccgcgctttccctccccctcctcctcctcccctttccagtccccaccccagcgaagcttccaaagccgccccaaccccaacggccgcccggcctgatcgagcatacagctgccgcggccctccccgccccgcacgcgacctcggagccatggagaagtacgagctgctgaaggacatcggcgccggcaacttcggcgtggcgcggctcatgcggaacaaggagaccaaggaggctggtcgccatgaagtacatcccccggggccaaaagatcgacgagaatgtggcgagggagatcatcaaccaccgctcgctgcgccaccccaacatcatccggttcaaggaggtggtgctgacgccgacgcacctggcgatcgtgatggagtacgccgccggcggcgagctgttcgaccggatctgcaacgccgggaggttcagcgaggacgaggcgaggtacttcttccagcagctgatttgtggcgtcagctactgccactccatgcaaatctgccaccgagacttgaagctggagaacacgctgctggacggcagcccggcgcctcgcctcaagatctgcgacttcggttactccaagtcgtcgctgctgcactcgaagcccaagtcgacggtcggcacgccggcgtacatcgcccccgaggtgctctcccgccgggaatacgacggcaagacagccgatgtgtggtcctgtggagtcactctttatgtgatgctggtcggtggttacccttttgaggacccagacgacccaaagaatttcagaaagacgatcgggaggatcatgtcaatccaatacaaaataccagagtatgtgcacgtgtcgcaagactgcaaggagctgctttcaaggatctttgttgcaaactctgcaaagagaataacgatcagggagatcaggaaccacccctggttcctgaagaacctgcccagagagctcacggaggctgcgcaggccatgtactacaagaaagacaacagcgccccgacctactccgtccagtccgtggaggagatcatgaagatcgtggagaaggcgcggacgccgcctccttcctccacccctgtggctggcttcggttgggcggaggaggacgagcaggaggacagcaaggaaccagacgaggaacacgaggacggcgaggacgagtacgagaagcaggtgaagcaagtccacgccagcggggagtttcatctcagctgctgagggttttcgccggcctgctagtctgtggtaccagccgatgatggacctgctagtctgtggtcttgtttccaagttttctttcattttttctttcttttgctgtggtgccgcaagactgcaacagttgtaaattattgaagggggttccagcgttgcccttgtattgactgattcaaactagcatggggaacatgattatggaataaaacaggtcgttgagcaagctcccgttgtaactgc

SEQ ID NO: 9699 - DNA, 5183 bp, Zea mays
  misc_feature (1417)..(1417): n is a, c, g, or t
  misc_feature (2054)..(2054): n is a, c, g, or t
  misc_feature (2085)..(2085): n is a, c, g, or t
tcttaactttgggggggggggggggtacttttttacattactgtttcactattcactcattatctaatgatactcctctgtacctgtaggagctactacaagtgcacgtttgctggatgcaatgttaggaagcacattgagaggtgttcatcagaccctaaggctgtcataacaacctatgaaggaaaacataaccatgaaccaccggttggtcggggcggcaaccagaacgcaggaatgtcatcacaacagaaagggcagaacaacgtatccagcaatcaagcttcattctcgagaccagacttgagcaccgctaaccagatgccaattggaatcttacagttcaagagcgagcaatagtaacatgtatttggatgacgttcttttggcaaatacaagatgcctgcaattcgtacagccatatggcatcaaaagtttcttaaagcctgataatttcaaatggtatcagtttgcagtttttccccgtagatacacaggatatatagctgatacggcctcatcgtttctagtttgtacatgctattaagttggggcatgagggatgcaatactagctaggtgaggttacttatatgtggttatggtgttctatagatggatcgatggtatacatgttctgattttgttcccaacacccgacaagattttgtatgtatttgtacagatgtttttgagttacattttgccttttgtaactttgaagatgttctagtttgctatgtcatttccttttttttctcattctttccaaaattggtttgcttagttttctatgagctattatcaagaatactaataaagtattggaactttgtttttttttttgggggggtggaggagggatttgtaactcgctgtctacctacaagaacagtgattcatgtgggtaggctccaaagctgtcttagatagacaattggcatgcctgctccatcattacattaggctgtatgcagcagtttatatggtagactgtactatttggaaagtggagttttatatgaggtacaatagtttttttttctctcaactctgtcacttcatctgtttcgggcctaacgacagtacgtgtttattacaaaatgcaaaaagttcccggcctctacgggccgtgcacacagccaaaataaatatatatcatactatgcactcaagcatattttattatttccattcttatgtcatggacactattacgtcactgtcatgatcagctagaatgtcatgatctaatgttgctgcatctgctccggatctcaggtacactattaggttggttgagcacaaacttttccaaggagagaaatatcatcatgaatgattttcagggtgagatttgacagggacatttgatcctaacggtgagcagtgccttatcctttttttttattcctctntgttagaggtttcctgaaccacacttgaagccaaagtcacgtttggctgaatgcttctgtcctgatatgatagcatcacctaagcagggctggatttcgtaacctatgtccggagctgaggtgcagtcatgcttaagtaaataaaccctggagtgatttatttaaactgattctctaaatccaacttttgaaatgtcaataatattctgacctcttataaaacagcgggccgtcttagacttctgaataatgttgggtggccaatagtttttatctcttgtggtatgcacatcagtttctttgagcaaattgtgttctgctttagcattctttgctaccggtttcgacgcattacgaatgtttggagctagtttggtaactctatttttttaagatattctcattttttcaagagacaaatgatctaacttttttaggaaaataaaaaatcctttaaaaaaatagtgttgccagactaacccttacaaaggtcattttgacaacaagattttatctccaagtttccaaaaccgccacatcaattttaaagacttaggatcgattgaaatacgctagagctaatagttagctactaaacgcccccatctaatagtccaactaactattagacgcagcntcaactacccattagtttattacctggtttnaacctcgctaaaatcagccaatagttagccagctaattttactaaaaaaattaaccatcaaattgttaatgcattcaaatggccccctagattaagaaataaaactctctctctctctcagtggagggttttgttgcacaggtttatagacaacctgcaacaatgcagttgtatgcgtattgtttgtggtcctatatatatgcgacataaactatgcagtcgtttgaaatataattaaactgaacatcactgctttactaactacattataaatcccatgtctataaataatcatggtacaataaaatatattaactaatccaacattcatgtgtacgggtacacatataatagaaatgattacgtatatagtatatgtcggaggggttcatatatacgtgtgcgcttgttttcacactagatatatcgaattcccatgcttacaaggatccacacaagcatcgaattaaataagggccatgcatgactaagataaaaataaaagataattgaagaccaaggaatccaagtgcacacaagcatcacacaggttcactagactgaatctcagtggagctttagttcgatcctgacggaggtccgttcgaaactctgtcgcttttctcatgtaaatttgcactaattaggccccgtttggtttgaacgactaaagattagtatctccattttagtctcattaagtccctaaattgataaacggtaggactaaaacagagattaaactgttttagtctatagtccctcaagctgtgactaaaagagaataggtcatataaatgtcactttttgtcactttttattttagttgcactaatgacgggagaatgataagagatattttagttctcttatgattcatttaatgtgtctagaatcaattagggtagagactaaactaagaagcctaggaaacagaacaaaacagcaaaaaacacaataatagcttaactgaaagccagagaatttgtactcatctcccgttgggtcgtactcctacacaccaaaaagccgatcaacttgaccatgccctagcttttcctgctcccagttattattaacactgctgcctatactcccccatgcctctactctactggatcaaagttgttgtaacattgtggtactgggaatctgtgcacacatatttcctagatctagatcggatttggagtccttgttccggtggctatccgccatccttagctgttcagactgctacagttataatctataaagataaaataatataaagataaaatagtatagaaacaacatccgaattaccgcaacaaacaataatacccatagaaaaggctggcgcaaaatcgttgagattttcaccactcgctgacttgcccaacactacagtagcatgtgctcttctcctttgctttggaatcaaggaaagtggtggggctcaggatctcatcgacatggctacttatcttgggggtgatggcatgtcagggtgtgtgggggatcttatccaccacatatattcacatcatgcataaatataggatgtatgcttgcatatgaaatgcacagcgtgtttttaaggatactatggtcctggtatttatggtggaaagctgcagacacttgtgctgtacgtacttactaattattatttacaaattaactgtccccagaagcagccattaataacccttatattagatgaagaagagaagaagaaaaaaaggacaaaaccaaaaaacatgacgaggaccacaaaagcatgcctgcagaaatcagagactcaagtcctcctgcctgtggcttccgccacccagctccagctccagctccaactccaagaggtggcaagaacggctggccttgcagctccggtagaccatggtggtgacgacggtgtccaggacacaaaccatggcgtggatgtaggcgacgagcagcccctcccagagcatccccggtgtgaccctgccggtagccgcgtacggccgcatgaccctgagctggaacagcgcctcgacggcggcggcggcgaggctggccggcagggacgcggccacggcggtggcggcgtcgccggaccggagcagcatgaggaccgccttgagcacggcgtgcgcgccgccgcggccctcggcggccgccaccaccgtggccaggttgcacgcggcggacgcgttggccagcgcgacggagtacacgatcacgccggccgccgacagcgccagcacggccctgccgctgccgctgccggggctggaggtggaggtgggttggggagcggcgcccagcaggtgcatcgcctcggcggcgttgaacgcggcgagcagcgcggagaacacggcggcgttggcgagcagcagcgcgaggcagttggcgagctgcgtgcacgccatcgccgggtacgacgagcgcaggagctgagcgaacgtgccgctctcgttccggcggcggcagcattgggtggcgtgcggtggtggcggcgagcagtcgcagcagcggtgcacggcgcaggccttggccaggagcaggaaggagagcgcgaagggcgcggcggcgagggacgcgcaggcgcgctgcgacaggcggtggctgagcaggaagagcagctgcgacgccggcgggaagcccgcggccacgagcgcccggcgcaggcgccgcgaaagcaggtgcgacgcgcccagcaccgccgggtgcgtccgcgacagcagcgccgcggcggagaatggcagcgccagcagcgacgccgccgggtggtagtgccggatgaaggcgtgcagcgccgcgcggaccatcttgccggcgccgcccatcatcatcatccccaccccactgcagtgctcactgtgttgcttcgatggtgttgctagctcactcttgatcgatcttggggtttgttgtttcgttgatgatccttataactagtgcgtgggtgtgtagtagtagtagtgtgtgtcaattcctcacttgctcctcaaatccaatacagacctgtttttgttggtgcgggtcggggtgttttaatttctgttttttttagaaaggtttgggtttgggttttgctttgctttgctttaggtagagcaagtaaaaaaaag

SEQ ID NO: 9700 - DNA, 2003 bp, Zea mays
caaaccctccaagcccgccggcggaaaccaagaagaaggcaagaagcagaggggaattctttctctcccttcctatctctctccctctctctattgcaattgcatcccgcgaccatgtccgcgcgtccgccgcctcaaccgcgcccgcgcctggcgctgccgccgcgctcgacggcggaatcgctcttcacgggcgccggggacaccagccccggcccgctcacgctcgcctcagcgctcttcccctctgacgccgacggcggcggtggccccggaggcgcgtcctcctccgccgccggggccgcgaccttcacgcagctcctcaccggctcccttgcgcctcctcctccgcagcagcagcggcatgacgcggagaggggacgaggcggcggggtcgccagggccgggccggcgctctcggtggcgccgccggcatcggcgtccgctggcgcgtccgtgttcacggtgccgcccggcctcagcccctccggtttgttcgactcccctgggctgctcttctcgcccgccatgggcgggtttggaatgtcgcaccagcaggctctggctcaagttacagcccaagcaacccattctccactcagaatgtttgatcaccttgaacagccatctttctccacagctgcaacaacgtctggagctctacagcacatgaattctgcagccagtatggcaggaatttcagatatgacaatggcaacagcaaacaatgagaacccgtcctttcagtctgctgaggcgtctcagaggtatcaagttaatgcccctgttgataagcctgctgatgatggctataactggcggaaatatggtcagaaggtggtaaagggcagtgattgtccaaggagctattacaaatgcacccatcccaattgtcctgtcaagaaaaaggtagagcatgcagaagatggtcagatatctgagatcatatacaaaggcaaacacaatcaccaacgtccaccaaataagcgggcaaaagacggcaactcttcagcatttgatcaaaatgaacaatctaatgataccacatctggcttgtcaggtgccaagagagatcaggacaatatatacgggatgtctgagcaagcatatggtttaagtgatggagatgatatggatgatggtgaatcaaggccacacgaagtggatgacgctgataatgagagtaaaagaaggaatatacaaatttcttcacaaaggaccttgtcagagcctaagatcattgtgcaaacaaccagtgaggttgatcttctggatgatggttatagatggcgcaagtatgggcagaaggtagtcaaagggaatccacatccaaggagctactacaagtgcacgtttgctggatgcaatgttaggaagcacattgagaggtgttcatcagaccctaaggctgtcataacaacctatgaaggaaaacataaccatgaaccaccggttggtcggggcggcaaccagaacgcaggaatgtcatcacaacagaaagggcagaacaacgtatccagcaatcaagcttcattctcgagaccagacttcgccaacccgatcccgatgccaattgggatcttacagttcaagagcgagcaatagtaacatgtatttggatgacgttcttttggcaaatacaggatgcctgcaattcgtacagccatatggcatcaaaagtttcttaaagcctgataatttcaaatgatttcagttttttcccgtacatacacaatacacaggatatatagctgatacggcctcatcgtttctagtttgtacatgctattaagttggggcatgagggatgcaatactagctaggtgaggttacttatatgtggttatggtgttccacccccccccccatggtatacatgttctgattttgttcccaacacccgacaagattttgtatgtatttggacagatgtttttgagttacattttgccttttgtaactttgaagatgttctagtttgctatgtcatttccttttttttc

SEQ ID NO: 9701 - DNA, 1044 bp, Zea mays
ccggccgggaaagtgctcaagctcgccccccgcggccgcccgcgcgttctagcttttaactttctcaggacacgggagcccttcttgccacaaaagttttagttccaactgggagagctagcatggcaagttcgcgctgctttgagaacccgccggtgctggagccggccagcggaggaggcgaggtggttgacgacttcggcgggcagaaggcctacgtcagcggctccgccgggtccaaggccgccgtcgtcctcatctccgacgccttcgggttcgaagcgccaaacctgaggaagatagccgacaaagttgcttcgctcggttacttcgttgtggtgcccgatttcctgcatggggatccatatgaccccagcaataatgcccatagcaatcctggaacgtggatacagtcgcacaatccgcaaacggcattcgaagaggcaaaaccggtaattgcggctataaaggagaagggtgtgtcgagcatcggagctgcaggttactgttggggcgcaaaggtggttgtggaactggcgaaagttcacgagatccaggctgctgtgttggcacacccttctttactaactgtcgatgatatgaaagatgtcaagtgccccatttccatacttggagctgaaatcgacaggtcagccccgcctgaattgctaaagcagtttgagcaagttctttcagcgaaccccgaggtcgatcactttgtcaaggtttttcctggcgtagcgcatggatgggctgtgaggtacagcgacgacgacgcagcggctgtcacgagtgcggaggaagctttgcgcgacatgagccactggttcaacaagtacctgaactgaattatgtggcggcatatgtgcgtgcaataagctcctaatggtgaacattatgcagggcccccatgctatgcgtgtgttttaaaagtcctcttagtggtggtatttgtactggtctcttacgcaatttttataacatttatcgagaataaagtgatgacacggtgaaaaaaaaaaaaaaacaaaaaaaaaaaaaaaa

SEQ ID NO: 9702 - DNA, 1684 bp, Zea mays
cctcgaggccggccaggatccactgtgggtcccgaggggccggcgggcgcggtgtccaccactccctcctcctctcctctcccgtcctatccatccggcacgcccagcatccatccactcctcccctgctccggctccggctccggctccgccatgggcctttcaacagtttactccccggccggaccgcgcctcgtgccggcccctctcggccgctgccgctctgcccagccccgccgcccgcgccgagccccgctcgccaccgtccggtgctccgtcgacgccaccaagcaggcgcaggatggcgtggcgacggcggtcgcgacggaggcgccggcgtcgcggaaggagtgcttcggggtcttctgcaccacctacgacctcaaggcggaggacaagaccaagtcgtggaagaagctagtgaatgttgctgtgtcaggcgcggccgggatgatatcaaatcacctgctgttcaaactcgcttctggtgaggttttcggacaagaccaaccaatagcacttaagctactcggctcagaaagatcgtttcaagccctcgaaggtgtagctatggaactggaggactcgctgtatccactgctgagggaagtcagcattggcatagatccttacgtagtctttcaagatgtagattgggcccttcttattggcgctaagccccgaggtcccggcatggagcgagctgcgctactggatatcaatggccaaatctttgctgaccaggggaaagcacttaatgcggtcgcctcgcggaacgcgaaagtcttagttgttggaaatccctgtaacactaatgcgctgatttgtttgaaaaatgccccaaacataccggcaaaaaactttcatgcattgacgaggttggatgaaaatagagcaaagtgccagctggcactaaaagcaggtgtattttatgacaaagtatcaaacgtgactatttgggggaaccattcgacgactcaggttcctgatttcttgaatgccaaaattgatggaagaccagtgaaagaagtcattaaggataccaagtggttagaggaagagttcaccctcacagttcaaaagcgtggaggtgtgctcatccaaaaatggggcagatcatcagctgcatcgaccgctgtttcgatagtggatgctattagatccctcgtaactcctaccccagaaggtgactggttttctacaggggtttatacgactggaaatccttatggcatagcagaggatatcgtgttcagcatgccatgcagatcgaagggtgatggtgattacgaactagctagtgatgtgttgatggacgattttctctgggaacggattaaaaagagcgaagctgaattgcttgctgagaagaaatgcgttgcccatcttacaggagaggggaatgcattctgtgatcttccggaagataccatgctaccaggagaagtgtagtttagttacagaagcaacagcagcggaatgcatttgccaatacattagctgagacttgaaacatctgcttgccagatgcagcaactacttttatatatatatgtgtatattcaataattgtgccacacgaatttgactatgatgcaaacctcttacacaggtaagtcttttttttttccgtaaatacgagaaagactgcttcaaataaaaaaaaaaaaaaaaaaccggccaa

SEQ ID NO: 9703 - DNA, 1227 bp, Zea mays
  misc_feature (924)..(924): n is a, c, g, or t
  misc_feature (944)..(944): n is a, c, g, or t
  misc_feature (957)..(957): n is a, c, g, or t
  misc_feature (972)..(972): n is a, c, g, or t
  misc_feature (980)..(980): n is a, c, g, or t
  misc_feature (982)..(982): n is a, c, g, or t
  misc_feature (993)..(993): n is a, c, g, or t
  misc_feature (1005)..(1005): n is a, c, g, or t
  misc_feature (1010)..(1010): n is a, c, g, or t
  misc_feature (1023)..(1023): n is a, c, g, or t
  misc_feature (1025)..(1025): n is a, c, g, or t
  misc_feature (1033)..(1033): n is a, c, g, or t
  misc_feature (1037)..(1037): n is a, c, g, or t
  misc_feature (1047)..(1048): n is a, c, g, or t
  misc_feature (1053)..(1055): n is a, c, g, or t
  misc_feature (1062)..(1063): n is a, c, g, or t
  misc_feature (1067)..(1067): n is a, c, g, or t
  misc_feature (1070)..(1070): n is a, c, g, or t
  misc_feature (1072)..(1072): n is a, c, g, or t
  misc_feature (1075)..(1075): n is a, c, g, or t
  misc_feature (1077)..(1077): n is a, c, g, or t
  misc_feature (1082)..(1082): n is a, c, g, or t
  misc_feature (1086)..(1086): n is a, c, g, or t
  misc_feature (1093)..(1093): n is a, c, g, or t
  misc_feature (1096)..(1096): n is a, c, g, or t
  misc_feature (1100)..(1100): n is a, c, g, or t
  misc_feature (1117)..(1117): n is a, c, g, or t
  misc_feature (1122)..(1122): n is a, c, g, or t
  misc_feature (1125)..(1126): n is a, c, g, or t
  misc_feature (1129)..(1129): n is a, c, g, or t
  misc_feature (1145)..(1147): n is a, c, g, or t
  misc_feature (1154)..(1154): n is a, c, g, or t
  misc_feature (1156)..(1156): n is a, c, g, or t
  misc_feature (1160)..(1160): n is a, c, g, or t
  misc_feature (1166)..(1167): n is a, c, g, or t
  misc_feature (1170)..(1170): n is a, c, g, or t
  misc_feature (1173)..(1173): n is a, c, g, or t
  misc_feature (1179)..(1179): n is a, c, g, or t
  misc_feature (1185)..(1185): n is a, c, g, or t
  misc_feature (1187)..(1187): n is a, c, g, or t
  misc_feature (1192)..(1192): n is a, c, g, or t
  misc_feature (1196)..(1196): n is a, c, g, or t
  misc_feature (1207)..(1207): n is a, c, g, or t
  misc_feature (1216)..(1216): n is a, c, g, or t
  misc_feature (1220)..(1220): n is a, c, g, or t
  misc_feature (1223)..(1223): n is a, c, g, or t
  misc_feature (1225)..(1225): n is a, c, g, or t
cctcgaggccggccgggataagttatatttctctggctggcgacggagccggcggcgcggtgtccaccactccctcctctcctctcccgtcctatccatccggcacgcccagcatccatccactcctcccctgctccggctccggctccgccatgggcctttcaacagtttactccccggccggaccgcgcctcgtgccggcccctctcggccgctgccgctctgcccagccccgccgcccgcgccgagccccgctcgccaccgtccggtgctccgtcgacgccaccaagcaggcgcaggatggcgtggcgacggcggtcgcgacggaggcgccagcgtcgcggaaggagtgcttcggggtcttctgcaccacctacgacctcaaggcggaggacaagaccaagtcgtggaagaagctagtgaatgttgctgtgtcaggcgcggccgggatgatatcaaatcacctgctgttcaaactcgcttctggtgaggttttcggacaagaccaaccaatagcacttaagctactcggctcagaaagatcgtttcaagccctcgaaggtgtagctatggaactggaggactcgctgtatccactgctgagggaagtcagcattggcatagatccttacgtggtctttcaggatgtagattgggcccttcttattggcgctaagccccgaggtcccggcatggagcgagctgcgctactggatatcaatggccagatctttgctgaccaggggaaagcacttaatgcggtcgcctcgcggaacgcgaaagtcttagttgttggaaatccctgtaacactaatgcgctgatttgtttgaaaaatgccccaaacataccggcaaaaaactttcatgcattgacgaaggttggatgaaaatagagcaaagtgccagctggcactaaaagcaggngtattttatgacaaagtatnaaacgtgactatntgggggaaccattcnacgactcnantttctgacttnttgaatgccaanatcgntggaataccattngnaataagtnattnatgataccanntggtnnnaggaacnntttnacnanttncnttttntaancgttttnagntttncttatttcaactaatgncggtnatnntcnctttttccggtttttnnntccgtgngncganaaattnngcncgntattcntctttntnaagtncatntgtctttcgtnttttctttngtcncgngntg

SEQ ID NO: 9704 - DNA, 5391 bp, Zea mays
  misc_feature (2193)..(2193): n is a, c, g, or t
cctagctccatctcagcatttcggatccccgaagaacaaacaaactgccgccaaaggtttctgccaccggttcttcgatgctgcccgagagtttccaatttcatgcgttttcctttcctcttttaccgaaacaaaccaaaaaaaaagcttttacttcgtggaggttccgtgagattactccggttccatgaatttcgatttcctgtctactatgtatgttatgttcttcttgccgtggatggaattcttctcttcttttcatgcccgccctgttggtactaattagtaattagataacccccgaactcgaacgtctctttctctcctcaaatcagataaccgaacttgctgtttgacgctaacatccagctgcgccttgatctcctccagatgagcgccaccatggcgtggtatccattaccgcagagcggaggcacaggcacgccgtcgggcggcggcgagctgttggacgaccagagcggcggctgggcgctctggagcttcggctcagctgacgacgaccacggcgctggcgtggtgcgcgcggagacgcacgggagttcagacgagcggacggaggagggccggcccgcgccgccgcagcagcagcagcaggcaacagacgacatcttcatgtacgcacgctcgcgacgcatgctactctcggcgctctgttctgttctgccatcgctgctcctcatccatccatccatccatccatccacgcaggagccagttctcggacgaggaggtgaggaagatggacgacgccccgttcgaggcgctgggcatgttcccggactccatgcaccagctgctgtcctacgagaacatgctgagcggcggggcgctgctgagctgctgcagctcggaggacctgctcctgaacgccacgctgggcgtggacgccatggacacctgcggcttccctctcttcagccacgacctgcagctgcagagcgcggcgccggatctcacgctcacgcctgaggaccaggtactggtttgcgcaagtgacgtgtggtgctgctctcgactcgatcacgcacggcactgctctgatgagccgagccctgggtgttcgttccgttggtgccaggatggggcgagctttgctgcgacgaaaaggagcaggtcatccgtcgcggatgaagggggcttcctcttccaagcgctggtgctccgggagctcgaggacgtcgtgttccaggtacggtaccccctctcagacctcagtgcacaaaattgttttttttttgtctgtaacggtgaaacatgtacggtccctgactgaagctgaccaagcggacgcgggtatgcttccgggacgccttcttcaggctggccgagagttcgagtgccaagtgcggcgctgcgaacggaacgccgccgccttcctctgcaactgcaactgcaaccggcggtaggatctcaacaccagggccaggccgcccggaacgggagacgaacgccatcgacaggacggtggcggacctcaccatgcgccccgctgtcctcgcgagccgctgccccgccgacggcgactcaggggcggaggcgcactccgcaaccaccgaccggcacgacgacggcgtagaaagggcaccgcgcgactgatccgtcttttttttgccggctactgctacgattcgttcggccatgttgggcgcagagagagagagagatgtacatatatatgatgaagagaaccggctgtcgtttatgcatttctacggaacttcgatatagtgaagtcactgtctgatgcagctgaacactggcaccgtttatacagtggtatttggaactggggtacacgactgttattaattattatgtttcttttcttttttagctttcggttgcatactgacacacgtgtgtttgtttggaaaggcaagaaactagaagtgatgagtgaactggtctttgcgttagtgaactggtcaacggtttcacgctagtttcatgcgtatgttcctctccccaattcttggtagggagtctctcccctgccaagatgttcgcttcagtttaaagtcgtatctgcaatacatagagacactgtcacactctacaagcagtagaagtcggtatgaattcaagtggtgtctatagaccgtcacatcacatatgacctataagaaatcatccaaacccaacatgacagaaagccacgcgcagcaatactcnaacatggtatcatttcactagctgaaagagactcccacatagtatcacttctctagctgaaggaggacggatgaccgaacaagctataaaaagaggtcaaactacttttctttgactaagtgtaatatttattcttatcaatttaatatctgatacatgtaccatttatttactttgatattaaatttgtttatgggtatcaaatatatataggtatcaaatatattaaatttgtttatgggtatcaaatatatataaaaaagaaaataatgtattagtatttcacagtaccatggcacgacacttttgttacttcacaggttaaaataaaaagggtttggttacaaacagcgcgcggattgattgatagccatagcaaaacgccaacaataatggtccaacaaatgatataatgcaggcgtcaagttcgagaactctagcgaggtgggcgtcttcgcgaggctcaccaacgcctactgcctcgtccccgccggcgcctccgagggcttctacaggtcggtcgccggcaggctccttcgcgaaccatacataaaaaaaaacctctagctcttagcatccgtgctgcgagtctgcgaccgccgcgactggttgcggcctggcctacagcctactgacaccgaactcacgtgctctgaccgcggcgtgcatgcaatgcagtgcggtcgagtgcgagctcgccggcgccgtcccggtggtcaggacctccgtcgccggcaccagggtcgtcgggaggctctgcgtcggtgaggactgcggactgcgctttggtcctcgcggattagtttggtctggcgctgcgccgctgccggctcctctgaggcttgcctaacatgttgggtggtgtcttgccttgtgtgtctgtcaggtaacaagagagggctgcttcttccccataccgccaccgaccaaggtaccgcgatcattaacagactaacagagactaatggtctgacctgacctgacatgcttaccgtcgttttttccccccgtcttgatcgtgttaccagagatccagcacctgaggaacagcctgcccgatgaggtggtggtcaagtgcgtcgacgagcgcctttcagccctgggaaactgcattgcctgcaacgaccatgtcgctctcacacaccctgacctggacaaggaaaccgaagacgtcatctccgacgtgctcggcgcggaggtgttcaggcagacgatcgcggggaacatcctggttggaagctactgcgccttcacgaacaagggaggactcgtaagtgggccatcggtcttgtcacgcgcggcgcgagcagagatgagttcgggcggtggccggggctctcttccgaggcctcgttcacccgcggacgtcggtagaggacctggacgagctgtccacgctgctgcaggtgcccatggtcgccggcaccgtcaacaggggcagcgaggtggtctccgccggcatggccgtcaatgactggacggccttctgcggcgcggacaccacggcgaccgaggtgtcggtcatcgagagcgtcttcaggctgagggacccccgccctgtggcgctgggttcagacgtcaaggactacacggttcaggatttctttacgagttgagctgagttttgctgcaggagagtagagagaccagtcgcattggccgccgaattgcctgcatctgcattgctggctaccagcaatttgtatcatgagaacctattattatcagacgtaaaatgttttttctttcctaccattgccacgcgattccaacaacaaactatccacaattgcattatcaaattctgtccttctgagtttcacagtgcggcaattgaacaaccaaattatcgctgcacgcgctatttcaccagctgcatgtttcggaaggaaccgtcaaacttccacagctgccaattcggattcggaatgatgtgcaaaaggctcatcttgattctacttgattgatgaaatgagtaacaacaaaataagaacaaatagcacacagttgccaatttccatgactcacgagttcagcaatctctatgactcacaagcgaaccagtccaaatgcaaagacactagtagttcattacaagactaggacacattattatcccgccgtattctttagcagaatgcaaaaaaaaaaaggcagcacatgcgttgcacggaaacatgatggatctcacactactcaataacctaatcgagcaagtcagatatcgatttcttcttgacaaacggatcagtagcggcaatcaaagttgacacagcactgttggggaaaatgttgtcagccttcatcctctctctgaatccataagcaggggccttagcatgtacataagcatggagcagcgactggtacatcctgatcctcccagtgtagccggactgccgcaacttgttgaacactttctctgagttgcggacgtctcctttctttgagtagctgtcaagcagcgtcatgtatgtgttgtatataggcttgatgtggttctgtatagatagcttgtgcactagggactcagctttctccacctctccagcctcaacgtatagcttcacaagtgcatccagagttggggccccaaacctgacacggttctcatccatccgctttgctagttccttacccttgtctaagaggttgtgatcagcatacacctttagcaacgcgttgtagaatttggaagagagtgttttccaatgcacaagcatatcctcaaaaaccttctctgccttttcaacatcaccaagcttaccaaaggcctctatagcagacacggactcagctacgcgagtattatcctcacacgccttccaaattctttccacagcatcactattgcccagaaaagcatgtaaaggtaataaagtcttgcaagcagcacgatttttctggatatcatcaccctccattgccttcagaagtgcctctgctttctcacgctggccataaaatatgtagtgtctggcaattgtagcattaaacgtgagatctggctcaatgctatctttctccattgattcaatcactttctccatagcttctatatctccaactgaacccttggcatctacaagaatcttgtaagtaaagagagatggtttcacatcctccttttccatcattgcaagaacatcagcaatcttcttcctgtccagccttttgtagagtaacagaagctgattg

SEQ ID NO: 9705 - DNA, 1673 bp, Zea mays
cattgggttcccccacggcgggcccggccgggaatccgcctcgcccgcagcgcccctccacttcctctctctctctctacggcggcggcgagaccgcgagatgaaggtcacggtaatgaccggcgacgagcagatcgtcaccctcgacgtcgaccgcgacgaatccgtggaaaatctcaaggcgctactcgaagtggagactcgggtgccgctgcggcagcagcagattcacttcaatgggaaggagatgcagaacacggagaagctcagcgccgctggggtccaggacggcgaccttgtcatgatgttttccaccagcgaaaggccatctcaggatggcttaagggtaaatcctgatggaactgctgtgaatcctcaagcttttcaacaacatgctcgaggtgattcacaacttatggcacagctccttcagaatgatcctcaactagcacaagctatccttggggatgacaccactgagctacagaatatcctgcggtcccgccaccaacaaagaacagaactaaaacgtaaacaagaagaagagcttgctttattgtatgctgatccttttgatgtggaagcccagaagaaaattgaagctgcaatccggcagaaaggcatagatgaaaattgggaggctgcattagagcacaatcctgaagcatttgcccgagtggtaatgctatatgtggatatggaggtcaatggtgtacctttgaaggcttttgttgacagcggagcgcaatcgactatcatatcaaaaagttgcgctgaacgttgcgggttgctgaggcttcttgatcagcggttccgagggattgctgttggagttggtcaatcagagatactaggaagaatacatgtagccccaataaagattgggaatatattctatccttgttctttcaccgtattggatgctcctaatatggaattcctattcggacttgacatgctgcgaaagcatcagtgcatgattgacctaaaggacaatgttctcagagtgggaggtggcgaagtttcagtgcccttcttacaagagaaagacatccccgcacacatacgcaatgaagagaaactgtctaagttagggtctctcagccaagcaactggagagtcatcaaggacacgtgagggtactcccaatgcgccacaacaaacccctcctccaggagctccagctgcaaaccctccacagggaggagattttgaagcgaaagtcacgaagcttgtggagctcggttttgacagggcgtcggtgacacaagcgctcaagttgttcaacgggaatgaggagcaagctgctgcgttcttgtttggtggttagactggtgggagcagccgttcctggctttgtgttcgctcaaccctttccagggttgagtacttgaatatttgatacgaaagtgattaaagtatttggatactgtttgtccagtgaaaggacttacttttagaggttttatgttttctcttgtttctgagaacaaacatttgttttctgtacctgatacatagactgatagacaccagaatggagacagaactgtgaagatttttttttattaagagtgtttatttgagccaaaaaaaaaaaaaaaaaaaaaagcggcccggtgagctcccagttggctactgtcatattagctcttcagcattaatttccaaaa

SEQ ID NO: 9706 - DNA, 1790 bp, Zea mays
  misc_feature (1631)..(1631): n is a, c, g, or t
cattgggtacctcgaggccggccgggcaccccgcggccccgcaatccgcctcgcccgcagcgcccccccccccacttcctttccctctctcacggcggcggcgagatgaaggtaacggtaatgaccggcgacgagcagatcgtcaccctcgacgtcgaccgcgacgaatccgtggaaaatctcaaggcgctactcgaagtggagactcgggtgccgctgcggcagcagcagattcacttcaatgggaaggagatgcagaacacggagaagctcagcgccgctggggtccaggacggcgaccttgtcatgatgttttccaccagcgaaaggccatctcaggatggcttaagggtaaatcctgatggaactgctgtgaatcctcaagcttttcaacaacatgctcgaggtgattcacaacttatggcacagctccttcagaatgatcctcaactagcacaagctatccttggggatgacaccactgagctacagaatatcctgcggtcccgccaccaacaaagaacagaactaaaacgtaaacaagaagaagagcttgctttattgtatgctgatccttttgatgtggaagcccagaagaaaattgaagctgcaatccggcagaaaggcatagatgaaaattgggaggctgcattagagcacaatcctgaagcatttgcccgagtggtaatgctatatgtggatatggaggtcaatggtgtacctttgaaggcttttgttgacagcggagcgcaatcgactatcatatcaaaaagttgcgctgaacgttgcgggttgctgaggcttcttgatcagcggttccgagggattgctgttggagtcggtcaatcagagatactaggaagaatacatgtagccccaataaagatcgggaatatattctatccttgttctttcaccgtattggatgctcctaatatggaattcctattcggacttgacatgctgcgaaagcatcagtgcatgattgacctaaaggacaatgttctcagagtgggaggtggcgaagtttcagtgcccttcttacaagagaaagacatccctgcacacatacgcaatgaagagaaactgtctaagttagggtctctcagccaagcaactggagagtcatcaaggacacgtgagggtactcccaatgcgctacaacaaacccctccaggagctccagctgcaaaccctccacagggaggagattttgaagcgaaagtcacgaagcttgtggagctcggttttgacagggcgtcggtgacacaagcgctcaagttgttcaacgggaatgaggagcaagctgctgcgttcttgtttggtggttagactggtgggagcagccgttcctggctttgtgttcgctcaaccctttccagggttgagtacttgaatatttgatacgaaagtgattaaagtatttggatactgtttgtccagtgaaaggacttacttttagaggttttatgttttctcttgtttctgagaacaaacatttgttttctgtacctgatacatagactgatagacaccagaatggagacagaactgtgaagatttttttttattaagagtgtttatttgagccagcgaaagggcgtctagccgagtttggtagccgagatagntagggtggtctgagtagactttttcattcctggggtttgttattttgagttatattttttttaagttattggggaacctggggctataggaaaagctgcttaagatgtgaatagaattcgaaagccatttaattagttgaacaactaatgggtttcttc

SEQ ID NO: 9707 - DNA, 787 bp, Zea mays
gggtacccctcgagccggccgccccgtttctcctgttcgctgcctcctcattcctgaacccctcccccaagtatacgagtcacatccgcatggcctcccgggtcacgaggctgctcctgcaccgccgcctcaccaccgcagcggaagcctccgcgcgccgcgcgccgcaggctccctgtgccggcgccgctgtctccaaggatgttgttaaggctgaagcttcatctttgaaaaattcaaggtggtacattactaggtcaaacacttcaggtcctttgactactcgttatgagtgccgcaaagtatttccttgttctgtaacgccatctgcatcttactctacacaagcttcagaccagaagggaaaacaggaagggaaagacttgtcaaatgtagaacacccctttgatgatattacctacaatatacctgagaagccagtgacatttactgaaggtgcttcttatagtcttgtaatactcgccgggctcggaattgcaggactggctggatatgctgtgttcaaagagcttatatttgagccaaaagagtacaagatatttgggaaagctctagcaagaattcagagtgatagtcaggtcacgtcaaggattggccaccctattactggatatggccaggaaactagaaaccgtgcagctcggcaaagaattccaaataagatttggacagatgaggatggtgttgaacatgtggaggtgaactttctcatccgtgggccacatggagctggaaagtgtattcagagatgttcaaagacactgat

SEQ ID NO: 9708 - DNA, 1406 bp, Zea mays
  misc_feature (1375)..(1375): n is a, c, g, or t
  misc_feature (1377)..(1377): n is a, c, g, or t
cattgggtacctcgaggccggccgggaggcgtttcaccgcccgcccgctccgtcgccgcgagggcaccagaaagccgataatccacccaaacagttctctgtttcccctgcgcgccgcctcctcattcctgaacccctcccccaagtataccagactaccagtcacatccgcatggcctcccgggtcacgaggctgctcctgcaccgccgcctcaccaccgcagcggaagcctccgcgcgccgcgcgccgcaggctccctgtgccggcgccgctgtctccaaggatgttgttaaggctgaagcttcatctttgaaaaattcaaggtggtacattactaggtcaaacacttcaggtcctttgactactcgttatgagtgccgcaaagtatttccttgttctgtaaggccatctgcatcttactctacacaagcttcagaccagaagggaaaacaggaagggaaagacttgtcaaatgtagaacacccctttgatgatattacctacaatatacctgagaagccagtgacatttactgaaggtgcttcttatagtcttgtaatactcgccgggctcggaattgcaggactggctggatatgctgtgttcaaagagcttatatttgagccaaaagagtacaagatatttgggaaagctctagcaagaattcagagtgatagtcaggtcacgtcaaggattggccaccctattactggatatggccaggaaactagaaaccgtgcagctcggcaaagaattccaaataagatttggacagatgaggatggtgttgaacatgtggaggtgaactttctcatccgtgggccacatggagctgggaaagtgtattcagagatgttcaaagacactgatcggacgtggaagttcacataccttgttgttgatatcgtgtcaccaccacatgcaaaaacacaactgatgttagaatcttacttaccagcataaggatgcaggaaacagaggcagttagcagtgccatgacatctccgagattttggcacaaatgggaagctctgatagaagtggctaaactggggatttgtgaacaagtctaggcaagttgggaatttaggaacaagattgtcataatgtactaccatcaaaccagttttgtggagtaataaacggttcttacattactagaagcatatctggaaatgtttcgatgtttcttttagttacggggaaaaccccctgcatgcctggatgagggtattttttgttagttctcatgagtaccttgtatcgcccaaatacgtgggctaatccagcaagtcatcttttgtaaaatcatagcaacccttggctgttaattcattttgtctggatttggtttccaattgaaaggcccgactnangggccaaggccagggggtttaaaaaaaaa

SEQ ID NO: 9709 - DNA, 1464 bp, Zea mays
gagctcctagtaaagtagtaatagcgtgcctgtttctacagggcttcccgtactgacactgatacctgcctggatattattagtaggatatagtatatattatggtctcaagggctgctaccgattggagggtcaggtcttcattcgcaaaacacagacatttgacttgcgctctccctttctctctctctctgtgtgtatgtgtgtgtgtgtctcaggttctcagcaaagagcagggaggataagcttggaatgcctcggcagtgagagctgcaactgcaacaaagcaaccggcgtccatggtggagagggaaaggggcgagggagaagccagggccctggccagcgggccactgcagcagcagcagcagcaggaaggagcagcggagggcgagagggtcgagaaagaaggagacgagcgggaggaggaggatcgagacgacgaagccgtggagtggtccgagatacggctcgccatcgaggagctgtccccggcggcccatctcaagcgcggcgacggcgatgccaaggcggccgcgtcgtccctgcccacgctccgcttcctggcgctgtcgcacctcctcgttcgagtgctcgataagatcgggccgaccatggccgtgctgaggctcgacgtccaacggaacatcgagaggctgcaggagctgtacctgctggacccagccacgtactcgaccctgacggggatagtggagaaggaagtgaaggagggcacagcgaggaaggtcgacagctgcgcaagggcgatcctatggcttgctagatccatggatttcacagctgcgctgttacagaggctggaggaggactctgcgcagcagcagcagcagagcctcgcgcagctcgtggaagccgcgtacgaggccaccctgaagccgtggcacggctggatctcctcggcggcgtgcaagatagcgtggaagctcatccccgagaggaaggtcttcaccggcatgctgctggggatgggccaggactgctctgcactcggggacgacatcgggcggctcgcgctgttgcttcggcccttcctcgatgacatccactccatgatggccaagttcagactggacaggctcaagtcgacgtgatccatggatggcgaacacgacgcaagcccaagccatggacatggtccccgtccttcgctgtgaatactgcctgccctggctttactcttggagtcgcatttgcttgcggttaggtctagtttagacgctgctgctctctagtctatacataggtcttttgcttgtagaatagactcccaagatctgcatgctgtgcccttttttcgtggtagggtacgtttggacagcgccctcctcaattgcctttgcctgtgccaatacgttggccggccaaactttggctgcccaagaaacggaaaaaaaaacttcgtgcaaaaaaaaaaaaaaaagtaaaaaaaaaaaaaaaaaaaaa

SEQ ID NO: 9710 - DNA, 1972 bp, Zea mays
cggccggggattttgaaccgtaataaccgaggccgaggccgaccggccgagagaaacaccgacccgaccgaactcaactcgttctcgacccgaaaccccaaatccctctcagaaaacccttccctcccgatggcaaccgccgccaccgccatggtggtacccgagcagccgcgccgccggaagccggccccggggcgcgggggagtggccctccctgcgggtctctcggaggaggaggccagggtgcgggccatcgccgagattgtctcggcgatgggggagctctcgcggcgcggggaggacgtggacctcaacgcgctcaagtccgccgcgtgccggagatacggtctggcgcgagcgcccaagctggtggagatgatcgctgccgtgcccgaggccgaccgcgccgcgctgctgccgcggttgcgcgctaagcccgtgcgcacggcgtcgggtatcgccgtcgtcgccgtcatgtcgaagccgcaccgttgcccccacatcgctaccaccggtaacatctgtgtctactgcccgggcggtcccgactccgacttcgagtacagcacgcaatcctacactggatacgaacccaccagcatgcgtgccattcgggcaaggtataatccatatgtgcaagccaggagcaggatagatcagctcaagaggttagggcatagtgtggataaggtcgagttcatcttgatgggtgggactttcatgtccttaccagctgattatcgcgattattttatcagaaatcttcatgatgctttgtcggggcacacttcagcaaatgttgaggaggctatttgttattccgaacatagtgctgtcaaatgtattggtatgacgattgaaacgagacctgattattgcttggggcctcatctgcgccagatgctatcttatggttgtacccgcctggaaattggtgtccagagtacatatgaagatgttgcccgtgacacaaacagaggacacacggtggctgctgttgctgattgcttctgtttggcaaaagatgctgggtttaaggtggttgcccacatgatgccagatttacctaatgttggagttgaaagagacttagaaagtttcagagagttttttgaaagtccagcattccgggctgatggtctgaagatttatccaacacttgttattcgtggaactggtctttatgagctctggaaaactggcagatatagaaattatccacctgagctcttggtggatatcgtggcaagaattctgtctatggttccaccatggacacgagtgtatcgggtccagagagatattcctatgcctcttgtcacttctggtgttgagaaaggtaaccttcgtgagctagctttggctcgaatggatgatctgggcctaaaatgccgagatgtcagaacccgtgaagcagggattcaggatatccatcacaagatcaggcctgatgaagtagagcttgttagacgtgactatgctgcaaatgagggctgggagacgttcctctcttatgaggatacacgacaggatatcctgatcggcctgttgcgcttgcgtaaatgtggccgtaatgttacatgccctgaacttgtagggaggtgttcaattgttcgtgagcttcatgtctatggaactgcagtccctgtgcatggccgtgatgtagacaagctacagcaccaggggtatggaactctgttaatggaagaagcagaaaggattgctcaaaaggagcaccgttcagagaaattggctgtcatttcgggggttggtactcgccactactaccgcaaactgggttatgagctagaaggaccttatatggtcaaatgtttggcataataccgtttcattttttttcgtgctcatgtagaacagactagtgtttataatgtaacttgtgtagttttttcaaaaaaaaaaaaaataaaatacccttcttcccttcttttgggggcgcccccctcccaat

SEQ ID NO: 9711 - DNA, 883 bp, Zea mays
atagccggcccctcaagggcgaaagtgactgaaaaggcccgcatgttctcctgcctccgctccgccgccgcaacaaccatttccttctctagccgccgcctccgatcccctcccgaggctacagaaccagttcatccaggcgcgaatggcggcggcgaggagcctgcttctgaggcacctccgcttggcggcggccccgtcagcggcgtccgtgaggccgacggcgtcgttgcatgaggccctgtgggggcagcggtggatgtcttcggaggatgccaagggctctttcctggacaagagcgaggtcactgaacgcatcatcaaggtcgtcaagagcttcccgaagatcgatgacccctccaaggtgacaccagatgcccatttcaagaatgatcttggcctagacagtttggatgcagtggaggttgtcatggccctggaagaggaattcagattcgagatacctgacaatgaagctgacaagattgactccgtcaaagttgcagttgacttcattgcctcacacccgcaagcgaaatgataaagatgcgttgcctggtatagcaaagctatatcgtcattaatctctgtttatgaagaaagttcagtttgaagatgtacactaccgtgcccatttggatacttctgctgatgctactgtcctttttggaacgaattttgctactgtggattgtctgcactaaataaaatgtttgaacctgagaaggaacttggatgtcgtttggttcacgaaatgtaacgtaaatggtaatggtaatgattgacactcgaataccggcagtaacaaatttgaataagacgatatccatttatagtgtggtatcgattacggttggaccgaaaaaaaaaaaaaaaaggcccc

SEQ ID NO: 9712 - DNA, 2819 bp, Zea mays
tgttgcccggcgcctatagtggcggccggtcataacagaaacacatgcataaagcatgttcacgaaaaaagcaatatgtcaatgatatttgcagctatagtccagtaacctcttagaatttgtacatgaacaatatcaaaatatgtttcattgtcagtttgtcacaaaccttgtagattgtgaaaatattgaatgataacagtcatggagcgatttcaattcaaagcttgcacagttatcacaattttttggttctgcttccaaggcacttctcgaattgttatgcgaacccaggagttcatgcaagtaagatacctttgcatcttctaagaactttttaacttgatgagccctctggacagtaacatggtggtcaagagtatgtatgtcatccactttcatccgtacttttgactagaaatgcagtcacatcacttgaactttcctcaaggagcacatgttgtgtttagtagggctgcaagtgaccagtgtgccagcatttttaccagtaatctctgcaggaacaatgtccatcttcgaaacggtggaatcttgccctgtcccgaataatgatcacccgattataggctttagagataagttttgccaccacatgacagtctccacatgttcggaggtttttatcactcgaatagtctccccaggtggtgtagaaattaacccaaatgcaatagccagcttctcgctgtggtagcttaaagcatactgcttctcctcctccccaatgtcatgtagcacattgctcgtttctggctcataccccagagcacagattcttgacccaatttcatctaatgctctatatatttccctccacctcatgtgttctttgtcaccatttatgaacttatgcattacgccatctatttctgtgtagctgattttttttttttttttgacatcattacttcgcatggtgtcacggactcgaccaacatccacccatcgggacttggatgcatatacattggacaggagcacatagtcaccatcaacgttagagccaagatcagcaagctttgtggcagccaactccgctagatccacattaccatgcatcttggcagcacctagcaatgtctgccagaggacaatatccgctggaaatggcatagacataatcatgtcatatgcctcagcaaggcggcctgcacggccaaggaggtccacaatggtcccgtagtgcttcatattgggaggaacccgcatggaatcaaaaaccctgcgcccatcatcaacaagcccagcatggttgcacccacccatcacagcaaggtaagtgatttcgtccggttcaatacgagctggcatttcatcaaacagcttcagtgcatcttccccatgcccatggatggaaagcgcctgaattgtagcattgtaggacacaagtgttcggtcttctagcttgatggaatggaacacttcaagagccccggctcagtgagccacacttggagtacatgtcaataagtgcgttgccgacacaaacattgtccacagctcctattgtacgagcaaactcatgcacagccaatccatcctttaaggttccaagttgtgcacatgcagaaagtgcagcgacaacagtcaccgcatttggctcctcccttggcggcaactcccgaaagctccctgccagcctgcggaatagcaatagagcgagattcggctccgtcccctgcgccagccctgcgagcagcgcgttccatgtggccacgtcgcgcacgggcatttcgtcaaacaccttccgtgcggacgcgacgtcgccgcacttggcataggagtccagcagcgtggtcatcaggcggacatcagcagccacaccgaggcgaacgagggtcgcgtggagctggagtgtggcgaacgcgtcggagcatcgggctgtggccttcagcgcgaaggagagggagagcgcatcgaggcgaggccgtggcggggcgggagcagggaggaggcggccggcgaggaggaggagagagcgcgcagggtgaggggaggcggctaggccgcgcagggtggcgttgaagtcgttggttgcgggggacgggagggagcggaggaggagtagcgcgtgcggaagcgcgtcggcgtgcggcaagagcgctaggcggtcgaggaagcgcgcgcggagggatgggtaggagtggagcgtgcccaaggcatggaggcgcgcgtggaactgcttgtagtgggaaagcgtggacaagtgcgggaggagggactccagctgcagcgccgccgccgctgccgtggacgacggcggcgatggcattgggtgggcgggctttttccggacccggtcggactgtgggatgggcgcctctacaagagccccctctacttgggtagttgaataaagtaatgatgtttttcatgggctcgaaaaaaagttgggcttattttgtttaatattttatttttaaaaaattacttaattagctttaaaaatatctttagttacttgcacgtctttttgttagttttggtacttacagatgattttatccttgagtgaaaagtcattttagtacgaagtttaatttatctatgataattttgaggaatattttgtatggtttaaaattatttcacaaaattaaacagagataaactaagctctgcactgattcactttcactccggaacaaaaacatcatttcatccttaatttatggttgttaaataagttcaaaaataaaaagaagaagaaagtaagctataaacttccttcatggccaaaaagataattctcttattacaattcactttaacaggctatagacacacgtgaccaggat

SEQ ID NO: 9713 - DNA, 1819 bp, Zea mays
caatccaagtgggttttttccttttttttttttttttgccgaacaagcaaataaatcatcattgcccaacatgcaaatccactccaatgacacaacaacgtgcaaaaccactactaaaggggtttacaaaaattgggttaaaaacataagccattcctttacatgatcatatttgcaactaccaacaaaaaacaagaaaggaattagcttggagtaattgctcattataagccattcccatggtgccatggtggtaccagcgttccgcagcagctatggtaagttcatgtacaatgacaccggagcgggattgacacgccatcaggcttccgcttgtccctgatgattgcctcctgaatcattggcagtttctgctgaatcttcttccatatgtgactcacagcaccatcaatggaggtagagcctctgctgctggagtagctggtgtcatactcaaagataggttggacacgagccaggtttcttcgaaactcgtccttctgctgcttggaaatattcctcaagtagcttgttagccatttcggtctcatagcgttactaactgacacgaaaatggagatttctgtgtagtctattatcccttcgaaagggagctcaacctcatcactaacgatgactggtatgcacagactggcaatagcatcaaagaggcgacatgaggttggggtgtcaccggctgggtgcaagcaaaattccgatgtccgcaacccttttattgattgttcacgtccggtggcattcgggaagccttcttccatgataacgtcaggctcattacccagcaaatcccataatttctctcgtactaaaccaccccgatgcctatgcttcgcccccttgaagtagagaagtgtgcgacgatctttattctctgataagagcagtgtcggaagcaaatgcgtgtaaggcacaataacatccttaagcaatgacacttgagtgtgctgtatcacccgagacgagtttttgcttgaagactttgaatcaactttataccatcctccaaaatcaaccaccaaaaggattgcaggagcaatctcagcacggacatgccacatagccacagggtctgtcaggacgaagatgtgatcccggccgctggacctccgccacgcggggtgggaggtgacgcggtcgacaacctcccgctgccgccggtagtcttcgttgccgtccttcttgcggaaggcgcccttggttccccacccgagctccatctccgcagacagcgtcgcgaagaagggaacaaagacgacatcggcttccctccagtccgcgacgaccctcacggcggccggcgccgtcgccgcggcgcggagggaggcgaggagccagtactcggcgctgtactgcttgatgagggggttctcggggtatggcgggtggtcgtgcgggggcgggtggtcagggtcggacgaggcctggatgcgggagtccgctgcgcggagggaccagtagcggtcgagcaggccgtagttgaacgcgcgggggaggtccgcgacgtagaccctgagacggcggtcgggttcgaaggcttgccgcgaactgaggacaggcggggtggtaggccggaagaggaagaaggagatggagagtaggaggaggaggacggggacgaccaggatggggagccgcttcatggccgacgccggtcagatctgggtgaccggaggtggtggacgcacatccggcatcgtctgctccatttcctcgcggcgcctcgaacctctgccaaagttggaccaattttctttttcctgctagtcttctcagcgcatgaggccatgttattgtattt

SEQ ID NO: 9714 - DNA, 1802 bp, Zea mays
ctcgaggccggccgggagctagcagcgtccctgctgctccgcgccacacctctccgcttcattcctatccgtctcccctgctctatcgtcgtcctcctccgtcgggccggaggagcgtctctttgtcggcgcagcgtgcagagcaccgcagattcagagacacgatgatgtcgcgacagtgtgcaaaccgcatctttcttaccggaggttccagcttcctccatggcctcaaatctagagttgcatccagtaggagtcacggcaccgtcagactcaactggcgctgcgtgagaactaatctctggagggccgagcgccttggtgtcaaggctactccgtctgagcatatcattgcagtactgcaagcgtcagatattttcagtggcatcaggaaatggagcaagttgcaattggtcgccatgacaggggtgatggcatgtgtagttctggtagtcccttcttctgatgcagtcgatgctctcaagacatgcacttgcctgctaaaggaatgcagaatagagctggctaaatgcatagcgaacccatcctgtgcagcaaacgtagcatgcttgaacacgtgcaacaatcgacctgatgaaactgaatgtcagataaaatgcggagacctgtttgagaacagtgtagtcgatgaattcaatgattgtgctgtttcacgcaagaaatgtgttccaaaaaaatccgacgtcggcgagttccccgtccccgatccatcttcgctggttaagagcttcaacatggcagattttaatggcaaatggtacatttcaagtggcttaaacccgacgtttgacacattcgattgtcagcttcacgagtttcatgtcgagggagacaaattgatcgcgaacatcacatggagagtccgcaccccagactctggcttctttaccaggtcaaccgtgcagcgttttgtgcaggacccatcgcagcccggcatactctacaaccatgacaatgagttcctgcactatcaagatgactggtacattatctcatccaaggttgagaacaaggatgacgactacatatttgtgtactatcgtgggcgaaatgacgcatgggatggttatggtggttctgtattgtacacaagaagtaaaactgtacctgaaacaataataccggagctggaaagagctgcaaagagcgtaggtcgggacttctcgacgttcatcatgaccgacaacacctgtggtcctgagcctcctcttgtggagagaatcgagaaaactgtggtggaaggagagaagaccatcgtcagggaggtgaaggagatcgaggaggaggttgaggagctggagaaggaggaggcgtcactgtttcagaagctggcagaaggtctcatggaggtgaaacaggatttcatgaacttcttgcaggggctgagcaaggaggagatggagctgttggatcagctcaacatggaagcgactgaagttgagcaagtcttcagccgtgcactaccgttgaggaagctaaggtagctgcagagcaaaggacttggagaaaacaagccatcaagtactggccgaaacggattctatttgccacagcagtacccacagtagagattgttgaacagatacaacaaacatttttaattttcttttctttttcttttcttttcttttcttttctttgtttacccttttctgtggtcaaaacacatgcctacgttagccctatttgtaaagcatcaagagacaacgtaactttttcttgccaaacagagaaaaaaaacaagtgtacttaagactaaaaaaaaaaaaaaaaaagcggcc

SEQ ID NO: 9715 - DNA, 1602 bp, Zea mays
gcaatggaaacgagtgtattctcgtaataatacatgccgccaaaaagcggccgcgcccagctttttttttttttttttctggtcaaatttgctacggttcaaacttaataaagttgaacaagattctcttttctggcaacgcgccagacactaaaaaaatcagccgtagatgcgtaacggtgatagagtcgcttctgtacaaaatgtgaaagtgaaacattgatccacgagccagtagaggctgtctattatcccccaaagctattcctgtcgacagcgtggtcctaacgagaccgcagctctcgaatgataatatcttcaacagcatccacaagcgttagaagatgttgccgaatctgcggctccaattcgttggccagttccttggtcttacaaagtatagttgaagcaatatttgttggacgatcccctgcattgcggatcgaaattagcttcaggccataggaacaaagaggccaatctgaagacatcttgatggagacatcaataccacgatctaagtgagcaacaatcatctcctttttgtttaagtactcaaaacaatgcctcgaactattagcatcattcaccaatgatcgtctcaaagcattgattatagactggtgttggcattgctgaattagccatatcaaggttggagaacaaactgtatctctggaggactccatcctctcaatcagtatatctacagacatgtcatcaggaatgatctgtactttctttggttccatatttattttatcaatttctatcagcagctcatggtctgaaataaatgaatcaatagaacaattaaacttctgtccataaatttcacaatctgaggtcaatattggtgccttgaggaacatcctgagacagtcgtctttaaagtctaagatcttcgctccaaatggcaataacttagattcaagttgaaacatttcatcatccctttgtagatgttgtaaaatttcaagttccatcgtacttttttctatttggtgatcaagttccaactcatatatgtagtccttgtcagcaatgcttcgatttctgcatgaatcagttgagtctgacagccccagaacagaactttcatcaaaatggttcaaagcctttggaccaagattcgaaatcaaagactccagcatttcaataccaacatccaattgaatcatatcattgaatgttgtctctgcagtgacactaatctcaccagataccttctgattcccctgctctgccatggctacatcctttctcagttgttccaggtatgcatccaaatcatcaattgaaaccgcagcagtggccgagtcccactcatccatcgcatcctgagccgccttgtgcgtggagtccaaacctagtgccacctcatcctccgccacctccgcctccggctccacctccagccttttcaatgagagctgctccacccggctctgaatggcggacgcatcgaggggcgcctcgtcgggaccttgcgccggtactagggcttgcgcctccgccatggccgtctcactctcccgcctagtagacagagagatttggttttcgaaacggaggggagaaggaaaagcccggcccggccgg

SEQ ID NO: 9716 - DNA, 2218 bp, Zea mays
tcgaggccggccgggccgggatcccaccacacttgacccatcgccgtcatcccagtccacgcccacgcccacgcccacgcccacgccgacccacccgcatccctccctcgcctccaccgcagcgatgtcgggctgggacgagggcgccgtgttctacagcgaccaggcgcagttcccccgcggcggccccggcggcgacccagccgccgacctcacccgccactccgcccttcgcaagttcaaggagttcctccgcggtttcaccgcccccgccccccgcgcccccggccgcgagagcctagtacacaaccgcgaccatgtcaccgtcgccactgaggacctcgacgccttcgatgccgagctctctgacaagatccgcaagtcgcctgccgattatcttcctttgttcgagacggctgcgtccgaggttctcgcaagcctccgttcgaaagtcgccggcgagaccggggagatggaggagccagtcccaggagatgtccagatctttctctcctccaaggagaactgcctgtccatgagatctgtcggggcggattacatgtcgaagctggttaagattgcgggaatcacaattgctgcatcgagagtaaaagccaaagccactcatgtaactcttatatgcaagaattgccggagtgtgaggacagtgccttgcaggccaggcctcggcggggctatcgttccacgttcgtgtgcccatgttcctcagcctggagaagagccatgccccctggatccttggattgctgtcccggataagagcaagtatgtggatctccagaccctcaaattgcaagaaaatcctgaggatgttccaacaggtgagcttccaaggaatatgctgctttctgtagatagacacctagttcagactatcgttccagggaccagattaactgtcgttggcatctacagcgtgtaccaagcttccacaacccagaagggtgcagttggtgttaaacagccttacattagagttgtgggtttggagcaatctcgagacaataactcaaatggtccctcaaattttactctcgatgaggaaatggaattcaaagaatttgcacagaggccagatgcatatgccaagctctgctcaatgattggtccttcaatttatggtcattctgatgtcaagaaagctattgcatgcttgttatttggggggtctaagaagaggctacctgatggtgtacgtttgagaggggacattcatgtcttgcttctgggtgacccatccacagcaaaatcacagttcctcaaatttgtagagaagactgcccctattgcagtctatacatctggcaaaggatcatctgcagctggtcttacagcatctgtaactcgggatagtagctcgcgcgagttttatttggaaggaggagccatggttttggctgatggtggagtagtttgtattgatgaatttgacaagatgcgacctgaagacagagtggcgattcatgaggccatggagcagcagacaatatctattgccaaagctggcattacaacagtactcaattcaaggacttcagttcttgcagctgccaatccaattgcagggcgctatgacgatcttaagactgcacaagataatattgatctacagaccaccattctttctagatttgatctaatctttattgtcaaagatatcagaatgtatgaccaagataagcgaatagcaagccacattatcaaggtgcatgccagtggtgcagcagcgtcatccgcaaacacagagggaagtgaaggagagaattggcttaaaaggtacattcagtactgccgtgcaacatgcaaaccacggctttcagaaaaagcagctgagatgctgcagaacaaatacatcgagattagacagaaaatgaggcagcaagctcacgagacagggagggctgcagcaatacccatcactgtgaggcagcttgaagccatcatacgtttgagtgaatctcttgcaaagatgagattgacaagcgtggctacaccagagcatgtcgaagaggcattcagactgttcaatgtctccacagtcgacgctgcgagatccggaatcaacgagcgtctgcaccggtcgccagagatcgcaaatgaaatcaagcaagcggaagcacaaataaagcgaagaatgggcattggaagccacatatctgagcgacggctgattgatggactaaacaggatgggaatg

SEQ ID NO: 9717 - DNA, 1398 bp, Zea mays
accgaccccgtccctcgccgtcgtccacgccgacgcacccgcatccctctctcgcctgcgccgcagctatgtcgggctgggacgagggcgccgtgttctacagcgaccaggcgcaattcccccgcggcggccctggcggcgacccagccgccgacctcacccgccactccgccctccgcaaattcaaggagtttctccgcggcttcactggccccaccggcgacttcccctaccgtgagagcctagtacacaaccgcgaccatgtcaccgtcgctattgaggacctcgacgccttcgatgccgagctctctgacaagatccgcaagtcgccggccgattatcttcctttgtttgagacggctgcggccgaggtgtccccccccccccccccccccacccccggcgaggccggagagatggaggagcccgtcactggagatgtccagattttcctctcctccaaggagaactgcctgtccatgagatctgttggggcggattacatgtcgaagctggttaagatagcgggaatagcaattgctgcatcgagagtaaaagctaaggccacccatgtaactcttatctgcaagaattgccggagtgtgaggacagtgccttgcagaccaggcctcggcggggctattgttccacgttcgtgtgaccatgttcctcagcctggagaggagccatgccctctggacccttggattgccgttccagataagagcaagtatgtggatctccagaccctcaaattgcaagagaatcctgaggatgttccaactggtgagcttccaaggaatgtgctgctttctgtagataggcacctagttcagactattgttccagggactagattaactgttgttggcatctacagcgtgtaccaagcatccacaacccagaagggtgctgttggtgttaagcagccttacattagagttgtgggtttagagcaatctcgagacaataactcaaatggcccctcaaacttcactcttgatgaggaaatggaattcaaagaatttgcacagaggccagatgcatatgccaagctatgctcaatgattggtccttcaatttatggtcattctgatgtcaagaaagctattgcatgcttgttatttgggggatctaagaagaggctacctgatggtgtacgtttaagaggggacattcatgtcttgcttctcggtgatccctccacagcaaaatcacagttcctaaaatttgtagagaagactgcacctattgcagtatatacatctggcaaaggatcgtctgcagctggtcttacagcatctgtaactcgtgatagtagctcgcgtgagttttattggaaggaggagccatgtgtttaaacacaataaagtgggaactggaggggggaaaggagtt

SEQ ID NO: 9718 - DNA, 1521 bp, Zea mays
ttcggacgaccctgatgggtacgtttgagaggggacattcatgtcttgcttctgggtgacccatccacagcaaaatcacagttcctcaaatttgtagagaagactgcccctattgcagtctatacatctggcaaaggatcatctgcagctggtcttacagcatctgccgctcccggccctagtccctcgcgcgagttttatttggaaggaggagccatggttttggctgatggtggagtagtttgtatcgatgaatttgacaagatgcgacctgaagacagagtggcgattcatgaggccatggagcagcagacaatatctattgccaaagctggcattacaacagtactcaattcaaggacttcagttcttgcagctgccaatccaattgcaggacgctatgatgatcttaagaccgcacaagataatattgatctgcagaccaccattctttctagatttgatctaatctttatcgtcaaggatatcagaatgtatgatcaagataagagaatagcaagccacattatcaaggtgcatgccagtggtgctgcagcttcatccacaaacacagaggggagtgaaggagagaattggctgaaaaggtacattgagtactgccgcgccacatgcaaaccacggctttcagaaaaagcagctgagatgctgcagaacaaatatatcgagattagacagaaaatgaggcagcaagctcacgagacagggagggccgcagctatacccatcacggtgaggcagctagaagccatcatccgtttgagtgaatctcttgcaaagatgagattgacaagtgtggctacaccggagcatgtcgaagaggcattcagactgttcaatgtctccaccgttgatgctgcaagatccggaatcaatgagcatttgaacctgtcaccggagatcgcaaatgaaatcaagcaagcggaggcacaaataaagagaagaatgggcatcggcagccacatatccgagcgacggctgattgatgagctaaaccggatggggatgaatgaatccatcgtcagaagagcccttctgatcatgcatcaaagggacgaggtggagtacaagagagagcgccacgtgatcgtccgaaaggcttgaggtggagaggccagtcagattcacggcatacaacgtacactggaggcggtccttcctcttcggacgtgtgtataccttcactgaaactgcacctttgtctgtccagaggacgaggcatgccttagttgatctctgacatgactcttgtaatctgcacacgagtggatgcaaccttttgcttcgtgcaaatggagctttgtagctgtaccacagtagtctgttgctgcctgtgatcctaaaccatagtgttgtgagcatgaagacttcgtttttttggaagtaaccataggttctgaactgcattgtgctgtgtagctcgtcaatcaattctggaatgcgaactttgtttactgcgaaaaaaaaaaaaaaaaactcgagggggggcccggtacccaatcg

SEQ ID NO: 9719 - DNA, 2674 bp, Zea mays
tggaaacaagaacacatagtcttgtgttagattataagatgtaatatgttgcggttctcttgccggtttaggaagcattgccctcctttatatagtctacaagacaagttttttatataatttaggagtcatggtaggattataaaataaagttgtaacagggtttagagttggtaagggctcggatcaacaagtcctcctccatggaaatgtttgttttaatggtcttgtgcaacctgaatgtacagaaaccacaagatcttcaagaatgcctctccaacaattgaaggttgcaaagcaatattcaagcttgaaataacttcgctcttctggcgtgtgaacaagaaagctctgcctctactttaagaaaagggtgcaaaaccacatctgatttcctactctactccaattctcttacttcctacacttcttcgtctcctaatatgtgtgaaggattagttttcagagtaacttcccttactttttgtttgcgcctcatgttcttattttgtaagactgttgctggtttggaaccttttaaatttgcaataggagctcaaactcctactgtttcaatttttttaaaaaagaggttctagcttgacatgccataaatcattgcctggcccaagctgccgtccaagcactccttatatacatgtgcatgctggagaaaaaaagggtaattttatgtctctgctaaactatttgaaaatttctaggatgtctttgttttagagacagagggagtagccagtggacactaagcaagcacagtgctgaaagttctcagcaacagcagtcagcagataacggatagacatagagaggagcacagggtaaggatccaccggatccgtccccgtggactttcccgtgcgtcgcgcgtgaacgagatgggttttgatttcacgccctcttccaaagtccattgcttgcttctcgcgggcgggcgaccccacccgcacgacgtcgcgaatgacccgtctccacttgtcggccgtgaccacttggtcctgcgcccaacgcccttccaagttccaacacctgtcccgccgcccccgctataaaaacccgcgacgccggccgagggcgccccaagccaacacggtcacacgactgcataattgtgctcgctcgccgggccccgggacgtgacacatcgcacggccgaagcagcttgccggctgccgcgtttcgcctcccgcctgccgtgccgcccgtgaccgcgagaaggccggcagctttgcatgaggaggaggaggatgggggcactgcacgtcgtcggcgagcccaggatcagcttccgccagcagcctgcagcagtcgtcgcgaagaacggcggccacggcgccgtcgtcgaggagatccacggcctgatccgcgtctacaaggacggacacgtggagcggctcccggcgatcccagccgtgccctgcacgtggggcggcacggccccggacgcgccgggcggcgtcgtcgcgagggacgtggtggtggaccccgcgacgggggtgtgggcgcggctgtacgcgccgacgtcggcgggggacggagccaggcgccccgtcgtggtgtacttccacggcggcgggttctgcgtcgggtccgcggcctggagctgctaccacgagttcctcgcccagctcgcggcgcgcgcgggctgcgccgtgatgtccgtggactaccggctggcgcccgagcaccgcctgccggccgcgttcgacgacgggctggccgcggtgcggtggctgcggcaccaggccgcagcgtcagcgtcagcgtcagcgtgctgcaacgacgacctgtcgtggtggcgggcccgctgcggctttgaccgcgtgttcctcatgggcgacagcgcgggcgccagcatcgccttgcacgtggccgcgaggctcgggcagggccagcttggcgcgctgccccccttgaccgtcaggggccccgtcctgatccagccattcctgggcggcgaggggcgtaccgcgtccgagaagaacgtggcgcagccgccacggtcggcgctgacgctggccacctccgactgctactggcggctggcgctgccggccggagccagccgcgagcacccctggtgcaacccgctgtcgggccgcgccgcgccgcgcctggagaccactccgctgcccccgctcctggtgtgcgtctcggagacggacatcctgcgggaccgcaacctggagctgtgcagggcgttgcgcgaggcgggcaagcgcgtggagcaggccgtgtacggcggcgtcgggcacgcgttccaggtgctccacaactgccacctgtcccagccgcggacgcaggagatgctcgcgcacatcaaggccttcgtcagcgccaggtagcaggcgccgcagcagcagccgcctcctccattcgtcgttggtccctaacaaacagacactcgccatgttaattaatccactacctaatcctaatccaatcgaagagtagatgccgtgtaagcaaccagaaccagccttgtgcagtactgtatcagtagtgtgtgacttggagcagaaagcgtccaatgcccagcccgggttgttgttgtagcggtgtcggaaagcaaaagcttatcactacactaccccggtcgtctggccgcttcatatacatgtatgatccgccgttcatttcatttcatcttgtttag

SEQ ID NO: 9720 - DNA, 2224 bp, Zea mays
ggggcgcgcgcgtgtagggtcgcaagccgagccaaagcagctgcagaccgaccaccacgcgacgctcctgctggctgctgccgcggaacccgggacaagcgacctcctccacctccccagctagctatagcttcctgcttgcagctgcaggtgccagccgagccgcctaccggtaccgggtacagccgcacaggcaggcggcggcatgcgctccagcctccagcagtgagggagggaggccccccgcccccgccccctctcccgctcccgccccttctacttctacccctccccccaccgcgggccgagagggagtccgcccgccggcgccgcgcgactcaccgatgcccagccatgaggcctgctgcggcaccatgttctgggtgtacctcatgtcctgcgtcggcctcgtcgtcttcgccggcctcatgtcgggcctcaccctcggcctcatgtccctcagcctcgtcgacctcgaggtgctcgccaaggccggcacgcccaaggacaagctcaacgccgccaggatcctccccgtcgtcaagaaccagcacctgctcctctgcacgctcctcatcggcaactcgctcgccatggaggcgctgcccatattcctcgacacgctcgtgccgccctacgtcgccgtcctcatctccgtcacgctcatcctcgcgttcggggagatcatgccgcaagccatctgcacgcgctacgggctcagcgtgggggccaaggcggcgcccgtcgtccgcctactgctcatcctcttcttccccgtcgcctacccgatcagtaagttgttggactgcctactgggaaagggacattttgcactaatgagaagagctgagctgaagacgttagttgatatgcacggcaatgaggctggaaaaggtggagagctcactcgtgatgaaacaactatcattacaggagctttggagctgactcaaaagattgcaaaagatgccatgactcctatatctgaaaccttctcacttgacataaatgctaagctggacttacacacaatgggtatgataatgactagagggcatagtcgtgttcctatatactctgggattccaagcaatattattggccttatattggtaaaaaacttgattacttgccgagctgaggatgaagtgcccattcgtaatgttactatcagaaaaattccaagggtggctgatgatcttcctctctatgacattctaaatgagttccagaaaggtcacagccacatggctgtggtagttaaacgaacaaaggaagcaggagtatccactgaaaaccaaaagagcacaactgcagattataaaataaaccccaaagatgctcatgctgatggctcatccccttcttatgctaacaacactgctggaagtcgtagatttaacatagagaagcatggagacgggcgctcatgtaataagaaatcagaaaagaagcgggaaaatattcttgattttaacacagatccacttccaagctattcaatggatgaggcggcagtcggaataatcacgatggaagatgtaatggaagaacttctacaggaagaaatctatgatgaaacagatgagtatgttgatgtacataacaagatcaggataaacatgttacctccaggcaaatcactgtcacctaccatatctcctggtggtggacccttatctcaggggctccgaaagactcctatggcatctccgttctcaccatactaccattgtaattcagtgttacgttccccagcttccaaccattgtcagtcacctgggactctaccgacaatactttcccctggaagatcacctactgcacaaacacctgggcaaagttcaccaaatggaagtcaggtttcaataaattccaacggtcaacataaaaaggacggtgagaactaacataccagaagattgttttccagacggtctcgtctcaagacgggatgcatgattaaatcatgaaattgctagcgtaggattaagctgcgaatataagtagcacagctctcttgaatggttagtggcccatgtatttattgattgtttgcttgtacatatatgctccggcatccggaccttagtatggcctaatcctcactatgtatcatacataggaagtgaatgggagccaatataattttgctctagacaattttagctaaaagcctggacccttacgtcagccttccacataaacacaacgttaagtgagt

SEQ ID NO: 9721 - DNA, 1108 bp, Zea mays
ttgggaccctcgaggccggccgggaagccgttgaacgcgttgggcggacacaccccgcgccccgcccgcattcttctagagacccccatcccagccgccagttcccggacaccggattgctccccaagacaagcccaaatctgggaccataaacaaaccgcacccgagcggcccaaatcgggatctgacggcaattccccaattcgattccatcccatgggttggcgttggcacgacgacgacggtgacagcggccggggcctcggcggtgtccctgacctcgctggtggcgggggcgatggggcgcagtgcgccacgcgacgggtggtgcagtcccgctgccacacggaggaagtcgagcccggccgatttgtccgcaagtgcgagaagacggagcagctcctccgcgactgcgtcggcaggccctctgaactggtggaatccaaaactgaaaacactgaagaagatgtcacagaagaaatgaagagcggttcactttctcttgggtttccaagaaacgagcccttcgcattccctggactccgcagtgacatggaagcccttgagaaagacttctttgggagcctagggaacgtcctggatgaagctgagcggatggccaacagcttcgtcagatcttttggttttccacctgctcatgacagcggatcaagtccatttcgaagacagcctgcagagaggcatattgaggaagataccgcaaagaataagactgagagcgactactcagaattcaggagcaagatttcagatgtgtaagcagctgtagagctgcagttatctggcctgtgtccacagagctgaaacctgagaagtgagagctttgcaatctcacggtccttatatgtttctctttggaacaaaataggtacttgcggcctgcaggtgctgtttagcctcgcttagtatggtaatcgtaatggtagatgaagtgatttgcctgtcagaggtgaggagtattatctgttatgttcggttttgcagggccattttgtacagtactttttgcagacccagcatttgaaatgtttgcattcttgcgcacaggctatgtttggagcagaaacgtttgttatgagctttcccc

SEQ ID NO: 9722 - DNA, 3281 bp, Zea mays
  misc_feature (52)..(52): n is a, c, g, or t
  misc_feature (92)..(92): n is a, c, g, or t
  misc_feature (3224)..(3224): n is a, c, g, or t
  misc_feature (3226)..(3227): n is a, c, g, or t
  misc_feature (3229)..(3229): n is a, c, g, or t
  misc_feature (3235)..(3238): n is a, c, g, or t
  misc_feature (3241)..(3241): n is a, c, g, or t
  misc_feature (3247)..(3249): n is a, c, g, or t
  misc_feature (3253)..(3255): n is a, c, g, or t
  misc_feature (3278)..(3278): n is a, c, g, or t
ggattattttagggcatggattgtggtatggatttaattccaatccatgctnatacagagcgggattggtgtaaacgaacaaagcctaattnggctagccggggcgggacttcaccactgctttggaacaatgcctccctctttgatcatctcttctctgcccgcccgtgagtccaaaatccaaatagcagcaaacaaatggaaaatgttggttgttggtcatgacaacagttttaataatatagcaggtttagaaagaaggtatgcatgtcttgaaaatttttgatgtcaatgagtgataatcttgtatactaagggactagattataggaatctatggtccatcaaatctatgatacttctgagttacagtctggaagacttatagtcaactgaaaacctaaaatatgctctcgtgatgcctgaagcatgaaggtcaacgattttcttttcaacataggttcaatctgtcaagcaactattattactcaagaacaagcaatattttggaccttttccaaatgtttagcacgagcagtgtctggacctgcacatgttaaaaggtttacatgtgttcatgtccttaatgttgattccagttgttgcgtgctaccaggttgggttgtcaatcacatgctatcaaccttggattttgaaactctcttttagaattgcaataacttgaggaaggacaacagtcatgtcatcttggctaaccttcaggctgccgtttacatgtttagttcttataggtaaattttagtaaagttcttgtgtagctatgtattatgcatgagtattgagattcgagaattagtgaattggctgttggcatgaatcgtatcattagagcggcctatgctttgttgttaattcatgttgccggttcaagtattgttaatttttagggaaccatatcatgccactgctttggaacaacattaatgttcctctcagtgttacctgactaaccctcgtgactccctctgtctccctcttcaatcatcattcatctcttctctgcccgcccgtgactccaaatatgctgctcgaagtccgatgagcaagcacgctgccaatcacaaatcagctcgtgatcgcgttatcgccgcacagtagagtgttgactctgttttctcgtcactgatcgtcacagtacggcatcggcattccacggggtgtggactgcgaatttcgcgccattttccatccgttaattaacgccgagcatgacaatatacgtctcgtcgttcaccatcagcggaggcggccccggaacgaggtgctgactggtgagccgacgagcaagacgacaagagccacccccacccaccacatcacagaccacaaacgccatcatcgcaccgactctgatccaatttcacacgcatactagcgccgccggtagcagcaccggcagccgcgttcccctccgccatggatcccgcgaacagcagcgcgggcgccgagctcgacgacgcgtccgagtggcgcacccgggcgctgggcggcacggagtacagctggctccgcgccgtgccgggcggcacgggcaccacgctgctcgcgctccgcctatcccacggcgacgcggccgaggcggcgctgcgctccctgcgggacgcgcaccccgtcctccgcgcccgcctccggacctcttctccctccggcccgacgctggcgttccccgatccggcaccgccgttcctgctggcgccgatcccggccccgggctccgcgcccgacttccacgcgctcctcgagcacgagctcaaccgcaacccgtgggccgacgaccccgcgtcctccgacgacgccccggtcctcttcgcgacgctctacgagctcccagccgccacgggcggcgcggcgctgttcgtccggatccacacggtcgcgtgcgaccgctcggcggcgagtgcgctggccagggagctcgtcgcgctgctggccggcgccggcggcgaggagcccgacccggaggatgcggcggcggaagcggggctggaggcgaggatcccccagagggacacctggaagccgttctgggcgcgcgggttggatatggtgggctactccatcaacggcctgcggacgtccacgctgccgttcgtggagaccggcacggagaggtccacgcagatgctgcggctcgggctcggcctcgacgagacgacgaggctgctcgacgtaagttcaagcctggactgtttctactcctgtgcgtgcgagtgttttgcattggcaacagataaggcccgtagctcattgtcctctgtctaggcgtgcaaggagaacggggtgaggctgtgctccgccgtggccgccgcgacgatgctcgccgcgcggcagtcgaagccgctggagagcggccagcaggagacgtactctgtcgtgacccttatcaattgccgcaagtttcttgagccagtcttggaggaccgcaacgttggtgagtacgagtcctccgtctctccgatagtaagctcattcaatgttgcaatgctagaggtaccagtgtaccaccattaatccattgttaatgttgcagggttcttctactccgccatcaccaacacgcacacgatccacggcggggaagggctgtgggagctggccaagagatgccacgactcgtacaccagcgccaagagcaacaagaaacacctcaccgacatcagcgacctcaacttcctcatgtgccgggccatcgagaacccccagctgacgaccgccggcgcgctccggacggcgctcgtctccgtgttcgaggaccccgtggtcgccgacgtggccgaggcgcagagcaaggccggcgtggaggactgcgtctgctgcgccaccgtgcacggcatcggcccgtcgatcggcgtgttcgactcgatcaaggacggcaagctggactgggcgtgcgtctacccttctcctctgcactccaggaagcaggtccaggagatattcgacaaggtgaagcagattttgcgccatgcggctgcggctgaggagaattttgaagactgcacctaagtacctaacgatgtcgtcgggagctttatggggcatctcggtagagctattgctccatttgtgtctttgtgaggcattcttttctcgtgagggttgtaatgtaagtatagtgaaccttgtgttagcctttttattctttcaattctcggcgcaatgaaaattttccggtgggaggctggtagctttatgatccaaanannanaaaaannnnaanaaaaannnaaannnaaaaaaaaagaaaaaaaaaaaanaaa

SEQ ID NO: 9723 - DNA, 1502 bp, Zea mays
cattgggtacctcgaggccggccgggatgctagactggaggcggaaccgcgcacgacaccaagctgccgcgccggactgctgcacgcaagcgcagcgcaggaccgaccgacctccgtaggcacgcacggcgccggcggcatggcggagcacctcctgtcgacggccgtgcacgacacgctgccggggagctacgtgcggccggagccggagcgcccgcgcctcgcggaggtcgtgaccggcgcgcgcatccccgtggtggacctgggcagccccgaccgcggcgcggtcgtggccgccgtcggcgacgcctgccgctcgcacggcttcttccaggtcgtcaaccacgggatacacgccgccctggtcgcggcggtgatggccgcggggcgcgtcttcttccggctgccccccgaggagaaggccaagctctactccgacgaccccgccaggaagatccggctgtccaccagcttcaacgtgcgcaaggagacggtgcacaactggcgcgactacctccgcctgcactgccatcccctcgacgagttcctgcccgattggccgtccaacccgcccgatttcaaggagaccatgggcacctactgcaaggaggtccgggagctcgggttcaggctgtacgccgcgatctcggagagcctgggcctagaggcgagctacatgaaggaggcgctgggcgagcaggagcagcacatggcggtcaacttctacccgccgtgcccggagccggagctcacctacggcctcccggcgcacaccgaccccaacgcgctcaccatcctgctcatggacccggacgtcgccggcctgcaggtgctccacgccggccagtgggtcgccgtcaacccgcagcccggcgcgctcatcatcaacatcggcgaccagctgcaggcgctgagcaacgggcagtaccggagcgtgtggcaccgcgcggtggtgaactcggaccgggagcgcatgtccgtggcgtcgttcctgtgcccgtgcaaccacgtcgtgctcggccccgcgcggaagctcgtcaccgaggacaccccggccgtgtacaggaactacacgtacgacgagtactacgccaagttctggagcaggaacctggaccaggagcactgcctcgagctcttcagaacctagcgaatcggatacggatggatggatacattacatacgcgccctctgtttttctccatgacgttagaagaacacgttctgcaatgtttgtccattcaaggtggtatcaatcaaggctgtggtcgttgcaattcttccgctccatatacatgattaaatgctttgaaagaaaaagaaaaaaagaaacacaagtattatggcactactagtgtttttaggaacaaggaaagaggggttgcccctgctggctatatatattaaatataaataaaggtaaggctgtagacattggtgaataagagaaagtatttgagtttctctactgacaaaaaaaaaaagacttctttgcctcgat

SEQ ID NO: 9724 - DNA, 1365 bp, Zea mays
cctcgaggccggccgggaaagcaaggccatcgatcgataatgccccgtcccccctcgccccgccgtctcctcccgctgtccctccccgacgcgcgccagcgccgcggtattctcccgccggcggcggcggcggcggccttgttgccatcgtggtcttgttcgccgccattgtctcggcttcgatcacgggggcggcaggctaaaacgaggctgcgagtcgtctctcccgagacatccagcaccgctgccaccgacgctgcgacgacgaccgccggcgcgccgccagataacagcaagtgggcagagttcgcgacgcgagtgtccggcgagtgggacggcttcggcgcggacttcacggcgtccggcgaccccgtggagctgccggagaaggtggtcccggaggcgtaccgggagtggggcgtgcaggtggtggactggcagacgcagtgccccacgctggcggacccgggcgcgccgtgcgcgctgcactaccgcctggtccgcctgctccccacggtggggtgcgaggccgacgccgccaccgtgcacacctcccaccagcgccacgcctcctccgccgccgccttcgcgtacgccgccgcggggtcctacgtcgccgcgtggcccaggggccccgcgctcgtgctcgaggtggagcactgcgtcgtgcgccccgacgcgcccgccgaggaggccggcagggtccgggtggtgcagaccgtggcgctgggcagggaggcgcggctccgcgggctcaaggtcttcgccgagcagtggtacggcccgttccgcgacggcgagcagctcggcggctgcgccgtcggggagaccccgttcgccgccggggagaagctcgacgtcgccgaggtgatcgggcagtgggagaccacggaccccgcccccgcgaggttctccggcgacctggaccccgagacgggaaagttcgcggagctgtcgccggaccacccgaggaagctggtgagggacgcggagggcgtcgtgacgctgccgaagcagctgtggagcgcgttcaaggagctcggcgacggcgagttcctgtgcgaggtcggctgggctctgggcggcggcggcgccgtcacgtcgcgctgcgttctgtccaaggacggagacgtcaaggagatcgctgccgcccacgagcgccgggtgtcggagaccacttgacttcggggccaattggccatacccgatccaacagagaacaaaacgcgctgctcgatgagccaactcaatttggtatcttcgaatcgaaggtacaacgactgcttggccgtctaacctcaacactcttcgccttaacaatcatcatttagacgattgcaacatttctgttcatttggccgtttc

SEQ ID NO: 9725 - DNA, 1656 bp, Zea mays
cttccaacagacgccaccagccaccgcgccatcgtctcagtgtcacagcaggaagccgcgctcccgccagccgttagctgctcccaacagcggcgggatcagggcttgcgatttggcagacgcgagtccccccacccccccggccgcttacttcatgcctccatggatccggtcgcggacccgtcgccgtcgcggcggtccctgaagcggaggccgccggcgcggtcgccggagctgtcgcccaagtcgggtccgggggcaggagaggcggcggcggaggggctgatccggcgggtagaggagctggaggcggcggcggcgcggctgcgcggggagaaggaggcggcggaggacgcggcgcggggcctgcggcaggagctcgacgccgagcgggcctccgcggagacggcggccagcgaggccatgctcatgatcgagcgcctgcagcgggagaaggccgccgcgcagatggaggcccgccagttcaagcgctacgccgagagccgcgaggacagggagcgcgaggtccaggaggagctcgcctcgctctccgacctcgccgcctcctaccactcccgcctccagtcccacggcatcgacccggactccttcaccgacgacgacgatgacgagtcgtactcgtacgaggaggtgggcgccgaagacgtggagcagatcggcatggccgcgctgcaggtggagcggaacgttcgcgactcgggcagtggcatggaggtgaaagccatggtcgttggcaatgaccgcggggaggacgaggaggatgccgacgccgacgccgacgacgcggaggagccgtcgtcccccgtggagaaggaattcgagtatacggtggatgttacctgcgcgagtacaacgaagccagctacgtctgtggttgcacagtacgtgggggacggcaactcgggggggctgtatgcaagggtcgaggcgctggaggcggacagggcggccctgcggagggagatcttcgctctgcgggcggagagggcacagctggtgatggccagggagatggcgcggcggctctgctgggagatggttgctgagcagagagccattgtgaagaaagcgctagtgcctgcgagcagtttctcagtgatcaggatatgcaagtgggtgctctcaatactattttggagaaacagaagctctacagccaagtacacctttggtttgtcgactacgttccttggcctcctgctgcttcttgacagatccgcattgttgagttcctggcgacgtctgccatggccacaaagatgaatgcaaccttctccataccaacagccaaatgcccttaaattcagagatttgaacagttaagctttattgtgcatgtgtattgattctttggtgtttctttttccttttgccacgtacagtattggagctgtacgtttttttcccctgaagctttgagctgccgtatagtgtgtaatttagactactaggcttgaatagtttgtaatttggggcgacatgctctgtatagagtgtacatcatagtaagttgtggaactccgatttgttttgtatcgtcgtggtgaccttgcttaatgtcagatgtcgaaggccattacgaggccttttttcgcaaaaaaaaaaaaaaaaaaaaaaaaaaaaatataaaaataa

SEQ ID NO: 9726 - DNA, 1948 bp, Zea mays
agcgattttgttcgtcttcttcctcagttgttcgacgccagcgacagcgggtgttcgggaggcgatcgggacctgacactccgctcccctccggaatcgatgtcctcgtctcctgctcggtttggtactttggttggcgtacggcgacgtggaaagctcacccgtatagtagtagaataatgcaatgagatggaatggccctcctgtcatctcccccagtcacatctcgactgaattattcaattctcaatgctgctgagcagctgctgtgccgccgccgccgccttctcctaatccagctgctccaacctagctcacgtcgcttccaacagacgccaccagtcgtcgcccgccctcgccctcgtctcagtgtcaaagcaggaggcggcggtgccgcgcgccccgccaaccgttagctcccgagtcccgacggcgcggcggaatcggggcttgggactggggaggcgcgagtccccgggcgcttacttcatgcctccatggatccggtcgcggacccgtcgccgtcgcggcgatccctgaagcggcggccgccagcgcggtcgccggagctatcgcccaaggcgggtccgggggcaagggaggcggcggcggcggaggagctgatccgtagggtggaggagctggaggcagcggcggcgcggctgcgcggggagaaggaggccgcggaggacgccgcgcgggggctgcggcaggagctcgacgccgagcgggcctccgcggagacggcggccagcgaggccatgctcatgatcgagcgcctgcagcgggagaaggccgccgcgcagatggaggcccgccagttcaagcgctacgccgagggccgcgaagacagggagcgcgaggtccaggacgagctcgcgtcgctctccgacctcgccgcctcctaccactcccgcctccagtcccacggcatcgacccggactccttcaccgacgaggacgatgaggaatcatacgaggaggtgggcgccgaagacgtggagcagatccacatggctgcgctggagatgaagccgaacgcccgcgagtcgaccaatggcatggtgaaaaccatggtcgttggcaacgatggcgaggaagaagtggaggacgccgaggaggagccgtcgtccccagtggagaaggaattcgagtacacggtggacgttacctgcgcgagcacaacgaaaccagctacatctgtggttgcagagtatgtgggggacgggaactcggggggattgtatgcaagggtcgaggcgctggaggcggacagggtagcgctgcggagggagatttccgtgctgcgggccgagagggcacagctggtgatggccagggagatggcgcggcggctctgctgggagatggttgctgagcagagagccatcgtgaagaaagcagtagtccctgcgagcagtttctcagtactcgggatttgcaagtgggtgctatcaacactgttctggagaaacggaaggtctacagccaagtatacctttggtctgtcgactacgttccttggcctcctgctgcttctcgacagatccacgttgttgagtccctggcggcgtctgccaaggccacaaagatgactaaggccttctccataccagcaggcagcagccaaatgctcgtaaatccatagatttaaacagttgagctttattgtgcatgtgtattggttctttggtgtttcttttttccttttgccacgtacagtaattggagctgtacgtttcggttgtgaagctttgaggtgctgtatagtgtgttattcagactactaggcttgaatagcctgtaatttggggctaactggcatgctctgtatagtgtgtatatcatcgtaagttgtggaacaccatgttgttttgaacgcggggggtttgccggggggcggggttttttttcctgcccccaacaattgatgtcagcggggggggtg

SEQ ID NO: 9727 - DNA, 5957 bp, Zea mays
ccccaagaggaatattgaaatgtaaaacaaatctacatatgattgttctggtctctgattgtatatttacaattattgtacgcctttcatagatagaaaacaaataaattataatatatattttttgtaatccataacaaggttatcttcagcatattgttaaaatactattttataatataaactgtaatgtttatataataaagtttgaaatatgagatacgatatataagttggtgacaacataaggacggaaccttctatagaggacacttcctaatctgcataatcaaatgcttctagaggggtagaacgcatcctagttcggataatcaaatgcttggaatttcaggaatgtgaacctacatgcttcgagagaacgaatgtagatgtctgggaaggtaggcatgaaaaagaacaacttacctgtttacagtgaatagcagaacgaaatagcactagttaattttgcaaacacgaagcattgaaacatataactgactgacaaatgaactattgttattagttgacaaatgtgttcagtaccatttaaacaaactacaacggattgatccaaatacagtaatgtgccagcagaccaaaagctgtatcgctaatggaagatatatcggtattacttgagatgttaagggctagtttggaaaccacgattcccaagtgatttttattttcccataagaaaatgaactatttttttttggaaaaataaaaatctcttgagaaattggggtttccaaactagctctaagtaaacaaagtttgatgtgatataggtagatttttagcacaagcagaacatgtgtataactgtagacacgaggaagaacataatttcacccttttgcaagttatagcaacacatttttttctgatatttttttttgggattgttcggttagggctagtttgagaaccctattttattttatttttttttcaaaaaaattagtttactttttcataaaaaaataggatcctttggaaaaataaagtttctaaactagctcttagagatagattgaggaggattgaaggatattatatctttttctagacaaatttaaatagaaagtaattagatccctcaattcctccggtttaggtgaaacggaacatgcccttgatatttaatttttccccaatctcctaatggaacctatgatatacccatttgcagagttatagcaactctaagggctcaaaacctaatccatcgaacatgaatcgggaactcggagtgaaggatgccccataaactcgaaaacttcatgcggcagcataagaaaatggttgtgttttccaagcaaaaatcgaattgcattgcaaaagtgcttcggtggggaaaaaataaatgagaatttctaccttcagccctaacggcctcatcctcattgggattgttggtccagcgcagctgattcatggatcgataccaaatcatgagctgacaaatcttcccttcagaggcaaggcagaagaaacagtcggtagcatcggcggcgagtgtgcgggagtccggttggtcaatcttggaggcgtcatcgtcggcacggtggtcaatcttggagggacacgtgcttgggccttgggaaacaagcaagctagtagtagaagaaacaaaggcgccattgatgagaagacggaaggctggtttgcatttgccgctgagatctggtaacgcctcgcctcgtcagcatctctataaacgtagaattcagttcccggccccgcagccccgccccccgggcttctctcaccaacacccgcgatgtcatcctcctcgccgccgccgccgcacgtcgtcgaggacatgccccatgtcctccagcttctcagcgacggcacggtggtccgcttcgccgactacgacacgctccctcccccgtccgtgcctcccgcgccgctgcccgtccggtggaaggacgtcgtgtacgacgccacccacggcctcaagctccgcgtgtacagtcccagtccgccggcctcctgcggcaagctgcccgtgctggtctacttccacggcggcgggtacgtcctcggcaccttcgcgctgcccagcttccacgcctgctgcctccgcctggccggcgagctcccggccgtcgtgctttccgccgactaccgcctcgcgccggagcaccgcctccccgcagccctcgacgacgcggcggccgtcatgcgctgggtgcgcgcccaggccgtcgcggcggggggaggggacccctggctcgccgactcggctgacccgggccgggtgttcgtcgccggcgactcagcgggcgggaacatcgtccaccacgtcgccgtccgccgcctcggctcggcggcctcgggcgaggagctcgacccggtacgcgtcgccgggcacgtcatgctctgcccgttcttcggcggggccgagaggacggcgtccgaggcggagttcccgcccggcccgttcctgacgctgccgtggtacgaccaggcttggcggctggcgctgccgccgggcgccacgagggaccacccgttcgcgaacccgttcgggccggagagccccgcgctgctgggcctgcgcgacgtcgcgctcccgccgacgctcgtcgtggccgcggggcaggacctgctgcgcgaccgccaggcggactacgtcgcgcggctcaaggcgatgggacagcacgtggagcatgtcgagttcgagggtcagcaccacgggttcttcaccgtggagccggccagcgacgccagcagcgagttggtccggctcgtcaagcgcttcgtgtatggcgacggcgacggcaactccatctaaactggactcatgagccatcatgatcatgacctttgttgttagcttagcacgagtactcgcgtgacacgaacagagctgaagttggcctaacctgccacgcgcaccaagctggatgttcgatcagcgacaagccatgttaggtacggcgccaccatcagtccaccagcactgttcgaatctgacatcagttggcttaggcctatgtttcctccagctttttatcagttcagatatgaacagctaggaaagttttatttcacagtgtcatcgtcgatctcgccgattagtaaatgaataaatttgtgcatgctagtaattgctaaagacatgtttcgtcaacgaggagaccttgtctggctgtccgcctgtccccgacgaaataattcacccggcccggcgaccacacgaagaaatggcgaaactcagcagcagtttccgccaccgaatcgcgaaacatcctagcgctggtttccggcgttccacatgcaaacggccgcgaaaaaattatacacgagactgccggtggctagctactgtttcctgccgccggcgacgtgaaattcgcaccggcaccgaattctttcctcgcacgactttccgcggctagtggccgttcgcccgttcaccctcgacatggtgggagcgtgacgccgaatcacacaaccgccaggccaccagctccgactcgttgcagttggcagttgctggtgcagcaggccgcagcgcctttcccttccatttcgcctttgctccgcctccgtgttagttagtttcagagtttagttaagtctgcatctttcatttcagtgtctgtaaaataatagttggctgagtcagggagctgtcctgatcgccacggagtggaggtccgcgcaaagcgtgctcacgtgagagttcatgccggtcttctcgcccactgatggtgtgcgcggcgtggtagtcatggcgccaaatacggaagacgccagaagactggactgcatgtgttgcatcttataaatgaaaaaaaccaaaaaggcggcggctggtgcgatttgttctggccgtccaaaaaaaaacatcgtctgagtactctctgtttttcctcccagcgattttgttcgtcttcttcctcagttgttcgacgccagcgacagcgggtgttcgggaggcgatcgggacctgacactccgctcccctccggaatcgatgtcctcgtctcctgctcggtttggtactttggttggcgtacggcgacgtggaaagctcacccgtatagtagtagaataatgcaatgagatggaatggccctcctgtcatctcccccagtcacatctcgactgaattattcaattctcaatgctgctgagcagctgctgtgccgccgccgccgccttctcctaatccagctgctccaacctagctcacgtcgcttccaacagacgccaccagtcgtcgcccgccctcgccctcgtctcagtgtcaaagcaggaggcggcggtgccgcgcgccccgccaaccgttagctcccgagtcccgacggcgcggcggaatcggggcttgggactggggaggcgcgagtccccgggcgcttacttcatgcctccatggatccggtcgcggacccgtcgccgtcgcggcgatccctgaagcggcggccgccagcgcggtcgccggagctgtcgcccaaggcgggtccgggggcaagggaggcggcggcggcggaggagctgatccgtagggtggaggagctggaggcagcggcggcgcggctgcgcggggagaaggaggccgcggaggacgccgcgcgggggctgcggcaggagctcgacgccgagcgggcctccgcggagacggcggccagcgaggccatgctcatgatcgagcgcctgcagcgggagaaggccgccgcgcagatggaggcccgccagttcaagcgctacgccgagggccgcgaagacagggagcgcgaggtccaggacgagctcgcgtcgctctccgacctcgccgcctcctaccactcccgcctccagtcccacggcatcgacccggactccttcaccgacgaggacgatgaggaatcatacgaggaggtgggcgccgaagacgtggagcagatccacatggctgcgctggaggtgaagccgaacgcccgcgagtcgaccaatggcatggtgaaaaccatggtcgttggcaacgatggcgaggaagaagtggaggacgccgaggaggagccgtcgtccccagtggagaaggaattcgagtacacggtggacgttacctgcgcgagcacaacgaaaccagctacatctgtggttgcagagtatgtgggggacgggaactcggggggattgtatgcaagggtcgaggcgctggaggcggacagggtagcgctgcggagggagatttccgtgctgcgggccgagagggcacagctggtgatggccagggagatggcgcggcggctctgctgggagatggttgctgagcagagagccatcgtgaagaaagcagtagtccctgcgagcagtttctcagtactcgggatttgcaaggtatacattttgctaaccacattggccattgtcatccaactcttttctgtttaagtagcatcgattttgttccttaaaagggtgctaagttaggcacatttggagtattcagtcacattgcaatgattgacttggtagaaagattttcatgtgatttcttacggtgggttagaggaaatagtcttttagggaagtgagctgaggtgttataccgtagagtgacctgattacacaaaatcagggtttcagtgtttttcttcttctcatattcagggatgacggagtggactacatggcttataggctgaacttgcacagtgaagtacttctgtaaaactcatagtgcttctaaaatcaaaatattgagaggaaatttattttttcagtttatgtggttttggttcttggaaaagtaaagcagttctcatggcagaaatattttgctcttttgaattccttggtgtacacaggcaaatattagcatatttgaagagttgccattttgatcatcatcttcgtttgtactttttgggtcagatctattaaagcatcaacattaaatttacaagcttttggtttagttgtttggggcataaaaggaagttgtcctg

SEQ ID NO: 9728 - DNA, 5443 bp, Zea mays
  misc_feature (460)..(460): n is a, c, g, or t
  misc_feature (483)..(483): n is a, c, g, or t
  misc_feature (612)..(612): n is a, c, g, or t
  misc_feature (814)..(814): n is a, c, g, or t
cgttcaccgttcgttcatacgaactattcatcattcatcgatcattcataatccctattcattgttcattgttcgttcatacgaactattcatcgtccatcgttcgttcataatcacaattcatcaatcgaccgatcacctaattatacatctacctttccatcatgatgttcagcttacctaaaacatgtcagaccaatatctcagtcatacgaactcccctacaagatcaacggatagatcgtaacagacagttataatggttatatcaacggctataatcgctttaaatgtgtcatcagatatcagataaagtttgacgcgaacggtccagtcatgcctccggatggttcgcgtggatgctataattcattttactgaacccgacaccttcgggttggtgtgatcttcaacgggcgggctaccccttttcttatcggacgatccgtagttcatgtgntattttgacatagttcttatcgnatctgttcttaggtacttcgaacggtctagggcagaggactggacggtccacgatacaccaagttgagggatgatcttccttaacgtattttctgagtatctaaactcataacttagcaaactagtcanctcaattgattgtgatggtcgtcaattaccacaacaagtgtggaaaattggttgtgatggtcgtcaattaccacaacaagtgtggaaatggtttttatgtcaatttccccttcaaagaactcggcttgggttaggatgtggttggaggtcaagctctaatctatactacttactatattaagaacctgatgtggacaattgntgctaccacacttcatcctccccacgcccagcatccggaaaaaacaatacagaacgagcactcgaaaccacaccactctgctttagaaatttgaggctaaccatcagactacacatgtcttagcgtttagaaataaacaaaaattatatatgtaacctaggcaccattccccacactccctcgcctcgtggtaacgcacaggcacatacctagtgaccatataaaggcaacgactgtgcaagtaaaccatctggtccattagattgtgatccaacgtaggtcacatttaacacttaaacccttccactaccagctcaataatctttataacaaaccatgattgtatatgtggttggatcgtaatctaatggaccagatggtttgcttatacgtttgcaaagaatgactgcttgcatagttgcatagcagtcgttgcccccatataaaatagggagacgttaaaaaaacttttctacaagcggctgtgtagcatactttcgtgtccatctagcgatgatcatgtggtttgtcgattttaggttaattatctatttagatcatgttagagcagaaagaaacaaacaactatcgatcattgatagatagagcctaaatcttaaatcaggctacaaagccgcatccctaccactagccgtagagaactttttttcctgtgaaataatgaaattaggaaagcctagagcctccgcacaggtcgttgtacgtgttatttgaaaaccgtcctaacgtggcgttacaaatgttgatcttatcccgtttgtttagagcaataacctaaatacaacaggctagaaaaacttaccgagggggaaaaaatatatatataacaacctaatctgccgaaccaagcaaccgaggataaatacaccagaaagagatatctcaacaccctcgtgtcatggctgtactgaaccgttttgcgttcactgtatcaagtggtcatcatcaatagacgatgtgtggacgaggacagatgtgcggaaagcacagagctgaaattagcataaactagaccggccttgctttcgaacttgatgcaggattcagcactagtcatcaatcagcgacaagccgtgttaggtacggcggcgccaccatcgaccgatccgtcggctttagggctatctttagtccagcttttataggttcagaattcagaaataaactagctccattttatagtggtagttcgtgataaaaaaaagaagagaacctggcctaatccagtaataacgtgcacaaccgtcgtcaacgcggagacctgtctgatgtccgcgacgaatcattgatccaccccggagaggggagaagcaacgaacgacaaccggagcggcgggcgaccacacgagatgactaaacacagcagtttccgcgccgtttccgtcgccgaactgctaaacttgggccaatcatagtatttttgcagttttgaaacaatactatattatttgatgtgatgatactatagtatttgagctcaaaaggtgtttggtttgtatagtcaaaactcagttttaaataccatggtttacccaaaactgtggtatttttggagttttcgaaactctactcatgacctcggtttttttctcttctctctacatatactttgttttttcaataaaaccaaacagatctcggttttgaacaatactttagttttactatggtaaagcaataccgtagtatttttgtcatgtaccattgtaaactatggtatctcaaaacaaaactacagtatttcaaaattgcattttcaaatttgtttacgaacatgtacgaactacctaacactcgtcaggtactcggagtaggagtacgactcgtgtcgtattccattccacctgcaaatggccggaaaaaacgatacgtggccagatactgtttgctgccgccggcgacgtgaaattcgcaccggattctttaccccgcacgactttccgctgttagagctagtttgtaagctttctaaggaatttttattttctcaagaaaaaataaattaatttttcttaaaaaaatgaaaatcccataaaaaattagaattctcaaaatagtcgtggccgtccacactgcacacactaccagctccgactccgtgcaggtgcagccgcccctttccccggaatcgtctattcgatgtgctcgtctgacctccctcctctcctgctggcgccctcgctttgcttccaatgggacggaaaggaaggaaacggtttgtgtttggcgtaaacggcgacgtggaaagctcacccgtatactacagtagcagaataacgcaatgcgatggaatccatctactctcaccaatgcccaatcacatctcgacttgatgctgccaccttttcctaatccagctgctccagcctagctcacgtcgcttccaacagacgccaccagccaccgcgccatcgtctcagtgtcacagcaggaagccgcgctcccgccagccgttagctgctcccaacagcggcgggatcagggcttgcgatttggcagacgcgagtccccccacccccccggccgcttacttcatgcctccatggatccggtcgcggacccgtcgccgtcgcggcggtccctgaagcggaggccgccggcgcggtcgccggagctgtcgcccaagtcgggtccgggggcaggagaggcggcggcggaggggctgatccggcgggtagaggagctggaggcggcggcggcgcggctgcgcggggagaaggaggcggcggaggacgcggcgcggggcctgcggcaggagctcgacgccgagcgggcctccgcggagacggcggccagcgaggccatgctcatgatcgagcgcctgcagcgggagaaggccgccgcgcagatggaggcccgccagttcaagcgctacgccgagggccgcgaggacagggagcgcgaggtccaggaggagctcgcctcgctctccgacctcgccgcctcctaccactcccgcctccagtcccacggcatcgacccggactccttcaccgacgacgacgatgacgagtcgtactcgtacgaggaggtgggcgccgaagacgtggagcagatcggcatggccgcgctgcaggtggagcggaacgttcgcgactcgggcagtggcatggaggtgaaagccatggtcgttggcaatgaccgcggggaggacgaggaggatgccgacgccgacgccgacgacgcggaggagccgtcgtcccccgtggagaaggaattcgagtatacggtggatgttacctgcgcgagtacaacgaagccagctacgtctgtggttgcacagtacgtgggggacggcaactcgggggggctgtatgcaagggtcgaggcgctggaggcggacagggcggccctgcggagggagatcttcgctctgcgggcggagagggcacagctggtgatggccagggagatggcgcggcggctctgctgggagatggttgctgagcagagagccattgtgaagaaagcgctagtgcctgcgagcagtttctcagtgatcaggatatgcaaggtacacatcttgctaaccccattggtcattgtcatcgaactcttttctgtttaaatatcatcgattttgttagttaaaggtcctatttgggcacatttggagtattcagtcacattgcagggattcacctgatagaaaggttttcctgctgtctttggtaaaaatgaaatgttggcaagtcttttctggacaagagaagtaattagatccttacattgcagtgtcctgaaatagccgcataattcggtgatctcttgctgtggcttggaggaaatagttttttaggatcaggtgaactcaagtgttatacagtatagtggcaagattacacaaaattagagctttagtttttgtttctcagcttcagtgatgggggagtggactacatgttccaccttttgatatcattgcagtgcttttgtcatttttggttaaatttgtaggctgaacttgcatagtgaagtacttcggtaaaactcaaagtgcttcagaaatcaaaatattgagaggaaaactgatatttaagttttacgtgattttggttcttggaaaagtatgtaagtacttatcatggcagaaatatgttgctcttttgagttccttggtatatgcacactggcaagtgtgtgagattagcatcttttcaatagttgcattttgatcaccatcctcagttgtacttttttaggtcagatctgttaaagcatcaacattaaatttacaaactttttctttagttgtttcggcgcataaggaactcatcatattattgtaccccctgtctgtgttgtgcaattatgttaagatccatcgctgcaggtcgtctttgagttattagacaatgttactcgtaagatttttaatattcttgtaagtatccatatctattggtggtatccgcatttatatttttttcaattgaatttaatacacgcccacattgatgtttacaaaaaatgatgcttgagttgtgtgtacggcacgagcaaatatttatgttgttctacctcatatgcttaatgtgtaattcagtaaatatccattaatacagaccataatggaattactagaaacttatgtcctcatgttgtact

SEQ ID NO: 9729 - DNA, 3464 bp, Zea mays
cggacttgatgctgccccttttcccggtccccctgctccagcctagctcacgtcgcttccaacagacgccaccagccaccgcgccatcgtctcagtgtcacagcaggaagccgcgctcccgcccgccgtgccgcacgcccgccagccgttagctgctcccaacagcggcgggatcagggcttgcgatttggcagacgcgagtccccccacccccccggccgcttacttcatgcctccatggatccggtcgcggacccgtcgccgtcgcggcggtccctgaagcggaggccgccggcgcggtcgccggagctgtcgcccaagtcgggtccgggggcaggagaggcggcggcggaggggctgatccggcgggtagaggagctggaggcggcggcggcgcggctgcgcggggagaaggaggcggcggaggacgcggcgcggggcctgcggcaggagctcgacgccgagcgggcctccgcggagacggcggccagcgaggccatgctcatgatcgagcgcctgcagcgggagaaggccgccgcgcagatggaggcccgccagttcaagcgctacgccgagggccgcgaggacagggagcgcgaggtccaggaggagctcgcctcgctctccgacctcgccgcctcctaccactcccgcctccagtcccacggcatcgacccggactccttcaccgacgacgacgatgacgagtcgtactcgtacgaggaggtgggcgccgaagacgtggagcagatcggcatggccgcgctgcaggtggagcggaacgttcgcgactcgggcagtggcatggaggtgaaagccatggtcgttggcaatgaccgcggggaggacgaggaggatgccgacgccgacgccgacgacgcggaggagccgtcgtcccccgtggagaaggaattcgagtatacggtggatgttacctgcgcgagtacaacgaagccagctacgtctgtggttgcacagtacgtgggggacggcaactcgggggggctgtatgcaagggtcgaggcgctggaggcggacagggcggccctgcggagggagatcttcgctctgcgggcggagagggcacagctggtgatggccagggagatggcgcggcggctctgctgggagatggttgctgagcagagagccattgtgaagaaagcgctagtgcctgcgagcagtttctcagtgatcaggatatgcaaggtacacatcttgctaaccccattggtcattgtcatcgaactcttttctgtttaaatatcatcgattttgttagttaaaggtcctatttgggcacatttggagtattcagtcacattgcagggattcacctgatagaaaggttttcctgctgtctttggtaaaaatgaaatgttggcaagtcttttctggacaagagaagtaattagatccttacattgcagtgtcctgaaatagccgcatagttcggtgatctcttgctgtggcttggaggaaatagttttttagggtcaggtgaactcaagtgttatacagtatagtggcaactggcaagattacacaaaattagatttttagtttttgtttctcagcttcagtgatgggggagtggactacatgttccaccttttgatattattgcagtgcttttgtcatttttggttaaatttgtaggctgaacttgcacagtgaagtacttcggtaaaactcaaagtgcttcagaaatcaaaatattgagaggaaaactgatatttaagttttacgtgattttggttcttggaaaagtatgtaagtacttatcatggcagaaatgtgttgctcttttgaattccttggtatatgtacaccggcaagtatgtgagattagcatcttttcaatagttgcattttgatcatcatcctcagttgtacttttctaggtcagatctgttaaagcatcaacattaaatttacaaactttttctttagttgtttcggcgcataagtaactcatcatattattgtaccccctgtctgtgttgtgcaattaagttaagatccatccctgcagttgatgtttgagttattagacaatgttactcgtaagatttttaatattcttgtaagtatccatatctattggtggtatcgcatttatattttttttcaattgaatttaatacgcgcccacattgatgtttacaaaatgatgcttgagttgtgtgtacggcagtaacggcacgagcaaatatttatgttgctctacctcatatgcttaatgtgtaattcagtaaatatccattaatacagaccataatggaattactagaaacttatattctcatattgtgctatatttatattgatgttttcaatggttattacactttttatagaactttgggtagaggagctcatttgccattgttccctaatatgcagagtaaattgtcgagagccatttgagctaatttttagtcaaccacctgttcgagttagctttttcttcaacatgtcaaggcatgttgcttgcgtagtaccctatgtcccaaaaaataaggcatattttttttgaataagtctttgaagttaaactttgaccattaatttcttttaaaatatgatatcaacaaatgcaaattaagcatcatattaaagtatttttgaatacgaattcaaatatataacatgtatacactaaaatatatgtttttttgctaaattgttggtcaaaatttaaaacgttgacttttctaaaaacatgtgcgtcttattttctgtggagggagtattgagtactgaaaatcgataaaatgacactgcaaatatagtacaatatattgtgttttgtgctatcactgtttcaattatgtcaacgcatgaagttgtatttgatatttcttgtagtataaatttccacgcccacaacattgctatgattcatccttgagaaaactaaatatcttttctgcagtgggtgctctcaatactattttggagaaacagaagctctacagccaagtacacctttggtttgtcgactacgttccttggcctcctgctgcttcttgacagatccgcattgttgagttcctggcgacgtctgccatggacacaaagatgaatgcaaccttctccataccaacagccaaatgcccttaaattcagagatttgaacagttaagcttcattgtgcatgtgtattgattctttggtgtttctttttccttttgccacgtacagtattggagctgtacgttttttttccctgaagctttgagctgccgtatagtgtgtaatttagaccactaggcttgaatagtttgtaatttggggcgacatgctctgtatagagtgtacatcatagtaagttgtggaactccgatttgttttgtatcgtcgtggtgaccttgcttaatgtcaaatgtcgaaggccattacgaggccttttttcgacgtttttgaagctgtaaccaacgcgattttgtatttttattatt

SEQ ID NO: 9730 - DNA, 2266 bp, Zea mays
actgccgacttctagcagttgttttataggttagtttcgccccgccgcgccggggttagtgtatcaaaaccaattcgcgacatcacttaggaaggggaaagcaggggccggaaaaagaagaagagacgggaatggcaagctccgactcaaatcccaccgatgcattcgagtacatgctgcttgagaaggatcctgatctctaccggacggttttctctggtccgagccagacaagcccatggattgacccgagtgtgttaaagctgaagcaccggatagggagaggtccatttggggatgtatggatagcaactcaccaccaaaggacagaggatttcgatcagtaccatgaggttgcggtgaagatgctgcatccaattaaagaggaccagctgcagatcttctcagcgaggttccatgagatcttcagcaaatgtcagggtctgggcaacgtttgtttcttgcatggcatctctacacagaatgggaggatttgtatagctatgaagttctatgaaggatccatcgggaacaagatggctcggcttaaaggtggaaagctccctttgtcagaagttctaagatatggggctgatttggcacgcggtgtactaggcctacacaccagggggatattgatcctaaatatgaaaccttgcaattttctcatagacgaaaatgattgtgctgtgctgggggattttgggattccatccctgctgtttggcctttcattacctaatccggaccttatccagaggcttggaactccaaattacatggctcctgaacaatggcaaccaaacatcagaggtccgattagttatgaaactgattcgtggggttttgcgtgcagcgtccttgagatgttgactggcattcagccatggcgtggaaagtcagcagatgagatatatcagttggttgtcttgaagaaagaaaagccaatattcccgtgcagtctacctccagacattgaaaatgtgctttctggatgttttgaatatgactttagaaaccgtcccttgatgaaagacattttgcatgcatttgagagtgctaaaggtgcagatcatgacaacattggttggggcaattctgaaaatgctatggtagacaggataaccatgccaaatcgcatcaattggttacactttaaggacaagcttcaagtgggcgacaaggtccgttcaagaaagcttaaaaactcttgcggtcctgaaactatggaaatccctgatggaaccatagttggcattgaggacgatggcgagcgtgacgcttacgttcttgtacgagtccacgcgctacacaaccctttaaaggttcgcttttcaacggtggagagggtaacatatggttttgctgctggagactgggtgcggctgagggaggaggacaagaagcgctctcaggttggcattcttcacagcatcgaccgtgacggtgcagtggcagttggtctgataggagtggataccccttggaagggcaattattcagacctccagatggctgaagcctactgtgtcggacagtttgtgcgcctgaaggccagcatttcaagcccaaggttcgaatggcagcgaaagcggggtggattagcttctactggccgaatttcacagatacatccgaacgggttgctcgtcgtgaaatttcctggcaagtttaaccttggcgaagtgtgcagttgcctggcagacccctccgaggtggaggtggtgagctttgacaaatgcgaggggattgtgaagaagtacgagcatctcgaggacttccattgggcagtgaggcccctgttcgttgctattggtttcctcacggcgatcaagctgggtgtttttgttggcaagagcatttcgaggccgaggagccggaaggttgccagcatctctgatcagagtggagattaccagcagcagcaccagcagcaggtagtccaacaaagtgctaatgcggcgtggcttcctccaccagttgcaaacatgttcttcggagatagtgttgggacttctggataagaaatcataactggcccggagttttgcttaaaatagcaatttggaattgtggttcctagttgtgtgcatatttaggcctgaaatggtttatcccttatctaagcatctgtacatatctgccttatgcaccacaagttctgtaaataaactctagaattatcgtcttaaacatacaagtatgcgaagctatttcttgcttaaaaaaaaaaaaaaaagccttcccaggcatgtcttatgtcccg

SEQ ID NO: 9731 - DNA, 1371 bp, Zea mays
cgaagtctacatgataggccccgactgccgagccgggacggtcgcgagagtgaaggcaaggaaaaacacccaaacggccaaaccccaggaagccccgtcggaccctacagaccctaaccctagcgctcccgacgcgccgcggagcgatggcgatggacgcggagcggcggcaggcggagctgatcgcgcagttctccgctcaggcggcggcgctttcgtccgcgccccagctcgccgcgctggtgcttgaggccacctcccacccggccctcttcgccttctccgagctcctcaccctcccggccctctccaagctcactggcacgcagtacgcgtcgtcactggacttgctccggctcttcgcctacggtaccctgaatgactacaagagtaattctggattccttccagcactgttgcctgaccaggtccgaaagctaaagcagctcagcgtgctaactctggcagagtcaactaagatactaccgtatgatcagctcatgcaagagttagacgtttcaaatgtaagagaactcgaagatttcctaatcaatgagtgcatgtattcgggtatcgttagaggcaaactggatcagctgagaaggtgctttgaggtacaatttgcagctggaagagatcttacacctgatcagctaaagaacatgatagagactttgtctgattggttgggaacatcagatagactgttgcatcaaattcaggagaaaatcaagtgggctgacacaatgagtgaggtgaacaagaagcaccagaaagaatttgaagacagagtggaagaggccaaaaaatcaatcaagaagttaaacaatttaagcaggcagacattgacttacgggggcatgacgagtttctctctgaatctggaggaataatggattttgaagaggaccgcgtccgaccaaaaaggaggaggcaaccaccggcgtagtttcaattagcccttaccaatctctcccagaatgggacctgctgataccttgattgagacattttgacgccggagttgagtaaactttgtacatctgtcgtgtgatgcctccactgtagcgagtctgtttattttgccttctggtcttggtggggacgtacaaggccaaacctaggcgttatgttgcatttatttggtagtaaatggcccatggaagaaataacgttgttatgattatggcactgggttattctcaagtgtactgaacgataacagaagcacctctgttaaatgatgattgactcgaggcttgctgacttgctgctctagaggagttagcatagctgctcaggtatacaaactgccagccttgccgccgcgcgcctctaaaaaaaaaaaaaaaaaaaaaaaaaaaaaaaaaa

SEQ ID NO: 9732 - DNA, 1381 bp, Zea mays
aatacttttaatcttgctgcttctaatagaccgaaggagtggaggtcaaatagcgaaaggacgcacgaaccccaggaggcaccgtctccaaagtccaaaccctaaccctagcgcccccaactcgtcgccgggagatggccatggacgcggagcggcggcaagcggagctgatcgcgcagttctcctctcaggcggtggctctttcgtccgcgcagcagctcgccgctctggtgctcgaggccacctcccacccggccctcttcgccttctccgagctcctcgccctcccggccctctccatgctcgctggcactcagtactcgtcttcactggacttgctccggctcttcgcctatggcaccttgaaggactataagaataattcgggatcccttccagcattgttgcctgatcaggtccgaaagctaaagcaactcagtgtgctaactctggcagagtcaactaagatactaccatatgatcagctcatgcaagagttggatgtttccaacgtaagagaactcgaagattttctaatcaatgagtgcatgtattcaggtatcgtcagaggcaaactggatcagctgagaagatgctttgaagtacaatttgcagctggaagagatcttacacctgatcagctaaacaacatgatagagatcttatctgactggttgggaacatcagatagcctgttgcatcaaattcaggagaaaatcaaatgggctgacacaatgagtgatgtgaacaagaagcaccagaaagaatttgaagacagagtggaagaggccaaaaaatcaattaagaagttgaacaatttaagcaggcagacatcgacatacgagggcatgacgactacctctctgaatctgtaggaataatggattttgaagaggaccgtgtccgaccaaagaggaggcgacaaccattggcgtagtttcaattaagcccttacaaatctctcctacaatgggaactgctgataccttgattgagacattttgacgccagagcgaggaagcattgtacatttgtcatataatgcctccagtgtagcgagtcagatattttgccttctggtcaaactgctcgtgtgtgtgtgttttggtagggaatgtacctcggccgcgaccacgctaatgttgtattttttggtagatgacccatggtagaaatagcgctgttatggttatggcactgcgtttttctccaagtttcatttcgttctgtcatgttttgatgttttgtgtggtggggtgctcgcagggtcgtggccatgggcgaggtgccctatttgccattgatgtgacgtgaatcttcgccgtttttaattttaagatgatatagatccgttcccaaaaaaaaaaaaaaaaggggggcc

SEQ ID NO: 9733 - DNA, 1245 bp, Zea mays
aacggtcgcgagagtgaaggcaaggaaaaacacccaaacggccaaaccccaggaagccccgtcggaccctacagaccctaaccctagcgctcccgacgcgccgcggagcgatggcgatggacgcggagcggcggcaggcggagctgatcgcgcagttctccgctcaggcggcggcgctttcgtccgcgccccagctcgccgcgctggtgcttgaggccacctcccacccggccctcttcgccttctccgagctcctcaccctcccggccctctccaagctcactggcacgcagtacgcgtcgtcactggacttgctccggctcttcgcctacggtaccctgaatgactacaagagtaattctggattccttccagcactgttgcctgaccaggtccgaaagctaaagcagctcagcgtgctaactctggcagagtcaactaagatactaccgtatgatcagctcatgcaagagttagacgtttcaaatgtaagagaactcgaagatttcctaatcaatgagtgcatgtattcgggtatcgttagaggcaaactggatcagctgagaaggtgctttgaggtacaatttgcagctggaagagatcttacacctgatcagctaaagaacatgatagagactttgtctgattggttgggaacatcagatagactgttgcatcaaattcaggagaaaatcaagtgggctgacacaatgagtgaggtgaacaagaagcaccagaaagaatttgaagacagagtggaagaggccaaaaaatcaatcaaggcagacattgacttacgggggcatgacgagtttctctctgaatctggaggaataatggattttgaagaggaccgcgtccgaccaaaaaggaggaggcaaccaccggcgtagtttcaattagcccttaccaatctctcccagaatgggacctgctgataccttgattgagacattttgacgccggagttgagtaaactttgtacatctgtcgtgtgatgcctccactgtagcgagtctgtttattttgccttctggtcttggtggggacgtacaaggccaaacctaggcgttatgttgcatttatttggtagtaaatggcccatggaagaaataacgttgttatgattatggcactgggttattctcaagtgtactgaacgataacagaagcacctctgttaaatgatgattgactcgaggcttgctgaaaaaacccccaacaggagttagcatagctgctcag

SEQ ID NO: 9734 - DNA, 788 bp, Zea mays
ctcgaggccagctgcatcaggatgacgtccgcacgcctcttcacctgctgctgctgctccagggaccggccgtctccgacgacgagaatgcgcgcgtcctcctcctcgtccttgctgctgctgttggcggcggcggccgtgggcgtgctgctgcaggccaggccgtcggagtgcgcgcgcgccttcttcgtgttcggcgactcgctggtggacaacggcaacaacaactacctcatgaccacggcgcgcgccgactcgccgccgtacgggatcgactacccgacgcaccgccccaccggccgcttctccaacggcaagaacatccccgacatcatcagcgagcacctcggcgccgagcccacgctgccgtacctgagccccgagctccgcggccagaagctgctggtcggcgccaacttcgcgtcggccggcgtcgggatcctcaacgacaccggcttccagttcgtggacatcatccggatgagccgccagctgcactacttcggcgagtaccagggcaagctaagcgcgctggtgggcgcggcgcgggcgcgccagctcgtgcgccgctcgctcgtgctcatcacgctcggcggcaacgacttcgtcaacaactactacctcgtccccttctccctgcgctcccgccagttcgcgctgccggaatacgtcggctacatcgtctccgagtacaagaagatcctcatccgcctgtacgccatgggttgccgccgcgtgctggtgacgggcacggggccttttggggtgcgcgccggcgatcctggcgc

SEQ ID NO: 9735 - DNA, 1242 bp, Zea mays
  misc_feature (178)..(178): n is a, c, g, or t
  misc_feature (1232)..(1233): n is a, c, g, or t
gagtgatgagttcgctcgttattcttctctcatgtggctccgagatggaaacagaggggctcaatcactgaacttccagggacttggagcatcatcatggcttcaaaccaagaatagattatccattattaggtctgaagccagatacttaccagcagatggctgctgctgcactggnaagaaattagagctggggatcatttgaagcagatatcttctctcctgccagtgcaacagcctcaaaatttgagtggtggattagatcctttatatggaaatcctgttctgcagcagatgcagttccaatctcagcagtcatccttgcaagttgtgcagcaaggttatggtccaaatgcaagcgactctgggttccttcaaaatcagctgcagctgcaaaagcagcagcagcagcaagctctgcaacaacaatcgcatcaggaaatgcaacatcacctctcagctagctgtcatgatattgctaatgtagcttctggtgtgtctgagtctggatctgcttctcaaacacaatcttctttgctttctgggtcatcataccaacagatctatgatggaaacagtggtccaggtctgcatgtgcacaacggtttccacaactgttcaagccaagagtcctccaaccttcttaatctctcaagaagtggacaattcatggcatcagagggatggcctttgaagaggttggctgtggaatctctttctggtcatgagctccaacctatgcagcacaagtttgagaaagtgaatcaccaaagtaatgtgtctcacatttctagcaccttgcccccactgtcagcaagagacagttatagtgcccaggctagtggtacaaatgatcagagtcacctgctttcatcatcatttgcaatccatgatggcttgacagccgtcaggagtggtggtgttggcagtggaactgatgcgataaccatagcttcgttgagatataatgatatgaatttgctacctgaaaaccccatcgcaacttccagttgtttgggcgaatcaggaaccttcaattctctcgacgatgtgtgtggtgtaaacccatcacaaggtggaacctttgtgaaggtttacaaatcagggtcccctgggagatcgctcgacatcaccaggttcagcagctactacgagttacgtagcgagctcgagcggttatttggtcttgaaggccaactggaggaccctgtaagatcaggctggcagcttgnngcgttgacg

SEQ ID NO: 9736 - DNA, 4351 bp, Zea mays
aattcggcgcggggcgaaagcaagcaaggagcaccgcaccacgccactccagtactccactccactctcgtcccctcctcgatccagccatggcggcctagcccccccccctcccctagggttctctgccagcccccacccacccaggcgcctcttgccgctcccacccggtggtcgcgctgcccgcgtcgaatgggaggccacccggcgctcggagtcgggcgtgaccgcgcgctgccggaggttccctgagctcggcggcggcgggagcgtggctggtccggagcgcgccgcgcgtgcaatgggaggttcgagtggggttcctgcgagccgccgcggcggtctcggttctgcgagcgcgtggcccatgcttcgcgaagggtagggttgtctgtctgtctagctagctgctagctgcttggtctgatgagctcagctccggcgccccgcctcggcttccccgcgcgcttgctccgtcggctgcccagaacccagcttgcccgctccggcgcttctcttcgcttcttcggggaaaggttggagctttgaggtggtgcgggtgctcagccgaggactccgggcgatgacgcccgcagtggcgcgcgtttgccgcgacagtcctgggttcgggtagcgagttcctcgagcggatttggctgctgctgcgtcctgcgtgggaaggggaggcggcggcggcggcagcagcagaggaaggggaacggttgctctgaagcggagggggagcgggctgacattgcttctgggagcatggcgagcttctaaggacgcgcagctcccgcagcccagccattctcatcgccgcaccttggtgttcttgcccccaggtcgtactggttggtgggagggaacatgaacctctccccgcccaagatgtcggagccatctccggaaagtgacggggaacaaaggtgtctgaactcagagctatggcatgcatgcgcagggccccttgtgtccctgcctgtggttgggagccgggtcgtctactttcctcagggccatagtgagcaggttgctgcatcaactaataaagaagttgatgctcaaatcccaaactatccaaacctacctccacagttaatatgccagcttcataatgtcacaatgcatgctgatgcagagactgaagaggtgtatgcccaaatgacactgcaaccattgagcccggaagagcaaaaggatccttttcttccaattgaattgggtgctggtagcaagcagccaaccaattacttctgcaagacgttgactgcaagtgatacgagtacccatggtggattctctgttccgcgccgagcagctgagaaagtcttccctccattggatttttcacaacagcctccagtgcaagagctggttgcaagagatctgcatgataatgaatggaaatttcgtcatatttttcgtggtcagccaaaaaggcatctactgacgactggttggagtgtttttgtaagcgcgaaaagactagtagcaggggattctatcatatttatctggaatgataataaccagcttctcttgggaattcgccgtgcaagtcgtccacagactgtaatgccctcttctgtgctatcaagcgatagcatgcacattggtcttcttgctgcagcagctcatgctgcagccacaaacagtcgtttcactattttctacaaccctcgggctagcccttctgagtttgtcattccactggctaagtatgtgaaagctgtttaccacacgcgcgtatctgttggaatgcggtttcggatgctttttgagacagaggaatcaagtgtcagaagatacatgggtacaatcacaggcataagtgatctggactcagagcgctggccaaactcgcactggcgttctgtgaaggttggttgggatgagtctacagctggtgataaacagccaagagtttcactctgggagattgagccactgacaacctttccgatgtacccaactgcttttccattaaggctaaagcgtccgtgggcttcaggactacctatgttcaatggtgggaggagcgacgagttcgctcgttattcttctctcatgtggcttcgagatggaaaccgaggggctcagtcactgaacttccagggacttggagcatcaccatggcttcagccaagaatagattatccattgttgagtctgaagccagatacttaccagcagatggctgccgccgcactagaagaaattagagctggggatcatttgaagcaggcatcttctctcctgccagttcagcagactcaaactttgaatggtggattagatcatttgtatggaaatcctgttctacagcagatgcagttccaatctcagcagtcaacactgcaagctgtgcagcaaggttatggtcagaatgcaaacgactctgggtatgttcaaaatcaactgcagcagctgcagctgcaaaagcagcaggagccaccaccaccacagcagcagcagcagacacaagtccttcagcgacaagcacatcaggaaatgcaacagcacctctcagctagttgtcatgatattgctaatgtagcttctggtgtgtccatgtctggatctgcttgtcaatcacaatcttctctgctttctgggtcatcgttctaccaacagaacatctttgatggaaatggtggtccagatctgcatctgcacaacagtttccacaacttttcaagccaagagtcctccaaccttcttaacctcccaagaagtggccaattaatggcatcagagggatggccttcaaagaggttggctgtggaatctcttgctggtcatgagatccaacctctgcagcacaagcttgagaaagttagtcaccagagtactgtgtctcactgttctggcaccttgccgccactatcagcaagagacggttctagtgcccaggcttgtggtacaaatgttcagagtcacctgcttccatcatcatttgcaatccatgatggattgtcaaccatcaggagtggtggtgttggcagtggaactgatgcgataaccatagcttcgttgagatatagtgatgcgaatttgctacctgaaaactccatagcaacttccagttgtttgggtgaatcaggaaccttcaattctcttgacgatgtttgtggtgtaaacccatcacaaggtggaacctttgtgaaggtttacaaatcagggtccctcgggagatcgctcgacatcaccagattcggcagctactacgagttgcgtgtcgagctcgagcggttatttggtctcgaaggccaactggaggaccctgcaagatcaggctggcagcttgtattcgtcgaccgggaaaacgatgttcttctcctcggcgacgacccgtggcaggagtttgtgaatagcgtagggtgcataaagatcctctcgccgcaagacctgcagcagatggcccgcggcggcggaggtgaccttctgtctgcgcctggagcgaggatgctgcagggcagtgtctgtgacgactattctgcaggccacgacgtgcagaacctcaccggcagcattgcgcctgtggtgcctctggactactgaagaggactgaggcgaaggccgggatctgaagctctgaaccaaaaccggcaatccagcatttgcaggatttgccatccgcaagtcgtttcgttcctgtgttatgatcctctcagtctcaggccctgttgatcgggaataacctagtcgtttaatatagctagatgatgatccatgtatcattatggtaatggacatgctgtacgatagctactgtagctctaaatgcaggcaaggcaagaattgatctatcaaagaacgaatgaatgcaggcactcactgtagaggtgatctagccctgtactcctaagtcctaagatatattctcatagctaaaactgatggttccatgtggcattggcacccaagctattgaaaccagtcacctttgccgattctttcttcacctcaatttgcagttgttcggtcctgctgcatgccatacaagtcaatctttttttgtccttttcgtcactcattaatcatgattccatagaatcagggtatagcaggaaccctttctctaacgctatctcggtatctcccctttactcttcttatcttatctcttattttaaacttagtatctctaacagtagaacattgtcggggaccataattaggggtactctcaagactcctaaatctcagcccgtaacctccatcagcacaaagatgcaaaggcctgatgagtgcgattaagttagggatcggtccattcgagggacgcgatcgcgcctcgcccgagcccagcctcgggctgtgggcaagggcagccgaccccgaaggg

SEQ ID NO: 9737 - DNA, 2641 bp, Zea mays
gcacccatgaagtgagcaatgacgcgcatttgtcgcgacaggcccctatacaagtagcggtttcttgaagtggatttggctgctgctgcgtgggaagggggaagcggcggcatcatccgccgcagaggaaggcttactctgaagcggaggggaagcaggctggcattgctactgggagcatggcgaggtgctaaggacgtgcaggttccgcaatcaccgcatcttggtgttcttatttcaggtcgtagtgggagatgaacctctcaccgcccaagatgtcggagccatcgcttgaaagtgacggggaacaaaggtgtctgaactcggagctatggcatgcatgcgcagggccccttgtgtcccttcctgtggttgggagccgggtcgtctactttccccagggccatagtgagcaggttgctgcatcaactaataaagaagttgacgctcagatcccaaactacccaaacctacctccacaattaatctgccagcttcataatgtcacaatgcatgctgatgcagagactggagaggtttatgcccagatgacactgcaaccattgagcccggaagagcaaaaggaaccttttcttccaattgaattgggtgctggtagcaaccagccggctcgtcgcttctgcaagacgttgactgcaagtgatacgagtaccccccggtgggttctctgttccacgccgagcagctgagaaagtcttccccccattggatttttcacaacaccctccagtgcaagagctggttgcaagagatctgcatgataatgagtggaaattccgccacatttttcgtggtcagccaaaaaggcatctactgacgactggttggagtgtttttgtaagcgcaaaaagactagtagcaggggattctatcatatttatctggaatgataataaccagcttctattgggaattcgtcgagcaaatcgtccacagactgttatgcccgcttccgtgctatcaagcgatagcatgcacattggtctccttgctgcagcagctcatgctgcagccacaaacagtcgtttcactattttctacaacccccgggccagcccttctgcggtcgcgtgggcactggctaagtatgtgaaagctgtctaccacacacgtgtgtctgttggaatgcggtttcggatgctttttgagacagaggaatcaagcgtcagacgatacatgggtacgatcacatgcataagtgatctggactcagagcgttggccaaattcacactggcgttctgtgaaggttggttgggatgagtctacagctggtgataaacagccaagagtttcactctgggagattgaaccactgatggcctttccgatgtacccaactgcctttccattaaggctaaagcgtccgtgggcttcagggctacctatgttcaatggtgggaggagtgatgagttcgctcgttattcttctctcatgtggctccgagatggaaacagaggggctcaatcactgaacttccagggacttggagcatcaccatggcttcaaccaagaatagattatccattattaggtctgaagctagatacttaccagcagatggctgctgctgcactggaagaaattagagctggggatcatttgaagcagatatcttctctcctgccagtgcaacagccacaaaatttgagtggtggattagatcctttatatggaaatcctgttctgcagcagatgcagttccaatctcagcagtcatccttgcaagttgtgcagcaaggttatggtccaaatgcaagcgactctgggttccttcaaaatcagctgcagctgcaaaagcagcaggagccactaccacagcagcagcagcaagctctgcaacaacaatcgcatcaggaaatgcaacatcacctctcagctagctgtcatgatattgctaatgtagcttctggtgtgtctgagtctggatctgcttctcaaacagaatcttctttgctttctgggtcatcgtaccaacagatctatgatggaaacagtggtccaggtctgcatctgcacaacggtttccacaactgttcaagccaagagtcctccaaccttcttaatctctcaagaagtggacaattcatggcatcagagggatggcctttgaagaggttggctgtggaatctctttctggtcatgagctccaacctgtgcagcacaagtttgagaaagtgaatcaccaaagtaatgtgtctcacatttctagcaccttgcccccactgtcagcaagagacagttatagtgcccaggctagtggtacaaatgatcagagtcacctgctttcatcatcatttgcaatccatgatggcttgacagccgtcaggagtggtggtgttggcagtggaactgatgcgataaccatagcttcgttgagatataatgatatgaatttgctacctgaaaaccccatcgcaacttccagttgtttgggcgaatcaggaaccttcaattctctcgacgatgtgtgtggtgtaaacccatcacaaggtggaacctttgtgaaggtatgtaatctcacttatgctgtatgctccttattcatcaaatggcatgtgaagttgccaagttggtaactgcaagagcacttacatttggggaaaaaaaaaaaaaaaa

SEQ ID NO: 9738 - DNA, 1997 bp, Zea mays
  misc_feature (1771)..(1771): n is a, c, g, or t
gccggccgggctcggattccgaagagagcggggggaggcgaaggcatcgccgttccgactccgagtcgtccgtcgcctgcccgctgcccgttccgggcgcctccgccccgtttcgtcgaccacctctccggcgccgccgtcctgagccgtcgcacgcgccaccggggcgcctccggcgcgcgctccctacgccggctccgccccgccgccatgggctccagagtccttcacttagacgttcctgcagattctgaggcctatcttatgagaaatgtaccagggagtgtaagtagccctcgcacgaatggtgaaaagggtctctttcgaaatcagaatgcggggttcactgcacttgcaagtcctgtgaggagagaaatcggaaacagatcgtcgacaaggtccttctgtgttgaagacaatgacttggaagatggtaagacctcaaaagaaagggagggttctgcacagtcactcaggctcccaaagattcagaatcaggctctcttatctggtctggcttactgcatatcatcatgcagcatgatcttagtcaacaaatttggtctatctagctatggtttcagtgctccagtatttttgatgctttaccagaacattgtatcagtgaccatagtttctacactatccctgtccggtgctgttccaactgaaccattgacatggaatttaatcaaagtttggttgcctgtaaatatcatctttgttggaatgctgatcacaagcatgtttagtttgaagtacattaatgttgccatgctgactatattgaagaatgtcgccaatgtcctgactgcttctggggaaacttattttttcaagaagcagcatggtactcaagtttgggttgctcttatgttgatgataatctctgcagttgcgggaggaataacggatctgtcattccatgctgttggatatatctggcagaccttaaaactgtgttctgacggcggcatattcgcttacattgcgacatgtaatggacagtgctaagcaagtcaccaagtctgggaatttgaatgagctttcgatggtgttgctgaataatgttctttcactgccattgggaattatcctcgtgcttggtttgaatgaagtggagtaccttttgcagacgtaggctattgattcaatcttcactatttctatataccataaacctaatagactacacgcaaactgctgagatatccatttatgcatcaataatcatttttcaatgacttgtcaagtagttaggcttcttctgaatatttacacgttgaatcctccattttatggttatgtatttgtgactgaatctgcagatcactcttaaggatgcccgagttttggctggtcatcactgccagtggagttttggggcttggaatcagctttacatcgatgtggtttctccatcagacgagtgcaacaacatatagccttgtgggctccttgaacaagatccctctttccattgctgggatcgtcctcttcaacgttcgtacaagcgtgcagaactctttgagcattctgtttggtctattagcaggagtattcttcgccagggccaaattgcgagataactcaccgacctagtgatcaccgtgcaggcattatagtttgtagatcatcaatcagctcagaaacactctctggaaattacctctgcgggaaatttgtgcagatgcaatggttgtttcccacctgactatgcagagagacaacatatgcacccggattgggctgggactctccagttctcctnttccccacaagctgacttgacccacagtggttagtcttctggtggtatacgtcttcgttcttgctgtaaaatagtacccaaaaagaaaattgatggacgcaactgattctcaggcagtttgtgatggaaaggcgggttgattgtagtagtttgtaaagacacggttgctggatggaaggggatgtaatggtaataggttccgtgcatcggaaaaaaaaaaaaaaaa

SEQ ID NO: 9739 - DNA, 596 bp, Zea mays
gggcctgtgtcttctctgtagctttcaagagaataaaaatttggagcttctctcgcaccagcgtcctttccttcttccttggtttcatgctgacaactagggctgatcttcaggacggcctgttcttggttcggttcctgagagcgattgataggtctgagattatatattggtggcgttgttgtttgttttttttcgtgctcatccgttgctaaataagcaaaccatcagcccatcagcttactacaagcactcttttgcctccttttctgttcttgggggtcttggggagacacagcgccagacggagtttcttctttaggagtcgtgcactatgggtaattgctggtttaaggggaatccatactttaacagggtttcttccaatgcaaccaaagcagaatctcccaaaattcagagcccctcggagagaactgaaaaggaggattgccagctaccatcccacccgaaagagggtgggaggcgctgagaaaggatacagctcgcaatcctttgatagcgttcacatttgaggagctcaagagaatgacaaaaaatttcaggcaagattcgttactaggcggtggtggatttgg

SEQ ID NO: 9740 - DNA, 3123 bp, Zea mays
tgtagacagtagtagcggtgcaacaggtcctagaaccctgatccgtgttctaccaaattttcctgtctcacacgaccgtctttctaatgctgggaacgtaaactgtacccctagagtgaacaattttcagtcgggcagtcggctaaggaacaggaaccgtgtaaaatgtccctgctctagctcggtcttcactcaccggccggtgtcagctcagtttcactcgaaacaaggatcggaggagcacgcacgcaaccgatccctgcctgcagtagtgtgaaagtgtgcagctagagctaaccactgctactgtccaaaacgttccatgcgcgcgcgcgcgcgaaacaagttttttttggttctccttgcgtaacagatgagacgagacgagacgacgtgtccaccattacgctacgctcaccgttgcggctctggtccatctctcacctgcaccatgaccatgccaacctctgacacgataaggattgaaagctggaggcagcacgttacgtacaagttgcatgcatgattttgctcgatatctatagctagagcagcatgttggggcgtgcaccgctgactataaatacgagagcgacgacgcaaccaaggcacgcttcgtacttgccatagttcgtcatctccaagtgcgtgccctggccgccccctatcccgccggccctgtgtgtgttccccgctaccagccatggcgtcgccgttctccgtgccttcgctggtcggtttcgatttactagttctatagacagttgctaatgctaggcgcctaggcgtacgtgtgcatgatgatctcgtacgtacgtaactgataataactcacttattcgtcccgtgtggacgtgtgtgcatgcaatgcagatcatggaggaggaagggcggttcgaggcggaggtggcggaggtggagtcgtggtggggcacggagcggttccgcctcaccaagcgcccctacaccgcccgcgacgtggtcctcctccggggcacgctccggcagagctacgcgtcgggggagatggccaagaagctgtggcgcacgctcaaggcgcaccaggccggcggcaccgcgtcccgcaccttcggcccgctcgaccccgtccaggtcaccatgatggccaagcacctggacaccatctacgtctccgggtggcagtgctcgtccacgcacacctccaccaacgagcccggcccggacctcgccgactacccctacgacaccgtgcccaacaaggtggagcacctcttcttcgcgcagatctaccacgaccgcaagcagcgggaggcgcgcatgtcgctgccccgcgccgagcgcgcgcgggcgccgtacgtcgacttcctcaagcccatcatcgccgacggcgacacgggcttcggcggcgccacggccaccgtcaagctctgcaagctcttcgtggagcgcggggcggccggggtccacctcgaggaccagtcctccgtcaccaagaagtgcggccacatggcgggcaaggtgctcgtcgccgtctccgagcacgtgaaccgcctcgtcgccgcgcggctccagttcgacgtcatgggcgtggagaccgtcctcgtcgcgcgcaccgacgccgtcgccgccacgctcatccagaccaacgtcgacgcgcgcgaccaccagttcatagtcggcgccaccaacccgggcctcaggggccagagcctcgcggccgtgctgtcggccggcatgtcggcgggcaagagcggcagggagctccaggccatcgaggacgagtggctggccgcggcgcagctcaagaccttctccgagtgcgtcagggacgccatcgcgggcctcggcgtcgcggcccaggagaagcagcgcaggctccaggagtgggaccgcgccaccggcggctacgacaggtgcgtgtccaacgaccaggcgcgcgacatcgccgccagcctcggcgtcacgtccgtgttctgggactgggacctgccgcggaccagggaagggttctaccgcttcagggggtccgtggcggcggccgtggtccggggccgcgccttcgcgccgcacgccgacgtgctgtggatggagacgtccagccccaacgtggccgagtgcaccgccttcgccgagggcgtcaaggcggcgtgccccgaggcgatgctcgcctacaacctctcgccgtccttcaactgggacgcgtctgggatgacggacgccgagatggccgccttcatcccgagcgtcgcgcgcctcggctacgtctggcagttcatcacgctcgccgggttccacgccgacgcgctcgtcaccgacacgttcgcgcgggacttcgcacgccgcggcatgctggcctacgtggagaggatccagagggaggagaggatcaacggcgtggagacgctggagcatcagaagtggtcgggcgccaatttctacgacagggtgctcaaggctgtgcagggtggcatctcctcgactgcagccatgggcaaaggcaaagttcctcatttcccagcgttttttttttgtttggaaaaaaataaaccatcgttcgtacacagttttgatgttgttttgtttacaggagttactgaagagcagttcaaggatccacggcccgcaactgggagcagtggcctgcaagttatggccaaatccaggatttgatgaagactcagaagaagaagaatgatttggagaaggctctaaataaattcgaaaaaaaaataagctgggttcagttcatcagcaatggggaagctgctttccaagttctaaactgaacataatcagcataaatgaatcaacgaatcgtctagctagctacgtacggatggagttctgagttgtgactccaaatgaaaacccaggttgggttgaaagtattggtgtcaatctgtgagattatttatcacttcagattgaatatatgattttggttttggtactctgttctcagggttaaaatattttttttttattttttggtactggtattgtgaccacgtccgtgcgttggaacgtgaataatattatgtcacgataaattttaagtttgaatacgtgtttcctcaaccgctttcgtcgggaacgaaatgagttggttcagatttaatgacaagagcacgtacatctgca

SEQ ID NO: 9741 - DNA, 2160 bp, Zea mays
gtgctgtgtgcaccgctcactataaatacaagagcgacgacgcacccccgggacgcttcgcacttgcaatagttcgtcatctccaagtgcgtgcgccggccgccccctatcccgccggccctgtgtgtgttccccgctaccagccatggcgtcgccgttctccgtgccttcgctgatcatggaggaggaagggcggttcgaggcggaggtggcggaggtggagtcgtggtggggcacggagcggttccggctcaccaagcgcccctacaccgcccgcgacgtggtcctcctccggggcacgctccggcagagctacgcgtcgggggagatggccaagaagctgtggcgcacgctcaaggcgcaccaggccggcggcaccgcctcccgcaccttcggcgcgctcgaccccgtccaggtcaccatgatggccaagcacctggacaccatctacgtctccgggtggcagtgctcgtccacgcacacctccaccaacgagcccggcccggacctcgccgactacccctacgacaccgtgcccaacaaggtggagcacctcttcttcgcgcagatctaccacgaccgcaagcagcgggaggcgcgcatgtcgctgccccgcgccgagcgcgcgcgggcgccgtacgtcgacttcctcaagcccatcatcgccgacggcgacacgggcttcggcggcgccacggccaccgtcaagctctgcaagctcttcgtggagcgcggggcggccggggtccacctcgaggaccagtcctccgtcaccaagaagtgcggccacatggcgggcaaggtgctcgtcgccgtctccgagcacgtgaaccgcctcgtcgccgcgcggctccagttcgacgtcatgggcgtcgagaccgtcctcgtcgcgcgcaccgacgccgtcgccgccacgctcatccagaccaacgtcgacgcgcgcgaccaccagttcatagtcggcgccaccaacccgggcctcaggggccagagcctcgcggccgtgctgtcggccggcatgtcggcgggcaagagcggcagggagctccaggccatcgaggacgagtggctggccgcggcgcggctcaagaccttctccgagtgcgtcagggacgccatcgcgggcctcggcgtcgcgggccaggagaagcagcgcaggctccaggagtgggaccgcgccaccggcggctacgacaggtgcgtgtccaacgaccaggcgcgcgacatcgccgccagcctcggcgtcacgtccgtgttctgggactgggacctgccgcggaccagggaagggttctaccgcttcagggggtccgtggcggcggccgtggtccggggccgcgccttcgcgccgcacgccgacgtgctgtggatggagacgtccagccccaacgtggccgagtgcaccgccttcgccgagggcgtcaaggcggcgtgccccgaggcgatgctcgcctacaacctctcgccgtccttcaactgggacgcgtctgggatgacggacgccgagatggccgccttcatcccgagcgtcgcgcgcctcggctacgtctggcagttcatcacgctcgccgggttccacgccgacgcgctcgtcaccgacacgttcgcgcgggacttcgcacgccgcggcatgctggcctacgtggagaggatccagagggaggagaggatcaacggcgtggagacgctggagcatcagaagtggtcgggcgccaatttctacgacagggtgctcaaggctgtgcagggtggcatctcctcgactgcagccatgggcaaaggagttactgaagagcagttcaaggatccacggcccacaactgggagcagtggcctgcaagttatggccaaatccaggatttgatgaagactcagaagaagaagaatgatttggagaaggctctaaataaattcgaaaaaaaaataagctgggttcagttcatcagcaatggggaaggtgctttccaagttctaaactgaactataatcagcataaatgaatcaacgaatcgtctagctagctacgtacggatggagttctgagttgtgactccaaatgaaaacccaggttgggttgaaagtattggtgtcaatctgtgagattatttatcacttcagattgaatatatgatttggttttggtactcggttctcagggtt

SEQ ID NO: 9742 - DNA, 1285 bp, Zea mays
aatcccaaaagctccttgcagacacacttatttgcattttttgcgctgacatgcagttaggatgcgacagggcctccctccaatgcaaaatcacattaaccatgtcaccgctgtcaattgttttcttgagtttgttcccaaaacctcttaattattattgcccacggatagtcatgttatctacataatccgttttgccactcttcagggttctgcattgtgaatagaggttcatctttgtgattagagcgcccccgccgctgctttctactcattcgacgaatgttttgcaaagaagaaatctggtttatcttaccctcgattccttcctatgatacaactaacaaaatgaattggtacattcaggtatctttaaaaccttttcacttccaaattagaatgatatcatgctcaagaggtaacattttctgatgttttttattttaatagtaattattggtcgctgactttttaaaactatttgtgttgtacttcaagcatcttctacactgcatctaagctttgaagagttacggacaattttgtactaattgttttctttattttcccaaatgtgtgccacttcctttagtatttttgcagtgcagacgattgaaaactactgttttacatcacctctctgtcataggaatagtttactactctaatgctcattctattaacactaaaaaaagatatatcgcttgaaaacaggtatgtatttcaatcttctagatttatatttctttctttatatatacaaaacaggtaagtttgtaccatttgttttattttttaaaaaaagaaaaggtatgacacttacattagtattttttcccaccagaaacgattgaaaactattgtttcccgtcacctcctgtcatagatggcttggaccctcttattatcctgggagcctcggtggtttggaagcatagaaacagagtggtgttcggtagagtttcttccaacctcactcttattctggagtctgctaatgaggaaagcgagaaatgacaagttgcaggagccaagggttatcctttctggctgctccaagccatataatttagggtggttggatccttcatggatattttaatgtacttctgttgttggcctccgtaagaagtgcatgtatcccgggcgtctttcagctctttgtattcttcgtcttttaatatagtggggcgcagttctcctgtgcttttcgagaaaaaaaaaaaaaagcgcggccgttcgtctcttaccaataagtgcctatcccatatgtttcattgttctt

SEQ ID NO: 9743 - DNA, 1165 bp, Zea mays
ccggccgggatgatacatttaatcctagacttgatggcaaagaacgggtgcaattttttgtctctctatttcctatttatgttgcacaaataattgtttccttttgttatccaaataaataattacttccttctcccacccttttctccagttgtagcgagtgagttttagtaagggataaacaatagtaggaagaactctgttgtgtttcaatctcgagtatttgatggatggggcattgttctatagatggtgtatacagaaatgatcttaactgtcattttggtcaaaaccacaatagttctacttatgttagaaaatcaaaagatttaagtgtcttccatggtttaaagttcatgatgagcaaatttgacttatttttaattgtttatcatattttgagaataattttgctgcctattcaacagataccatggggggagcatttgatccagctagctggcaaacaagatttggtggtaactgtttatgatgaaacaaatatttcgaatcattaattgctatgtttgtgtctgcatcctgtcagcaattaggatgtgacaggacatggcctccctccaatgcaaaaatcccaaaagctccttgcagacacacttatttgcattctttgcgctgacatgcagttaggatgcgacagggcctccctccaatgcaaaatcacattaaccatgtcaccgctgtcaattgttttcttgagtttgttcccaaaacctcttaattattattgcccacggatagtcatgttatctacataatccgtttttgccactcttcagggttctgcattgtgaatagaggttcatctttgtgattagattgccaccgccgctgctttctactcattcgacgaatgttttgcaaagaagaaatctggtttatcttaccctcgattccttcctatgatacaactaacaaaatgaattggtacattcaggtatctttaaaaccttttcacttccaaattagaatgatatcatgctcaagaggtaacattttctgatgttttttattttaatagtagttatgggtcgccgccttctttagtctttttcccaccagaaacgattgaaaactattgtttcccgtcacctctctgtcgtaggaagaatttactgccctattactcatcttattaactctgaca

SEQ ID NO: 9744 - DNA, 4293 bp, Zea mays
gactttctttgatagatatagagcatgtcaggttctcagctaaccgcactatatcctgcctaaagttaatctatcaaattaaagaactaatgttaaataataaaattatataaagtgtaacaagttaggcagtgaactaaaaagacatatattccatacccatctaatccctaccatccgttttggatcgatgatgtgctgatggctggacatttaggcaagcttacatctaagggtggtaatgtatcacaatctaaatgtttcttcatgatttgtttgagtctttaactaattttagtttaaaattaaatacaaatagagtttgattttaaattgacatgatccttaaattttaccgtgtaaatgtaaagtttagagcccattatgttgtcttcaacaaatcatgcatatagtcatgcaaaaaaactattttgtattgtactataagtaaagtttgaaatatataataagataggaggtatgatgtgtaatctgttggagacagtattaggccctgtttggaagcaacctagattttaagaatctactttctatctccactttctagaatccggtttgtaaaaaaactggttataccccatttggatgtagatgttggcgcatagaattgagaattggaatcaactttcctaaattctattgtttggctgcacatagaattaagatttggaatcagagagtcaattccgcggtattagactataactagaaactccctctccaatacatagcgtcacacctctgtattgtgtggaattgggacaattctaaacttcaatacattggcatccaacaacagaattgaaattgcatctcatttcaatactatgtctgatttggtattcaactcattttaattacatgccctctaatatcgacatcaaacagagcattaatattatttgaaaccacctcaatttttataatctgtttttaggtatgtgaggctagcttcttggttttcaaaaaactaagaatatagttttataaactagatcataaacttgtatatttgaaaccatcttaatttttataaaccagtttttttttaagtttgagtgcttccaaacatacacttaagcagatgctagctgttccgtttttccgttggccaaaagcaataggtgacgactgcgcctctactggaccgctcctccattatcccagtcgaccgttgggcttgccaacgttccaaatgtcacgtgatcttcttttccccctttcccatcccgcctcctcttctttcttctcgcctcgcgctcctcccttcctcgtaggttaccgttggtgcgagtgcaacgcaaccccgccccccctgctaaacccgagaccgaacctcgtatcgtccagcttaaccgcacccacctttcgcgactgggatttttctcgagatcgatcgatcgctttccatcagagagcagcatcaccttcttgccttgcccacgccccaggtaaagctcaatctcagctcgctggttttccaatcgcttcttggttctatcggtcgatccgattcttggggcttgtcctctcccgtgccttgccgcgtacggttcttcttgatgtcaacgattgcttcgtcctgagaactttcctcggctcgaattcatgcgatttcagttctctccgtgcaaaattggtcccgattttacagcataataccgtttagtttggctactgtttcatcttcttgttctttttttgggattcggtggcgagaagaaacccccgggttcgatttcgccaagaacagcgtttgcaagaggaattctttcttcgatcgcctgaactagatgtttactactaaattgtctctttggcgaatcgcctgggcttgaatatgctgtgactgactgcccctgaactaatcgcctgaactagttgtgactgcctgccggttgcgaatcgaagcgtaaacatgacgacgctgtcgtccggcgtcctcctgaagctcctggacggcatgaagagcggcgccgccaagcccgtgggcgagcaccggacggcggtcctgcaggtgacggacatcgtgccagcggagctggacgagaaggacctcttccccaagcacggcaagttctacgtcaaggtctccgatgcgtcgcactccatctacgccacgctcccgctggcgcaggcagacctcgtgctctccaacaagctccacctcggccagttcgtccacgtggaccgccttgacccggcctcccccgtccccgtcatcgttggcgccaggccgctccctggccgccacccgctcgtcgtcggcacgcccgacccggcagctagggccaagcccgccgcgccgcgcagggggtcctggggccccgagcagaatgccgccatcaagcctaccacgctcaacttcgacgccgagaggatgacgccagtcaaggagcggccggccttgtcgactccggtcaaggaccgcgctggtggcgcgacgcctgccagggagcgcggggctgcggcgacgcctggtagggagcggaccgccgtggcgtcgccggcgctgagctctgcgtcgttgaggaagagcagcagcgtgctgcccaggctgaccaggagcaagagctttgtcgcggacagggatcagcagcatcctaggatccccaagagcccattccccactgtacgctcacagcctcaactgaaaagcattgggagccaagtcgagtcgcgcctttgtttacaaatcaatgttgatttccaatttgtgtttgcgcaggagaagagctcggtgagctgcacagcctcgagggcgacgaggagggtggccaaggaggaagagccctcctcgcctccttctgatgatgagctcggaagctcggccacatccaccaagaagcgatcggcgacagctgctcgcgtgccggtgccggggaagctcagtctactcgggaaggtgcgatcggatctaggaataacagcaaaccatcaatcttgactcttctttgtctaacgtgtctgctgtatcctgcattcaggacgcaatggagcagagagagcaggcgcagaaggttgccctggaggcactgcgcaacgcatcagccacggacaacgtggctaggatctacaagtatgtgtgtgatttctcgtagtagcgttttggcactgattgcgagtgtataagtaaattttgttctcacgatatcgctaattgctgctgaacaatcgttacaggttgttctcggaagtgagcaagacggcgaggccggaagcgccggccacctgttttgacagcttcctcagctttcaccaagaggccgtgcaggccgtcaccgacattgaggcgatccaggcggccacctcgatggccgcggccgtggcgagtgacgagcagcagctcgaagatgcgccgccggtcctgcaggagatagcacagaacaggacggtggtgcgtcggagaggcatcggcttggggagcgtgtccaagtcagtgtcgttcgcgcccggcacgttggacccgaagcaggacgatggaggcggcaaggccatccggagctcgagtgccagcaggaagtgcctcgccacggacaagatcggcgaagacggtggcgacgagaagagatcatcttcttctggtccttcctctgccaccaccaccactgcgcactctgctctgggctcctcgctgaagctggctaagaagatacaggccgaagcagggagctggttcatggacttcttggaggccgcgctcgagaccgggctgaagaagagcaaggcgtcttccatgggggacgggcggaagcaaagcagctgctgttgcccgcagtcgttgatgctgcgggtgatcaactgggtggagatggaacagagcggcggcgacagcagcggcaggaagactgcccacccaagagctgcggccgttgcgcggaagctcagaatcaaggccaaaaacccctcctgatgcgctgctgccctctgattcttgtgagaagctagtttgcctctgattcttgtgacaaaggtacccagatagaatccgtagaataagaaagtgattgcctccattgttcttgtcacggcatagcagattgtttcaagtgttcttgaagtaggatgacctgttcccttatcactaatcttaaacagcactacagcagcagaacaatggaggtgttgtaccgtagttacgatattcagtgtttgaattcgctgcccattcttatttgttattctgctgatgtttcagaccacctctgcggcagtcattcggtcggccagcaaatcgatatcaaaattctgttttgaaaaaaaaaaaaaaaa

SEQ ID NO: 9745 - DNA, 616 bp, Zea mays
ttcggcacgacggttaccgttggtgcgagtgcaactcaaccccaccccagctgctaaacccgagaccgaacctcgtatcgtccagcttaaccgcacccaccttttgcgactgggatttttctcgagatcgatcgatcgctttccatcagagagcagcatcaccttcttgccttgcccacgccccagttgtgactgcctgccggttgcgaatcgaagcgtaaacatgacgacgctgtcgtccggcgtcctcctgaagctcctggacggcatgaagagcggcgccgccaagcccgtgggcgagcaccggacggcggtcctgcaggtgacggacatcgtgccagcggagctggacgagaaggacctcttccccaagcacggcaagttctacgtcaaggtctccgatgcgtcgcactccatctacgccacgctcccgctggcgcaggcagacctcgtgctctccaacaagctccacctcggccagttcgtccacgtggaccgccttgacccggcctcccccgtccccgtcatcgtcggcgccaggccgctccctggccgccacccgctcgtcgtcggcacgcccgacccggcagctagggccaagcccgccgcgccgtag

SEQ ID NO: 9746 - DNA, 3680 bp, Zea mays
  misc_feature (1152)..(1152): n is a, c, g, or t
  misc_feature (1227)..(1227): n is a, c, g, or t
aactcgtacacgtgagaagacgtaagcagattagctcaaaagcccccgtcactgatgtcacgctcttccccctccgcgaaataacaacctcgatttctgcatgatttattgtttacacatacgaaggcttgctttccagcagtatctaaccgaatcagagcctgacatttctttttgtatctcgtgcttgcttgctgtaacaaacaaacgaacgaacgaccaaaaggtcgcggagctgatggtgacgcggtgcatccgcgaggcggtggcgctggcgtgggtggtgctttgggcgctgagcacgcgggcgggcacgctgctgctgtgcggccggctcagcctcggcgccggcttcccctacgtgcgcaggttcgccgacatggcgccggagcggcgggaggcggccctgcggcgctggaaccgggtgcgctggctcttcccgctccgcatcgccttcgccatcgtcaagatcctctgccactacgtcttctacgccatggtacgccggccgcacccttctctctcgtacgcaccgtgctggccgcaataaatctaggcgtctatactaatcggcaggagattaggttctggaaccctccaattagtaacgggcggctttccactgttcctgaacgcgggtactactagtgtggtacgtcagccagttctctgaaatctgaatacagcgatagggaatcatgcatgcatggtccactccagccacaccggcgaatctgaacacaacaagaacgtcaggatcaggaacaacatatatagcgccgacacggcatttaaagtgtttactgcagagatctgaagctagtgttattattatgcatggtagcttgccgctgctcattcaggaggtactacaacttactatctgttcaggatcgttgggtgctttagaatcacataataattacaggacagctctgcgggaggccccgtctctgatctctctccaagctaaacacaacaaatactttctgatgaatagcacactaaaaagtcttgctcggcccagttccgaaaactgaaaatgactgcttatctgaatgctaacttggccatgcacgttttcgaatcttcagatgccatgagaggcagcataacacaccagtatagtcttataatgtgctaaggtgtctnggtccatgagaagggaccacaaaaaaatctggttcttgtgatcagggcagcttgtttaacaatggatcgtgtatnatcaaggtcaccaaccatagccacaagcatggcagtggaccagtgggacggatagggctcgagtcccctctactgctcttgtgcctatggagaccctctaaatcttaaacgtatatggtataataatatagaagggtttcatatatatagtagtggtttagtttagtccattctaaaaataatttctggctctgtccttgcatggcacaaattcatcctgttgttgcacaccgaaagaaaagaaaactgtggccatactattccgggcaaaccattgatgctatggattttatccgttttgttttagttgtcgctggatagtgtaaaattaaactatccaacgacaactaaaaaacggagcgagtacaatgtttttcacagtcatcctttttcatctcaaaaaagatcataggcagacatccagtgcaaagatttctctcttgacatgcaggtgaacgagaactccgagaatccatactggaaagcgataggatacagcgtggacgagccacgggaggatcgggctcggacggcgacaccgtcgccgtcccggcccctcgacgtcggcgtcgtggagaccaggctgctggacgacaacaagctgctcagatcgctcgtggggaggggcctcacggtgaagccggcgtcgtcggacgcgaaccaccacacagtgcaatgcgacgccgtcatcgtggggtccggctgcggcggtggcgtggccgcggccgtgctcgcgtccgcggggtacaaggtggtggtcgtcgagaaaggcgactacttcaccgccgaggactacagctcgatcgagggcccgtccatggagcgcctcttcgagcgaggcggcatcttctgcacgtccaacgtgaccaccatgatcttcacgggcgccacggtcggcggcggctcggcggtgaactggtcggcgagtatccggacgccggaggaggtgacgcaggagtgggcgcgcgagcacgggctcccggtgttcgcgagccccgggtatgcgcaggccatggacgcggtgtgcgcccggctcggcgtcaccgacgggtgccaggaggaggggttccagaacaaggtggtccgccgcgggtgcgaggctctcgggctgtgcgccgacgctgtgccgcgcaactcgtcggatgctcacttctgcgggagctgcaacttcggttgcccgaccggggacaagcgcggcaccgacacgacgtggctcgtggacgccgtcgcgcgcggcgcggtcatcctgaccggctgcaaggctgagtacttcgtcctcgagaagaaccacagcagcggcagcggaagcgggcggggcaagaagtgcgtgggcctggtggcgacctgcgcgagcaacggcgtcaccaagaaactgcgcatcgaggccaaggtttcgatcgcggcttgtggggcgctgatgacgccgccgctgctgcggcgtagcgggctcaagaaccggcacatcggcagcaacctccacctccacccggtgtccatggcgtggggttacttcccggagaacaagcaggaccccccgctctctggcaagtgctacgagggcggcatcatcaccagcatgcaccgcgtcacggaccgcaccatcatcgagacgccggcgctggggcccggcgccttcgccgcgatggtgccgtgggagtccggccgcgacatgaaggagcgcatgcgccggtactcccgcacggcgcacgcctttgcgctggtccgcgaccgcggcgtcgggttcgtggacggcgaaggacgcgtgcgcttcaccccgagccgcgaggacgtcgacgagctccgcaacggcctacgccgcgtgctgcgcatcttggtggcggcgggggccgcggaggtcgggacccaccgcagtgacggtctccggctgcggtgcaagggcctccgcgacgaggacctcgaggcgttcctggacgaggtgaccatcgagaaggggcccatgcactcgagggttgacaagtgggctctccactgctcagcgcaccagatgggcagctgtcgtatggggtccagccctaaggacggcgccgtggatggccgcggcgagagctgggaggcagagggcctgtacgtgtgcgacggcagcctgctgcccacggcggtgggcgtcaaccccatgatcaccatccagtctatcgccttctgcctctccaagggcatcgccgagaccatggcccaggggcagggcaagggacagtagcctatgattgagacgcgcctggcgatggtttaattcatgcgtgcaacactgcaacatgtgtgcgttcttgttaatcgagtgtggtgaaagcgtcgaaaaatgtgtttgtgcattgtgtttgtgcaaatggtacgcgaatcacaatacatcctgtttcctgccccggtcaaaaaaaaaaaaataaaaagcataagattgctcattgtaaaatgtatggctgccgccgcttgcccaa

SEQ ID NO: 9747 - DNA, 925 bp, Zea mays
  misc_feature (34)..(34): n is a, c, g, or t
  misc_feature (51)..(51): n is a, c, g, or t
gaaaagcacccctaaggtgtcctgagctaatgangcagacaattgaccatntatcatgtaaaaagtcatcttcagaaatacagaccagctagatacagaccagagttatctgaaggctcttctgaaaagaaagtggcatcaaaagaagatataccatctattgactggaaagggagttttgatctcactgaagcacttaggctccagttggaacttcaaaagcggcttcatgaacagcttgagatacaaagaagtttgcagctaagaatcgaggaacaagggaagtgtcttcagatgatgctagagcagcagtgcatacccggggcagaaaaggcgcaggatgcttcaaccgctgcagatgaattgaggtcaccttctgagattccagaatcttctaccgtcaaggaagttccagaaaacagtcaaaatggatcaaccaagcaaacaaaataagctaagggccgatgaagttgcaagcatgaaatgtgtttcatgatccgattggctgtttccaggcttaaatcaagttgtttttgtccttccgtgggaacagatgaacgctatagttaacttccttgcaaagcctggctaggtgcatgtaactaggagttagttgtatattacctaccctcacggtatcactgaatcccagtgttatgcggatgatgtagtcttcagaagacagcgcaagcacattgtcaggggtttgacttgttttgccccccattacttaggtatcaagtagcgtctcctaggcatttgattatgggctaattcaagtgtttacaataatgtttagcacctgttgtttaaaacatgtcatggtaccaaatatgacgaagatgtattgcatttatatgagagaatgagagatttgaactgctttagtttggtaaaaaaaaaaaaaaaaaaaaaaaggggcccg

SEQ ID NO: 9748 - DNA, 2937 bp, Zea mays
caccctagtaaccgagcagcaaaaaaaagttgatcaatcgattcaggctggttacagaaacaacaggacaagtctccaatccaccccttctttgccatattatttttagttaacaacaaattgttttcaagtaaccacacaaacattttaatatttggcaggattttttgctttccatacatgtttcatgctagtaccataagtatagttatgattcacaatgtgagtataaagggatttgacactcaatgacttcaggatcattgtggaaattaaactgcatatgtcttcccacttaattctgcaatcttcatataaccatcttctaaagctcatttgccaaccattttcatcaggatttggttttggaattgatgaaataaaactagacaatgacgataatcaagagagagaaaatgattttttggattaaaacagcccgcattgacacagacagaggcaggccgacaggtagtgccgaaatgtgtctgcgtcggcccacacgaaaaactggatcgtcaaaaaaagctagcgctcccgcctctagcctctctcgcgagtcgccagtagcagtgggcgcagccgccccggcccggcccgccaagcggcaggcgccaactcaaaaaaggtagtccgaaacctcccgccacaaccacccaaggtttcgactttcgagttcgaatgcccagagcaggcaacgaaatccccccggaacggcggcggctctccccactccttttaaatttcggtaccctccaccttcccggaagtcgcgcacgctccccagtccccacactccccatccaatccgcgcacaccaagcccccaatctcggccgccactcgctgactagctgctccggcaacagtcccccccgaggtacgagggtgcgaccgcggcatggacacgctcccagaaggcgtcgtgcagcacatcctctcgcagctcagcaacgcccgcgacgtggccggctgcgccgccgtcgcccgctgctggcgcgactgtgtggccttccttccgtcgctctattttccgcggggcgcctttgaggccttggccggcggaccggcgtcggccgtggccttcgccgacgacgccatcggtcggatggtcgacgccgccgcgcgcctcgaggagctcgtcgtgtactgccccttctccgcgtccctgctcccgcactggctcgcggcgcgggccgccacgctgcgcgtgctcgagctacggatggactccgccgccgctgacaagtcggggcacctgaatctcgattctatcggggtggccgcgggcctcgaggagctcaggctgtgggggctcacgatgacgcgcgcccccgcgtggggccggatggagcggctccgcgtgctggagatcgtcagcgccatcctggtagacgcagcggtcaacgacgtcctcgccgcctgccccaacctcaccgacctctcgctgctcgggtgccagtgcgacggagaggcggtcatctcgctagcctcgctcgagcggtgccggctcgacttcctcggctctggcaactcctctctcaggttcgccgcgccccgcgtcgagtcccttgaggtccagggtttctcatttatctatctgcaaggtggcaaccgtctcaaacatctcacaatctccaagaacactggtatgttccggtcttccgaagggctcttttgcgttcccttgcaaaacagatttggtccctttcacattgcctgatggttaatataccaaaaatggatattttaggtagtgtgcatcatgtcgagatggggaagctcccggagctggaccagctctcgctgcgcggcgtccagtggagctggggcgccatcagctcggtgctgcagtgcgctagcgaggtgaagcacctggtgatgaaggtcgaattctccggtgattatgacacgctgcagccgtttccggagatcgacctcgtcgaattcttcaacagccacccgaagcttcgcaagttcgaggtccacggcgccatgttcgcggcgctgagtcaggaaaacagcctgaagaatgtaagccatgtcatacagcttctatgcttgcaatattttgcttctggacttctggttgttgtatggcctagctaactctgttcttccaaattccaacgcagttggattcaaggttcgtgatacctttcttggagcaggtcgtggtcaccgtgcggtcatctctcaatgctaagcagaagctgaacaccctcaagtccgttgtcaggtacagcgtgaggctaagaaggatgatcattaggatctcgcagatgaagaattgccatgctgctggagatgatttctttgaggagatttgcaagttcacttacatgaacagtgggacagtgtgcatagagtagaggtgttgctgcatttgccattcttgaagtgatttaacactaaatcaaggcagtttttacccatgctgtttgcttaggacagtttactggataattcattgtttgttttgttgttcaccgagcttgaatgtatcctgcacttcaggcttgaaatcgtttggttctatttgtcactagtctaagttttgcgcctgttaactgcactggtaataagtggctttggtttgttgctgttctttgatccaagcaatttttcccatttggtacaatctagtttgatataataagaaatatatagttgattgttgcccttcagctgcacattattcagtggccgattgactttatcgacagaactgtaatctaacgacattgacactaatccatttttacaacatacagcagaaactgcatgatgataatgtgtcacatcaatgaaaaattctagatattcataggactatccaaatagtatgcactccagttacacatacaacctatgatctatgaataaaaaatcaagcaaagctgttggtctacattttgctactaagtgaacctttcaa

SEQ ID NO: 9749 - DNA, 1568 bp, Zea mays
atcaaacgaatcgcgcacgcttccctgactcatccaatccacgcacaccaacccccattctcggccgccactcgccgctccggcaagtctccagagatacgcgtgcggtgcgacggcggtatggacgcactcccggatggcgtcgtgcagcacatactctcgcagctcagcaacgcccgtgacgtggccgcctgcgccgccgtcgcccgctgctggcgcgactgcatgcccttccttccgtcgctctatttcccgcgtggcgcctttgagtccgtcggcgtcggaccggcgtcagccgtggccgcggccgacgatgtcatcggtcggatggtcgatgccgccgcgcgcctcgaggagctcgtagtgtactgccccttctccgcgtccctgctcccgcactggctcgcggcgcgggccgccacgctgcgcgtgctcgagctgcgcgtggaatccgccgccgacgacaagtcgggccacctggactccatcggggtggccacgagcctcgaggagctcaggctgttggcgctcaggatgacgcgcgcgcccgcgtggggccagatggagcggctccgcgtgctggaggtcgtcggcgccgtgctggaagacgccgcggtcaacggcgccgtcgccgcctgtcccaatctcaccgatctcgcgctgctcgggtgcgagtgcgccggagaggcagtcatctcgctcgcccatctcgagcggtgccggctcgatttcgtcggctccggcaacacttctctcaggtttgccgcgccgcgcgtctcgtcccttgaggtccagggcttctcattgatctatctgcaaggtggcaaccgtctcaaacatctcacaatctccaagaacactggtagtgtgtatcatgtggagatggggaagctcccggagttggaccatctctcgctgcgcggcgtccagtggagctggggcgccatcagctcggtgctgcagtgcgctggcgaggtgaagcacctggtgatgaaggttgagttctgtggtgattatgacacgctgcagccattcccggagctcgacctcgtggaattcttcaacagccacccgaagcttcacaagttcgagatccacggcgccatgttcgcggcgctgtgtcagaagaacagcctgaagaagttggattcaaggttcgtgattcctttcttggagcacgtgctggtcaccgtgcggtcacccctgaatgctgagcagaagctggacaccctcgagtcccttgtcaggtacagcgtgaggctaagaaggatggtcattaggatctcgcagatgaagaattgccacggtgccgctgatgatttttttgcggagatttgcaagttcgcttacatgaacagtgggagagtgtgcatagagtagaggtgttgctgcatttgccattcttgaatgagttagcactaaatcaaggcagtttttttacccaatgccgtttacttgtggcagtttattggataatttatagtttgttttgttgtccaaaaaaaaaaaaaaaatttgcacttgaggccagaaatcatttggttaaaaaaaaaaaaaaaaaaaaaaag

SEQ ID NO: 9750 - DNA, 1428 bp, Zea mays
cccacgcgtccgctcggcccaggtttaggtaagttccccttcttttttattattttttgctgttttcaatgtcaagttttgatttcaaattttaaatctgtgtttaagctctcaaattcaaacaaatgcagcaaacaaaaatataccagcatgagatgcaaatacctaatgttattagttaatttactatcctattttaagcaaatgcctttacacatgcaactcctacactaaaaaataggcatttttgagaaaaatgatctctagtatattaaaatccctaagagagagcttataaacatataattcaacaaacggatgactggactttatgtagagatcattttattttaatctgtattaggaacatgtttattttgggaaatgtagcttcagaggtatggagattctttttagggtattattaattcaaaacctctggagaatttaaccaattcgaaaaataaaattttgaggtgttacattgagcttcttcttaatgtactaccgtgggacggtgggagcggtctttcccctaccgtccgagtgtttttaataaaatgaattgaacaactaaacaagttgtagaacaccatgttctgagctgggcgcctggctcttgcttcaacctgctgcacgctctaggaatcaatgactctgtcatccctgtgggagattgttccaaaggacctctgtgccctgctcatgaatccgtttctcatctgccttttgattatttgtttatttgctcttttctccttttgtagttttcacaagcatgataatcagaacatgttttatgtgcatagatggagaggagctattttggaaaacaagttggttcctctcttcaaacaaaggatgctatatgacaaaggaaattcctcattttgcatccttcaccatcttgtgttaggattgttatttgttgctgtagccggcttctttcctatacatcaaggtcatggatgattccaggaatggtggagggaggctgagagcagggcgccaaaactccagaaaaagggcttcaattcaattgtgatccttgtggcttggtgactgtggaaacacattgatggtgcctctccaaacagcaaccttgtcctgcaacatatccatcaagatgctcatatgtggggaatggctggggcagcagacattaggagactttggccttagtcctgggagtgcttgtttgctgctggttgtagtagtgtggtttttcatggacatttatgtgtatgcatgtgtttggccgccgtcaggaggccattttttgtactgtttttgccttataaggcctatttttgttcttaatataatgatgcgcagtcctcctgcgttttcgagagaaaaaaatggaagactccacagctgcagatttaggattggaataccataactgagcatttgtagtttttaaag

SEQ ID NO: 9751 - DNA, 726 bp, Zea mays
attcttgagatatagagtaaacatgctccagcccatacaaaatctcaaaatcctccagatgaaggtcgctcggcccaaacctagtagcgtctagggttttaccctctccaacacgacgaggttttgctccgacaccgacgcgacagccgacaaggcaggccgagaggggaaatggcatcgttgtcccgcaccgctgctgccgctgtcgtggccctgaggtcggcggtccgctccgcgccccttaccggccgcgtcctcggagcgccactaccttcctttgcctcgccttccgctacccgctccgcccggatcctccgcaggtcggcggccgcggcgtcggcggggctggaaacgctaatgccgctgcacagcgcggtggctgccgcgcggcttaggtcctgcatcgccgtcgactcctcctgctggtgctcgctctcacaaggtttaaacaagcgcatctgaccatggctaggagctgagcagaagagaagatatgctttgcctttatgacagcgaggcgagctgcacctgaagaaacaaaagaatcttaggaattacaaacaagggctgtactgtaataatgtggttcttgtaaaccaattttgccttagaattctgtaacttgaatcatccacagatgtgcgactgtcttttgtttatgtggatctatgaattacctgcagctcctcgtttgaactaaaaacaaaaaaaaaaaagcctcatttg

SEQ ID NO: 9752 - DNA, 1482 bp, Zea mays
cttcctctcccttctcttctcttcttcacttcacagcacgatcgagccagttgcaatcacacagacgatgccgaccatcatcgtctcggtggacctggaatgcagccgctgccgcgccaagatccagagggtgctcaacaggatccaaggtctgttcgcgcttgcttgctactcctctctgttgttcgctcttccctttccgcttgtacaggtaggtctcgagacggttcgcgttgatcgcaactgataagtttcctgggacgacggacggacgcctcggcttgcagagaagggcgagttctgcatcgatgacatcgacttcgacgagaagaacaacaaggtgaaggtcacggggcccttcgacccggacaagctcgccgacaagctgtgctgcaaggcgtgcaagatcatcaagcagatcgagatcgtcgagcccccgcccccgccgccgcccaagcccaaggaggagccgaagaaggaggagcaagccccgccgccgccggagaagaaggaggaggccgccccgcccccgccggcgaaggtggagccgcccaaggaggagccacccaaggagaagcccccgccacccaaggaggagccgcccaaggagaagccacccccgcccaaggaggagaagcccgccccggcaccgcccaaggaggagaagcccgccccgccgccgcccaaggtggtggaggtcccctacccgtggccgtacccgtacccgtaccctgcgtggccgtccgactgctgctgccaccacggccacggcgggtgccactgctgctcctgcggcaaggcccccgagccggccccggcccccgccccggccccacccccgccgcagtacttcccgcagtacatgccccagccgtacccctgcaacccctgcggcggcggctaccggatcgtctgcgaggaggacccctcctacgcctgcgccatcatgtgattcgtttattatcaatatcatcccttgatgagtgtaccgtccgtgtgcgtaccatggccttaattaccattatacccaaccccaccctaaaaaaaaccccagtacgtcgtctcatcatcattccgtacctcctcctgtataatcgccgtacagattcatcatatatatactctatacatatatagcatcatgtatacaccgccgtaccccctgtcatctctttatgtagattgtgcattatgttctgcgcgcttcgttttggtaattacagtatatgccagtcaggctaagtgagagaataaaataagcaatgatgctgttgttttttttttcttctgtgtgtgtaaagaaaaagggcaaggtgagagagttcatccgttgatggcagcagaaatgtcctaccttgcacaccagcatccctttctttatgttgcacccagggaaaaaaaaataaacagttgcttttatcaaaaaaaaaaaaaaaaaaaaaaaaaaaaaaaaaaaaaaaaaaaaaaaaaaaaaaaaaaaaa

SEQ ID NO: 9753 - DNA, 1435 bp, Zea mays
  misc_feature (1343)..(1343): n is a, c, g, or t
  misc_feature (1369)..(1369): n is a, c, g, or t
  misc_feature (1377)..(1377): n is a, c, g, or t
  misc_feature (1383)..(1383): n is a, c, g, or t
aattcggcacgaggctcttctccatccctgcttttgtcaccgccacggctcctccaagatgagtcagatgacgtgggaggcagccaggcgtcggtgcctccttatatagccgcgtattcacgccgcgccgcggcatgcctcccccccccttcctctcccttctcttctcttcttcacttcacagcacgatcgagccagttgcaatcacacagcgcagacgatgccgaccatcatcgtctcggtggacctggaatgcagccgctgccgcgccaagatccagagggtgctcaacaggatccaagagaagggcgagttctgcatcgatgacatcgacttcgacgagaagaacaacaaggtgaaggtcacggggcccttcgacccggacaagctcgccgacaagctgtgctgcaaggcgtgcaagatcatcaagcagatcgagatcgtcgagcccccgcccccgccgccgcccaagcccaaggaggagccgaagaaggaggagcaagccccgccgccgccggatgaagaaggaggaggccgccccgcccccgccggcgaaggtggagccgcccaaggaggagccacccaaggagaagcccccgccacccaaggaggagccgcccaaggagaagcccgccccggcaccgcccaaggaggagaagcccgccccgccgccgcccaaggtggtggaggtcccctacccgtggccgtacccgtacccgtaccctgcgtggccgtccgactgctgctgccaccacggccacggcgggtgccactgctgctcctgcggccggccccccgtgccggccccggcccccgccccggccccacccccgccgcagtacttcccgcagtacgtgccccagccgtacccctgcaacccctgcggcggcggctaccggatcgtctgcgaggaggacccctcctacgcctgcgccatcatgtgattcgtttattatcaatatcatccctcgaatgagtgtaccgtccgtgtgcgtaccatggccttaattaccattatacccaaccccaccctaaaaaaaaccccagtatgtcgtctcatcatcattgcgtacctcctcctgtataatcgccgtacagattcatcgtatatatactctatacatatatagcatcatgtatacaccgccgtaccccctgtcatctctttatgtagattgtgcattatgttctgcgcgcttcgttttggtaattacagtatatgccagtcaggctaagtgagagaataaaataagcaatgatgctgttgtttttaaaaaaaaaaaaaaaaaaaacttgcgtagagagttgggcgcagagaatccccaagcaaacaaacagggtanagggagaggaggggagaggagagganaggttggntctggnacaccatggctccgatgaagctgtacggggcggtgatgtcgtggaacgtgac

SEQ ID NO: 9754 - DNA, 3695 bp, Zea mays
tcctccccgtctgttgagtcattacccgcaggcgtttcgtcaccggttttataattcagacagaggtcggtcgccaggaacccataaaaaaaggtagctttatgtttccctcttgctccgtcgtcgtcgtcgtcgtcgtcgtcgtcgccgccgccgttgctcgataggatgtttagaaattaactgcttgtgcacacagaggttacagttccttgtagactccttcagttcagaaatgaccatgcaatgcatgctagtttctgtttacagtttccaagcatgcatggttttgttgcctgtgagtagatgatgttggagtacgtaacgtagtaacaatgagcagtgatgtgaattgcgatgatatacgtgacgccgagagagcacatgaacaggtcagactgtacccttgcgtgcctagctagctcaagttcttttcttgcagccttttcttcaaatcccacacacccatgacatcggccggcgatccgatctctatcctgattcctgacacacaagcacggccacggaaccctcgcgcatgcatgctgcctgctgacgcttaccttcgtttcgttttcatggctgctgctgcttattgctgcgagtgcgatgtgcaggcggcagcgggcacagtcctccagtcctcgggtgaggcgatcgtcgccggcgccatgggagggggagtccaccaccaccacccgtgcgtggctgctgatggagatggggccggggccgggcccgggccggccagcgtggaggccgcgttgaggcctcttgtcggcgtcgacgcctgggactactgcgtctactggaggctgtctcctgatcagaggtcggcgccgacgcctgggacttgttcctttttgtgtgtgttcttttatggagctcggaaatcagaaccaggcgaatgcgtgtgatggcgtgtgtgtgccacaaactgcttgcaggttcttggagatggctgggttctgctgcagcagtcagttcgaggcacagcttccagcgctgggcgacctgcctccatcaatccagctcgactcctcgtctgcagggtatgatctccgtcagctccgctatcactcggccgagttctaatccctgcatgctcgatctgacggtcggccaggatgcacgccgaggcaatggtgtccaaccagccgatctggcagagcagccgcgtgccagagctccaaacaggttactccagtgtacgtaagcagagcacatcgatcgatcatcggctcttgtcatcttcaacctccctccctccgtccgatccagtccactgcctaagaatccatccaactgcatgtctgatcatcgtcttgtatccatgacagggcatggtgcaggagcccgggtccagcggcggcccgaggacgcggctgctggtgcccgtcgccggcggcctcgtcgagctcttcgcggcgagatacgtgcgtaagccactgcagctggacctgcgccgtttctttttcgttcttattattttcttctgtttgccgccatcacgtgagaaattccatttccaggattgttagtttctagagtacggctacgggtagttagctagagagacctgccagaaccagaaccagaagcgcacggcttctgcgtgagccagcgtcgccgcccccggcgaagatgtggcggtgaaccgctcgcaacagccacggcctttgcatttgcatgccatgcgcacacaaacacatgacatgacatgacatgacacaccagacttgacgctctcctgtctttatatgccggcgcggcgcgcgggcgtgcgtgcgcgcgcagatggcggaggaggagcagatggcggagctggtgatggcgcagtgcggggtgccgagcggcggcgaggggggcgcgtggccgccgggattcgcgtgggacggcggcgccgcggacgcgtcgcgtgggatgtacggcgatgcggtgccgccgtcgctcagcctgttcgacgccgccggcagcgtcgcggcggacccgttccaggcggtgcagcaggcgccgggcgccggtggtggtggggtggacgacgtcgccgggtggcagtatgctgctgcggctgggagcgagctggaggcggtgcagctgcagcaggagcagcagccgcgcgatgcggactcggggtccgaggtcagcgacatgcagggggacccagaggacgacggcgacggcgacgcgcaggggcgtggcggcggcaagggcggcgggaagcggcagcagtgcaagaacctcgaggcggagcggaagcggcggaagaagctcaacgagcggctctacaagctcaggtcgctcgtcccgaacatctccaaggtcggtgtccgtcggccccaccgtcgccatccatggaaacgcttgattccttgcttctctgatgatgccatcgatgatattcttcagatggaccgcgcggcgatcctcggggacgccatcgactacatcgtgggcctgcagaaccaggtgaaggcgctgcaggacgagctggaggacccggcggacggcgccggcgcccccgacgtcctcctggaccacccgccgccggcgagcctggtggggctggagaacgacgagtcgccgcccacgagccaccagcacccgctcgccgggaccaagagggcccgtgcggcggcggaggaggaggaggaggagaaggggaatgacatggagccgcaggtggaggtgcggcaggtggaggccaacgagttcttcctgcagatgctgtgcgagcgccggcccgggcgcttcgtccagatcatggactccatcgccgacctgggactcgaggtcaccaacgtcaacgtcacctcccacgagagcctcgtcctcaacgtcttccgcgccgccgtacgtacaatgacaccgccgccattattgacgcatgcaattcgtagcgcacgtgctcattctctctctctcccatggtggtgctggcagaggcgggacaatgaggtggctcggcacgaggacagactgagggactcgctgctggaggtgatgcgggagccgtacggcgtatggtcgtcgtcggcgccgccggtggggatgagcggcagcggcatcgccgacgtgaggcatgacagcgtggacatgaagctcgatggcatcatcgacgggcaggcggcaccgagcgtcgcagtgggggtttcagaggatcactacggcggctacaaccatctcctccaatacctcgcttgatcattatttaattgcgttcgttcatgttgaaagttcgatcaaactatcaaaggatggatcaactaataaaaacgggatccatatataagtaactgtgaattgcgatcattaattgtatacaaaaaaaaaaaaagtagtggattaaagtttgttaattgggttttctcactgcttttctggatctttcttgtgttggttcaaacgagggcggaataataaagctatttcctctatgtttttatacaaggtaaattaaatttcgggtctttgcatgagctgtgcgctaaaagcgcttattacaagtttcggcctccatgtataaaggctagtttggtaacactattttccgaaatgattcctatttttttaagggaaaatgaactaatttcctttagaaaatgagatttccaaactagccctaaaagaaaattctaggctaaaaaagacaacatgttgcactctatttctattgattttaactaaaattaatt

SEQ ID NO: 9755 - DNA, 1826 bp, Zea mays
ccgattctctttcgtgcttatcatttattgttttctgtttgccgccatcacgtgagatatctcatgattgtttttttctagagtacggctacgggtagttagctagagagagctgccagaaccagaagagcacggcttctgcgtgagccagcgtcgccgccccgcacgagaccattacctagaacatcctaatcgaaaaacggcctttgcatttgcatgccatgcgcacacaaacacatgacatgacatgacatgacacaccagacttgacgctctcctgtctttatatgccggcgcggcgcgcgggcgtgcgtgcgcgcgcagatggcggaggaggagcagatggcggagctggtgatggcgcagtgcggggtgccgagcggcggcgagggggggcgcgtggccgccgggattcgcgtgggacggcggcgccgcggacgcgtcgcgtgggatgtacggcgatgcggtgccgccgtcgctcagcctgttcgacgccgccggcagcgtcgcggcggacccgttccaggcggtgcagcaggcgccgggcgccggtggtggtggggtggacgacgtcgccgggtggcagtatgctgctgcggctgggagcgagctggaggcggtgcagctgcagcaggagcagcagccgcgcgatgcggactcggggtccgaggtcagcgacatgcagggggacccagaggacgacggcgacggcgacgcgcaggggcgtggcggcggcaagggcggcgggaagcggcagcagtgcaagaacctcgaggcggagcggaagcggcggaagaagctcaacgagcggctctacaagctcaggtcgctcgtcccgaacatctccaagatggaccgcgcggcgatcctcggggacgccatcgactacatcgtgggcctgcagaaccaggtgaaggcgctgcaggacgagctggaggacccggcggacggcgccggcgcccccgacgtcctcctggaccacccgccgccggcgagcctggtggggctggagaacgacgagtcgccgcccacgagccaccagcacccgctcgccgggaccaagagggcccgtgcggcggcggaggaggaggaggaggagaaggggaatgacatggagccgcaggtggaggtgcggcaggtggaggccaacgagttcttcctgcagatgctgtgcgagcgccggcccgggcgcttcgtccagatcatggactccatcgccgacctgggactggaggtcaccaacgtcaacgtcacctcccacgagagcctcgtcctcaacgtcttccgcgccgccaggcgggacaatgaggtggcagtgcaggcggacagactgagggactcgctgctggaggtgatgcgggagccgtacggcgtatggtcgtcgtcggcgccgcccgtggggatgagcggcagcggcatcgccgacgtgaagcatgacagcgtggacatgaagctcgatggcatcatcgacgggcaggcggcaccgagcgtcgcagtgggggtttcagaggatcactacggcggctacaaccatctcctccaatacctcgcttgatcattatttaattgcgttcgttcatgttgaaagttcgatcaaactatcaaaggatggatcaactaataaaaacgggatccatatataagtaactgtgaattgcgatcattaattgtatgcatacaagcatatggtcgtggattaaagtttgttaattgggttttctcactgcttttctggatctttcttgtgttggttcaaacgagggcggaataataaagctatttcctccaaaaaaaaaaaaaaaaactcgagggggggcccgtacccc

SEQ ID NO: 9756 - DNA, 1673 bp, Zea mays
ctgctcttgatggatttaggtagtgtccagttgtcggttgccacttggatcatcattacttgaagagaaaaactgctggtcttggcaaagtagaggttttttgtagttatcctgatcttataccccgcgcccgcggccgcgtgggttcgggtgagcgaaagagaactcgacaatgttgcatgtacagtttttgtctcggatgggtaatctgcttatagccacatactcacatcacatggcatacaaagaaaggctgtttggttccccttttccatggaaggttagaagcaagatgcctggtaataggtgcaacatgaagtttatatacctgtgttctgcccgcaaaatttatctgggtaatactttaggtcaaaacacgtgatgtacatccaatcatgggtatagtttgttgatatccacccttctgtttgtaaaaacctcccaaatcccatctcataaccctctttagacgtggttggcccatgaatgaattgctctatataatgattacttttatctgattgatgtataatacatgagcataatatctctggcgttttatttatgggcaaagtcctggaccagtaaatggtttcatgtttgcctatatttttcttggtcacctggctaattcagttctgtatcctttattctatccgtatttaagcaacaattgattgatggaccaaaaattggcaatatagaactggaggttagaaggtacatgcacattttttgaattgattgtatgagtattgtcatagtaattacaactttgttggcccttgcagctgattgtgcaccggcttccctgtcatgtccgggttcgggacactaataaataatcagttgacggagcccaaacaaataggatcttattatttcgttacagttccattttggtttgtgcatgttcaagtttgcatttatgtacatatattcagcaaataagattgactcaaaagatgatatttgactggcctattatttaaagcttaattatggggggcatggttctttatttcaccaaacaagtgaattatgttttatttgctgtgaattcatgttctgtgccttgcgtgcaataatttaattatactatggtacgagtgtatgtgaactagtaactgaggccctgagccttggccttcttttctttctgctgattcatcacctgtatgcatgtaattcaagttgaagaaaatatattgctgctacttacactccagccatgtccttctgtttgcatatgtccatttcccttttattactctgttagatacttagattgatttgtactgctaggctttagcaatgcatgaaaggagtctactttacaagatgagttttaggttgtcataaatgtgaccgatatttgctatttacttaaactttatttaatgcactgttatctggtttcagcctttcagctggaaaattacacatgctcactgcattatatactatgtagaatactagaatcgactatgcaaaggcaaaacatcacataacatcatgctatttcttttttgaccgttttctttaatgtgactattgatgctgccatttcatgttgagaaacataaagagaactctctcttgtcaaagatatttgacacatttgacttgcatagttttcaatgcatatctttgaccactaatgtattctcata

SEQ ID NO: 9757 - DNA, 1799 bp, Zea mays
gccggccgggctcgcgaaattattgagatcgttattataagttggtgtttttatagggctaaaaaatattgcgcgctgcacggaggcattcatccgtcctgcgattttcgtttcctccgtgtctccgttcttcatcctgcgttagagaacaagacgaggtcgaggacccagacgcagacgcacacgcagcgcgccttctccaccgcgaagtcatcgttccgcgctgccgccgccgccctagcaaggtgttggattctgtgttgcggcttcggagtgtcattgctacccttctcctgacaacatggtttctttcgagatgaatgacctcaagaagattgggctaggcctaacaggctttggaatattcttctccttcctgggaatcattttcttctttgacaagggtcttattgcaatgggcaatatcctctttctatctggtttgggtttgacaattggtttgaaatccactatgcagttcttcaccaagcctaagaactacaagggtactatctcatttggtgctggcttttttctggttcttattgggtggccctttcttggcatgctcttagaagcatatggctttgttgtactcttcagtggattttggccaacccttgctgttttcctccaaaggattcctatcattggatggatttttcaacaaccgtttgtcacatcgttccttgaccgctacagaggaaaacgtgttccggtttagcttagtcctgctatatttcaacatacttccctcacaaatatcatgcggttatggatatgttccgtccttgcctttttctttaacttgtttagttggtggtaggaattttgttgttgttgtgtaaattacccctcatccgtggttttccacagaccagaatgcattttccccgataatacattgaagaaagttctcatgcaagcctctttgtggggggaaatgaagtcttagggatgttctgaaagtagtgactacccatcatgtctttttgtaacattacttaatgtaagcatatctgatataggtatgcaaaggctccaatagcttccgtttgctgtatgggaaagaaaggagacttggcagaaaaaaagttacttgtgattcttgtgccgccatgtggttattttcttcagtaattccccttccaggcctagtatgggaactcagctttgagttgtaaagaaaaattgcattggtaatctggtatgagttctggtctgctggagtggcgtctacgcctcgccatgttggctttgtaaggttccgcagctaatcaaaagtgagccgtttatcaccttgcaagtaccttttcaaaatacaagctggaaagaaggcttcataaatgtgcatatggtccgtcttattgacttagcaatgtagtgcatctaagctcagattggcactgggctaactccaaattaaccagtgcattgtatcataaattcatgtcaaccaatacaaaggattaaaaggagaatgatacgttgagtcagatattccacatatatatccgaaagcaacatgttcgcacgcaattcggggtttcagttacaagcactaaaacttagggtgtttgggtgtgaagttttttcgtagctttggaaaaataccacagtattattaaatactgttgtattatagacataatgatgtttgacaagctagctaaagtctctgttttcaaaactgaagtattgcaaatattatacttgttttaaagcattctaaacttaggtcaggaccttagttttcaaaactgtgatattattgtgactaaagtattctgcaggcatgc

SEQ ID NO: 9758 - DNA, 1029 bp, Zea mays
acagtgactcaccagtgcatgcaaaaagtttgcgcgctgcacggaggcattcatccgtcctgcgattttcgtttcctctgtgtctccgttcttcaagccgaggtcgaggacccagacgcacacgcagcgcgccttctccaccgcgaagtcatcgttccgcgctgccgccgccgccctagcaaggtgttggattctgtgttgcggcttcggagtgtcattgctacccttctcctgacaacatggtttctttcgagatgaatgacctcaagaagattgggctaggcctaacaggctttggaatattcttctccttcctgggaatcattttcttctttgacaagggccttattgcaatgggcaatatcctctttctatctggtttgggtttgacaattggtttgaaatccactatgcagttcttcaccaagcctaagaactacaagggtactatctcatttgctgctggcttttttctggttcttattgggtggccctttcttggcatgctcttagaagcatatggctttgttgtactcttcagtggattttggccaacccttgctgttttcctccaaaggattcctatcattggatggatttttcaacaaccgtttgtcacatcgttccttgaccgctacagaggaaaacgagttccggtttagcttactcctgctatatttcaacatacttccctcacaaatatcatgcggttatggatatgttccgtccttgcctttttctttaacttgtttagttggtggtaggatttttttttttgtgtaaattacccctcatccgtggttttccacagaccagaatgcattttccccgttaatacattgaagaaagttgtcatgcaagcctctttgtgggggaaaatgaagtattagggatgtacccatcatgtcttttgtaccattacttaatgtaagcatatctgatataggtatgcaaaggctccaatagcttccgtttgctgtatgggaaagaaaggagacttgccagaatcgaagttacttgtgaaaaaac

SEQ ID NO: 9759 - DNA, 2574 bp, Zea mays
  misc_feature (2411)..(2411): n is a, c, g, or t
  misc_feature (2481)..(2481): n is a, c, g, or t
aaaaagaaatcagatttcttttcaactcatatctttcttaccctgttggctaagataaaatctaatatttattcgtaccagtttaatatctgatatgtttttgtatgaaattatttttataggtatttttttgtgaagatcaaccacattgatttactaggccctcgcatatcgcttagtcacattgcattgctggtagggtcttttccaccccaaccggtagcatcaaataagattaaatggttatgggtcttttccaccccaaccggtagcatcaaataagatcaaccgttttttttggcatgaattcgagctagagccatggcaaagagacctaactaactcatgtatgttttcttcgatcgaaagtcgaaagttaggttacttgttgttgttgtgagtataatataaaaaaaatataattgacacgcgcgtacagtataaataagcatgcagtctagctggggcacgatggccgacacgaatgaaacacgtttgtttgtccggtcgactggaagcacgacaaggccgtgctgctgaagcagccctgtggcgttcggcggcctactaagagcccaccacgcggcccttggcagcttccgtcccctcctgatgaaggagaaggagatgaaagggaaaggagctggattggattggattggatagatatcgtgtttatttgtttgagacggtagttttcatctaaagtttattcttcgtcacatgggatggccgtttgcttgtttgttgcttccgggaggcggtggtgaattgaagcagatcgacaagcatggctgcccactggtctcgatcgatcggcctgccatgccatgccatgccactagagtccgtcctgactggccgcccgttcccccgtctaaacaggcgggcccccggggccggcggggacgagcaagcaagcagttgcagttgcagcggcctcctcctctgcttcctccctcctcctcctcaccatggtgctggctgcgcacgatccccctccccttgtgttcgacgctgcccgcctgagcggcctctccgacatcccgcagcagttcatctggccggcggacgagagccccaccccggactccgccgaggagctggccgtgccgctcatcgacctctccggggacgccgccgaggtggtccggcaggtccggcgcgcctgcgacctgcacggcttcttccaggtggtggggcacggcatcgacgcggcgctgacggcggaggcccaccgctgcatggacgccttcttcacgctgccgctcccggacaagcagcgcgcgcagcgccgccagggggacagctgcggctacgccagcagcttcacgggccggttcgcgtccaagctgccctggaaggagacgctgtcgttccgctacaccgacgacgacgacggcgacaagtccaaggacgtcgtggcgtcctacttcgtggacaagctgggcgaggggtaccggcaccacggggaggtgtacgggcgctactgctctgagatgagccgtctgtcgctggagctcatggaggtgctaggcgagagcctgggcgtgggccggcgccacttccggcgcttcttccaggggaacgactccatcatgcgcctcaactactacccgccgtgccagcggccctacgacacgctgggcacggggccgcattgcgaccccacgtcgctcaccatcctgcaccaggacgacgtgggcggactccaggtgttcgacgccgccacgctcgcgtggcgctccatcaggccccgcccgggcgccttcgtcgtcaacatcggcgacaccttcatggcgctctccaacgggcgctacaggagctgcctccaccgcgccgtcgtcaacagccgggtggcacgccgctcgctcgccttcttcctgtgcccggagatggacaaggtggtcaggccgcccaaggagctggtggacgacgccaacccgagggcgtacccggacttcacgtggaggacgctgctggacttcaccatgaggcactacaggtcggacatgaggacgctcgaggccttctccaactggctcagcaccagtagcaatggcggacagcacctgctggagaagaagtaggcatgctatttgggtatggaagatggtggatgtaagcaaacaaagccaaattaagcagagtaggttaattaaggttggctgatgatccatttagggaaggagctgatctccctgactccctcctccaattttctcaaccaaatttatatagtataataataataataaaatagcaagtaatagttgtatcgtattattattaattaatttattagctggtaggcaagtagtattaaataccatttgtagtacgatgggcgtatttctattttggcgttttgctctgtgttttttgacgtttcctttggatttggggggacntcagatcagctcggcctgctacactgcatgcatgctaccatatcataccatgccatgccatgccaatgcnataccccgcagcagttgattccatccatcactagcttagctacctgatagcgagagcccagaaatttttcctcgagtcgatcgagacctgccc

SEQ ID NO: 9760 - DNA, 1470 bp, Zea mays
aactccaaacctccttgcccctacgtgactcgccttcctctcctgactcctccgccttggcccgccgtctctcgccgccccggccccaacccctctcggactaggtgagggggccggctgcccagcgtcgtcgccggcgagatcttcccaccgccgctggcaatggctgccccgcacgacgaggccgcggcgtgggcggaggaggcggcgcgccgggtctgggccggcgccgtgccgctccaggtccacctccacgacgccgacgtcaccgcgctacccccgccgccgcccttcctgactttgggaccaagaattgggtatttgcccctcttgatacctgttataagggctcatttcagcaatgcactcccacctggtgttgacactgtttggtttgaatataaagggctgcctttgaaatggtatgtaccaattggtgttctttttgatcttctatgtgcagatccagaaagaccatggaatctaatagtccattttaggggatatccctcagaaatcttgtcaccatgcgagggtgaagatagtgtgaagtggagctacatgaattccctgaaagaggccaccttcatcattactgggaacagtaagagtgtgatgaatatgtcgcatgctgatcaagtcgctctgtgggaatctgtaatgaaaggtaacttagatgggtataaaaatatctccaccaggcttaagcttggaccatttgaagatgatgtgttagtacggacagcctccgtggagcggcaacgtcaacaaaattctgatgaacctgaatctcctggatctagcaaaccgtgcagggtccctgttcgattatacgtacgcaatgttcaagaagaccttgagtacatagaacatgcagttcctgtcagtgactgggaaaacgtgtcctacataaatcggccatttgagactcgcaaggctgaaggtagaagctacatcaccctggaacatgcgttgcaaacattgcttccggagttcttcagctcaaagcccccaggcagcgctgacggctcccaacacgcaggcgcaatggacgcagccgcagacagttcagatgccaccaactcttcaagtcgttctcaggaggcagagcaagccctggcaagtccagcagaggcgggttctgccaagagagcgaaagtgaagctggtgagggtgcaaggtgttgagctcgacatggacatcccgttcctgtgggtcgccgaccacctcaagaaccccgaatactacgtccacatctgtgtatacgtcggcactagaaaacaatagagataagagtacatggggaaattgttagatactgcgttaggagtgtgtcccagaaatcattttctttgttctttggttattacatgtgctatcctgtgtgcagatacagacgctgaaatttgtaacccttttggatgcacagtcatggaaggatggaattggatggcgaaaaaaaaaaaaaaa

SEQ ID NO: 9761 - DNA, 2027 bp, Zea mays
gggacctcgagcccgcccggcactctcactcacactctgtttctctctctctcgtggagacgactgggcgaccgccggcgccgacctacgccaggtgcccaagccttcgacgggaccatcgccgacgacgagcactcacgagctggatctgatctaattacagtcagaaatgtcttcagtcgggagcggcagtggcaccagggctgcgaatggtgcagctgccatcagtgctgccgcgacggcagcaggctcggccgacgccagattccacccccaactactacagcagcaggacaggcaaagtagatgggctggctgcttttcaggcttatcatgtttcggatcgcagaagggcgggaaaagaattgttcctgcagcacgtacttctgatgggaatggatcaaatgctcgcggaaatggtctccagtctggtgccaattcaaaccaaaatatgcctatgaatttatctcttctggctccaccatcatcaccggcatccttctcaaactctgcacttccttcgactgctcaatcgccaaattgctttctgtctgtatccgcaaactctcctggtggcccaacgtctaatatgttcgccgttgggccatatgctaatgaacctcaacttgtctcaccacctgtcttctcaacttacacaactgagccatccacagcaccgttgaccccaccacctgaactagcccatgcaactacaccttcttctccagatgttccatatgctagatttctttcttcttctatggatatcaaaactgctagcaaggagcataacatgcctttcttatcaacaacctattctggtggttcaggactccaagcatcctacccactttaccctgaaagcccttgtagcagcctcatctcaccggcttcagtaactccgaggactggtctatcctcacctatacctgagcaagaggttcctcctgcccattggaagacctctaggtccgcgtgcgacacaccatatttcagggcttcgcccattcctgagcaagaaaccactgcacaatggaagacctctagatctgcttgtgacacaccgtatgccaggacctcaccaaccaatatttttggtctggattcaaataccccgagaaactatatgctagatagcaatttctttcggccagcggcatctgctcagttctacctggaccaggctcagcaggcatttccacataatggcgggagggttagcgtatccagggagaagcaagatgccgatgaaatcgaagcttaccgagcttcatttgggtttagtgccgatgaaattgtccaatctcaatcttatgttgggataccagatgcggttgacgagtcattcagtatatcaccatttggaaacaatgctcctgctactgagatctgcccattcagtgatctgcctagtgaggttcagaaggcggataaatcatgcacctacgttaaagatggcacgagcccaaagaaatcagcaaaccaactctcgattgattctccaaataaagttctgcgcttggacgtgttcaaagtaacaaaagggggtcatctgtctgaggacgagggtattgcgagagatggtcatcctttcagaaggacaacggatgaaatatctctaaaaccgatagaggtaaggaagaaatctcctcctggccattcttgctcagacgcagagattgagtacagaaggacaaggagtctgagggatgccaacggtgttttatcacggcgtagcgcattggcaagacaactgcactaataagtcactagtatgcatggcaatttcatagttcatgtagagcagtgtgcattgaattcgagctgtcattagagtgatctgtaggcgaagagtagcctttatcgtatatgaggattatattaccagattgtgtgttctgggtatgtgatgatgagctttgtactctgtttgaactccaagatcctctttgtagacacctccagtcgttcccaggagcagtgaaatgaaatatcgttggcaaattacagcaaaaaaaaaaaaaaaa

SEQ ID NO: 9762 - DNA, 2196 bp, Zea mays
cggacgcgtgggtttttcttctccgggtaccctccgggccggccgggactctcactctccctttctctcgtggagacgactgggcgaccgccggcgccgacctacaccaggtgcccaggccttcgtcgggaccatcgccggcgacgaacacccaccagctggatctgatccaattacagtcagaaatgtcttcagttgggagaagcaatggcaccagggcggcgaatggtgcagctgccatcagtacttccacgacggaagcaggctcagccgacgccagatttcactcccaactactacatcaggacaggcaaagtagatgggctggctgcttttcaggcttatcatgtttcggatcgcagaagggcgggaaaagaattgttcctgcagcacgcacttctgatgggaatggatcaaatactcgtggaaatggtctccagtctggtgccaattcaaaccaaaatctgcctatgaatttatctcttctagctccaccatcatcaccagcatccttctcaaactctgcgcttccttcgactgctcaatcaccgaattgctttctgtctgtatctgcaaactctcctggtggtccaacgtccaatatgttcgctgttgggccatatgctaatgaacctcaacttgtctcaccacctgtcttctcaacttacacaactgagccatccactgcaccgttgaccccaccacctgagctggctcatgcaactacaccttcttctccagatgttccatatgctagatttctttcttcttctatgggtatcaaaactgccagcaaggatcacaacatgcctttcctatcaacaacctattctggtggttcaggactccagacatcttatccactttaccctgaaagcccctgtagcagcctcatctcaccggcttcagtaactccgaggactggtctatcttcacctatacctgagcaagaggttcctcctgcccattggaagacctctaggtctgcctgcgacacgccatatttcagggcttcgcccattcccgagcaagaaaccactgcacaatggaagacctctagatctgcttgtgacacaccgtatgccaggacctcaccaaccaatatatttgggctggattcatctacaccgagaaactatatgctagacaacaatttctttcggccagcggcatctgctcaattctacctggaccaggctcagcagacattttcacataatggcggaagggtcagtgtatccagggagaagcaaggtgccgatgaaattgaagcttacagggcttcatttggatttagtgcggatgaaattgtccaatctcagtcttatgtgggaataccggatgcagttgatgaatcattcagtatatcaccatttggaaacaatgctccagctactgagatctgcccattcagtgatctgcctaatgaggtgcagaaggcggataaatcatgtgcctacgcgaaagatgacacaagcccaaagaaatcagcaaaccagctctccactgattctccaaacaaagttctgcgtttggacgtgttcaaaggaacaaaaggaggtcatcagtctgaggacgagtgtatcaggaaagatggtcatcttttcagaaagacagcagatgaaatatccctaaaacccatagaagtaagaaagaaatcgcttcctggccattcttgctcggatgcagagatcgagtacaggaggacacggagtttaagggatgccaacggcgttctatcacggcgcagtgcattggcaagacagctgcactaatatggtactagtatgcagggtgatttcatagttcatgtagcctagtgtgcattggatccgagctgtcattagagtaatctgtagggcaaagagtagcctctaccgtatatgaggatcatattgccagattgtgctctagatatgtgattatgagcctgtactctgtttgaactccaagatcctctttgtaggcacactccaatcgtatgcaggagctgtgagatggaatagcgttggtacattacaggagttcgtgtttcggtcttcctcttcctgatgatgtaacttgtgtttgaatcttgcagaatgctggtttggaatcataaaaaaaaaaaaaaaaaggcgggccgcaagacagcaacttgtgtaacgcaatctgacgacgtctagggtctttatatatacgcaaagaaagcaacag

SEQ ID NO: 9763 - DNA, 1971 bp, Zea mays
gcggctctctccccccctctgtttctctctctctctcgtggagacgactgggcgaccgccggcgccgacctacgccaggtgcccaagccttcgacgggaccatcgccgacgacgaccactcacgagtcagaaatgtcttcagtcgggagcggcagtggcaccagggctgcgaatggtgcagctgccatcagtgctgccgcgacggcagcaggctcggccgacgccagattccacccccaactactacagcaggacaggcaaagtagatgggctggctgcttttcaggcttatcatgtttcggatcgcagaagggcgggaaaagaattgttcctgcagcacgtacttctgatgggaatggatcaaatgctcgcggaaatggtctccagtctggtgccaattcaaaccaaaatatgcctatgaatttatctcttctggctccaccatcatcaccggcatccttctcaaactctgcacttccttcgactgctcaatcgccaaattgctttctgtctgtatccgcaaactctcctggtggcccaacgtctaatatgttcgccgttgggccatatgctaatgaacctcaacttgtctcaccacctgtcttctcaacttacacaactgagccatccacagcaccgttgaccccaccacctgaactagcccatgcaactacaccttcttctccagatgttccatatgctagatttctttcttcttctatggatatcaaaactgctagcaaggagcataacatgcctttcttatcaacaacctattctggtggttcaggactccaagcatcctacccactttaccctgaaagcccttgtagcagcctcatctcaccggcttcagtaactccgaggactggtctatcctcacctatacctgagcaagaggttcctcctgcccattggaagacctctaggtccgcgtgcgacacgccatatttcagggcttcgcccattcctgagcaagaaaccactgcacaatggaagacctctagatctgcttgtgacacaccgtatgccaggacctcaccaaccaatatttttggtctggattcaaataccccgagaaactatatgctagatagcaatttctttcggccagcggcatctgctcagttctacctggaccaggctcagcaggcatttccacataatggcgggagggttagcgtatccagggagaagcaagatgccgatgaaatcgaagcttaccgagcttcatttgggtttagtgccgatgaaattgtccaatctcaatcttatgttgggataccagatgcagttgatgagtcattcagtatatcaccattcggaaacaatgctcctgctactgagatctgcccattcagtgatctgcctagtgaggttcagaaggcggataaatcatgcacctacgttaaagatggcacgagcccaaagaaatcagcaaaccatctctcgattgattctccaaataaagttctgcgcttggacgtgttcaaagtaacaaaagggggtcatctgtctgaggacgagggtattgcgagagatggccatcctttcagaaggacaacggatgaaatatctctaaaaccgatagaggtaaggaagaaatctcctcctggccattcttgctcagacgcagagatcgagtacagaaggacaaggagtctgagggatgccaacggtgttttatcacggcgtagcgcattggcaagacaactgcactaataagtcactagtatgcatggcaatttcatagttcatgtagagcagtgtgcattgaattcgagctgtcattagagtgatctgtaggcgaagagtagcctttatcgtatatgaggattatattaccagattgtgtgttctgggtatgtgatgatgagctttgtactctgtttgaactccaagatcctctttgtagacacctccagtcgttcccaggagcagtgaaatgaaatatcgttggcaaattacagg

SEQ ID NO: 9764 - DNA, 788 bp, Zea mays
ccaaaccggagttctgatacagcctgtgacaatggcatgtcaaagtcaaggtatactccgacactgtctcacattaagcatataagctgtgaactagactattacaatggttctggtgattcaaatttcttggatcttgactggcttacagcttcagacaatgaaaggtcaaaagccataagcactcctgatgtgaatatttcaactgatagtggtgttcgtgatgtaatatctgggacaacggacgatcaagcttctgggatccacgcccaggggttttcaaaggatttcgtgcagtggctcaatcaaggagaggcgttttggtactgacatcgcaaggtgggcttaccatgtaaaaccaagccacacgatggttgcacttgcaacccaaacctggttccaaaagcatcataactctcaaagaccattgcaagcaaggagggcaccatcgacgtgcacgagatttgcttgtcaaccatcagcattctcctcgcggccaaatatgatgacggggcttagagtcgcacacactgttagcagacttgtctagggaagtgtaccattctgttcattgattggagcttgctcaccaggcgggtagatagcgcatcgctgttgttcttctttaaaaaaaaaggaaagaaagaaggtggtaggtagtagtatattcttttgaagatgtaccattgtccagacatcatcgtctccatctccattgtgtaaatatatatgtatgtcccaggtgctcccacctttcgcaataaaaaaaaaaaaaaaaaaaaaaaaaa

SEQ ID NO: 9765 - DNA, 2386 bp, Zea mays
atctcctgccctcccgcgggtgcccgcaccgcgtggcgacgcctccccttcaaatctcccgggcctccgcgccgccggccggcaccaccgcaccgcaccgtctcggacgcggctgcagctccgagcattggattccgaccaactgaccgagcggcgtgtcagatgatctcgccggcgatgtgtcgttcggcgccgcggcgggccgcgcaggtccggcgcctcctgtcgtcggccgcgcccccggcgcacgccggcgctgccgtgcctgggccctgcatcgtgcacaagcgcggcaacgacatcctccacgatccgtggtacaacaaggatacggcgttccccatgacggagcgcgaccgcctcggtctccgcggcttgctcccgccgcgggtcatgtccttcgagcagcagtacgagcgatttataaactctttccggtcgctggagcacaatacccgcggcgagcctgactccatcgtcgcgctggccaaatggaggatcctcaacaggttgcacgaccggaacgagacattgtactacagggtgctaattgacaatatcaaggattttgccccgataatatacactcccactgttggcttggtctgtgaaaattacagcggtctgttcagacgaccccgtgggatgtatttcagtgcaaaggataagggggagatgatgtcaatgatttacaactggccagcagagaaggttgacatgatagttgtgactgatgggagtcgcattctaggcttaggtgaccttggtgttcagggcataggtatacctattggtaaactggatgtttatgttgcagctgctggtattaacccacagaaggttcttccaataatgcttgatgtgggaacaaataatgaaaagcttctggaggacaagctatatttaggactgaggcaacctcggctggaaggagaagaatacttggctgttgtagatgaattcatggaggctgtccatgcacgttggcctaaagcagttgtgcagtttgaagacttccaaatgaaatgggcctttgagactcttcagaggtatcggaaccgattttgcatgttcaatgatgacgtacaggggacagctggagttgctctagcaggcctacttggtgctgttagagcacagggccgtcctctccaggattttacgaatcaaaagatagtcgttgtgggagctggaagtgctgggataggtgtgcttagcatggctaaacaggcaatgttaaggatgcctgggatccacagaaccggggaagggcataatcaattctgggttctggacaaagatggccttattacgaaagctaggaaggacctggattctgcagtggcgcgttttgccagaggctttggtcctgatgaggtcccagatctctatgagggggctagtcttgttgaagtggtcaagaaagttaagccccatgtgcttttaggactatctggagttgggggcatatttaatgaggaggttctcaaagctatgaaagaatccgattcccctcggcctgcagtttttgcaatgtccaaccctactactaaagctgaatgcactcccgatgatgtattcaagcatgttggagataaagcgatatttgctagtggaagcccttttagtaatgtttctttaggaaatggtaaatctggttatgctaatcaagcaaacaacatgtatctatttcctgggattggtttaggtgcccttctttcaggtgcccggcatgtttcagatggcatgcttcaagcagcagctgagtgcctggcatcatacatcacagacgacgaaattcgaaaaggaatcctcttcccttcggtctccagtattaggcacatcaccgcacgtgtcggcgcagcagtcgtccgtgccgctgttgctgaagacctggctgaggggtgctgtgatgtgggtcctagggagcttgggagtatgtcagagtcggaagcagtggactacgtcgctcggaagatgtggtaccctatttacagccctcttgtgagcgacaaataataaatccgaagatctcgatgcctgcgcagaagcagatgttccattgaaggaatgtatcggatttgatatttttcttaaccatctctaaattagctgctcatctagaaagcatttcggcagagattggtgcccacgcatatggctaatgtatggctacattcatttgctctagacatgatttcgtcaccaggggacactcagttttgaaccgttgagcttcatactgccacgggaaccgtatttttcatcattattgtaatataaggcgccggagtttctgtcctgaaaataagcatgagatcagaagcgatatgatatcctttttaaaaaaaaaacaaaaaaactcgacggggggcccggtacccaa

SEQ ID NO: 9766 - DNA, 2434 bp, Zea mays
actgaggtggccccccacagcgaggccggccatccctttcctttccttcacctcactcgctctctcgcctctctctccgtgcggtgactgactgggcaaccgccaccgccctccccctccgtcgggtcttcgccggcgccaccagcgacgactgggcggtctgtgtccctcttcgccggagacgatcacccaccaggtggatgtcgattttttggttgacaagttgaaggttacgaactactttgatcctgaggtgaagaagtaatgatccgcccaggctcaagggactcgcaaaattatgataacaataatcaaagagttcatccgcaaccagttgatgagaacatgaatcagaacggggactcagtggacactatgatcgggaggatattcaacaacatatcctctttaaaatctgcatacattcagctgcaggaagcccacaccccatatgaccctgacaagatccaggaagctgataaacttgtcatagaggagcttacaaatctttcagagctcaagcatgcttacagagaaaaacatcctaagccaatagctgcatcccctcaagattcacgcttgctctctgaaatacaagagcagcagaatttgttgaagacctacgaggtcatggtaaagaagttccagtcccagatccagactagagacactgagataacccatttacagcagcaaattgatgaagctaaacttcggaaatcaaagctagagaagaaactgaaacagaggggcctacttaacagggagtcagaggaatctgacgaagaagagaactacttttccattgaattgacgccaagtttgtttacatctgctgtcgataatgcataccagtccatacatgaattttcaaagcctttgatcaacatgatgaaggctgcaggttgggatcttgatggggctgccaatgcgatcgaacctggtgtggtttacacaagaagggctcacaagaagtttgcttttgaatcctatatttgccaaagaatgttcagtgggttccaagaggagagcttttctatcaaggattctaacatcagtgtttccaatgaggctttcttccaccaattccttgcagtgcgagccatggatcctctggatgtcctgagccagaaccctgattcagtattcggaaagttctgtagaagtaagtaccttttgcttgtgcatcaaaaaatggaaggttctttcttcggcaacatggatcagaggaactacgtcatgagcggtggccatccaaggacacctttctaccaggcattcctaaagctagcaaagtccatatggttgctgcacaggttggcgtactccttcgacccaaaggcaaaggtgtttcaagtgaaaaaggggagtgaattttcggatatccacatggagagcgtcgtgaagaacatcatcctagaagaaggtgcggagaggccaaaagtcggcctgatggtgatgcctggtttcctgatcgggaccagcgtcatacagtcccgtgtgtacctttcagatgccaagtgtgctgactgactgaagattgcacaaggagcttgagggggtgcctttgctccttgggagagctaccagcagcataagtttatggtggactgttgtcttgtatgtaatgcgtgagacctgttgcttcaatgccgtgctacgtgattctgtccagtgggcttgtggtttccccatgttgcatttccatgtgttatacggctatgtaattctgctcagtgttttgcacacattatcagggtgattgattgatcgtgtaggctgcacttttcatctgaaatgtgtttgcccaatcaatcagatgattctgttggtgttccatgtcaagtgttgtagcttagtttctttgaacaaggtgtgtggaggattttgatggacaatgataaaactgatgacaatttagttgcttcatatggattccagcaaaaacatttctcggtcagaggtgctttaaccatttgccgatgaggaattcgacgaggacgacgacgacctcgatgacgaagccgccgcggacgacggcgaaccctccgcgtccccatccgaggcggctcgcctcgaggccgtgctccggcggctcaccgcggacgaggtctggatccgggtgcactagatattgcggctgcaaatgaagatgaacaaacgactgctacttcgccacctagaagtgtcaaatgggtagttaagaaaattacccctcgaaagaaactgaagaaccgtgcttatcacggacagtagatctgaaaaattgtgtgtaataaactgtgatgttcccagatctgaatgtgaaccgtgcatgtaccaccgacttatgttcccagatcatctgaaatgtgtgcttgtctgtctgtttattgccagatttagttcatgtgctaaaggaaatgtgtgcttgtctatgctgggatttttgttc

SEQ ID NO: 9767 - DNA, 1994 bp, Zea mays
ccccggccccgcccgcgaagagtccagagagaggctcggccactgcaggcgggccccacctgagcaaagacaggcgaccatttcctttccttcacctcactggctcgctcgctcgcctttctctccgtgcggcgacgacggactgggcaaccgccaccgccctccctttccctgcgctagcgacgactgggcgaacgctgcctcgcttcgtcacctcttcgccggcggcgacgatcacccaccaggttgatgccgattttttggttgacaatttgaagattactaacttctatgatcctgagggcaagaagtaatgatccgcccaggctcaaaggactcgcaaaattatgataacaataatcaaagagtccatcctcaaccaatcgacgagaacatgaatcagaacggggactcaatggacactgtgatcgggaggatattcaacaacatatcctctttaaaatccgcctacattcagctgcaggaagcccacaccccatatgaccctgacaagatccaggaagctgataaacttgtcatagaggagcttacgaggctttcagaactcaagcacgcttacagagaaaaacatcctaagccaatagctgcatcccctcaagattcacgcttgctttctgaaatacaagagcagcagaacttgttgaagacctacgaggtcatggtaaagaagttccagtcccagatccagaccagagacactgagataacccatctacagcagcaaattgatgaagctaaacttcggaaatcaaagctagagaagaaactgaaacagaggggcctacttaacagggagtcggaggaatctgacgaagaagagaactacttttccattgaattgacaccaagtttgtttacatctgccgtcgataatgcctaccagtcgatacatgacttctcgaagcctttgatcaacatgatgaaggctgcaggttgggatcttgatggggctgctagtgcgatcgagcctggtgtggtttacacaagaagggctcacaagaagtttgcttttgaatcctatatttgccaaagaatgttcagtgggttccaagaagagagcttttctatcaaggattctaacatcagtgtttccaatgaggctttcttccaccaattcctcgcggtgcgagccatggatcctctggatgtcctgagccagaaccctgattcagtattcggaaagttctgcagaagcaagtacctatcgcttgtgcatcaaaaaatggaaggttctttcttcggcaacgtggatcagaggaactacgtcatgagcggcggccatccaaggacacctttctaccaggcattcctaaagctagcaaagtccatatggttgctgcacaggttggcgcactccttcgatccaaaggcaaaggtgtttcaagtgaaaaagggaagtgaattttcggatatccacatggagagcgtcgtgaaggacatcatcctagaagatgtcgcggagaggccgaaagttggcctgatggtgacgcctggtttcctgatcgggaccagtatcatacagtcccgtgtgtacctttcaggtgccaagtgtgctgactgactgactgactgaagatgcagcagctacacaaggagctagatagagggtcatttgcttcttggaatcttgggagagcttcagagctaccagctgcataagtttaaggtggactgtgctgtcctgtatgtaacgcgtgagagacctgttgtttatctgccgtgctgggttggacgccttttgccttttgtggagttttccatgtgccatgcgattctgtctaatggtacgatatgtttctgttcccctatgctgggtttccgtgtgctatactgctatgtaattctgcccaaatgtttgtacatgttatcagtgtgattggagagcctatgtgatgctcgtataggatgcacttttcatccgaaatgttttttttttttgccagcccagatgattctattgtgccgccgtgtgc

SEQ ID NO: 9768 - DNA, 889 bp, Zea mays
gtgacattcccgttccgtcacctcactggctcgctcgctcgcctttctctccgtgcggcgacgacggactgggcaaccgccaccgccctccctttccctgcgctagcgacgactgggcgaacgctgcctcgcttcgtcacctcttcgccggcggcgacgatcacccaccagttgctttgcaggttgatgccgattttttggttgacaatttgaagattactaacttctatgatcctgagggcaagaagtaatgatccgcccaggctcaaaggactcgcaaaattatgataacaataatcaaagagtccatcctcaaccaatcgacgagaacatgaatcagaacggggactcaatggacactgtgatcgggaggatattcaacaacatatcctctttaaaatccgcctacattcagctgcaggaagcccacaccccatatgaccctgacaagatccaggaagctgataaacttgtcatagaggagcttacgaggctttcagaactcaagcacgcttacagagaaaaacatcctaagccaatagctgcatcccctcaagattcacgcttgctttctgaaatacaagagcagcagaacttgttgaagacctacgaggtcatggtaaagaagttccagtcccagatccagaccagagacactgagataacccatctacagcagcaaattgatgaagctaaacttcggaaatcaaagctagagaagaaactgaaacagaggggcctacttaacagggagtcggaggaatctgacgaagaagagaactacttttccattgaattgacaccaagtttgtttacatctgccgtcgataatgcctaccagtcgatacatgacttctccgaagcctttgatcacatgatgaaggctgca

SEQ ID NO: 9769 - DNA, 891 bp, Zea mays
gcagtgggtatccagaagagagcttttctatcaaggattctaacatcagtgtttccatgaggctttcttccaccaattcctcgcggtgcgagccatggatcctctggatgtcctgagccagaaccccgattcagtattcggaaagttctgcagaagcaagtacctatcgcttgtgcatcaaaaaatggaaggttctttcttcggcaacgtggatcagaggaactacgtcatgagcggcggccatccaaggacacctttctaccaggcattcctaaagctagcaaagtccatatggttgctgcacaggttggcgcactccttcgatccaaaggcaaaggtgtttcaagtgaaaaagggaagtgaattttcggatatccacatggagagcgtcgtgaaggacatcatcctagaagatgtcgcggagaggccgaaagtcggcctgatggtgacgcctggtttcctgatcgggaccagtatcatacagtcccgtgtgtacctttcaggtgccaagtgtgctgactgactgactgaagatgcagcagctacacaaggagctagatagagggtcatttgcttcttggaatcttgggagagctaccagctgcataagtttaaggtggactgtgctgtcctgtatgtaatgcgtgagagacctgttgtttatctgccgtgctgggttggacgccttttgccttttgtggagttttccatgtgccatgcgattctgtctaatggtacgatatgtttctgtgcccctatgctgggtttccgtgtgctatactgctatgtaattctgcccaaatgtttgtacatgttatcagtgtgattggagagcctatgtgatgctcgtataggatgcacttttcatccgaaatgttttttttgacaggc

SEQ ID NO: 9770 - DNA, 935 bp, Zea mays
tccgtccgcaggagggctcggccaaggcggaaggcgcacacagcgaggcgacgccggtatcggacaccggcgttgaggagtggaaaggcgccccggctgccacggacgcggccaacggcgcgtcggggccggcgggctatactcacaaggtcaagtccgcggctgcgggcaccacggagtacggcaagcagctggcgagcaccgtgtacgagaaggtcgccggcgtcggcaccgccgtggcgggcaaggtgcagcaggccacacagtcgcccagcacggcgacgccgggagccggcgcgcagcaggacaccgacgccgccgcgacggccacccccggcgccggcgggcagtccaagggaacgactgtcacggggtacatcgccgagaagctccgtccgggcgacgaggaccgcgcgctcagcgaggcgatctccggcgccgtgcagcgccgcaaggaggacgtcgggggcacggtagcgcagcgcgtgccggcgcccggccaggtggtgaccaaagcgcgcgaggccgtcgcgtcgctcaccggcgggaagcgggtctcggagaccgtgcagcccaccacagcaacagggaaagatgtgaaggaagtctatgcggcggaggcgcctgtgatccatggggaggagatcggcggcccgaagctgaacaccaataccatgtgagctgctcatggagagcgcgggtgatctctgagtattgtgtcaggtttgtgtacacagtacacgtgaatggtgtggtttgcgctgtggagtagagtaggagctggaataataagcgtgctggttgcgttcgccgtggtgcgctttggttttacgtgtgcccgtgattgtcgatctacgagtagttgtacgtatacatatatgtatatgtgtatccaactatgtgctcgcccacgttgaaggaaaattgttctgttt

SEQ ID NO: 9771 - DNA, 2078 bp, Zea mays
gtctgcgcgacccgtttgcagtgtacgagtcggcgagggctccggccgtgcaggacctcgtcgccgagtacgatcagccggcgtggacgccggccgtgcgagaggtggagggcgacggcgtctcacctagggtgcggctcggtgacgtcggcggccccgtcgtcgaggatccggccgcgccgcgctccaagacgcccgccgcacgaggtacgtatgtatggcacacgccgtcgaacgccactcgatcatgtctttccggcactctgtgatcgatcttgtggttggcactctgcccgtactccgtacgcgcgtggcacgtttccttctcgtcgatgtgttaattcgcagagggtgaggacataggcacgacgcccgtggtgcagcagtttgagaccatgagcttgtccgacggtccggcgcacgtgggcgcggccaaggagggcgccaaagcagaggagtgggaaggcaatgccgcggatatggtgggcggtgtggccggtggcgctagctacacggacaggctcaagaacgcggctgccggcaccacggagtacggcaggaagctagcgagcacggtgtatgagaaggtcgccggcgccggcaccggcaccggcaccgctgtgggcgtggggaagcgcgacgacgaacgcacagaggcggtgccggcgtcgaacacccgcacggacgcggcgagaggcgcggggtacacggacaacatcaagtcggcggccgcgggcaccactgggtacggcaagcagcgggcgtccaccgtgtacgacaaggtcgccggcgtcggcaccgccgttgcgcccagccgccgtcagcaggagggctcggcgaaggcggaaggcgcacacagcgaggcaatgccggtgtcggacaccggcgccgaggagtggaaggacgccccagccactgtggaggaggccaacaccgagtcgaggccgggctatacggacaagatcaggtccgcggctgccggcacaacggagtacggcaagcccctggcgagcaccgtgtacgagaaggtcgccagcgtcggcacagccgtggcgggcaaggttcagcaggccacgcagtcggccggcacggcgacgcccggggtcggcgcgcagcgggacacgggtgccgccgccacggccacccccggcgccggcgagcaggacaagggggtgaccgtcacggggtacatcgccgagaagctccggccgggcgacgaggaccgcgcgctgagcgaggcgatctccggcgccgtgcagcggcgcaaggacgacgccggggacacggtagtgcagcgcgtgccggcgcccggccaggccgtcgcgtcgctcaccggcgggaaccgggtctccgagaccgtacagccaaccacagccacaggtatgttggaacattagcaagatggaaatcgcattagcaaagttgacgcgagacgagctctgtgggttgcaggggaagacgtgaaggaagggtatgcggcggaggcgcccgtgatccgcggggaggagatcggcggcgcgaagctgaacacgaatgccatctgaagtgatacgcaagaggagagcacggctgctctctgattactgtgtcaggtttgtgtacacgtggatgatgtgggttgtgctgtggagtagcagctggaataaacgtgctggttgtgttcgacgtggtacgttttgggttttacgtggtggtgtgatcgtgtatccacatgcttttttactcgtgtatgtattccgtttatatatgttgagaattgttctgtttttgttgcgtccgtacagtcgcattctaaatcatatactcaatctatttcgcgttgctgtagtttgtgtttgttcaaacatttaatttttgaacatgtttaaactatttttggccttcaaaaaacttgtaaatgtaactgtggtcgcactatcgagtgcgaaaaagatccagaaagtgcaaaaagatcacgaagaccttcatacaacttcatacaagggaggatcaaaactccgaaatcatctaggaaagatgaaaaggcttcgaaagtcatttctaaggaagttcagcgtcagaaagaaaacaaaaaacac

SEQ ID NO: 9772 - DNA, 1799 bp, Zea mays
ggccggcccggagtacacgctacgacctcgcttccggcgccatggagacgaagcgggtggccatcatcggcgccggcgtgagcgggctggcggcgtgcaagcacctgctggagcgcggctgccggcccgtggtgttcgaggccggcaccgtcgtgggcggcgtgtgggcgcgcgtgccagacagcacggcgctgcagacgccgcggcccatgtaccagtactccgacttcccgtggccggacaccgtcaccgaggtgttccccgaccaccggcaggtcatgtcctacctggacgcctacgcgcgccacttcggcgtgttggactgcgtccgcttcggccgccgcgtgctcgggatggagtaccacggcgtcgccgaggacgacgtggcggcgtgggaggagtggggcggaaacggccaggcgttcggctgcgccggcgctggcgagtggcgcctcaaggtggccgacgccgagggacgcattgagacacacaaggcagacttcgtagttctctgcatcgggaggttcagcggcgttcccaacacgcctacattccctccaggcgaaggtccagaagcgttcgacgggcaggtgatccactccatggactacgccaagatgggcaccaagaaagccagggagatgatcaaaggcaagcgcgtcactgtcgtcggctacctgaaatcagcggtcgacattgccgccgaatgcgcagaagtgaacggcgctgatcatccatgcacaatggtggtccggacgaagcactggatcataccagactacttcgcttggggagtccacatatcgctgctattcctaaaccgcttcgcagagctcctgatccacaagccgggcgaaggcttcctcctttggctcctcgccaccctgctggcgcctttgagatggctgttctcgaaggtcgccgagagctactacgccatcccgatgaggtaagcacagcatggtgccggaccacagcctgttccaggcgctggccacgtgcctgatcgcgatccagccgaaggggttctacgagaggctggaagaaggcagcatcgttctcaagaggtcgaagacgttcagcttctgcagggaaggcgtcgtcgtggaaggcgaggtgtcgtcgtcgtcgctggtggagagcgacgtggtgatctacgcgaccgggttcagaggcgacctcaagatcaaggacatgttcgcgtcggagtacttccggagcgtcgcagttgggtcagcatgcactactgtgcctctctacagggagtgcatccaccctaagataccgcagctcgcagtgctcggttactcggagagcatcgcgaatctgtacacctcggagatccgggccaagtggctggcccatttcatggacggcggcttcaggatgccgagcgtcgctgcgatgcagaagaatgtcctcgagtgggagaagtgcatgaagaggtacgccggcggcaggtacttccgcaggtcctgtatagggctccttcacatctggtacaatgatcagctgtgccgggacatggggtgtgatccgaggaggaagaagggctttcttgaggaactgttcggagtctatggccctgctgattatgctgaccttcaccccgaccgcaagaaagacgactagaccttctgtggcggcactcgtaatctagaccttcattataaagtgggtatgtccatatggatgctgttaatgtccatatggatgctgaatatataaagtgggtattattgtgcctattaattaatatcgcaaaccgaataataaaaatggtcgaacaggtcgattag

SEQ ID NO: 9773 - DNA, 1559 bp, Zea mays
ttggcatcgcacggacacatatctactactatattaaaaacataatgtgggcatctggtgttaccacggcttcatcctgcatgctgacactctgggaccgcccacgcgtcccgactggttctcccgccttgccctgggccccacgcccagcgcccgcgcagtgctctctcagctaatgctctgtggctaatcaacaaaaaatagtgcagagcaagcactcgaacacaacgctctcctactctagaaatttggagctaactaccaaaccacacgtaccttagtgtttagaaataaaaataattatatctaaataaatatctcaatacctatttttatgatatataataattgtagtaaagcacgagcaactggccagtaaaagtataagcgtattcgattgtaaaatcaaatttattataaaacctttaatgctaaataaaaactaaaaataaatcgtttgaattatatatgcgtcgaagagtggaaagggtgagagaaattagaaaaaaaaagtgttgttacatgggctggtgggctgaccaatcttctgttcggagtctgccatcagctcatctctgtgcgactgtgcgcgactccccgtccgctcccctcttccaccacgtgctcgcgtccgctcctcctccttccgaaggcgagttcgcatcgcagcgtcgcccgcagcagcagcggaccgcggaaccacgccacctcatccagcggcattgagcgagggagcgattcgatcagaatcgacatggacggcggcgagcacgaagcggaggagtcctcctctaagcgccgggagcgcctgctcgccctccgctccgccgcaaacgtgtcgccggcgggggctcctccgccgacggccgcggggagcctcctcccggatcctgacctcccggacgacgaggccgcatccgtgtgcccgcccccgccccagcgtttcgactactacaccaaccccgccgccgccttcacatcctcctcaggaggcgccacaaatcccacctggtcccacaagcgcaagagccctcccgcctgctacgccccgcctccgccggcttacgggaactactgcagcaactgcacctactagcttatgctactcttctcctcgttacccactaatgtcgattgtctgattagggttgcatatgctgcacaattcagtctcgccatattcgtaattgaacctaaaccctaacaaaaccctcttcctgatttctagtattgtagtaggcagccctaactacacctcgccatactcaattggatctaaaccttaacagaaccatccgtggcatcatcctatatgcagagaaagaaaaaaagataatgcagctttagtgttcttccatagttgcacattcggcctgtgtgttatgttggcagtggccgagcttgtgcctaaagccattagggtttctatgtgggcaacgactgatatgcagccattacgtgcaagcgtgcaagcaggtcttttggtccgttagatctagatctaaccatatgctactatgtgtcctattagattgatacatgcatgtttttctttaatg

SEQ ID NO: 9774 - DNA, 2749 bp, Zea mays
agttcggagtctgccatcagcccatctctgtgcgcgactccccgtccgttcccctcttcactacctgcgcgcgcctcgcggccgcccctcctctttccaagggcgagttcgcatcgcagcgtcgcccgcagcagcagcggaccgcagaccacgccacctcagccagcgacagggagcgagggagcgattcgatcagaatcgacatggacggcggcgagcacgaagcggaggagtcctcctacaagcgccgggagcgcctgctcgccctccgctccgccgcaaacgcgtctccggcaggggctcctccgccgacggccgcggggagcatcctcccggaccctgacctcccgggagacgaggccgcatccgtgtgcccgaccccgccccagcggttcgactactacaccaaccccgccgccgccttcacttcctcctcaggaggtgccacaaatcccacctggtcccacaagcgcaagagccctcccgcctgctacgccccgcctccgcctccgccggcttacgggaactatggcagcgactatcaccgtccacaccagcagcctacatcatggcaagttcactcaacatccccgatgccacaagatgcggcaaggagcagtccatggcaaagccctatgcagttccaggatccaatgtcaggataccaaggaggtcctcccagcgctccacgtccttggggctcacattctggtcctggaggccgaggttcttattcaaatccaccaaactttgggttcagacacccgaatcccagccggggtggcagcccaatgaactatggaccaagaggtggcccatattcatcttatggacgtggcagggggcccaactactttggcagcccaggatcaagggggagaggtgggagggttggctgccatggccggagttacttcaacaagtcaatgcttgatgacccttggctggacctgcaacctggtgtcggcaacatactgatacctaggggtgagtatgactccaacaagtcctggctcccagaatcgctgcgaaaaaagaaggaaacgccgcctgctcaagggcaaattaaaccgacgccaggattgagcctagcagaataccttgacatgtctttcaatgaggtttctgataaagagaagtaggctttttttatgtatgcatagctacgacgacaggttgatgtttgtttttgccatcgtttgcaatagatctttggaagcacctcttcattacaactttgtaggctttgtttttttttaaaaaaaagagaagcagaactttggagaagggaaagttgcaaaggttgcgtagcatgtcagcgttttctgctggtgcattaacgaccaaaaaaaaaaacaaaaaagaggccatagaaagtttggtggagattctgttgaaggaaaaaaaaagaagggtgcaaatcttgtgccaaaggtcagctggagatagatgctgcgcttttctttctttgttggtgcatatatgtataacgtgagcatccaaagtgagctaggcacataatataaagcgcacagatcttttgcgtgatggcaattagagtctgctaagagaaggctgatcaagcatatatataagatgagaagaggaagaaaaggttgtgtttgttaggaagaaaggaccgtccatctcactgactgacttggaatagacaatgaaatggaagtgagtttgaagctaggtaatgccgatatcatacgtgcttgcatgttgacactgattacagactaatttgattccagactaatttgctcgatgcacatgccaccatgcacgagatctgactatgatagatagggctgcgaaatgtgtaaatatagttttagaatcacggcactaaacatctgggtgtcgtggagttagttgcacggtacccttcaaattagaagcatcttgcatgcatagggttacattttgcgaaggttgcatagggaaataaaatgattgacttttttaagttactccatagtccctacatcacaaaagagcatgtcatattccagctttccccttgaccagcaaacaatcttaaatctgatataaaaagtgaatatcaatattacggtgccacaaaaataaatatcattagatacgtcatgttgaaatatatagttataaatagtggtaatcttcaccataaatatgaaggatgcggtttgacggatggcgagaaaaaaaggttggcaaattcagttaggactggactctggaggaagaaaaggccgatcgccaggtgctgtcagtgtcaactgcgtgcgtgtttggcggaagcggaattcgtctcgccgtcaaatcagttctggtatggtttggttccgtgatttccttgaccataaatatttttataagtatttggaacgtcttaggtcctgtatagaagcactagagctaagctaataagttattagctagattgagccagttaataaacaagttgttagttgtgaggtagctagcaaccagttatgatattagctgaggctagttggaacgtaacaactaatttttatttttagatgttctaaacagtgccctaaaatcgacttgatttgatcaatctgacacgatcttcaaagtaatcttattggtaagactaataaattgttttgaaacgctatattgataagacttttatactgattttattggtgtaatcaataaccaatcagctaagatttttataacgattttaggaccatcgtttgcgtaggacgcatagactgttgaccgc

SEQ ID NO: 9775 - DNA, 646 bp, Zea mays
cgcggtgggcggcgggcggcagctgaaccgcggcgagagctggcggatcacggcccccgcgggcacgacggccgcgcgcatctgggcgcgcacggggtgcccatgagcttcctccccgacggcgggtccgggtgcagccgcggcccgcgctgcgccgtggacgtgaacgcgcgctgccctgccgagctgcggcaggacggcgtgtgcaacaacgcgtgccccgtgttcaagaaggacgagtactgctgcgtcggctcggcggccaacgactgccacccgaccaactactccaggtacttcaaggggcagtgccccgacgcgtacagctaccccaaggatgacgccaccagcaccttcacctgccccgccggaaccaactacaaggtcgtcttctgcccgtgaggccgctgaactagcatcagcgtgcgcgcgtcgaccaagaacaagaaataaacgaccgaggctgtgtatgttgcccgccgtgtgctcaactggagcaaaaataaagccaacaaaacaagcacgtgtgatctctatgtcaccaactctatcaccttaattaatggggcattatgaagttgtttctttaaaaaaaaaaaaaaaagcccctacgactacaaaagaaaaaaagaaaagaaaagagggc

SEQ ID NO: 9776 - DNA, 782 bp, Zea mays
cattgggtacctccgcgccggcccgggtccactacctcgacttcttcgacatctccctcatcgacggcttcaacgtgcccatgagcttcctccccgacggcgggtccgggtgcagccgcggcccgcgctgcgccgtggacgtgaacgcgcgctgccctgccgagctgcggcaggacggcgtgtgcaacaacgcgatgccccgtgttcaagaaggacgagtactgctgcgtcggctcggcggccaacgactgccacccgaccaactactccaggtacttcaaggggcagtgccccgacgcgtacagctaccccaaggatgacgccaccagcaccttcacctgccccgccggaaccaactacaaggtcgtcttctgcccgtgaggccgctgaactagcgaacaagaaataaacgaccgaggctgtgtatgttgcccctgtgctcaactggtggagcaaaaataaagccaacaaaacaagcacgtgtgatctctatgtcaccaactctatccccttaaataatggagcattatgaagttgtttctttacatgctcctactgaaattgggttttatggactgaatcgcaagcccccggtagtgatcttcggacgaggattgcaagcttcggctacaagcacaagcacgactacatctctcagcgtgctcaactggtgcttgagatgttgtagggatatgatggttattgactttaatattatataaaagataggttgctgacgttttaaaaaaaaaaaaaaaaaaggaaaaaaaaaaaaaaaaaaa

SEQ ID NO: 9777 - DNA, 1146 bp, Zea mays
ccggccgggcattggtacctccaggccggccgggacacgcttcagcattcttcaaatacttgcataagatggcaggttccgtggcaatcgtgggcatcttcgtcgccctcctcgccgtggccggcgaggcggctgtgttcacggtggtgaaccagtgcccgttcaccgtgtgggccgcgtccgtgccggtgggcggcgggcggcagctgaaccgcggcgagagctggcggatcacggcccccgcgggcacgacggccgcgcgcatctgggcgcgcacggggtgccagttcgacgcgagcgggcgcgggagctgccgcacgggggactgcggcggcgtgctgcagtgcactgggtacgggcgcgcgcccaacacgctggcggagtacgcgctgaagcagttcaacaacctcgacttcttcgacatctccctcatcgacggcttcaacgtgcccatgagcttcctcccggacggcgggtccgggtgcagccgcggcccgcgctgcgccgtggacgtgaacgcgcgctgccctgccgagctgcggcaggacggcgtgtgcaacaacgcgtgccccgtgttcaagaaggacgagtactgctgcgtcggctcggcggccaacgactgccacccgaccaactactccaggtacttcaaggggcagtgccccgacgcgtacagctaccccaaggatgacgccaccagcaccttcacctgccccgccggaaccaactacaaggtcgtcttctgcccgtgaggccgctgaactagcatcagcgtgcgcgcgtcgaccaagaacaagaaataaacgaccgaggctgtgtatgttgcccgccgtgtgctcaactggagcaaaaataaagccaacaaaacaagcacgtgtgatctctatgtcaccaactctatcaccttaattaatggggcattatgaagttgtttctttacatgctcgtactgaaattgggttttatggactgaatcgcaaagcatttgccggtttcccccggtagcggtagtgatatttggcccaggattgcaagcttcggctacaagcacgacgactacatctctcagcgtgctcaactggtcgcggggagaaaggtgcttgagatgttgtagggatatgatggttattgcctttaatcttatat

SEQ ID NO: 9778 - DNA, 545 bp, Zea mays
aactgcagcgcaagcgaaatcgccgaaggaaaggagaccccgagacgagcaaggcggcgagggagggcaaagaccacgtaccagcgcgcacgcacaatgtcgggagcacagggcgcgcacccggtcggccagacgacgccgacgacgtacgagtcggtgggcggcggggagaaccgcacgcgcacggacctgcggtcgcgggaggaccagggcgccatccagatcgagaaggtgcaggacaaggtcgacgatgccgcggggcgtggggtagaccacagcaccttcggcgccaacaaggagggccgcgacgacaaggccgatgccggggcaaccggcacaggcgcgtgattttgtgcccttccgcagtacctgagcgtgtgtgtaccatagctttgtgtccgctgcttggctgctctgtatgcgcgcgcgtggaatgtgtgaaacctttctgtaaaaatgcacttgttagattgaaataaaacaaggaccgactggtctgaatcccacttggtactcccccaattgggaaaaaaaaaaaaatataa

SEQ ID NO: 9779 - DNA, 6594 bp, Zea mays
  misc_feature (2234)..(2234): n is a, c, g, or t
  misc_feature (2691)..(2691): n is a, c, g, or t
  misc_feature (2897)..(2897): n is a, c, g, or t
ctcctccactccagctagcgagcaaatctgactgagacgacgtacggtataatagtaggtggaagcgctttttggcaagaatctcatgcatgttgtccttctccttaacattttgtacttggcacgtataggagcacaggaacaagtctcaaagtgtagtagatgcgcgaatatttctactttatatgtatagattattattccacaatcaatatggtagatatatactgtgatgctctaattaatgtcacatatataataatacccgcatacacttgcatatctcatatgccacataatatatacccacatatatatacagatgtgtctttcagctaataatgctccaaattttattattttttttccttgtttcgtgtccaaaacattttcaccgtcacgaagaaaattttggttcaaaataagttagattatataatctgagcagattataatctcaaacaaacaagttattaacccccgccccagccatccaagatccaattatcccaacgttacatctctcggtgtcttgctcacccccacttaggcactactacaggtcgtcttgcactttagtccccacatgctgacatgcacactgctattgcttattatctagctagctagctagccacacgagaggaggaacacaactcctgcttgttcatgtggcgatcgatatatccacctcccaagacctaacagtattatagccacaagagcaactttcattatcttcgttcataatcggttcgattatagagtatacgtcgtagagattttttttttattatcgattgtgatagttcaaagttccaaagcgcgcggtagccaaaagccaaaagaatcagaaatagccaaagtatttggtgggattctcgctttttcccaccaagaatcgcttttttctctgttcaaagatatttgttgacacaccacgaaaacaaccatatgcatatggggtgtctcaaatgggagactgttttacaaattctagtcctctctctagatctctcggatttgaattcaaaatgaaaccctcagatccgatcccatacatataccaaagctataccatagcatatatagaacaacaacagagaatatatcgcatacacaggccacgtgtgtacgtacgcacttgcgtgcgcgcagtgcacgacgagggttagcttagctgtggtggactggacggcgacggcgaccgcgacctgcatgccgaggttgagctgggacggagaagattcggcgtgggcgctacccaacaagccacgcaaagcaaaaaaaacgcagagacgatgctagctgcagaaccaccgctgctgcatgccgattaactgcatgcgtccacgcggagtgggtgatctctcgggctggccggcaccggcaccctagctactagcctactatacgtacgccgcggcggcttgcgcttgtcgtcgtcctccgctcgccttctgccaccgcctgcgacgctgctggccggccggccggtgcgcggtggcgcgtgatagatgaccactgtgtgagctgaactgtatgcacatgcatgcatggggcatggccatggggggccggccggatccatgttgctggccggcgccccgtgctgcccgccggccgcacgcatccatgagaccgtgagcatgatggctgctgcctgacgatgatctgcagcagccagcagcacgagctggatcgatgtacgtggatgatagatggagcatgggcttaaatagttcccgccaggcccggcccgcctcctcctggcgcttttcacttgttgcagcccggcctggcccagcctggccacaaacacaaagcaatagctacatcatacacaactcttctttgtgcgattgtaatcacagactagtatatagcctatgttaacgttgtgatccacagaagggatagaatgggttggcggcggcatgagtgagagaggctgagggcggtggggtcgtggaaggagaagggagagtgggagggatgagtgattattatccatataatattgtttgtgtgagtaaatgagatagggttattcatcgatttgaactgttgatttttgatggtgtgttctgtctgggtaccatttatttggtgaatttagtggaggttatgggtttggagtgatttgattggatgagttttgtaaagtttaaactagtgaattatatagtgttgtagatatagatagattacgttctcctgaaaatcaatccgantacttatgtattgattccctctcaagtctagttctctattattactacctccgtttgtaaatgtataagttatttttatatttttagatatgttacttttactatatagcattatagctagacaattagatatagactgtatcagctagatgtataataaaaactatgtctaaaatgaccttaatgaattaaatttaaaatagagagtttatgtaatggctagttggttggccgggttatataaatgggagcatatattgggtgcacatgacatgcccggtgcatatgtgcacatattaaatctcagcccaccatccgtgatccgacgtcgacattcttgcaagaatgtcaccacagtccagagtccacacaccacaccataccatgaatgcacgggacactggggccatgcggcaccaaacctactgtgctagccatcttgctggttttgctgcgncagcctgctcctgtacacggaccagtcagcatgtgcactcatacgcagcctacagcctactcctggtccttgagagccagaacgcatgcatgccttcagagttccgaaatccttgagagctatctccatcattcgctcgcctccaaacacaatcagaagctgctaaaacgtccaaacaatcagaagacggctgcaccgaaggcatncctcaattatacgctttcaaacttccatggcatccacagaccagcacagatgtagggctacatggttaatttaagaggggaattctattctatttcgtgctacaatccctgtttcacagtgcttgaataaggagggagcaaaagagcagcagtcatatttacagatgcatccacataacaaaaataatatctagaatgcagactaacatttccagctagaacaactaatttccccttccatatcaaaacaaaacaaaacaaaaaacaaaaacttgtatatcaccatgtttaagttcccaggccggtaccattcaaacttgaaaccagctttgatttccaacgagtctcttttaaggaggccaacgctgatctttgaaggccctgatgcattctaccgtggaccggatgctactcgacacgcccttccccagcttcggcagatcaactcctcctggaacctgagggctgtcctggaacctcggaagcttctgtcgagattctttcctcatagccgctacattgcccacgtagctgatggcgtcccataccagacctctgatgatggttagggcgtaggatctcgctgaatcaacagggacgctgctcgcaaaacctgtaggtgaaattcagaaggcagatctgtctgtcattcatgtgtcagatgtttgtccacaaaggtcgggaatagcaacaaataatcgggcctgcactgaggcggtgaggcctgctaattgtgcatcagtaatgataccatactgtcaggttgctaaatcatgtgcaccaactaacactggcaaggacaggtgaagcatggctgactgaatctcccctacagacatttgtttccaccaaatcaccaattgattgattactacttgcccaaatatttccattctatttctcacaacaatcaggtagagataataaaagcactactgccctacactaactgaaactcacactggatccaagaattagtacaccaataccaaccgtggtgcacatggattatatttactgaagggggcgcaataacagagcatgactaattaccaccgtggtcgtggttcctgatgaggctgtgctgcggcaggccgatgccgacgccggcgagcgtgaacccaacgctgaaccccacgccgcacccggcgcctacgtacccaatcacctcaggcccgaagccggggccccagccgacgccgcagccgacgccgagccccacaccccagaaggtgccggccgtcgggtgcacggggttccagcgctggtaccgcccgagcacgcccttgatgatcatcctcagcttcacggcagtctgctcgggccgcgcgccgcaagcagcagcaaaagcctcatcaaagatccgacttttttttcccccgcggaaaaggagaatagaagaagcaatggtgggcggcagcggagtaccagcttgggttgcgcatttgctgccgctggcgcggctggtgttgcgctggccggcggcggcgcgggagggggaggcggttggtggagctggggggagtctggcatcagcggacctgccgctgctgctgtgaagaagcctctgggctcctcgtgactcgtggacgccgccgttcgtgcagtctcccagctacagtccgaggtgtagcaaatcttatcgccgtctcctcgccgtcgctcgttctgtcccaagccaatccaatgcgtcgccgtcgtgggtgcctctcctggcaggaaagaggaagcccgtgcacttttgttcgttttcttgggccctggacgattttgggctagcccatctgcgcttgtggtcgttggtaaaaatatctggcctccaggctccccgggaggatttaagatttaacctgaaacagaacatttccatgttagatgaatagatggagaacaaattcattcttttaggaaaatcaatcatatatcgcagaagttctgtgttctgtgacagttgagatcatggaacagatctacaagcaatacaccatcggcagtggtctttgctaatttgacaccggtccataaatcatagacatggacccacaaatcatagacagagatagcaaaatagcaaagtgtcaacagttgggagtggcgaaattgcaaatatttccatgtacatgaacagaaaccaaaagccatcctttcgtaggattattagggctgatttggtgacccgggattctgggaggatcggagggaattgaggaggaaattagtttatttccccctcaatcccctccaatcctctcaggatctctttcgtaggattattaaagagaacagaatcagagaatacagtgatgcaggttctgaaacaaccttgtatcagaagtgcagaagttctgaaagaaccctacaggcctacaacaccaaactactcgtgaaacaacgggtgaatcaagtgctactggtttggtcagggaaggaacagacagcaggtgttagaaaaggctcagaactgtacaagaaaaccctatccgattcatcacttggaacccttgaagccaccgaagttgccggaatctgacgtgccagaaccaccctagcctcttgggtaacgtgaggagcctgaatcatcagagctccgggaacgcccaaagtcagcgttaccacgtctgctgaaatcactgtctccaaagtcgccaaatctatcagaacgactgaagctaggcctgccaaagtcactggaagatcgtctgaaacctccagatccaccgtggtaccttgaacctgagtcacggaatccaccgccgcggtcagaggaaccaccaaatctctcaaaatcaccgaagcctctggaacgatggtcttcaaagtcaccataaccttcacggctaaaaggtccacctgttcttctgcttccaactgatctagagcgagtatctctcatgacattaaacatgtctgcagcctcgtctgaaactggcatcttcggaagctgcaagcggcaaaaaaaaggaagtggataagttttccacatttcatctcaactacaaaaacaacttcatgaggattcgatagcttggttcctgaagtactctacctctgtgaacctgcatcctatatcttgctcgatgacccttacagctctagtctgttcatacgtgtatattagaattgcactgcctttcttccctgctcgtgcagttctcccagatctgtgaacaaataactctgatgtatttgggatctcataatgtaccacctgaatatataaggggggaaactcaaaactatgctcacaaaaagagtcagcagacatattttctggacgacaaaaaaagtttgtgataaatatttgcacatagtataccccaggtcactcactagatcaacgtggggtatgtccaatccacgagctgcgacatcagttgccacagggatattaaaacgaccatcacgaaatcctgaaagtgtcctctctctttgattctgtgaaatatccccatgcagtgcctgacactgataactccttcccatgacatatgccaatctatctgcttcccgtttagtttgagtaaacacaatgcattttccaccattggcatgctctttaatcaaaggaccaataattgaaggcttcccgaagttatcagatgcaatggaatagagagagattccttcaggtaatttctgatctgagtcaccaacaaggtctcttatacctggatcctttaagtacttgttcgaaatt

SEQ ID NO: 9780 - DNA, 1014 bp, Zea mays
ttttttttttttttttgtagaacaatggtcgcagatgattaaattactcatattatgttcagtcattccctcagtattttctagcttgttttctcctctgaattgcgtgtccattctgtggttcacacaaatcaccgtcgggttgcctgcgctccgttttcgtagacttcggaggcagtagggtagctgaacaactcagacgaccaggtggttcatgacttcatgtcatgtttatcctgaccgaagaacccaaacccaagccagcaacggcgtctcttctgttctgttctctggacagcggacacgagtccgccaccaattccgcgcgaaagatagtcccgcccatgtgtccccgggacgccgctcccgtcgcaccacgtccccaggccacgcggcgcctcacgcgcgggggggtacccacgaggccacgacgcagctcagctgtatatatacacacacgacttgcttcccatctctgcactgcagcgcaagcgaaatcgccgaaggaaaggagaccccgagacgagcaaggcggcgagggagggcaaagaccacgtaccagcgcgcacgcacaatgtcgggagcacagggcgcgcacccggtcggccagacgacgccgacgacgtacgagtcggtgggcggcggggagaaccgcacgcgcacggacctgcggtcgcgggaggaccagggcgccatccagatcgagaaggtgcaggacaaggtcgacgatgccgcggggcgtggggtagaccacagcaccttcggcgccaacaaggagggccgcgacgacaaggccgatgccggggcaaccggcaccggcacaggcgcgtgattttgtgcccttccgcagtgtacctgatcgtgtgtgtacgatagctttgtgtccgctgcttggctgctctgtatccgcgcgcgtggagtgtgtgaaacctttctgtaaaaaatgcacatgttagattgaaataaaacaaggaccgactggtctgaatcccacttggtactcccccaattggg

SEQ ID NO: 9781 - DNA, 1296 bp, Zea mays
aatcggttttttttttttttttttaatttaagaggaattctattctatttcgtgctacaatccctgtttcacagtgcttgaataaggagggagcaaaagagcagcagtcatatttacagatgcatccacataacaaaaataatatctagaatgcagactaacatttccagctagaacaactaatttccccttccatatcaaaacaaaacaaaacaaaaaacaaaaacttgtatatcaccaccatgtttaagttcccatggcggtaccattcaacttgaaaccagctttgatttccaacgagtcttttaaggaggcccaacgctgatctttgaaggccctgatgcattctaccgtggaccggatgctactcgacacgcccttccccagcttcggcagatcaactcctcctggaacctgagggctgtcctggaacctcggaagcttctgtcgagattctttcctcatagccgctgcattgcccacgtagctgatggcgtcccataccagacctctgatgatggttagggcgtagaatctcgctgaatcaacagggacgctgctcgcaaaaccaccgtggtcgtggttcctgatgaggctgtgctgcggcaggccgatgccgacgccggcgagcgtgaacccaacgctgaaccccacgccgcacccggcgcctacgtacccaatcacctcaggcccgaagccggggccccagccaacgccgcagccgacgccgagccccacaccccagaaggtgccggccgtcgggtgcacggggttccagcgctggtaccgcccgagcacgcccttgatgatcatcctcagcttcacggcagtcagcttgggttgcgcatttgctgccgctggcgcggctggtgttgcgctggccggcggcggcgcgggagggggaggcggttggtggagctggggggagtctggcatcagcggacctgccgctgctgctgtgaagaagcctctgggctcctcgtgactcgtggacgccgccgtccgtgcagtctcccagctacagtccgaggtgtgccaaatcttatcgccgtctcctcgccgtcgctcgttctgtcccaacccaatccaatgcgtcgccgtcgtgggtgcctctcctggccggggccggcctccccgtgcccttttgttcgttttcttgggccctggatgattttgggctagcccatctgcgcttgtggtcgttggtaaaaatatctggcctccaggctccccgggaggatttaacctgaaacaaaacatttccatgttagatgaggccggcctcgagggtcccaa

SEQ ID NO: 9782 - DNA, 1676 bp, Zea mays
gcacgagaccattacctagaacatcctaatcgaaaaattccattgacttgacacgctataaaatcccagctccatggccgcaaaccagcagctgcagcatcagcatcgttccatccatccatcctactatccagcttcagcccgggccagccgctccacagcagcaagcaagcaaggctgagaacgaacgaagcagcccgcatccgcatccatggccgccgtgctggtggcgaggcaggggcgcgagctgcagcggtacagccagagcacgggcgggcgcatcgtggtgggctgcatcccgtaccgcgtgcggcgcgacggcgagctggaggtgctggtgatcacgtcccagaaggggcacggcatgatgttccccaagggcgggtgggaggtggacgagtccatggacgaggccgcccggcgcgaggccctcgaggaggccggcgtgctcggcgacaccgagccggtcctcggcctctggcactacaagagccgccgctacgtggaccagacctacgagggcttcatgttcccgctccgcgtcgccgacgagctccaccagtggcccgagatggcgtcccgcaagcgcacctgggcaacggtgcagcaggcgatggacgggtgcccgcactggtggatgcgcgaggcgctggagcggctcgtcgcgcggcaagccgtgctgcagtctgccctctgatcgccgtcatcgactggggtaacaacagaggcggggaggcgcgaggcaccatgtgcgcacgccgccacggctctctctctctctctgtctcggtgcagcggcaggccggccggcccggcgttccgggtctggaatttggtcgccctcaccggagagtcgaacggcgcgccgcgcggctcgtgtgctctggcgatgctttcttgtgaccccccctgaccccgaggcgcggagtcgtcgttggcaaataaaatcatcagatcgtttttagagggcggatggtttagacgaaatggaaaacaaaatctgaactggacgcctagtggaaggaaaagaaaaggaatagaacagcagcgcgaaacaattcggcgattctttcgagtaactgcacaaattgtaaaattttagtggtgactcgtttcttgaccttgggtggcaccgtggcagaattgttacgagctgttcaattcaaaaaagaagaagaagaaaaagtttcagtctcaggcataagtattgctatacactgctagtaattactactcgtcgctgctgctggattaagcggtaaagatgcacaagggacagcaacaggccgaggtgttttcgcagcatctccaactttgctgtcgcaaacatgctatgctaggaactggaccctcttggcctcttggctagtgttccgtgatctgatttccggatcagacaaacacacgtttcgcgatgtccatccacccagacccaggagccaggaataaggatgaacccacaccatgccaaaagctgaccctgtcgatctggtcccgagcactcgagcagagcagcgacagctccagggcccggcggggacgtcgcgctcgctgatttttgcgccgataagaacaggcggggcgagggcatgacggcatgggcgcccgagtttcgctgccgcaatgagtaaactactccggcacaccgcgacgtgccgacggcgacaccccctccc

SEQ ID NO: 9783 - DNA, 1973 bp, Zea mays
  misc_feature (10)..(10): n is a, c, g, or t
gctagctcancagtatcattatatgtgaaaacaatcattaaattcttgcaataaatagctctgactattattctttttatgtactacacatcaaagccggactagtggccaagtagagctcttacctcttctatctatatcaaattaaatcgataacacgtgatccagtaaaataaaacacaccattactagagaagtctagaatgccaatcacgcttagctacttttcggaaaaagtcaaaaatattcagcaaactaataaggcttgtacgaaaactgaacacatctgattcagactaacctgagtttgaggctgaggcgaaggcagcaacatacgccacagaagatccgatccgatccgctcggcttgtccacgtcggtagccagtcctcgcgtccatactccaggcccacgcatgttactcatcagttaatcactcggcaccaacagcattccattgacttgacacgctataaaatcccttgatccccagcctccatggccgcaaaaccagcagctgcggcatcatcgttccaccttactctccaggctccagctccgaccccggcgagccgctagagcaacgagaacgaatcagctagtagccgcccgcgtatctccatcatggccgtgctggtcgcgaggcaggggcgggagctgcagcggtacagccagagcaccggcgggcgcatcgtggtgggctgcatcccgtaccgcgtgcggtgcgacggcgagctggaggtgctggcgatcacgtcccagaaggggcacggcatgatgttccccaagggcgggtgggaggtggacgagtccatggacgaggccgcccggcgcgaggccctggaggaggccggcgtcctcggcgacaccgagccggtcctcggcctctggcactacaagagccgccgctacgtggaccagacctacgaggggttcatgttcccgctccgcgtcgccgacgagctccaccagtggcccgagatggcgtcccgcaagcgcacctgggtgagttcaacttctccttcaattcagaccaatccgttgcctgcccctcccgtcgtcgcggcaccggctgccaatgcacaaataaaactaatgcatatctgaccgtgcgctcgcgatccaatggaacaggcaacggtgcagcaggtgatggacgggtgcccgcactggtggatgcgcgaggcgctggagcggctcgtcgcgcgccacgccgtgcccgtgctgcagtctgctctctgaacgattgggcggagaggaggtcgcgcgcggcggctccggcaagaaaggaccggcggcagcgcgagccaccacggtagcgcgtgctctccctctctcggtaaagcggcaggccggccggcccggcgttcgcgggctcggatttgggtcgccctcaccggagagtcgacgtcgcaccgcgcggcttgtgctctggcggtgctgctttcttcttgaccccctctcgaggcgcaggagtcgtcgttggcaaataaaatcaaactgtgtgtttttagcgggcaagtgattggacgaaatgtaaaaaagaacgaaaccagaacagcagcgcgaaaaaaaaaaacaattcacgattctttcgagtaactgcaaaaagaaaattgtaaattggtagcaactcgtttcttgcccttggtggcaggattgaataaactgatcgatacggggagctgttcaattgaagaaagaaaaaaaagttgacacattagtcctgaactcctgatgctgttgagctaggcggtgaagttgctcagctcaggggacagcaacatctcgagaagtgctcgcagcatctccgatttgctgcggaaaacatgctagaactggatccttgggtggcgctcagtgacgagatctccagatcagacgagcacacaactcgcgattcctttgccaacgtccatccaccccaggagccgggaataggaacccgcaccgtggcagataaccgacctgtc

SEQ ID NO: 9784 - DNA, 2462 bp, Zea mays
  misc_feature (2007)..(2007): n is a, c, g, or t
  misc_feature (2122)..(2122): n is a, c, g, or t
aaaaaaaaaagttggcggggcttcaggctaggtttcgtctttttccgttcacaggcggccgtcggtgttcggtgcccctctcctgccaaacgatcccgagcagtgccaccggtgcggccgtgcagaggaagcggccggggtacagtacaggatgcgggggttgacacgcgctgcgaaacgcgcaggggagatggcgttcaacgccggtggtggcgccgtcaactggttcccgggccacatggccgcggcctcccgcgccatccgcgatcgtctcaagctcgccgacctcatcatcgaggtccgcgacgcccgcattccattatcctcagcaaatgaagaccttcaaccagtgctctcagcaaagaggcgaattcttgctctaaacaagaaggatctagcaaaccccaacataatgaataggtggctgaatcattttgaatcatgcaagcaggattgtatctcaataaatgcacatagctccagttctgttaaccagcttcttggttttgctgagctgaaactaaaggaagcaatctcaaaggagccaacccttctgattatgcttgttggtgtccctaatgttggcaagtctgcactcataaattctattcatagaattgctacttctcgatttccagcgaaagataaaaataaacgggctacagtggggccactgccaggtgttacacaagatattgcagggtataagattgcaactcagcccagtatttatgtgcttgatacacctggtgttcttgtgccaagcataccagatatggagacagggttaaagcttgctttaacaggagctgttaaagactcggtagttggggaagaacgtatagcaaaatatttattatctctttttaacattaaaaagacacctctacactgggagcggttgttgcacagaaaagaagagtggtgtgaagagatatgcagcagtaataaaaaagacaattcattacggaggactcggttgaataactctgatgccgtatatgttcaggatttagtgacggaggtgcagagggcactatgccgtacgttcctgaacttcactggcaacatcgaggaagaaagtgagctggaaaccctcatagacatgcagcttgtggagctccgcaaggtgttcaggataccccataagcctttcgatgaaacgcagggccctacctccaagaagctcctaactctcttcagatcagggaagcttgggccgttcatcctcgacgaccttcctgatggatctgagaaataacctgtttacttgattctttttattttgcactgggcagctgatgttctatgatggaaggcattggtacgagctgatgttcttgcagggaggatatgtttatctgtctccctcgttggctgtttggctttgacagaacatggtatgttttggaattgaagtgccaggccttcaatggtacattgtcttgtcgatacttttgttggacttatggtagtggtatccatctcataccatgaaagtttgagtgtaacatgaacttaaccctgaaactcttgctgttagtttctattccttttgtcttagaaaggatacaattttagttagcttttctaggcacaaaagttggctttcgtttattctatgttgtgagctatttggctttattaataaaaaaacaatgctttctctcctagggtcgcatgcaccatttgttctctttctcgatgtcgccttgggaagctattcttgatgtcgccttgggaagctaggattgtacttcttccatttcttttatttgtcgtctatttggcgtcaaataaaaaaaagatggaggtagtatttttttaaccttttcgttttttttaattttttgaggtcaccgaaaacggaaaatcacctaatttcgttttttcagaccggatggattttgaaatttttaaaaacggatctcagatgttttcccgaaaaatcctgctttctcgccgaattttgttgtttttgtaccaaatagagatgagtaatttcgnaaaaaataaattttgataggatttgtttataatgtgtataactcatgctgtacaataaataataatagtttcaggcataattcgttcataaaaaatcataaaggtcatatatatncaaatagaaaatgcaattcgaataaaatacaaagcaatacaactttataatagcgacatactactttataagagatttgaataatattacctatttagcacctgtgtgtttaataattaatatggccctccacgcgctacgtgactcagctcggagtggactgctgtctgtggacgcatcacgcccggctccactttctgcccgtttggctagaggtgtcttttcgatttgcaagtgcggcttagaactgctttgatgaacaagaaatgatccagtcgcctttgccaaaatgaaaaaaagagaaaggaatcgatgcataaaaactacccttttaggacgt

SEQ ID NO: 9785 - DNA, 797 bp, Zea mays
  misc_feature (49)..(49): n is a, c, g, or t
gcaggaattcggcacgagatttgtagagatttgagatatcctttttagncttctacgtctttgcacgcggtgattgggatttgggagcttcagcaaatataatatgtttatgggactatgggagttttgaatgcggcaccagtcatactgaatcaggttcacactccaaaaaacacagcagataattcttcaggccaaggcacatccaaagatcacgagcattctattatagttactaggcctgatggcatgccagcacatattaggatgctagtgtttggttttgccttgacgaactctctacatgatggatatctcaatatgggcacctggaaggtaagggaaacacacgcccattctcacaattgagcagatgttcatgcttcctgcaactccccattttgcattcagaaggtcataatttggtaatacatggcaaacggatgtgagtttatagtataactgtctgtattgaaactataacatcttaggaaatagtcaaattaaatttgggcctggatataaaattgggattctgtttcaagtgtaccatgtactaaattgaattgttacagaacaaaaaaaaaaaaaaaaaaaaaaaaaaaaaaaaaacaaaaaaaaaagggcagccaataacctacgtgaaactcaaaaaataaagaataaataaaagggtcgataccaacaagtggaccaacttaccctaaaataaatcgaacaacagtactgcggactaaagaatatatctatggcgggctctattggagctccctttacaatttcacacaacatactaa

SEQ ID NO: 9786 - DNA, 869 bp, Zea mays
gaccctcgaggctggccgggggtccagcaatcaaaacacgccacctgtgcgtacactccacacctcgcctccgtgcttccgtctcgcacttccggacataaagtgcgaccatggccatggcggcgctgcgggaaacctcccgctgtttggcgtccagggggagatctgcggcctggcgacccgtgctcctcgcgcagtcccgcggcatcacttacaagctcttcgtcggaggtttatcacagtttgcgacggaagcaagcctagcagaagcattctcacgttacggacaagtaatagaagctaccgtcgtcagggataaggtgaccgacgtaccgaaaggattcggcttcgtgaagtttgcttccccggaggaagccaataacgcgagggaagagatgaacggcaaggcattgaacggtcgggtcatatacgtggacattgcaaaggccagacaggaccgtgctgcagatgccctcccaatagcgagaggccctcctaagcctatcagcaacgactgatagaggaaggccttggtgtgcgctcccaatagcgagaggtcctcctaaaccaattagcaacggctgttcaaggaatgcctggtgtgtagttccctcccgtcctcagctggcatactagttcgattctcagatacggaggctcttagatgatgaaacgtgccgtgaaatattctgcggaactttgaggttctggttgaacacaagtagagtttatttagatttaattacccggagtactcgtgtcatgcttgtccggatcagacactgcgtttgcttgtcatgacaggtgctgctttaataaatccgtggtgctagccacacgaaacatcttgatgttacaataaaaaaaaa

SEQ ID NO: 9787 - DNA, 887 bp, Zea mays
aagcttgtccattctcactttcctgactcacctcactcgatcatcctccagtcttgtcgtcgcctgctagcttgaatattacgccagcatctcgccaggaaaatggcgggcactactccgcgccgcttgctcctggtcatcgtccccctcgtcgccgtcgtgccggcgtccgcaaaagactacatggtcggcgactcgtccgggtggaagtccggagtggactacgctgcctgggccaagggcaagccgttcgccatcggcgacacgctctcgttccagtacagctcggcgcactcggtgctggaggtgagcgaggcggaccacggcgcgtgctcgccgagcaacccgctgcgctcgcaccagggccagagcaccaccatcccgctcaccaaggccggcacccgctacttcatctgcggcgcccccggacactgcgcctcgggcatgaaggtcgccatcaccgtctccggcggcggcggcggcagcagcagcagcgccgacaacaccgcgacgccgtcgggtccctccgtgcgggcgacgaacacgaagccggcgtccggtggcgcgacgacgacggccgagtcggactccagcgcggctggcagcggcgcccgcctcgcgacgggcctgctgttcggggccgcgggcctcgctgcaatgatgggctgaattgaggacccgctagggaaaaggcagtgcggtttcacgaatttcctatttagtttcctgcgttctctgcttgcgtccccgagtcgcgaggctgagtgtccggccgtgcatatttttcgtatacttttgctgtgttttttttggggcttctcgttgttcaatactgttgtttcagaataaaatttcatccttgaccattcaaaaaaaaaaaaaaaaaa

SEQ ID NO: 9788 - DNA, 1619 bp, Zea mays
caaggctgaacaaacgcgcatgccaggatgttgctgttttgggcctggggtttctcaaagttgatgctcgtgcacggaaggatactcaaaagattgaccacacagtgaaggagacgcccgcgcgtccgccccctcgtcccagagcttttaaggagcgagctcagtcagacttgaaggaagctgcagacaaacattggagtgatggtgccttggaggcagacctgcgacgagctgacttggttgttaaacgacgtgccatggaagacgctttcatggcattgaagtttgttcaggatatccatgacatgatggtgaacagattatatgagcagcttccgaaggacgggtcatcttctcgtacaaattcaacagggtttattacacttgagaagaacgggaaggctcttgaactgtttcctggtgaagtttctgctgatcagatttatgccatagaggaagcataccagagtatggcatctgccttttctgaagctgatggtattgactacacagatcctgaggagcttgaattgttggtagcaactctaattgacctggatgccatggatgggaaaaggagtgtttccttgattgctgaatgttcaagctctccagatgttaatactaggaaagccctagctaatgcattggctacagctccatctatgtggactcttgggaatgctggcatgggtgcattgcagaggctggctcaagatcccaactacgccgtagctagggctgcatcaagagccattgatgaactcaagaagcagtgggaacttgaagaaggtgacagtctgaggtttgtgatgaaccagaatctggcctccagggatactgaggatgacaattcaccagcggatgatgccgcatgagtcataaacaagatgaaagattccagtttcagtggcaatggatcaaagcacaaggaaccaccatgggcagcacataagcattcccattttacttttaggactgaaaatcagatagatgtgttctagttgaagggggggggggggggggatgattacagtgcacccagaagtctgctccctttggatattgttcatgcatgaagcaaaatgttatatctgaaaagcgcgtaccttgtaccaaagtatctagtcttaggtgctccttgtttttatatatagtactgtaatatggcaaaaattatgtatctggataacacatgtagcttggttttgtcggcactgcatattgaggattgagtatgacttgtaccagcatagctaccgtctgctggtaacattaataagtacctttatccgggtaacaattgcacacaggaacatggatccgttataggatggttcttggctcctctgtccattagtgaatgcttccgttcaacaacaatttgttttctattgacgtgcttttcatctggtctggcagtgaccgagcccaagtctcacggcttaggaaaaaaacaccgtcaactctacgccgctctacgccgctcacctatgcctacgtataggggaaggaactagagaaaagggatgaccgtgctttattaatcttaggcaattacatgaaaataatacaagagaactaatatacttccggcctttacacactaaagtatacat

SEQ ID NO: 9789 - DNA, 1283 bp, Zea mays
ctcgaatatttgtccgtgcccgctattttatttttggaaaaaagcgacaaataaaaaaacaacagagggagtaatttgtagtagcattaagataattgagtcctttattaatcgtgtcgatgtctaaaggaacttcggtctcatacagctagtgctatccatggccacagaacgtacacgatcaccgtcactagtccttgatctccggcgagcggagcgacggcggctgcacgacgcggcgcacgccgggcagctcgaccagccactttccgagcgtgtccgtggtggacgcgccgaccgtgtcgacagtgagcaggcgggagttccaggccaggacttccgggaggcaggcccgcagcaagtagacgcccatgtaccacctgggctcgaacacgtacctcgcgccccggcacacgtcgcgcaccacggtcctggcgaagtcgcccacgggctcggccggcgtcggccccaggatggcgtctctttcgtcctggtccaccttcatctcgcctcccttggtgagcatcttccccttggtgatctcagactccaccacgcctggcaccacctcggtgatgcggatgtcgctgcccagctccatcctcagggtgtcgtagaagctgagcgccgccgccttgctggcattgtagaaggtgttcctcccgatgaatatgtaggacgagttggaggtgacgcccacgatccggccacggcttctcctgaggtgagggatggcgagccgggttgggtacacgtggccccagaagttgatgtccatcagggctctcaagtgcctgacgtcctggatctcttcgaacttgcacacttgccagatggacgcgttgttcaccaggtgatccagtctaccgaagtagctaatcgtgtcgtcgatgaagccctcgcagtcccgaggcttggagacgtcagccgggaggacgaggacgcccggcgagcccagccccagcgcgacgtcgccgacctcgcggaggctcgcctccctcctcgccaccagcgccaggtaggctccccgcttcgcgtactcataggccaggtgctcgccgatgccggaggaggcgccggtgatgagtaccaccttgccggcgacgtcctcggggaagacggcgccgaggaggtacgtggtcagcttgtacacgtagtacgccggcaggaccagcggcagcagcgccgtcagcgccacccgcagcgccgctccggccaaccccgtcctgctcatgcccagcatcaaggtgtgcgcaattccatgctcgccacagctatttttt

SEQ ID NO: 9790 - DNA, 1655 bp, Zea mays
ggttacgacgaccttgccactacttgacgttttaaccggtctcgctcgagatctctagagaaatgaatgttgatcacaagctcccagagtcacggacttggtttcgcattcataagagcatctccaatattatgacttataaaattaccttataattaaaaaatagtatattttatagaatttaagttactaacaaaacatttcgtttcaacggtaaagcctcaaatataaattatagggcaaccaaatgtggtgtaatatatttaagttaattgagtgtgtatcctatagttttttgaccaaattttataaaataaatagttttttttctatacagaccccctttcaatctgagacatcagttaggatgtaatcaagtggacagagatcttagtgtgaaggcgaagcccgctgtccacagtccacacgaagctcagcgctcggtaggcaaaacgagcgagcgcggccttctttagagaaaaaaaaaacgcgaaacgcactcccagtcccagcgtcactgacgccgtccagagaacgcgcgcgcacattccccgcgtattctgttctgcgagacgccgcgagcctttaccggccggcgaacgaatccacgggtggctctgccttttgctattatagtctttaggggagaacagaaacttggcttacatctcaagcgcaccatggattggatttggcccgctcgcacacaagtcgcctgctgcttccgcacatcccacggcatattaccactcggcgaaccagaccagaccacgacgtcgcgcgcggccaccactgggctcgtcgccgatcgctataaaacgcggcgggtacctcgaggccggccgggaagccgagaccaagaaaacacaagtacagactacagagccatctttgatctttccagtccaagatgagcgtggagatcctcgacgggcggacggtgcagagcttcgtggaggacgagcgcgcgttcaactcgtccgtggacgcccgcttcgcggcgctggacgtggaccgcgacggccgcctctcgtacgccgagatggccggggagctcatggcgctgcgcgtgcgggaggcgcacttcggggccgacgcgccggcgcccgcggccgagctcgccgcgctgtacggggcgctcttcgcgcgcttcgaccgcgacggggacggcgccgtggaccgcgacgagttccgtgccgggatgagggaggtcatgctcgccgtcgccagcggcctcggcgtgctccccgtgcagatggtggtcgaggaaggcagcctcctcaagtgggccgtcgacagggagctggccactaccatgccagcttgaccagctcggctccatcagctagctgcctgacagtgtgcactagcgctagtgtcacctctagctgaatgggagttttatcacctatgtatgtatgtaaccgtacgccgagggtgtcggtctaatttgggctcgtttaacgttttcgtgtttgtagacctgacatgagtatgtaacgtacgcactgaaccttttttatcagtccgaaaagtagcgttttacacttttactccaagagacttcatgcatcgttgcaagatgcgagttgtaaaatggaattggagcaccacccacccaatctcctcattggaggcttggagccctccttgta

SEQ ID NO: 9791 - DNA, 1109 bp, Zea mays
  misc_feature (16)..(16): n is a, c, g, or t
agcccaacgccatagngcctagccacccacgacacgactcgattcccagacccaaatccatccatcaatccatccgcagcgggcaggcacacacacacaggcttttgcgttggcagggatggacgcgttctactcgaccaccgcctcctccacgtcgtcggcgccgtacggcggctacggcggcggcggcgaaggctggggctacgactcgctgaagaacttccgccagatcagccccgccgtccagacccacctcaagctcgtttacctcaccctatgcgtggcgctggcctcgtcggcggtgggcgcgtacctgcacgtcgtctggaacatcggcgggatgctgaccatgctcggctgcgtcgccagcatcgcctggctcttctcggtgcccgtctacgaggagaggaagaggtactggctgctgattgcggctgccctcctggaaggggcgtcggttggacccctcatcaagctcgccgtggaatttgacccaagcatcctggtgacagcgttcgtggggactgccattgcgttcgcgtgcttctcttgcgcggccgtggtggccaagcgcagggagtacctctacctgggcgggctgctctcttctggcctctccatcctgctctggctgcagttcgccgcctccatcttcggccaatccactagcagcttcatgtttgaggtctactttggtctgctcatcttcctgggctacatggtgtacgacacgcaggaggtcatcgagagggcgcaccgcggcgacatggactacatcaagcacgccctcaccctcttcaccgacttcgtggctgtccttgtccgcatccttgtcatcatgctcaagaacgcggctgacaagtcggaggacaagaggaggaagaggaggaggtggtgaaaatctgtgtgcgaacacagcactcaagggaagggaaggaactggtgcgtctgaaatgaagctcccacataactaggtgtatacatatataggagcgaggagttactttggggtggaactgaactgtgcaagtgtcgttcctttgttttctcttgcctgttgaatgaatgtgacaaatctccacctgtcctgtcctgtgaatgaatatgac

SEQ ID NO: 9792 - DNA, 1251 bp, Zea mays
gcaccagagaagctttcgttccttcgtccttctccttcccaccgcacgccacgccacgccggctcggtacatatactaccggcccattgggtccctcgaggccggcccgggcattccccctcgatcggcctccctcccccaagatcctccactcgatcccaaacaaaccaacaaatccatccatcgcacatggacgcgttcttctcggcctcctccgcgtcggcgccctacggctacggcgccggcggatggagctacgactcgctcaagaacttccgccagatcacccctgccgtccagacccacctcaagctcgtctacctcaccctgtgcgcggcgctggcctcgtcggcggtgggcgcttacctgcacgtggtctggaacatcggcgggacgctgacaatgctcggttgcgtcggcagcatcgcctggctcttctcggtgcccgtctacgaggagaggaagaggtatgggctgctgatggcggctgccctcctggaaggcgcttcggtcggacccctcgtcaagctcgccgtggaatttgacccaagcatcctggtgacggcgttcgtggggactgccatcgcgttcgcgtgcttctccggcgcggccatggtggccaggcgcagggagtacctctacctgggcgggctgctctcgtcggggctctccatcctgctctggctgcagctcgccgcctccatcttcggccactccgcaaccagcttcatgttcgaggtctacttcgggctgctcatcttcctgggctacgtggtgtacgacacgcaggagatcatcgagagggcgcaccgcggcgacatggaccacgtcaagcacgccctcaccctcttcaccgacttcgtggccgtcctcgtccgcgtcctcgtcatcatgctcaagaacgcggccgacaagtcggaggacaagaagaggaagaagaggtcgtgagcgtcgagaacggaagctctcccacatgcataggagtaactgccagggttccttcctggggtggaagtgtggaactgagcttgaatgttaagaagtgttcctttgttctcttcctctcttgatgactctgtaaatagctatgtcaatctggttaagtttggtttggttgcatgtgcctgtgttcgctgccctttggatagaatgcaaattaaagatgttgctattgcacaaaaaaaaaaaaaaaaaagctgaagcctaataaagttttacagtttttgagctaataaaaaaaaagggcgccct

SEQ ID NO: 9793 - DNA, 1167 bp, Zea mays
cattgggtacctcgaggccccccggggcgattggggccctcgaggccggcccgggcattccccctcgatcggcctccctcccccaagatcctccactcgatcccaaacaaaccaacaaatccatccatcgcacatggacgcgttcttctcggcctcctccgcgtcggcgccctacggctacggcgccggcggatggagctacgactcgctcaagaacttccgccagatcacccccgccgtccagacccacctcaagctcgtctacctcaccctgtgcgcggcgctggcctcgtcggcggtgggcgcttacctgcacgtggtctggaacatcggcggtacgctgacaatgctcggttgcgtcggcagcatcgcctggctcttctcggtgcccgtctacgaggagaggaagaggtatgggctgctgatggcggctgccctcctggaaggcgcttcggtcggacccctcgtcaagctcgccgtggaatttgacccaagcatcctggtgacggcgttcgtggggactgccatcgcgttcgcgtgcttcaccggcgcggccatggtggccaggcgcagggagtacctctacctgggtgggctgctctcgtcggggctctccatcctgctctggctgcagctagccggctccatcttcggccactccgcaaccagcttcatgttcgaggtctacttcgggctgctcatcttcctgggctacgtggtgtacgacacgcaggagatcatcgagagggcgcaccgcggcgacatggaccacgtcaagcacgccctcaccctcttcacagacttcgtggccgtcctcgtccgcgtcctcgtcatcatgctcaagaacggggccgacaagtcggaggacaagaagaggaagaagaggtcgtgagcgcgtcgagaagggaagctcttccacttccacatatgcataggagtaactgctggggttccttcctggggtggaagtgtggaactgagctgagtgttcagaagtgttcctttgttcggcacctttgttctcttcctctcttgatgagtctgtaaatagctatgtcaatctggttaagcttggtttggttgcctgtgcctgtgttcgctggcctttggatagaatgcaaattaaagatgttgctattgcacagaaaaaaaaaaaaaagcggccac

SEQ ID NO: 9794 - DNA, 731 bp, Zea mays
tacccgccggcccggccgggatctcatcttcttcctccatccgcactactgagagcgacaaagctagctctctccagggatcggattcggatcaccatgccgtccaccgtgaactccgcgtccctcgaccagaaccttgagctcgccaagcaatgctcgcgagaggccgccctcgcagggttcaaggcagcagctgtcgcgaccgtcgcctctgcagttcccaccctggttagcgtcaggatgctgccatgggccaaggccaacatcaaccccgctggccaggccctcatcgtctccacagttgctggcatggcgtacttcatcgcggcggacaagaagatcctctcgctggcgaggcagcactcgtacgagaacgcgccggagcacctcaaggacacctccttccagggcaccggccgtccgcacccagggttcttcaggccttgagcgagagaccatcaaactaccgccctagctagctggacgcactagttcgtcagcggccgccgattcatgtcgtccaagatcatatcaactactgctagcatatatatagtgtactagctagtagtaggcaccggcgatccgtgcatgcatgtgctcggagaaactgtaatggcttagtgctctgctccagtttactgtatctaccttccattatcatataataatatcatcctcctgtttaaaaaaaaaaaaaaaaaaaaaggaccctagggggcccggtaccc

SEQ ID NO: 9795 - DNA, 2476 bp, Zea mays
ggattaattagtcttaaattttttgtcttatcgtttagtctttacctatataattatttttgtaactagactttatttaatactcatatttaacattaaaatatttgatgtgacatatactaaactttagtccctgaaatcaaacacctccttatacagagagcacctttaggctgagtactttctaagcatgatgcacgcatgacttattggtagactacttctttccgtaggcaaatgataaataatcatgatggaatgttaatggaagaaataacatgtattaatgaagttacatatagaccaataaaaaccagaacagtagacctgaacaaataaaaaataagttcaatagaatactcgcatcattataatactcacatattataaactcagtagatttcctccaaacaaaagcaactgcagaaaaatggcacacctccacggaatctgtgagtgtgttagttcttgggtcatagatctgtaaaagctgcatgtcttctttatataggaccacccttccgtcacgtaataccaccaatggatgcacatattgaaaactggcatactctttgaactgtatgatgtattgtttgacccagagacccttaccagagtccatcagaatccaaatgtccatactgggagctgggccatgcacaacagctaaagagccattcagattggctaatgttagctgctttataggtggaagccgaaggtcattgaacacctgagcagcagcatcagaaaagctgatggggggtcctcgcataaatggcccccatttctcagtctcaatgtcaaatgtaattatcaagtcttcctcagtagctcgacaatcataagtgatagaatggtgcggatcaaaacattgggagtagatgattccattaattaccacactggtgaacacaccaaactgaatgtttttttcgaggggcgtgactgccctccaccctgggtggttgctaccgttgactgtgcagatctcgagcagctgcctgcctccaaactgaacggaaagatggtaaagcttccggaacaccttgtattcccctgtgctgctaacctgaccaaacagatatctggactgtgaaataaagctcgatgtgaaatctatgtgttcttcggcgaagctgtttggtatttgatacacagctccagttgctgggttgagcaattgatctggtaagtaatgcacgtctccgctaaacgggttgcagaatcggtagctgctgctgctgctatcggttttcttgacaaagacgaggtcaagggccgtgctcacgactctctgacccggcacgccgcgcacctgctttaagatttgccctgacagatccatgatgttgacgtgcacgtcgggtctctcatcgatggcggcgatgatgagcggccccgggtgccgcatggcgtgggccgcggcgaagtgcgggtcagagaggatggaccgccacaaccggcacaccgtgcgcagtcggcagaggagcttggcggggtggcgcagcagaatctcgtacacgaggaggtccaggggcagagccccgatgttgaacgtggcgagggcgcgcctcttcggtgcggcgtgcggcttgaacgacgacgccatcgctgggacagggaggaaaaggggatcttcgtgaggagcaagcacatcgaggagaaaagttatctccgcgatcggagaagacgcaaacggcttacggggagatcgtggttagttcacgtgccggaactaaccggcggcgtaacgatcggcgctgtcgtcggaggcggtgaggacttctatagttctattgccccgcgcgagggcctggtgcggcgatcggtaggccagtcatgaactcatgatgacggcggcggtgagtcggggacgacgacaagatgttattgggctgtggacctgcagcgcaactgagccccggtgcataaatcaggatgttttttgtgactagcccatgtctcatttatatttcaaactttgctctcttctaatttataattcatttgactttttaaatcaattataactagcttgtcttattaaaaaaatacaaaaaatataaaaaaattaaaactatacttaaagtatattataaaaaattaactgcatatgggagtaacttccacgacttttgtttgacacaattatataacgtaccctctggaccagtccgcctaaagcccaccatcgtcggcgtccggcgttcatgcgctcgcggcagcctattcagacgggcatctcgctcttgaaacctaggctgaaagagaagcgaggtccgtccttataagggcaccatgacccccttggctaggcggggtggtactaacccagagcgtgcataccggtctctcacatctcaccctttaagaggctcaaagctctcccaggcagcagcggcaatgtgggcttcgataccaattgtaacgcaccctctgggtcaatcccgccaaaggccaccatcgccagcgt

SEQ ID NO: 9796 - DNA, 1277 bp, Zea mays
aaaaaataaagtgtcaagtccagtcaaatttaatacttattttcatgaaaatttttgtctatcaggcacattcaggatatgcccctactactcattactcatatgtgttttgaatatgtgttttgaaattggaactttttggataaactttataccccgtatctatgaagtgggaattcttacaggatccatttgacacccaatatgaaagaaaagaagtaccccctatttattttcccaaaactaaagaactaaagtaagtaaaaaaaaaaaaaattaatgaggtaaaacactgtatagaaaatgagacctatccctttatgatagagatagatttttgttgtattatttgttttcttgtattattagtaaaaaagaagcgtccttcttttctttggttaagcgaaaacgatctcgatctgtgattctttaaatatccagaatgatccatttcggtaaggttaaggtaagaactgttcgttggatagaatggattctgaaaaaatcgtacttttcttattttttttttttttttttttcttttggtaattcgagtcgaagaagtatgagaattttagaactactcaaaaacgaccaatcttttcattggcatagcttatttgtttatatagttaattgtttttgttacagaaaaatagattaattcattaaattaattccactttttttgaggttgatagtttatttgttgggaaagagtggatccttctcatttcaggattaatcatcttgagttctctgttgaaaatggaaattcaataataataataaataagtcttaagtaaactattttattcctctttttcgaactatgtttcattcatatgatagaatatgggtttaaataaattgtatctttgcagagtgttccccgataaatacttatttcttttatccaattttctccatagatagcaggtttgaattagtatacaaaagcaatgactattcatgattccatccatattggatcaattctcgataccattttgcaatgaaattagaggaatgttatggtaaaacttcgtttaaaacgatgtggtagaaagcaacgtgcgacttgaaggacatgatcgattgtggatttgcctatccatcattttccatagtaatgaaaatgctcttggctcgacatagtctgttctattcgtcccgaaccgaattttcgctgggttgtttgtaagtaaagtaaatagtacctcggccgcgaccacgcgacagaatttcttttttgatcaagggaaagaatctaggg

SEQ ID NO: 9797 - DNA, 764 bp, Zea mays
tagtatcatgaatcccgagctctcatgcatggatggtaagttttttagttttcagctcagtgtccattttccttaattgatcatcagaacttcagaagtatggagtaccaaattttcttcgtcttagcaaatatatcctcattgcctgtgcgaacctctcagcttgtggaatgatactcagtctggcctgttttcttttggctttatctggttgttcttttactgtattgatgctgttcctattttcaagctactgggaaagctgccgaatttggacagctcaaagatggttatatgttcgacacatcaactggcatgtcacgaatgttgttaagttccccaacgtgtccagttctggaggtccttgggaaaaaactgtcgtttgagattgctgttggactcaatggtcgagtctgggtgaatgctcctgcagcaagtactgtcattcttgtatcaaatgcaataatgaggtcagaatctttgagcggcataaaacaaagagctatggtagaaaatctattggagagattgtcatgatgataagtcagcaagcattagtctaaagtaaaatggaggagtttccattgtgtcagttcaaagtaaaagtaggaaagtttgagatcaaagtgactatccccatcaaaagattattatgtatcacgtgtcgtagtatacagtaccctatactcttttttatattaaattatcaatgtatttatccaaaaaaaaaaaaaaaaaaaaaaaaaaaaaaaaaaaaaactcga

SEQ ID NO: 9798 - DNA, 1359 bp, Zea mays
gcacgagaccattacctagccccgcctccgcgacgcacggagtcagtctcaccatctctctcagccgacagccggccaccaccagccgccagtagcaatagcaaattagcaacccgccgagcaccgacctctccatagttcctcttcctctacggctctaccgagcaaccgccggcgtcgaccctgccgtccaggcccgtcctttcgcggtgccgcctgcgtccctgccccagccacccggccgccacccgccgccgccagcgaggagcgagtagtagcgaccctggtccctgccgccctgcgttcgtggctccctgcccagtgcccctgcgtcagcgtcactgcactctccgaggtggaggtggttctcaaatctcaagtccatccacggcgctactaccctcgcctcaatggagttgaggaggcctgcaccctctcctctcgtcgacaactacgtagtacctggtgacgtcgtcctggacctctccgagatgaacaaccagaccattaaactcggcgcgggtctgcgtcaggagtgtgacaccatccaggcgactagtgctgggaagctgcggcagttgaaacccaacaagtattggattgaaaactcacagaaaagatatataccttctgtagaagataccgttcttggtattgtggtcgacaccaaaccagacaactttttggtagacataaagggtcctaatttggcctttctaccagtactttcatttgaaggcggtacaaggagaaacatacccaagttcgagattggtacattaatatatgctcgagtggtgaaagcaaatagtatcatgaatcccgagctctcatgcatggatgctactgggaaagctgccgaatttggacagctcaaagatggttatatgttcgacacatcaactggcatgtcacgaatgttgttaagttccccaacgtgtccagttctggaggtccttgggaaaaaactgtcgtttgagattgctgttggactcaatggtcgagtctgggtgaatgctcctgcagcaagtactgtcattcttgtatcaaatgcaataatgaggtcagaatctttgagcggcataaaacaaagagctatggtagaaaatctattggagagattgtcatgatgataagtcagcaagcattagtctaaagtaaaatggaggagtttccattgtgtcagttcaaagtaaaagtaggaaagtttgagatcaaagtgactatccccatcaaaagattattatgtatcacgtgtcgtagtatacagtacactatactcttttttatattaaattatcaatgtatttatcaaagtcttgcgtccgaaaaaaaaaaaaaaaagggcgggtctagtgc

SEQ ID NO: 9799 - DNA, 1657 bp, Zea mays
acgcggggaatatgggtttaaataaattgtatctttgcagagtgttccccaataaatacttatttcttttatccaatcttctccatagatagcaggtgccggccgggccgcgaaagcaatgactattcatgattccatccatattggatcaattctcgataccattttgcaatgaaattagaggaatgttatggtaaaacttcgtttaaaacgatgtggtagaaagcaacgtgcgacttgaaggacatgatcgattgtggatttgcctatccatcattttccatagtaatgaaaatgctcttggctcgacatagtctgttctattcgtcccgaaccgaattttcgctgggttgtttgtaagtaaagtaaatagtacacgatggagctcgagaggacagaatttctttttgatcaagggaaagaatctagggttagtgaaaactaataaattaggccaactttgtcagtctatccttaatatagaaatcaaaaggttaaaataagaaaaagtctaattttggaagattggaaaaacttttttgatgaaaagtctatctgaatcaattgttcatatttgatttctatagaagagtgaaatgctttatcgaaggaaataagaaaaaagaaagggtatgttgctactcttttgaaagaaaaaagaataggagttcccgaagtaatgtctaaacccaaggatttcacaaatcaaagataaaggattccggaacaagtaaacacgattttcaaccgtctcaacaatagaattagatctgaataaggaataaaagtcaatttgttcgagatgagataaagaaaagagtttagagacgactcaaaaaatttcgaagggtttttcttttgaagtttgtcagtaaaaattagccaacttgagtcatgagtataaatgaaatttgttttttcttttctttaaggaaattaatgcaagtcataatcgaatttctatctatttgcattatagacagattgcattatagacagaaattcgaatcattttctcgagccgtatgaggagaaaacctcctatacgtttctaggggggggttgtttatctacatctatcccaataagctatctatcgaatcgttgcaattgatgttcgatctcgaagagaaggaagagatcttcgaaaagtaggtttttatgatccgataaagaatcaaacttgtttaaatgttccagctattctctatttccttgaaaagggtgctcaacctacaagaacagtttatgatattttaaggaaggcagaattctttaaagataaagaaagaactttgagttaattgaagaactaaatgaataaaaaagtaggagagggtccttagttccccggcccgggttagacacaatttgcctctttcttagtcctatttttttttttgctgcatttatgtcgtgccaatccaacaaaagtccctattttatttcctttttatatctaattacattgtatttgcattgacaaaggtctattgaacaaatagaatttgtagatagatgggtctctttattgtcactccatattaggtatttctgtctacacttcattcaaatgatagggttgcccctcttgcatgtactctcatacacatacaagattattttaccccgcgtactctgcgttgttaccactgct

SEQ ID NO: 9800 - DNA, 1404 bp, Zea mays
cattgggtacctcggccccggccgccctgctcctttgcgcccacgccaacccagttaccagagccgccattgccgccggccctgcgtatcggcaacaccacacgaccgcagccattgtatcacctattcggtccgagacgcttcgattcagctcgctgttggtgttcccggactcgctgcgcgggattgatggcaggtgacgcgtgaatttgtcgtcggagttgaagctccgccgtgaccgcgctcactgccgtggcccggaacatttgcgctactaacctcggtggaggtggttctcaaatctcaagtccatccacgcggaatcggacttgacctttatttaaggcgcagggctgcaggcccgttccctcagctgaccatacgcaaccgcacaggaaacaggaccgtcgccgcgaaccgccgtactctataccgacttctccgaacctcctgtcctccataccggcgctcctaccctcgctgcaatggagttgaggaggcctgcgccctctcctctcgtcgacaactacgtggtacctggtgatgtcgtcctggacctctccgagatgaacaaccagaccattaaactcggcgcgggcctgcgtcaggagtgtgacaccatcgaggcgactagtgctgggaagttgcggcagttgaaacccaacaagtattgtattgaaaactcccagaagcggtataaaccttctgtagaagataccgttcttggtattgtggtcgacaccaaaccagacaactttttggtagacataaagggtcctaatttggcctttctaccagtactttcatttgaaggcggtacaaggagaaacatacccaagttcaagattggtacattaatatatgctcgagtggtgaaagcaaatagtatcatgaatcccgagctctcatgcatggatgctactgggaaagctgccaaatttggacagctgaaagatggttatatgttcgacacatcaactggcatgtcacgaatgttgttaagttccccaacgtgtccagttctggaggtccttgggaaaaaactgtcgtttgagattgctgttggactcaatggtcgagtctgggtgaatgctcctgcagcaagtactgtcattcttgtatcaaatgcaattatgaggtcagaatctttgagcggcataaaacaaagagctatggtagaaaatctattggagagattgtcatgatgataagtcagcaagcattagtctaaagtaaaatgggggaatttccattgtgtcagttcaaagtaaaagtaggaaagtttgagatcaaagtgactatccacatcaaaagattattatgtatcacgtgtcgtagtatacagtacactatactctttttttattaaatttatcaatgtatttaacaaaaaaaaaaaaaaaa

SEQ ID NO: 9801 - DNA, 2336 bp, Zea mays
gaaaggtagatattttttcccgtctcgctcaatgattcaccccatcgcagccatcgatcagaaaatttacggctcatacttcgcgtcccccgagcccccccggcctctccctcaacttcagcaagttccccgaaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaagccacctctcgatgacgagcgccttacccggcggttcctcagcagcccgcagctgtcgctcaaggcgctcccgctgctctcttcctgcctcccctccgcgccgctctccaccgccgacaggacctggatggacgagtacctcctcgaggccaagcaggcgctcgggtacccgctcgcgccctcggagacgctcggcgaaggcgatgactgccccgcgcgtcatttcgatgtgctgttctacctcgcgttccagcatctggacccctctagcgagcgcacgcggatgcggcacgtacggaacggccactccaggctctggttcctgggtcagtacgttctggagctcgcgttctgcgagttcttcttgcagaggtaccccagggagtcacctgggccgatgagggagcgggtgttcgctctaattgggaagaaagtgttgccccgatggctcaaggcggccagcctgcacaatttggtcttcccctatgatgatttggataagatgatacgaaaggaccgggagccaccgtccaaggctgtattctgggcaatatttggagctatatatttgtgctttggaatgcctgaagtctatcgtgtcctttttgaggcatttgggatggatccagatgatgagagctgtcagccaaaattgcgtcgtcaactagaggatgttgattatgtttcagtggagttcgaaaagaggcagctcacttggcaggatgttgctgcctacaggccgccaccggatgctctttttgctcatcctaggcttttccgagcttgtgtgccaccaggcatgcatcggttcagaggaaatatttgggattttgacagtagacccaaggtcatgactaccctaggatatcccttgcccatgaatgacagaattccagaaatcacagaagcaaggaatatagagcttggacttggtcttcagctgtgttttttgcacccatcaaaacataagtttgagcatccaagattttgttatgagcggcttgaatacgtcggccagaaaattcaggatctagtaatggcagagaggctactcatgaaacacctcgatgcaccaggcaggtggctggcggagaagcatcggaggacgttgatgaacaagtattgtggacggtacctgcgggacaagcacctgcagcactacattatctacggggagacagtgcaagacagattcgaacacaatcgacgtctaaggaatccttcaacgacctctgtccagcaagcgctacatgggcttgcatactgtgtgtatggcaaacctgacgtgcggcgtttgatgttcgaggtgtttgacttcgaacaggtccagcctaaagcagtctgaggatcttctccattggtaccgatgctagagttgctgaatgctgaccaacaagaccccaatggcagtggtacaaatgctgtagattcttgaagtcgtccattcgacaggagatctttcgattctgaagcctgaagccctgaaccctgagctgggacagctgattagccactgggtcctgtctctcctgaaaccgtcactgttccaaccttcttgtccgtcggaaatggtagactagtgatgctgtggatcggaggctgctgttgtttgaacttacaattttgataattcgttgtaaattcctgtttgggcagaaacgcaaatagcagcagcatggcagattcatttcctatcagaattgtagtccgtaatggagaagcagtaagatgaataatataaagatattcattcgtccgccaaaaaaaaaaaaaaatcgtgcataggataattgtctgttatactccatttagatattggagcacggaattggaaattaaaatcagctttcctaaattctgttgtttagttgtatatggaattgagatttggaatcagagatctaattctctggaattggattataactagaaaa

SEQ ID NO: 9802 - DNA, 3635 bp, Zea mays
aaaaaaaaatcacacacccacagagcagagagggggagaggctgggagaggctccaaaccctagccacacacgacgcaacgcaacgccgatggggtgcgcgcagggcaagtgctgcctacggcggcacccgaggaggggctccgccgctgccgccgttggcggcggcgccacgctcggccgcgccgcggtgcccggggccgggctggtactggagtacgccgcgctggctgtggcggggctgtacccggactccacagcccgggagtcccaggacgcgcaccttgtcgccacgcgcttcgcgggcgacccggacctccacctcttcgctgtcttcgacggtcatggcactgccggcaccgcctgcgctgggttcgcgcgggacgcgctcccgcgcctcctcgcgtcgctctctctcgccagcgccgccgaccccaccgcggcgttccgcgaggccatgctgggcgccaacgccgagatgcacgcggctcccgaggtcgacgactccatgagcgggaccaccgccgtggccgccctcgtctccggcggcgctctccacgtcgccaacgtcggcgactcgcgcgccgtcgccggggtctggcgcgccggccgcgtcgtcgccgaggacctctcctgggaccagactccgttccgcgccgacgagcgcgagcgcgtcagggcctgcggtgcccgggtcatgtccgtcgaacaggtggagggcatgcgcgatcccggaggccgagcgctgggcgcccgacgagggggacccgccccgcgtctgggcgcgcgacggcctctaccccggcacagccttcacgccccgccccggcgacctcgccgccgaggccatcggggtcatcgccgagccggaggtcaagagcgtcgagatcactccatcgcacctcttcttcgttgtcgccagcgatggcgtgttcgagttcctctccagccaggaagttgttgacagggttgccacgtatcaagatcctcgagatgcctgctcagcaatcgctgcagagtcatacaaactatggctggagcacgaaaataggacagatgatataacgataatcattgtgcatatccgagacatggaaagtgcccggccgccagtgtcttagcggccgccggcataaacagaagtaacttattcagtgactggctgaaaatttgttgttcttcccaaaatttactgtcaggccctgcagggagtgacaaagcggactacggtagcgtgggagcgtcaatagctgtgcacgcaatacagtcagaggtacctgtatttgtagaatcagaagcaagtcacatgaacagatctttctcctatgcaccctttgctgatgcatggcagaatatcagatgcttccaagcccgtgcaaagcgagcagcgagctgcatcacaaccggtgcaaacttggcatcaaatggacgggggtactggattggtctatgcagcaaagcatccctcctccaacctcctgatgaaagtggaggtaaatctgataatcttctaaatcctttgctatgaaggagaaattgcaaaccagctcacataagtgtgcacattctattgcagaatggaagttgaatgacaaaaggaggcctcgcaataacccaccgccatcctccgtaagatattttgcagaatggaagttgaatgacaaaaggaaccattattgagaggccgttgtcttttgcagagagctactaaccgtacaatggatgtgatgtttgctagcagcaaatctcgtgttgctgctcgtgttttggtagagcacctgctgctgccgaccatgtgtgggatctagagctggttggttgacgatgtccgtggaatggagtgtagttaggtgggtgtcaatgtatgtttggagctaaaccaatatctgcgctcattttagtttatttttgtaatttaaatgtcgtggggtcagcctggcacgattatactgacagatcgtgtttagatcttgctcgtggcctaccgtgctggttgctagttatgttcgcaccgggctggtctgacccaaatcgtgctttaggtactttactgacaatgacatgattcgagaagaaaaatgacgcttcgatatttcattcctgccaaacaagaacgctttaacttggcagtgttagttttcacttccacaaaatctagttttacaagttacaacaaatgtggaaggatggtgtaacaaaacccttccagccttactacgggtctcaaaagtatatggaaagtgtctcatcgatcctgtcctgcagcttggtgcactgctccagtagccgggaaagcttgtcgtccgtctcgatgggcatcacctcgcccaactctactcttagccgggaaagcttgtcgtctgtctcgatgggcatcacctctcccaactctactcttcttggtatgtacatttcatcaactccatgcacgccgttgttgtcagcaagtgcctgaggttcttcatgaacatgcacaggcagtcgtggtgccagagttacggtctgcgcatcaacagcatcgaggtcacaactgatctcaatgatttcgtctagtgtgatgccggttgaaacagcaggcatcatgatgtgatccacagcatcgctgctggcggtgttagcagtaagcccttgtgtggtaccatttgagccagctgctgtaggagcctgatacaggtgctgagtcagaacataagcttctgacaactttccggtagagagctttgctagcctccagttgtaaatacgacggaagatcgccacccatctgggagcgagatagtaagacgaatcctggagttcaaggccaacacaattctgcaccataacattcacttcggtgaccacctggctttcatctaagagccgggctgattcggtcaagtatctcgccaagcactcctcaagtaacttcttctgatcctggatctgcttgcccatgtgcccacccggccgcccccgcgtccgatcgtaactgaacttctggattcttgcagctattaatggctgcaagcagtggctggatccttgatggcgaagcccatcccaatgctaggcaagaacatttctgcatatatccttctcattggcttgttctctccagaagatcaatctcgggagctggccattggctacagtttgcgtttgctgcaagccaaaatctcttctgcaagttgattgacagcattgttgaatactgaaatgcaatcgccaggaccagctccaggtgcaacatgggtgttaagcagctcaagttgtggattcaagtattccagaagcaattcatgggtcttcacaagagtgacatcaggctgcactggcaaactacttaccagccacttcaggccctcacgcagtttgtcatcatcaaagaaaccattggcatggtcttctgtgtagttttcaacaagaaaaataaccaaagacgaaccgatctttcctctgttaagaccattgaggccaagcctgttgatgatgtactttgacgcatactcgtatccttcgttatatgtatcgccactgaaaatcagaagaggaagattggattcatctggtatgcaggctaaaagactgttaaaccgttccttctgcatttcccatgaaatgctttcagacactacaaatactatacagcttgtac

SEQ ID NO: 9803 - DNA, 2159 bp, Zea mays
ccctttctctgctctggcctccatataacttgctcagcaggcctagttctcgcagtcggatcctctcatactgcaagaaccccccctctctctctttttctctcaacacatacacacacaaaagaaagaagggagcctccaagcacacccctgttgcttcctcagcatgcgcgaatccttaactgaggactaggccaacaatacatcgcaatgaagtacatgaagctcggttcaaaacctgatacgttctataccgaagaagcagtcaggtcagtcgtatcagacatacccgccgatctcattatccatgtaaataacaccaagtatcagctacacaagttccccctgctcctcaagtgcggcctcctgcagcgcctctgctccgacaccgacgacggcgatgaggagccggtgcccgtggcgctgcacgacatccctggcggcgagcaggcctttgagctgtgcgccaagttctgctacggcatctccatcagcatcagcgccgggaacctggtgcccgcgatgctggcggcgcgcttcctccggatgacggaggccgtcgccaagggcaacctggtggccaagctcgagaccttcttcgactcctgcgtcctgcagggctggaaggactcggtcgccgcgctgcaggccgcgtggcggatctccggctggaacgagagccgcatcgtacagccctgcatcgactccatcgtcgagaagatcctcctgccaccgtccaaggtcacgtggtcctacacgtacacgaggccagggtacaacagcacgaggaaaccccaccagtccgtccccaaggactggtggacggaggacatctccgacctggacatcgaggtcttccgctccgtcatctccaccgtgcgcgcgtcgcggctgctcccaccgccgctcatcggcgaggcgctgcacgtctacgcgtgcaagcacctcgtcgacccgctccacgttgccagcgacgcaggactgaccgccaacggcgtcctccaccagccgccgcagagctcagacgacggcgaggagaagctggtggccatgcagcgctcgcgtgctcgagtccatcgtcaccatgggcccgggcgagccggggtcggtcaccggccgcttcctactaaggctgctgcgggtggccaactacgtcagcgcgtcgtcgtccacgcgcgcgcagctgatccggcaggccggctcccagctcgacgaggccagggcggcggacctgctcatcccgctgccatcggacccgcacgcgtacgacgtcggcacggcggaggccgtgctcgagcacttcctggcccagttccagcggcccgcgccgaccgacgagcggcgtcggatgagcgccgccatggagaaggtcgccaggatcttcgacgagtacctgcggaccatcgcgctggaccgcagcttccctgtcggcaagttcgttgacctcgtcgaatgcttgccggacatcgcccgcagtgaccacgacggcctctactacgccatcgacatctatctcaaggggcgagcaggagcacccggagctgagcaaggcgcataagaagcggttgtgccggctgatagactgcaggaagctgtcgccagacgtgcgggcgcaggcgatagccagccaccggatgccactgcgcaccattgtacagcttctcttcgtcgagcaggagcggaccatcggtgcagccgccggcagccatgctgcttccggtggcgccgcagatcgggcctccgtcggtgttatctcccagctcgcggcgggaaccaaagatgaagaaccagcctcgtctgctggccacaagtcagacgtgcacagaccacgccgggaccatgcccgggtagccgatggagcctctgccatggcgaggtcgctgtcggcgtcaaccaagactccaccggcagcgaggaaggagaggacgccggaggagacggggagcaggatgaggaacaagcagtgaagcccagtgcacaatttgttcatacttgtgattcttgattatattttttttatttcagtgcatcccatttttggtgggagatgtaagaggtagatttttgtaattaaaatggataaggagttaataagtggctacgtgcagtcatgctcatataatctagggtagctccccgatgaacaaaggttcgtgttt

SEQ ID NO: 9804 - DNA, 3520 bp, Zea mays
ggtttcatgaatatacgagcattttcatgcctatatatgagtcgtttcgtgcctaccttaaacgagtcgtaatcgtgttcgtccatgaacccccaatctcgatcctaatccgacccgatgcatcatgccgaatcccctatactaaaatatattggattgtgccacgtttggaccgtgcctttttcgtgcttaggatcggtccattagatccgaccgaaatatacaactatagacaggaggagttgcgtgtgaggaatcaggaacaaggggtggacggtggaggcttccatggagttagattgctaaaaaagagttagaaagtgtttggaagcaaagtatttatgaatttttgaggtaaaaccatggtatcaaatagtaccatagtgttttttttgctaagaggtgttgtaaaaaatactacagttatatcatgacatcttaaaaccgtagtatttcaaaatcacggtttttggaatattttgcttctaaacacgtccttaaagtatttacatggcttcatctcactttaatctagagtttaaagttggagtcatacgagacacattttagcacttctctttttttagttttatcgcctcatgatgattttatttgctctctcagtcctgaataaaacttttttgattatttaaagtcaatttgtttctagtttaatcaactttatttaaaatattaaaatttgtgtcatcaaattagtatcgttcgacttattacaggttatattttttgtattatacctattcgatattataaatattcatattttttataattctagtctaatttaagatgagtttttagtctggatagttaatagcttaatagtttaattagttaacatagaaaccatctcgtatcttgtttctttgtcacagactcgcaatattcaggggtattttgaatatactaaaactaatagttatttagctaaaaaattactagtgaattagctagctaataaatatctacctagctattatctaatttgttaaaaatatttaatagttaaactattagttagtctgtttagatatgtacaactaattttagtaactaattattagttataatgcaacccttatgtacaaagtttgcagttaatttccggtcggaccgggctgtggaatactcacgtaccggggtcagtcagtccaagaccgtagctatcagcccatgaccagcccagccccagaccagagcaaaatcgaaccagtgcttttacgattcgtgcgtgaccatccggcggccctgatcgccctaccggctcgtctccttccctgtgaccctgtcccataaattcgacgccccgacgcgtcggcccggcgcctcccccaagccgagccccccacacctgacagaaaagcgccactaaaaccctagccatccgccatgtccacctccccagccgcctcatcctccgctccgaccgccttcgccgcctctgcggttacgatggctgccgaggccgccgacgggccggtgctcagcgtagtatcgaagcgtctccgcgcgctgcggaagaagtacaatcgcatcacgcagatggaggagtcgctcgccgccggcaagtcgctcaaccgagagcaggaggaggttctccgctccaagcccgtcgtcgctgctctgatcgacgagctcgagcgcctccgccccccgctcgcatcagctctcgcggaggagctctcctcccgctctgcccccgcccccgccgccaccgcttcctcctccgactcagattcgtcagtccaggacctcctcgcgctcgtctactttggctccctcttcgatgtcaagcaacaaagcgacttcgtctctttggtatacacgcgcgagctcgagcggagcagctgcctcacttatgactacgtcggggatgatccggaagacagtctcgtggagaccgatctgaacgccgtttctgcccttgccaccctcgcggcgtcgcgccctcctgctgcagctggagtctctcaccgtgatgccctccaggcttgtgcccatcacgcccgcctctggctcagccgtgcggatgaacccatccaccctgactccaccatcacatgtgcggggggctgccggtcgtgcgtttgattttatttgagatggtatgttagtctgactgagacttaatctgtatttcttttttgctgtagatgctggggtgagggcaaagctggatagaatcatggcatcgggctactacacagctcagctagaaatgaggacaccaatggatctggctgctgcagtggcaaactttggagccggaggtgtgcaggtgcaagagagcatggttgtgtcgcctcaggcactggaagcagtcgaggagagccaggatgttgaagaacacaaggtgaaatcatacttgttctttcctttcgttatacttgttattttgtttttgtcaatgtttggctggcattgctaaatgattgatgttccattaaccttgtttaggtgtgaatctatgaatgatctagttagctatacaattatttctcaggctgctgttggtagatcatctgttttttagtatgatgactctccatactcgagattagtggtctaaagtagattccatagtatctgggtttaagttatcaaaacatcacatgaaaatactctcagttctaattctaaattataagatttttttagcatttctagacacatagcttttgctttgcacttatatactatgtctaggtacatactaaaaccaatgtatcttaaaaaaccaaaacgtcttataagcatctctgtgctctcgaccaaatgatatgttactttgatgttttggaaatagtaatgtgttaaatggaaaattagtttgtttgctgtctcgtttgttgttttttcatgtgccaagtatgtagactgtaagaaatgttttcagaaccaaactatatgttagttttagagtattataggtctgtatcttgtggcagaactaaggccagatctcttgctttttttgggagtgttcatttcattaatggggtgccatgtcagtgttatttgtttcctgtatcctggatcttagtgctgaactatacttgtcagtctttgatgttgctttttgtctagttctagtgacaggaagctagttccttttacattatatgttgccatggaacaaaacatatcattacttgttctgtttaatacaatggttttatgcttttcaatggccttgctgataacactggctattgttgattttatctttttactcttttctccccgtcccaaaaattgtcattctagtatattcataagttattctatcttaagtttgaccaagaaggtctatttatattttagtaaataagcacgaacatattcaccatgaatgggcctgttaggatcccatgtgctaaactcttgcagtgtgctagcgtttagtcctctcaaatggagagctaaagtttagcacacgggtagtatttggatgcaagtgctaaagtttagcgcatggatatagaaagacatccaaggg

SEQ ID NO: 9805 - DNA, 1855 bp, Zea mays
gcacgagaccattaccgggaacctccgacgccccggggcctccccgagagcccccgtttctgtcacaaatcgccactaaaaccctagccttccgccatggccacctcccctgccgcctcgtcctcctccgctccgaccgcctccgcggtggctgcggctacgatggctgttgaggccaccgacgggccggtgctcagcgtagtatcgaagcgtctccgcgcactgcggaagaagtacaaccgaatcacgcagatggaggagtcgctcgccgccggcaagacgctcaaccgagagcaggaggaggttctccgctccaagcccgtcgtcgccgctctgatcgacgagctcgagcgcctccgccctccgctcgcctccgccctcgcggagggagctctcctcccgccccgcccccgccccctccgccgcttcctcctccgactcagattcgtcagtccaggacttgcttgcgctcgtctacttcggctccctctttgacgtcaagcagcaaagcgacttcgtctctttggtttacacgcgcgaactcgagcggagcagctgcctcacttatgactacgtcggggatgatccggaggacagtctcgcggagaccgatctgaacgcggtttctgcccttgcctccctcgccgcgttgcgccctcctgctgcagccggagtctcgcaccgtgacgcccttcaggcttgtgctcatcacgcccgcctctggctctgccgtgcggatgaacccatccatcctgactccaccatcacatatgctggggtgagggcaaagctggataggatcatggcatcgggctacttcacagcgcagctagaaatgaggacaccattggatctggctgctgcagtggcaagttttggagctggaggtgtgcaggtgcaagagagcatggttgtgtcacctcaggcaccggaagcagtggaggagagccaggctgttgaaggacacaagaatgagaaggaagattctcaggctacagaaatctacaatgatcatcctgttgttgactctgaacatgtggaggatgaagtcctggtgcatccaactgatgaagttcctccagctgagacagagcaggagcaggagacatttgatgctgatgtgaaggatcaggagcaaaaggaccaacaattcatccagcggcggtcttaccagaaccagcgtggtggtggtcgtggtggcagcaggagaggctatcctaatggtcgtggaggacgtggtggccgaggtggcgggtaccagaatggccgtggtggataccagaatggtcgtggcggtgctggcgggtactactacgaatctggatactaccagccgaggaactacaacagaggccggggtggtcgctccggcggtggcaactcttactacaacagccatggtggaggtgcacaggggcatcatcctgggagtgttgagctgggcgcaaacgcctagcttcgctgactgttctgtttgataatgaggagcgagtgagtcgtgccattttgttattatagaactaacttagcctgttattacgtcaccgttggtcccatccgtgagtctttttgctgctcgagtgactgcatatggtcggtcggtattgaggaaatactctgggaaagtagtttcaggtcatattcgttttctaagttacgtttttttttgtgttaatatgcccttatttcttaattattatatactctgctagaggtgtcgatgccgccaccaaaaaaaaaaaaaaagcggccctgctacttactagtatgttctatcggacctttgcagcatttggaggtgattgttgacctgttcgttggcctcgaagtgtttttttttgttgcaacgcctacc

SEQ ID NO: 9806 - DNA, 1720 bp, Zea mays
gaagagctatgacgtcgcatgcacgcgtacgtaagctcggaaggcggcccgcggccgcgccccccacaccggacagaaaagcgccactaaaaccctagccatccgccatgtccacctccccagccgcctcatcctccgctccgaccgccttcgccgcctctgcggttacgatggctgccgaggccgccgacgggccggtactcagcgtagtatcgaagcgtctccgcgcgctgcggaagaagtacaatcgtatcacgcagatggaggagtcgctcgccgccggcaagtcgctcaaccgagagcaggaggaggttctccgctccaagcccgtcgtcgctgctctgatcgacgagctcgagcgcctccgccccccgctcgcatcagctctcgcggaggagctctcctcccgctctgcccccgcccctgctcccgcccccgccgccaccgcttcctcctccgacccagattcgtcagtccaggacctcctcgcgctcgtctactttggctccctcttcgatgtcaagcaacaaagcgacttcgtctctttggtatacacgcgcgagctcgagcggagcagctgcctcacttatgactacgtcggggatgatccggaagacagtctcgtggagaccgatctgaacgccgtttctgcccttgccaccctcgcggcgtcgcgccctcctgctgcagctggagtctctcaccgtgatgccctccaggcttgtgcccatcacgcccgcctctggctcagccgtgcggatgaacccatccaccctgactccaccatcacatatgctggggtgagggcaaagctggatagaatcatggcatcgggctactacacagctcagctagaaatgaggacaccaatggatctggctgctgcagtggcaaactttggagccggaggtgtgcaggtgcaagagagcatggttgtgtcgcctcaggcactggaagcagtcgaggggagccaggatgttgaagaacacaaggacgagaaggaagattctcaggctacagaaatctacagtgaccatcaggctcctgttgttgacgctgaacatgtggatgatgaaggcctggtgaacccagctcatgaagttccttcagctgaggcagagcaggagacatttgacgattatgtggacgatcaggaacaaaaagaccaacaattcacccagcggcgctcttaccagaaccagcgtagtggcggcggtcgtggtggcggcaggaggggctatcctaatggtcgtggagtgcgtgggtaccagaatggccgaggtggcggtggataccagaatggccgtggcggaggcggtgggtactacgaatctggatactaccagccgaggaactacaacaacagaggccggggtggtcgcaactcttattacaacaaccatggtggaggtgcacaggcaggcggccatggccatcctgggagggttgagctgggtgcaaacgcctagctcgagctgactgttttgtttgaggagcagaggtcggggggagccattttgttattatagaactaactgagcctgttatttcttttttgctactcgcatatggaaatgctttggggaagtagtttcaggtcgactttgttcttctaagttacgtctattaatcgtgttaatatgcccttatttcttaattattatactctgctggaggcgtcgatgtcgtcaccagattgtcgccaaaaaaaaaaaaaaaa

SEQ ID NO: 9807 - DNA, 889 bp, Zea mays
gtgtgggggcaaagctggatagaatcatggcatcgggctactacacagctcagctagaaatgaggacaccaatggatctggctgctgcagtggcaaactttggagcaggaggtgtgcaggtgcaagagagcatggttgtgtcgcctcaggcactggaaccagtcgtggagagccaggatgttgaagaacacaaggacgagaaggaagattctcaggctacagaaatctacagtgagcatcaggctcctgttgttgacgctgaacatgtggatgatgaaggcctggtgaacccagctgatgaagttccttcggctgaggcagagcaggagacatttgatgattatgtggacgatcaggaacaaaaagaccaacaattcacccagcggcgctcttaccagaaccagcgtagtggcggcggtcgtggtggcggcaggaggggctatcctaatggccgtggagggcgtgggtaccagaatggccgaggtggcgggtaccagaatggccgaggtggcggtggataccagaatggccgtggcggaggcggtgggtactacgaatctggatactaccagccgaggaactacaacaacagaggccggggtggtcgcaactcttattacaacaaccatggtggaggtgcacaggcaggcggccatggccatcctgggagggttgagctgggtgcaaacgcctagctcgcgctgactgttttgtttgaggagcagaggtcggggggagccattttgttattatagaactaactgagcctgtgatttcttttttgctactcgcatatggaaatgctttgggaaagtagtttcaggtcaggtcgactttgttcttctaagttacgcctattgatcgtgttaatatgcccttatttcttaaa

SEQ ID NO: 9808 - DNA, 920 bp, Zea mays
ctcgaggccggccggggtccaatccccatcgccccagaccgcagcgcgacagtgagtacagcagcagcagctgagagcgtgagagcgtgcgaagcaggagggaggacaagaagaagccgatggcggttgtgagcggcagcggcgggaggctgaacccctgggcggagcccttcgtgccttccggggcgcggtaccgcggcctgcggaccgtggaggcgacgccggagcaggaggtggaggacttctcccccgagtggtggcgcctggtgtccgcctccccggccttccgcgaccgctggctgcgcgagtacggcgcgctcggcctactcgacgccgaggacgacctggacgacgacgtcgacagcttcctccccgacgacttcttctcgcctccggccccgcgctacgagagcgagcgggaggacgccgcgggcaggagggcgggccgagggcttgaggtggcggcgtggggcatcgacaggtggtggagggcgcacggtgggccgccggagaccccgaggtacgcggagaaggcgccgcggagggtggccgccgccgccagggtgagcccccgccccatccagcagccgcgctgaaggaccagatccgttcatccaccgacggcgacggctgctcagtcagtgtcacatcttggcacggggggaaaaataggcacgaaaaaaaaagagttccctttcttgaatcgatgcagtttgctttggtgttcgtctcgcgcagtttctggatctgggctccgcttcagctcgagatcgactgggatgggaagatcctctgctgcgttgtcttgtctgtgctcatccgtgtgtactgtgtaaatatgaagatgtaataacaaaaacacgcattttagctttcaaaaaaaaaaaaaaaaaaaaaaaatgaccccccgcagcccgggg

SEQ ID NO: 9809 - DNA, 964 bp, Zea mays
gctattaataatcatcatcgtctccaatccagagagccgtaccaatccccatcgccccagaccacagcgcgacagtgagtacagcagcagcagctgagagcgtgagagcgtgcgaagcaggagggaggacaagaagaagccgatggcggttgtgagcggcagcggcgggaggctgaacccctgggcggagcccttcgtgccttccggggcgcggtaccgcggcctgcggaccgtggaggcgacgccggagcaggaggtggaggacttctcccccgagtggtggcgcctggtgtccgcctccccggccttccgcgaccgctggctgcgcgagtacggcgcgctcggcctactcgacgccgaggacgacctggacgacgacgtcgacagcttcctccccgacgacttcttctcgcctccggccccgcgctacgagagcgagcgggaggacgccgcgggcaggagggcgggccgagggcttgaggtggcggcgtggggcatcgacaggtggtggagggcgcacggtgggccgccggagaccccgaggtacgcggagaaggcgccgcggagggtggccgccgccgccagggtgagcccccgccccatccagcagccgcgctgaaggaccagatccgttcatccaccgacggctgctcagtcagtgtcacatcttggcacagggggaaaaataggcacgaaaaaaagagttccctttcttgaatcgatgcagtttgctttggtgttcgtctcgcgcagtttctggatctgggctccgcttcagctcgagatcctctgctgcgttgtctcttgtctgtgctaattctcatggctgtactgtgtaaatatgaagatgtaataacaataacacgcagtgtgactttttagctttcaaaaaaaaaaaacaaaaggcccaataagccacccatgttcccttgcctgatctaatccgccgcctccttcagtttcc

SEQ ID NO: 9810 - DNA, 1361 bp, Zea mays
ataatcccatggcttggtggctgtctctctccccaacagctcggcgcctcgcctcctgcccgccatagctcccaaccccaataccgccgctctgacctgctgttgcatcgccgccgtcggcaaatcgcttccactcttccccgccatctccaccgacaaggctgtctagtgagtgcgcggccctgctcggtggagccagccaccaccatgcccattgtgtgggcagaaggcgcagcacaggggcctgctacttggtggagaggaggacaaatctgcgaccttttcatcgagtagaagcatcggcgctgtggcggccctcctccttgcccattcctctctttcgattcttcgatgcccatcgtccccaatccagtgagctgtaccaatccccatcgccccagaccagaccaacagtgagtacagcagcagctaagagcgtcagcgtgagagcgtgcgaagcaggagggaggacaacaagaagccgatggcggttgtgagcggcagcggcgggaggctgaacccctgggcggagcccttcgtgccttccggggcacggtaccgcgtgctgcggaccgtggaggcgacgccagagcaggaggtggaggacttctcccccgagtggtggcgcctggtgtccgcctccccggccttccgtgaccgctggctccgcgagtacggcgcgcttggcctactcgacgccgaggacgacctggacgacgacgtcgacagcttactccccgacgacttcttctcgcctccggcccagcgccacgttaaagctacctcgcagctccgtttctgccttgcctgtgcctgtctttgttgctatgagtacctttagcaattagcactgctgactcggtgtgtgtgtgttgtggcgttcggacggagcagagagcgagcgggaggacgccgcgggcaggagggcgggccgagggcttgaggtggcggcgtggggcatcgacaggtggtggagggcgcacggtgggccgccggagaccacgaggtaagcggagaaggcgccgcggagggtggccgccgccgccagggtgagcccccgccccatctagcagccgcgctgaaggaccagatccgttcatccaccgacggctgctcagtcagtgtcacatcttggcacaggggaaaataggcatgaaaaaaagttctctttcttgaatcgatgcagtttgctttggtgttcgtcttgcgcagtttttggatctgtgctcctcttcagctcgagatcctctgctgcgttgctcattcctgtactgtgtaaatatgaagatgtaataacaataacacgatgtgtgactttttagccttcagttttgccttttcgggctttgacaggcgcaatc

SEQ ID NO: 9811 - DNA, 2451 bp, Zea mays
  misc_feature (1451)..(1451): n is a, c, g, or t
gaccatgagtccaacgagctcacgagctacgagtgttttgtgcagccctactttaacgtagaaacgacaagggatagtataaacatgctacgcctacctccggagcgagcactgttgcacccgccgtggccataaatgattggggtcaccgcccggtcggccgcgtccgcctcccttccctccctagctctttctcccccacctctcgtgtcccggatcgacgctgcagctccgtcctcgcctccacagtttagcctccagctacaccctatctatcgccacccgcgtcccgtcctcctccatctgtaaccactccccgtcgtctctttcgcggtctcgcctcctgcagcctctcgcccagaaagggaaaccgcatctgctcccgtctcccgcctcggcgccgccgcctagtcgacctgagcccagagaggggggggcgtcgaggccgtcgggcgctcaggtgagctcgactggtgtgcgatttccgttgttcacttgctctcttgatctcttctcgcaactcgttaaaattggcgtgtctcgggctcggctacccaactagcccttctccaccctgtgcgctgcgcgcgcgagttttctagctaggctgccgcagtagctggagctgctgctggcctcagatcaggcaattcttgggatgtgctggcctcagaggcgccgtacttgccctggaccaggcctgattctgattctgattccatctcccctgttgcaaaccctagttctttactcctcttttctcgattaagtagcagcagaatccaggaccacgaaatcccgaactagttgtttacaatttcttctctgcttcccactttccgccctctcgaaagcttctctcccttctgcacaagctcaggattataggtactcctagtataccacaagctacaagcatataatccagctcgctcctggtcctgggtgatggcggcgaaaagctcagtcatttgattcggtgttttggttcccggcgtcgccgtcgcactaaccgagggggttcttgcatgcagatctggggcgggagtggcaagcgaaggacatgcagatgcacgtcggaggaggcgcggccgacagcccggaggcgacgcggccgagccgctacgagtcgcagaagcggcgggactggcacacgttcgggcagtacctgcgcaaccaccggccgccgctggagctggcgcggtgcagcggcgcgcacgtgctcgagttcctgcgctacctcgaccagttcggcaagaccaaggtccacgcggcggggtgccccttcttcggccacccgtcgccgcccgcgccgtgcccgtgcccgctgcgccaggcttggggcagcctcgacgcgctcgtcggccgcctgcgcgccgccttcgaggagcacgggggccggcccgaggccaaccccttcggcgcgcgcgccgtgcgcctctacctccgcngaggtccgcgacagccaggccaaggcgcgcggcattgccttacgagaagaagcgccggaagcggccgtcgtcgtccgcctcgtcccagtcgtcgccgcaggccgcgaccagcccgcggcagcaggccgctccctcttcctcgccgaccctgtcggacgcggcggctgagagggccgacgtgcgggcgttcgtgtctgacgccgggcacgggcacgggcacgggcaccagcaacagcaccacttcttcatgccgcacccgcagttcctgcacgggttcagcctgctgccgggaaaccccgaagcggtggctggcaatggcaatggcagcagcagcagcgctagcgtcgccgccagcagcggggacgagatagcgctggcactggcggcggcggaggaggcgcacgcggcggggtgcatgctgccgttgtcggtgttcaactaggcaggcgtatagccaaaagcgaggtagggcgaatgaatagtccgggtgcttgcttatccggttccggtgttcatgcatgatcgttctcactgtcgcgatggagttgaggcgatcaacacacgtacgttctgcttgctgttcttaagtaattcctattcccatctcttttgctcatgcatttcctgctgtgctgctgctgctgggaaatagtattagtagctgtgcttggtactgtagggtttgcagaatcctgcttggtttgtgtatgcaatgcaaatgatgacggaggtataatataatggaaggcttaatttccaggctaaaaaataaaagcggttgctctctctatctctctctctgattcttgggtatttgtgcttcatcgttactcgttagtgcttatctcttcttttgagagaggcatgcatccagtgtttgtccaagtatatatgcacgctcttgatcgaatgatcgatctaagtggtgtggttcgatttccaggccatgctgccatttacaactccctgcagatcaacactttattattccatcatatgc

SEQ ID NO: 9812 - DNA, 1391 bp, Zea mays
atttcggcacgaggcggtcctccatcagtagtaaccactcctcgtcgtctctctcgcggtctcgcctcctgcagctagcgctcgccagaaagggaaaccgcatctgctccagcctcccgtcccgtctcggcgccgccgcctgatcgaccagagcccagcgcggggcgtcgaggccgtccggggcgggtccggcgctcagatctgaggcgagtagcaagcgaagaacatgcagatgcaggtcggaggaggcgcggccgacagcccgggcgctgcggcggcggcgggcgcggaggcgccgcgcccgagccgctacgagtcgcagaagcggcgggactggcacacgttcgggcagtacctgcgcaaccaccggccgccgctggagctggcgcggtgcagcggcgcgcacgtgctcgagttcctgcgctacctcgaccagttcggcaagaccaaggtccacgcgccggggtgccccttcttcggccacccgtcgccgcccgcgccgtgcccgtgcccgctgcggcaggcctggggcagcctcgacgcgctcatcggccgcctgcgcgccgccttcgaggagcacgggggccggcccgaggccaaccccttcggcgcccgcgccgtgcgcctctacctccgcgaggtccgcgacagccaggccaaggcccgcggcatcgcctacgagaagaagcgccggaagcggccgtccgcctcgtcccagtcgtcgccgcaggccgcgacgaccccgtcgttgcaggcccctcccgtctccacgccggccctctcggacgcggcggccgagagggccgacgtgcgggcgcacgtccccgacgccgggcacgggcaccagcaccagcaccacttcttcatgccacacccgcagttcctgcacgggttccgactgctgccaggcaaccccgaagcggtggctggcaatggtaatggcgatggcagcagcagcagcgctagcgtcgctgccggcagtggggacgagatagcgctggcgatggcggcggcggcggaggcgcacgcggcggggtgcatgctgccgctgtcggtgttcaactaggcaggcgtatagccgagcgaggtagggcttaaacaatagattaatccgggtgcttatctagtgttaagatcgatctcattgtcgcgatggagatgaaccgatcaacacacacgtacgtgctgctgttcttcaggatttcctattcctattctcatatctccccccttttggttacatgatgctcatgcatttcctgctgcgctgctgggaaatggtactagtagctgtgcttggtactgtagggtttgcagaatcctgcttgttttgtgtatgcagtgcaatgatgatggagatataatataatggaatgcttaatttccaggtc

SEQ ID NO: 9813 - DNA, 1252 bp, Zea mays
  misc_feature (1249)..(1251): n is a, c, g, or t
agcttgattctctctggctggtacgcggtagctcgctctctctcctacctacacggctacacttaaacggcagcaggcacctgcaggcagggagagctgctaacggaccgatcggggagctgctggccatggagcctggtccggatgcgcccgctggtggtggtggcggaggaggaaccagtattagtgagccagcagaggccgggccgtcgccgtcgtcgtcctcggccgccgcagcagcctcgtcgtcgagccggcagcaggcagagcaggaagcacagcagcaacaaggagcacagcagagggaacagccagcagtaagggcccaggcgcagccgcagccgcagccgcatcagcagcagcctccggcggggctcagccggtacgagtcgcagaagcgccgggactggaacacgttcctgcagtacctgcggaaccacaagccgccgctgacgctggcacgctgcagcggcgcacacgtcatcgagttcctccgctacctggaccagttcggcaagacgaaggtgcacgctgagggctgcgcctacttcgggcagccgaacccgccggcgccctgcacgtgcccgctgcgccaggcctggggtagcctcgacgcgctcatcggccgcctccgcgccgcgtacgaggagtccggcggccgccccgagtccaacccgttcgcggccaaggccgtgcgcatctacctccgcgacgtgcgggaggcgcaggccaaggcccgcggcatcccgtacgagaagaagaagcggaagcgcgggagcgccgccgcgcctccggtcgcgccgcctcctgttgtgactgcagaggccgccgggacgtcgtcaggggccggcggtggtgatgacgaggacgacgacgaaccaccgccatctgcagatgaaccacgacgacagcagaccgccgcgccgactcctcctcctcctgcaagtatgatttccagcactagtgcaagcagtagcagtgtcgccccagtcacgacgacgacgacgacaagcaaggagaaagaaggatccgcgccaagctcgtgataagtttgtagatcatctactagccttctgattcaattctatcatcgccggcctccaaattataatcccaaccgcctccatcttaaatttttagttgctcactattactatatattgttattgtttactggcatatataagagagaggtctaagggaaaaaaaaaaaaaaaaaaaaaaaaaaaaacaaaaaaaaaaaaaaaannna

SEQ ID NO: 9814 - DNA, 435 bp, Zea mays
ctctccctctccctcctttcttctcagcttgctggccatgagaccgctctcctcaacccaccatatttatctgcctcctctcgccacatgctctcctcctctgccggctcagtcgtgggacgagtcccgatcccgacccctagcttccgctcccgatccgtcgtctcatcctctcctacctggcacgtcgtgcagatctggtcgagctagtgttcgcgcttcgcgagatcgtcaggtgaccgagcgagccatggaggtagccggcgtcgtcgcggccgcggccgacagccctggcgccgcggcggcgggccgagccggtacgagtcgcagaagcggcgggactggcacacgttcgggcagtacctgcgcaaccaccggccgccgctggagctggcccggtgcagcggcgcgcacgtgctggagttcctgcgctac

SEQ ID NO: 9815 - DNA, 1264 bp, Zea mays
gagagaagagaacacgcgcggcacgggcgcaccccgaccccgcacaccgacgacgaagagaggagaggaggcggagccgagagctcgagcccaaccgcgcaactcacttccccgtcgcgatttgcattgccctcctcttggcccccgatctcgccgtgccctacccccagacccgctccgccgccaccggagagatcgcgccccccattcccacaatctaatgcttccgtccctcgaggagccgagccctccgcgcggccgtgggatggggcggtgacaacaccggtgagtggcgtggggcagggagccggtggcgagggcatatcatggtgcagtgcctggacggggtgaggcagctgctcgcggtcctgctcaagtgctgcgacgtcgagctcaagcagccgcccgggctcgaggaccctcaggttctcgcgagggagaccgtcttcagcgtgagcgaagtcgaggctctctacgagctgttcaagaagataagcagtgctgtcatcgatgatgggctgattaacaaggaggagtttcagttggcactatttaagaccagcaagaaggagagcctgttcgcagaccgcgtatttgatttgtttgacacaaagcacaatggaattttaggatttgaagaatttgctcgtgctctctcagtatttcatcctaatgctccccttgatgagaaaattgacttttcattccggctgtatgatctcaagcagcaaggctacattgagagacaagaggttaagcagatggttgttgctacacttgctgagtcaggaatgaatctttcagatgaaattgtagagagtataattgacaagacatttgaggaggcagacacaaaacatgatggaaggattgacaaggaagagtggcgcagtctagtcagtcggcatccatctttgctgaagaacatgactcttcagtacctcaaggacatcaccacaacatttccaagctttgtctttcactcccaagttgatgataactgattttcatgggattattttggcaagaagcattagaagatattctcgtggggttctgatatggttttctttttcaattattgggttgttggattgactgagatcgtagtgctcataagtatgttggatgttggattcgagaactcaaatcttttgtcaaccatgtttctttcatttgcatgtctggatgcgcttggaaaataaaaaaaaaaaaaaaaaaaaaaaaaaaaaaaaaaaaaaaaaaaccaaaaaaaaaaaaaaaa

SEQ ID NO: 9816 - DNA, 1445 bp, Zea mays
gagagccccgcccccgggaggccgggagagaagagaacacgcgcgtcaggagcgcacaccgcacggcgcacacacacacgcctcccgcggcaagcagcgcaggacaccgacgacgaagcgaggagaggggaggaggcggagccgagcgcccgagcccaaccccgcaaccacgacccacttccccgtcgcgattcgcattgcccttccctcgggttctacccccagcctcgcgccgccgccgccgccgccgcccttgccagagagatcaccccccattcccacaatcccgtccctccctccgtccctcgaggagccgagccctccgcgcggccgtgggatggggcagtgaccggtgagtggcgtggggagccggtgggcggtggcgagggcatatcatggtgcagtgcctggacggggtgaggcagctgctcgcggtcctgctcaattgctgcgacgtcgagctcaagcagccgcgggggctccaagacccccaggtcctcgcgagggagaccgtcttcagcgtgagtgaggtcgaggcgctgtacgagctgtttaagaggatcagcagcgccgtcattgatgatgggctgattaacaaggaggaatttcagttggcgctatttaagaccaacaagaaggagagcctgttcgcggatcgcgtatttgatttatttgacacaaagcacagtggaattttgggatttgaagaatttgctcgtgctctctcagtatttcatcctaatgctccccttgatgagaaaattgatttttcattccggctgtatgatctcaagcagcaaggctatattgagagacaagaggttaagcagatggttgttgcaacacttgccgagtcaggaatgaatctttcggatgaaattgtagagagtataattgacaagacatttgaggaggcagacacaaagcatgatggaagaattgacaaggaagagtggcgcaatctagtcattcggcatccttctttgctgaagaacatgactcttcagtacctcaaggacatcaccactacatttccaagctttgtctttcactctcaggttgatgataactgaaattgatggggttactttgaaaagaaacattagaagatattctcatgggttctgatatggttttcatttttcaaaattgggttgttggattgaaagattgtagtgttgtgaagtacgtgcatgttggattcgaggactcgattttttttgtcaaccttgtttctttcatttgcatgtctggatgcgcatgaataagatatgaagtttatgtctaaaaaagaaaaaaaaaaaaaaaattttctttggctggccggcaatcggatccagtttttagaagcttgtctttctgtacaggatagaaacagcgttttaaggatttatattgtccttgactttttttctgctgtagctagagcagaatttttttggttg

SEQ ID NO: 9817 - DNA, 1278 bp, Zea mays
actctacctcgctgtaaagcccctgcccctcgtcctcgtcctcgtcctcgtcctcgtccaccacagccgccccgcgccctcctccgcgctccgcctcccccgccgaaccgccagcgcctggctgccgcgcttcccctcctgctcgacctcagcgccgcccccgtgcccgcccggcccctccttggacgcgccgccccagggttaccgcaccaacgtcggcatctgcctcgccgacccatccctcaccaagattttctcggcttctaggatcgacattcctagcgcgtggcagatgcctcagggtggtatagatgcaggggaagaaccaagggcggctgccttcagggaatggagagaagagactggtgtcacatccgcagagatcgtggctgaggctcctgtctggttaacatatgatttcccgccggatgtcagaaccaaactgaatgccaggtggggaaccgattggaaaggccaagctcaaaaatggtttttatttagacttactggaaatgacgatgagattaaccttaatggtgatggatctgagaagccagagtttggtgaatggacatggatgacacccaaggaagttatcgaaaaggcagttgatttcaagaaacctgtatatgaggaagcattgaaacactttgccccctacctgcagtcagatccagccgcttcatcatagaagatttggccaatttgcttgcatccctgctgtatctggacccccaataatttgacacgacgcaatgtagccatgaggtgtgctatacaatttgatagtgtgtggcctgtttgagtcaattatatatgccagcattggatcctcgccctctacttagtcacataagtatacaataagtggtggaaacagtttactgtaatgaccgctacagatgcaccgtcgcatgattgggcctgtggctctagtttcagccaatctggaacatggtggccagtgtatcttgtctgccaatgactgaatgctttaggttgaagcaataccataattccagagacgcggccgtacagcaacctcaggttatgtgggggatcatcggcaaaacgacgctcgtttggcattggctacggcagatactagtgtctggctggcatttgttgtgggaggagcacagagaaaaacaaattgttagttacacactgtactactgcgtcatgatattgtcggctttcgctttgtggcttttggaggaactggagatttatttggcagctttggctttatggttcttggaggaacaggagattcac

SEQ ID NO: 9818 - DNA, 1704 bp, Zea mays
ctttgggtacctcgaggccggccggcgctgtaaagcccctgttcctcgtcctcgtccaccacagccgccccgcgccccgcctcccccgccgaaccgcccgcgcccggccgctgcgcttcctctcctgctcgacctcagcgccgccgctgttcgcagccgtcgcatccatggactcgccgccccagggttaccgcaccaacgtcggcatctgcctcgccgacccatccctcaccaagattttctcggcttctaggatcgacattcctagcgcgtggcagatgcctcagggtggtatagatgcaggggaagaaccaagggcggctgccttcagggaattgagagaagagactggtgtcacatccgcagagatcgtggctgaggctcccgtctggttaacatatgatttcccgccagatgtcagaaccaaactgaatgccaggtggggaaccgattggaaaggccaagctcaaaaatggtttttatttaggcttactggaaatgacgatgagattaaccttaatggtgatggatctgagaagccagagtttggtgaatggacatggatgacacccaaggaagttatcgaaaaggcagttgatttcaagaaacctgtatatgaggaagcattgaaacactttgccccctacctgcagtcagatccagccgcttcatcatagaagatttggccaatttgcttgcatccctgctgtatctggacccccaataatttgacacgacgcaatgtagccatgaggtgtgctatacaatttgatagtgtgtggcctgtttgagtcaattatatatgccagcattggatcctcgccctctacttagtcacataagtatacaataagtggtggaaacagtttactgtaatgaccgctacagatgcaccgtcgcatgattgggcctgtggctctagtttcagccaatctggaacatggtggccagtgtatcttgtctgccaatgactgaatgctttaggttgaagcaataccataattccagagagactgcggtacagcaacctcaggttatgtggggggtcgtcggcaaaacgacgctcgtttggcattggctacggcagaaactagtgtctggctgccattggttgtgggaggagcagaggaaaacaaattgttggttacactctgtactactgcgtcatgatattgtcggctttcgctttgtggcttttggaggaaaactggagatgtggcagctttggctttacgcatcttggaggaacaggaacagtacacacgccaaagcgctttactctctgtagtgaagtgaagcacgcacgcacgttgcttttccttcactccatcggccaccaagttattaatgcattgcatgccagctggcccatctgattcctagcgacaggaacatcattaagcaactagtactagagtaatgtaggttgatgtcgatgatgtgtcccctcagaatttttgttgacactcgttgctggacctggacctgactagatggcggatggggggccattaccatcatccattcattgtgcgtgcagtactcctgctaccgcctccacggctctccatccatccatccatttgcatgcatgacccatcaagtatggaggaagcattacactacacatgtcttggccgaccacaccaaagagcgaaaacaaaaggtttattggaaaaaaaaaaaaaaaacataggccctcga

SEQ ID NO: 9819 - DNA, 5106 bp, Zea mays
  misc_feature (914)..(914): n is a, c, g, or t
  misc_feature (3462)..(3462): n is a, c, g, or t
  misc_feature (3885)..(3886): n is a, c, g, or t
  misc_feature (3897)..(3898): n is a, c, g, or t
cgcgcgccctctccccgcccgaccctcacctgtcccggtctctctgccatttctcctttcgctttcacggctcgccagccatcgccctacccctccagcgggcacaggccgcagctagctaccctcttttttttcacctccgcccgcctcttcacgggtccccagtcgacttcccggtctcggcttttgccgaaagaaaggcacccggaacccaacgacagcggcagcagtcgagtccgggacgggccggggcaaagctgggatgaggatgaaaaggggggctgaataaaaaggcgggggaggaggcgagaaggctacagcggcggcaggccaggccagcagagcgcagaggaccgccgctcggaaagtgcggagccgtttcccctctagctgctcatgctctctgcttgcctccgtccactcacagcccacgtccacgcctcgcgctcttctccaggctcccaggtgctccccgatcaatcgcttccgctgctagcgcgcgcgcgatccccgaggtcgcgcgcttgatcgcgctcaacgccatgtcgtccgccgcgggcgggtatggcggcggcggcggcgcgggaagcggcgccgagccccacggccacgccgacttcctgctgcaccaccatgcacagcacgtcgccgcgcagcagctctaccacgtgccccagcacagccgccgcgagaagctgcggttcccccaagacgacgcgcccccacacgcctccgcttccgtcccgcagcagcacggcggggcggtggcctggccgccgcctccgccgccaccggcgttctactcctacgcgtcctcttccacgtcgtcctactccccgcacagccccacgctggcgcaggcacagctcgtcgtggcgcacggcctcgccccgccgctctcgtcgcagatcccngacgcagaacttcgcgctctcgctctcctcctcgtcctcgaacccgccgcccccgcccccgcagccgaggaggcctcacgccgcgcccttcgggcccttcaccggctacgcggctgtgctcgggcgctcccgtttcctcctccccgcggagaagctgctcgaggagatctgcgacgtcgggggcgcggcctcgcgcgtggaccgcagcgcctccgacgagggcctgctcgacgctgacccgatggaatccatcgatcacgaaatggacggcgccgaccgcgtcgccaatgacgctggcccaatctccggcgccgagcagcagtggaagaagactaggctcatctctatgatggaagaggtgagctctggctacctcgcttgcttctgttgcctggccccttgcaggtttctcgtgctatctatcctccatggcgtatccatcttttcttcgcttgtttcggaattgcaattatcgccctctcgctgggtggggaagaatcttgcttatacaggtcacatcgcccctgcagttgtggcctgcttttgttcactgtagttgcatgtgcttttgatttgatgatgatttcctctgctgttgatactcgcggtacatctttttcgagttttttttctctttgtactcgctggtacgtggttgtgagcttttacagctcgcactgttcatcgggcagtcgtttcataaatgttgtgtgttttggtctgctgtttagcagtaggaattgcttcagaggtacatgaaattataagagtaaaaagaggttgactgctttgaactctttctaatgtcatgagacgataaaaactggcgtcacctcttatgtcttctgatgattcgtcgtggcttggctcgtcgtagcacctgtgaccgcaagcttccatttttggaaccctgaataggcgattgggttttttgcagagttctttaatggcatcccgcttccataattgggaagcatgcctgctttgttgatgtcacgtcttcatgcaaacaaaagcgccctgctcccttttcgtaacttgggagtttcttcattgcttaatataaaagctgtctaatctacatgattcaacctctagattgagttatccaataattaagaaactttttttttttacttctaggtttgcaagcggtaccggctgtactaccagcaggttcacacggtgatcaactcgttcgagacggtcgccgggttcagcaacgctgccccgttcgcggcgatggcgctgagagccatggcgaagcacttcaagtgcttgaagggcatgatactgagccagctgcgcaacatcaccaaggcccctgccggcaaggaggggctcagcaaggacatcgccatgttcgggcttgccggtggtagcgcggccgccctccagagaggtagcagtgtgggtgccttcggccagccgcacaacatctggcggccacagagagggctgccggagcgtgcggtgtctgttctccgcgcttggctcttcgaacacttcctgcacccgtaagtcgccttgccgctgtttgttcaatccaaatgccatcaggatatgattacatactgtgccgcgcacctttcaagacgatgataggtagaatgcaaatttcgattagtattgcgattgctcgccagatactaattttattgatggtctggattaggagctcaataatatctattttagatggctgtttggtattcgatacgtctctactgagtctactctctacttggccgttcataatgagttactgtttttttgagcacggagccatgattgcattctagaatgatgatatcgtatttgatacatgctggaaagaatatgggataagatgttttggtgagacaccacagcaagcattcctgcttgtccgaatcattgtgttagacttgcgtgatagaatgcatggtttccgaatcattaggatggagtttgtaacatgatggacagtcaggctttatgcctgtgcgtgagctgcattttgagccgtgcacgttataagtaatgctggagtgaccaatttagtggatgtaaaggccggtgccgcagtctttgttagatagtagtactcatgacttcgaagcatcctaaggcgtcttgttcttttgtttggtaacggacccaatgtctctgatgggtatggtagcacaatcatccacagctcgaaagtgagggttacttgcaaccaaattaatagagtaccaacctaaacactatgatttattagttcgatctgcagattaagtctagttttcatagtacaaacgtttcacatgatgtatgatctaaaagttgaaattatgtatcaaccattacatcaaactgtttggtataacctctagatgttgaaccgctgatagtttgtcactttagagccagtatctggtgctcagtcagtttaattattgctactagtctttcctggcctatggtcgaaaaaggtttcccatccatggttagtcaattttgtccccatatcaatcagtgctaccttttgttaccttcgacatatcatattgctcaaccgtgnaaataatgtagcaatgtgttaatctaatccttctgttgtttcattttggtttcttgtacattgtcaaattgcatgttttttttgtgtactcctttgttgactactaatagctaatctaccttttaacgagctacagtaatactttatcggtcacattttgattgtccaattatccagatatcctactgatggagacaagcaaatgcttgctaaacaaacgggtttaacacggaaccaggtaaatagctgtgttacttgtattttggtatggataaggtgctcatgttttatttgttgcagtgattgttgtgtactagtttcgactaggcttggaggattgtacctttatttttgtctttgaaactttctgatggcatatggttacactcgtccaggtacccaactggtttataaatgcaaggnngttcgtctttnnggaaaccaatggtggaagagatccacaaccttgagatgaggcaggtgcacaaacaccctgttctcgacaagggccagcacgtgctgcatcaccaaacccagcattcgttcgagagcagtggaaagccttctgacccttccgactctcagcttggccaaagcagcagcatcacgaggaaccacaacatccctgcgtcccagggatttgccgatgagctctccgagatgtcccattctattcagcaggggcaggtaaccttcgcatacaatgggatgtcggcgccacaccacagcctcgcttcgtcacagcaccaccagcaggccgggccgatgagcggcattggtggcgcggggaacggtggcgtctccctcaccctcggcctccaccagaacaacagagtctgcatagccgagccactcccggcgtccgtccctcccaacctcgctcaccgttttgggttggaggaggtcagcgacccctacatgatgggctctttcgggaaccaggaccggcatttcggcaaggagattggcggccatttggtgcatgattttgttggctgacatggcagctgctgctgcattgttgcttctggtcagctgatctgatctcagcttgctgatggtgcacaagcatgtatttgtaccactactagtatgttagaatggtatataagtgtatcacttggtggctttggcttgatcagtttgaatcaattcctgaggatggagaaaaaacattgctgaattggtgagtccttgttggtccccgcgtgctatcaaatgctatttgacttccaaggctagaagcgattaggtggtttgccttccctagttcacacttgtttggtctgaattgagatttaactaaggggccctttggatccttcatttaaaaggaattgaaatttatttaatagagtagtttatttagtttaaaattcgaaattccaccactttcaagagtttagatatgatactaccctaaatttataggacgagagtttagatataattctatcccaaatttataggacaaggggtaaaaattgattttatgtatcactagtctatatttttactctgtaatttataacatgatttataacaatctcttcgactctcttatataatagaattatagcatctaaggtcctgtttgttttcttataggattatataatctagcttatggattatatatgcacc

SEQ ID NO: 9820 - DNA, 2380 bp, Zea mays
gcacgagaccattacctagaacatcctaatcgaaaaccagtcgacttcccggtctcggcttttgccgaaagaaaggcacccggaacccaacgacagcggcagcagtcgagtccgggacgggccggggcaaagctgggatgaggatgaaaaggggggctgaataaaaaggcgggggaggaggcgagaaggctacagcggcggcaggccaggccagcagagcgcagaggaccgccgctcggaaagtgcggagccgtttcccctctagctgctcatgctctctgcttgcctccgtccactcacagcccacgtccacgcctcgcgctcttctccaggctcccaggtgctccccgatcaatcgcttccgctgctagcgcgcgcgcgatccccgaggtcgcgcgcttgatcgcgctcaacgccatgtcgtccgccgcgggcgggtatggcggcggcggcggcgcgggaagcggcgccgagccccacggccacgccgacttcctgctgcaccaccatgcacagcacgtcgccgcgcagcagctctaccacgtgccccagcacagccgccgcgagaagctgcggttcccccaagacgacgcgcccccacacgcctccgcttccgtcccgcagcagcacggcggggcggtggcctggccgccgcctccgccgccaccggcgttctactcctacgcgtcctcttccacgtcgtcctactccccgcacagccccacgctggcgcaggcacagctcgtcgtggcgcacggcctcgccccgccgctctcgtcgcagatcccgacgcagaacttgcgcgctctcgctctcctcctcgtcctcgaacccgccgcccccgcccccgcagccgaggaggcctcacgccgcgcccttcgggcccttcaccggctacgcggctgtgctcgggcgctcccgtttcctcctccccgcggagaagctgctcgaggagatctgcgacgtcgggggcgcggcctcgcgcgtggaccgcagcgcctccgacgagggcctgctcgacgctgacccgatggaatccatcgatcacgaaatggacggcgccgaccgcgtcgccaatgacgctggcccaatctccggcgccgagcagcagtggaagaagactaggctcatctctatgatggaagaggtttgcaagcggtaccggctgtactaccagcaggttcacacggtgatcaactcgttcgagacggtcgccgggttcagcaacgctgccccgttcgcggcgatggcgctgagagccatggcgaagcacttcaagtgcttgaagggcatgatactgagccagctgcgcaacatcaccaaggcccctgccggcaaggaggggctcagcaaggacatcgccatgttcgggcttgccggtggtagcgcggccgccctccagagaggtagcagtgtgggtgccttcggccagcccgcacaacatctggcggccacagagagggctgccggagcgtgcggtgtctgttctccgcgcttggctcttcgaacacttcctgcacccatatcctactgatggagacaagcaaatgcttgctaaacaaacgggtttaacacggaaccaggtatccaactggtttataaatgcaagggttcgtctttggaaaccaatggtggaagagatccacaaccttgagatgaggcaggtgcacaaacaccctgttctcgacaagggccagcacgtgctgcatcaccaaacccagcattcgttcgagagcagtggaaagccttctgacccttccgactctcagcttggccaaagcagcagcatcacgaggaaccacaacatccctgcgtcccagggatttgccgatgagctctccgagatgtcccattctattcagcaggggcaggtaaccttcgcatacaatgggatgtcggcgccacaccacagcctcgcttcgtcacagcaccaccagcaggccgggccgatgagcggcattggtggcgcggggaacggtggcgtctccctcaccctcggcctccaccagaacaacagagtctgcatagccgagccactcccggcgtccgtccctcccaacctcgctcaccgttttgggttggaggaggtcagcgacccctacatgatgggctctttcgggaaccaggaccggcatttcggcaaggagattggcggccatttggtgcatgattttgttggctgacatggcagctgctgctgcattgttgcttctggtcagctgatctgatctcagcttgctgatggtgcacaagcatgtatttgtaccactactagtatgttagaatggtatataagtgtatcacttggtggcttgcgcctgagcagaaagaatcaaaaaacggaggaggcagaaaaaaaaaaaaaaaaaaaaaactcgag

SEQ ID NO: 9821 - DNA, 2164 bp, Zea mays
gaccgacgacctcgaagcttggcctgcgcggtggtgacgatggatgtcaaatgccggcgtctggaggggaaggtggccgtcgtgacggcgtccacgcaggggatcggcctagccatcgccgagcgcctcggcctggagggcgccgccgccgtcgtctcctcccgcaagcagaagaacgtggacgaggccgtggaggggctcaaggccaaggggatcaccgtggtgggcgccgtctgccacgtatccgacgcacagcaacgcaagaacatcatcgagacggccgtcaaggtcgcaactgtggaagggggttccagtctttcagggcttgttttgttgtcctcgtatttgctcagtccaaaatagttcattttcagatggattacattgcattgtcagcttcctcttgttgctaagcgatcccatcaggcctccctgcggttaacgttttgctgaaccttggggaagagggggattcctgtcaactctgtttttttcctagtaggatctggctctgttgctcacccgacattacctgcctgccctcgttagtcgccacctcgtattttctctagctgcttgcttaatactagcttcgtgctaaaatagtactctctccgttattttttatttgtcatgtttaatataaaaatgaactaacgagcgacaaatatttaattacggaggtagtagtcgttttagaaaatttgtagattcgtacaattcttgatgcatgtgttttgtatgtgtgtctagatttatcatctatttgaatataaacataaagaataatagctaaaccgactaatattttggaatgtagtacattttttggtgcaacggcattgtccaaactagctaagaaacatgggttcatggttggtaaaacacagacattgatagatacatctttaaactgggtaacagtgagatctatttgtgcataagtgcaaataatgccgctactagagctagaattgtctttttcttaaattatgaactaagacaacctcatttatacaaatatctactggaatttcacttatgagtataacgctcttttatcagtttagtcaatagcttttccaagcttacgaacagtagcgtagtatatatttatcatgtgaaagtgaaagtctcgagccaaaaggccgtgtcatttctcttttatctgttcatcttgtgacattgaggttgatggctagctcaacttgcatttacttcattagtacttcgacacacagtggtcataccttgtcttattcgcttgcatctaaagtgtacctttttcgtatctcaaatcacttgttttgttgatcatgttgtacattattttagtttatgttcatgtcttatatattgaaaagcatttgaggatgtgaggattcgtgtagcagtaatcaactgattatatggttgcagaactttgggcacattgatattcttgtctccaacgctgctgcaaatcctactgtgaatgtcatacttgaaatgaaagaggttgttctcgataagttgtgggatattaacgtcaaggcttctattcttcttattcaggatgctgctccccacctacgggcagggtcatctgtgatccttatttcttcaattgctggttacaatcctgagcaaggattgacaatgtatggtgttacaaagaccgctctctttggtctcacaaaggctcttgctggtgagatgggacccgatattcgtgttaattgtatagcccctggttttgttccgacacggtttgctagtttcttcatagacaacgagaccattaggaaaaagcttaacgagaggactatgcttaagagattgggttccgtggaagatatggcggcagctgccgcattcctggcatctgacgatgcatcattcatcacagctgaaaccattgttgttgctggaggggtgccgtcgagattgtaaatttggctcaagtttgtaccgattgttactaggttggtgacatagcaactatactgtaataatccactctgaaaatgtgggtcgtgctaagttggccaccgttagatctaataattttttaggtgtcttggtatttgtttgagataataatctactcagattatctgtcacttagttcaaattttattggattatataatataaatagataatcccaaaaaaaaaaaaaaaa

SEQ ID NO: 9822 - DNA, 751 bp, Zea mays
  misc_feature (26)..(26): n is a, c, g, or t
agcgcaagagcctcatcgagacggcncgtcaagagctttgggcacatagaatttcttgtctccaatgctgccgcaaatccttctgtagatagcatactcgtgaatcaaagagtctgttctcgataagttgtgggatattaacgtcaaggcttctatccttcttatccaggatgctgctcctcacctacggaaggggtcatctgtgattattatttcttcaattgctggttacaatccagaacaaggattgacaatgtatggtgtcacaaagactgctctctttggtctcacgaaggctcttgctggtgagatgggacccgatactcgtgttaactgtatagcccctggttttgttcctacacggtttgctagtttcctcacagaaaatgagaccattaggaaagagcttaacgagaggaccaagcttaagagattgggtactgtggaagacatggctgcggctgcggctttcctggcatctgacgacgcatcatacattacggctgaaaccattgttgttgctggaggggtgcagtctaggctgtaaatctggctgaagtttatatttacttggttaataatgtgtactagtgccctaggcgtggctaataatgtgtactagtgccgctagagcatcaggctaccttctatatatgacaggcaactctaaaatattttctatatcttattcctcttcaataatgtcctctctatcagcatcttctatatgtcgaaaaaaaaaaaagcggcc

SEQ ID NO: 9823 - DNA, 1352 bp, Zea mays
cattgcgcgccgccggcccggccggggccatccctaccctatggttccgatgaagcgccagaaaagagtccacatgaccacatcggtctctccggttctttaattgcgcgccaatctgttttatatatacggagagagcactcctgttttgtggcaaattctattactagctgcaaaagggcgtgtttgagactagcggaccgaccttgaagttgaagttgaaaaggtcggcctgcgcggcgatggatgtcaagtgccggcgtctggaggggaaggtggccatcgtgacggcgtccacgatggggatcggcctcgccatcgccgagcgcctcggtctggagggcgccgccgtcgtcatctcctcccgcaagcagaagaacgtgaacgaggcggtggaggggctcagggccaagggtatcaccgcggttggtgccgtctgccacgtctccgacgcacagcagcgcaagagcctcatcgagacggccgtcaagagctttgggcacatagatattcttgtctccaatgctgccgcaaatccttctgtagatagcatacttgaaatgaaagagtctgttctcgataagctgtgggatattaacgtcaaggcttctatccttcttattcaggatgctgctcctcacctacggaaggggtcatctgtgattattatttcttcaattgctggttacaatccagaacaaggattgacaatgtatggtgtcacaaagactgctctctttggtctcacgaaggctcttgctggtgagatgggacccgatactcgtgttaactgtatagcccctggttttgttcctacacggtttgctagtttcctcacagaaaatgagaccattaggaaagagcttaacgagaggaccaagcttaagagattgggtactgtggaagacatggctgcggctgcggcttttctggcgtctgacgacgcatcatacattacggctgaaaccattgttgttgctggaggggtgcagtctaggctgtaaatctggctgaagtttatatttacttggttaataatgtgtactagtgccctagagcatcaggcgtggctaataatgtgtactagtgccgctagagcatcaggctaccttctatatatgacaggcaactctaaaagattttctatatcttattcctcttcaataacgtcctttctatcagcatcttctatatgtcgttctccagtctccacgcttaaaaaaatttgtattaaggatatattttgtttccagttctttatgtgtcacaaatgcgctcagggttatatttagtccgtcctctaaagtttatacactcgtgtgtgtccattacttgcctttattgtggggggt

SEQ ID NO: 9824 - DNA, 721 bp, Zea mays
caaatatttcgcgctctgcccagccagcctatccactccagctccacttcttccccgcacaccacagtcacacgcgcagtgctagacgacgaacaccagagggcaggcagaggatgatggcgtccgttctcgccgtctcacggtggtcgtcgctgcttctcctcctcctggtggcgacggcgtcgcaggccctcaacgtcggcgacctgctcgggacagcagcgccttcggggagccagggctgtagccggacgtgcgagtcgtcgttctgcatagatgactacctcaacacgcggtgcaacgagaacctgctgagctgcctcgacggggtgagcccggcggggccgacgttcccggggaacgagtgcgacgtcggccagacggcgtccgtcatacgtggggtcatcgagtcggcggtgctcgcgggcaagatccttcacaagcgcgacgacggccagtagccggcgtcctgggctcctcctggcagtggcaggacatgcaggagcgggccgacctgagtcagtgaggctagctcgcggttggtacagacagtataaagccgcttgtgctggatttcaaggtcatgaatggccggaccacctgttggagttcgtttacgtattaggtttagttcatttactttaaaaaaataaattttagaataaatgtcaaagatccgctcatgaatctgaattcgtcttgtgcaacaaatttaaaactc

SEQ ID NO: 9825 - DNA, 1220 bp, Zea mays
ctcctatagggccggcgggtgcgtgcggagccgccccgggccccttcccatccttgagaaccgagcggacgccgagctgcaagtaactgcaccgactttcaaccggaagagccgagccgaaccaaagtcgcctcgtcgtctccaacctcccctcgcctcttgactaggccagggttccatcccacccccgccgccatccgatccgatggagggcggcgactcgtccggcgccggcgccggctccggtggcgccgtggcggcggcggccaagtggcggagcgacgcgtcgcggtcgttccagtactacctggaccgctccacgcctcacgccacggggcggtggctcggcacgctcgccgccgcggcaatctacgcgctgcgggtctacatggcgcagggcttctacatcgtcacctacgggcttgggatctacctcctcaacctcctcatcggtttcctctcccccatggtcgaccccgagctcgacccctccgccgccgccgaggggccggcgctgcccacccgggggtctgacgagttcaagcccttcatcaggcgtctccccgagttcaagttctggtatgcaatcacaaaagcttttgttgtagcttttgtgatgactttcttctctgtgtttgacgttcctgtcttctggcctatactcctctgctactgggttgttctctttgtccttacaatgaagcgccagattgtgcatatgatcaaatacaaatatgtgcctttcagtatcgggaaacagaaatacggtgtgaagaagagtgtcgcaagcaccagttcctcgaaagactgattatgagtctacctcagtaggaacttggcaggggaacaagatacggtggatgatgatgtgctaaatacctaagtgtaatactccattcatatctagatgtagacggatattcgctcctgtttctgactctgggctcactgtttaattcgatattgtgcttagattgctccctcctatgcttgtatagcgaattccgcatctcagataaattatttcgtttatttactaaatatctgggccccaaaagcaataacgtagtggtggagggtatggcagtggtggttgaatatgttagaagcgtcgtcgaggaattttctcccatactgtcttcacgagggtttgttcggttattttcaatccatatgaattggaggagatgaatacggattggagaaaaaaaaaaaaaaaa

SEQ ID NO: 9826 - DNA, 1585 bp, Zea mays
cagttttctatttcaacgcgggtgatcagcacccgacttgaaattttgttcattctttattttacacaaaaataattaagaaacaataataactatttaaataaataacttggctaatgattcatgaaatgatttgtttctactcaacgtgaaaaatcttaaattcatacatataactcaactattgcttctacttaatcgtttattgctgaattattgtttaaaatcatacactcgttaaaacccgcaagtaatctgaaacccagccgaaactcgactaatacgggtttagaattacacccgtagatacaatcatatgcgagttttgatagttttttgcgccacaagatccgaacttgacccattgctctagtttgcacatgtacgttcccatccaaaaaccctcggcaacggtgatgcgacgcccgtcccgttccaagtcctgacaaccgagcgtacgctgagctgcaagtaaacggcgctggctaccggaagagccgagccggaccaagtctcctcgtccctcacctcgtcgccgatggagggcggcgactcgtccggcgccggcgccggcggcgccgtggccgcggcggccaagtggcggagcgacgcgtcgcgggcgttccagtactacctggaccgctcgacgcctcacgccacggggcggtggctcggcacgctcgccgccgcggccatctacgcgctgcgggtttacatggtgcagggcttctacatcgtcacctacgggctcgggatctaccttctcaacctcctcatcggtttcctctcccccatggtcgaccccgagctcgacccttccgccgcctccgaggggccggcgctgcccacccgggggtccgacgagttcaagccattcatcaggcgcctccccgagttcaagttctggtatgccatcacaaaagcttttgttatagcttttgtgatgactttcttctcagtgtttgacgttcctgtcttctggcctatactcctctgctactggattgttctctttgtccttacaatgaagcgccagattgtacatatgatcaaatacaaatatgtgcctttcagtatcgggaagcagaaatatggtgggaagaagagtgccgtgagcccgagttcctcaaaagactgattccgaacctgccccagtagaaacttgccaggggaacaagatacgttggatgatgatatttgatgtgctcaataccaagtgtaatacttcattcatatctaggaggtagacggattttcgctcctgtttctgactctgggctcactgtttaattccatgttgtgcttaggtcgcttcctcctatgcttgtatagcgagtttcgcgtctcagataaattatttcgttttagttactacatatctgggccctaaaacaataagctctatgctctcagcaagtttggttgggtgttgagctgggtgaggtaggcggttggttatttttgtatcgaactggaacaggatgctaaactttaaacgcagaatattttgacccaaaaaaaaaaaaaaaacaccgttcgtatcaaacatcgaaattcaaacgcagaatattgctgtctgcatttg

SEQ ID NO: 9827 - DNA, 957 bp, Zea mays
gcgacgcccgtcccgttccaagtcctgacaaccgagcgtacgctgagctgcaagtaaacggcactggctaccggaagggccgagccggaccaagtctcctcgtctccacctcgtccctcacctctgacccgagccagggttccaccccaccctgcccctatccaatccgatggagggcggcgactcggccggcgccggcgccggcggcgccgtggccgcggcggccaagtggcggagcgacgcgtcgcgagcgttccagtactacctggaccgctcgacgcctcacgctacggggcggtggctcggcacgttcgccgccgcggccatctacgcgctgcgggtctacatggtgcagggcttctacatcgtcacctacgggctcgggatctaccttctcaaccttctcatcggtttcctctcccccatggtcgaccccgagctcgacccctccgccgcctccgaggggccagcgctgcccacccgggggtccgacgagttcaagccattcatcaggcgcctccccgagttcaagttctggtatgccatcacaaaagcttttgttatagcttttgtgatgactttcttctcagtgtttgacgttcctgtcttctggcctatactcctctgctactggatcgttctctttgtccttacaatgaagcgccagattgtacatatgatcaaatacaaatatgtgcctttcagtatcgggaagcagaaatatggtgggaagaagaatgtcgcgagcaccagttcctcaaaagactgattctgaacctacttacccccagtaggaagcttggcaggggaacaagatacggtggaggatgatatttgatgtgctaaatactcaagtgtaatacttcattcatatctagaggtagacggatattcgctcctgtttctgactctgggctccctgtttaattcgatattgtgcttagattgcttcctccc

SEQ ID NO: 9828 - DNA, 1053 bp, Zea mays
cattgggtacctcgaggccggccgggctcgtctctcccaccaagccgcaacacagcgcagacggcggcggctgctagcctgcaacgaacaaaccagcgagcgagcgggcggaggaggagatgccgggaaaggggcagcggcggagggagaagaacttccgggcggcgcacggcggggtaccgtgcctgcccccgccgccaaagcagagggagctcgaggccatcccgactaaactccgccgcctcatcgccttccagaacaagcacaacgccaatgctgacgcgtcctcaggaggtgctcccaagaagcaagacgatgggttaaggaagaacaagctagcaacagacaaggcaaaggacaagaaaaccaagaagcaggcattggtggttcctgctgatagcaaagcatcagatattaaaggtaatgataaacgttcagctgccaatgaggatgtgaatgcagagggaagtaaggggaagagaaagaggggaaatgttaaggaccttcgtttcgaggaactggacaagaacatctcagcctcgaagaagcagaggaggaagcagcacctggatgagaagaaaaagaagcgcaaggacaataagacagaaactctaccagactttcctgggcgcgagaaagtcaaatttggtgaagttgttgtggctccaccaaaattgtcattcccgaaggtgaagagtgcttcagatgcttctcgcgagatgctgaggaaagaggcaattgagaattacagatatatcaaaggctggacatcgaggcctggactgcagcttccaacgctagcagaatcacaatagatattttctctgtttatcgttgtcaaacttactctgtttatatcagagaagtttagagtatcaattgtgtaatttgtactctcatgtaggcaattccgaacaaatattcctgtctggatttcctctcttcttttgtgtgtttgtttttccgaaaaaaaaaaaaaaaagctcttgccaatagggtattatgtgattaagaaagaaaatgctgactgtttgatcagtggcttggatttcg

SEQ ID NO: 9829 - DNA, 1894 bp, Zea mays
cttcttatccccaatggcggacgcacggccccacatcactgctcactctgcactctcgcgggatggagcttggcctagcgctccggctcgtcgcgccgccaccgctgctgccgtgtctctcccgtagagctctttccctaccaccggattttgtttcctcgcgtgtgcttcgaggaagacgcatccatgcctcgagactgaagcatggagctggggttgtgtgcaatgcgattatgacctattcaggagtggaagaggaggagatggtggaagaagaaatggaagaggaggctgaaccggcggtgagcacaaggccgcgcctggagctcatcgagaagccggaccggagcctggcgctgctggatgagtacgagtcggaggaactgggcacctctctttgcgccaatcatcgtagcggttatgttgctgtattggggaagccaaatgttggcaagagcacacttattaaccaaatggttggtcagaaactttcaattgtaacagataaaccgcaaacgacaagacatcgcattcttggtatatgttctgaaccagagtaccagattatactttatgacactcctggtgttattaaaaaggagatgcataagctggacagtatgatgatgaagaatgttaggagcgctatcggcagtgcggactgtgtgcttgttgttgctgatgcttgcaaaactcctgaaaagattgatgaaatgcttgaagaaggtgttggaaacaaagatattggacttcctgtactgctggtattgaacaagaaagatctcataaaacccggagaaatcgcaaagaaacttgagtggtaccaaaaatttactaatgttgatgatgttataccaataagtgctaaatttggtcatggagtggatgatatcaaggagtggatattgtcaaagctccctctgggtcctgcttactaccccaaggatatagctagcgaacaccctgagagattttttgttggtgaaatagtgagggaaaagatttttgttcagtacaggcaggaaattccttattcatgccaggttaatgttgtcagttacaaaagtcggcctgctgccaaggacttcattcaagttgagatacttgtggagaaagaatcacaaagaggcattatactagggaaggatggcaaaagcataaagatgctggcaaccgcatcgaggcttgacatcgaggactttctacagaagaaagtctaccttgaggtggaggtcaaagtgaaggaaaactggcggcaggacgagcgactcctgaagcggtatggctacggcggcgagatccaagcgctgtgactgtgactgtgactatgaccggtgcgctctagctcactgtcagctgccgcgagcgtggaatgacctggttttttttcaattcctctcgtgtgttgttgttgtcgatgcgaatgagtagcagttatttaacctggtgtcgaactcaactagcagctcagttgtgttaattagtcagcaagttatgtgctctgatcctgctgttgttgtcagcggaactggttttgccgcagacaagtcagcatggttgcgctctctgtagcagtctgtgtgaatagaatcacgggggagttcagacatcagagggactgaacagccgagccaagccacaagtgcatgtacaagtcgtgtccttcgggcggcggcgggtccatgtggaggcgcgccgtgtgccggtgccctgcgccggccgtcgtggatactgtgtggcatagcgagcacgaccggttggggctgactgaccgtgggaggcggtggactatgctgatacacgttgggtctgccgcagcattgactcggctaccttgagcaggtcctgtgttgtccaaacaaaaaaactcagcttgtgcacagaccacatgaca

SEQ ID NO: 9830 - DNA, 718 bp, Zea mays
aggctgctcttgctacgcagttgcaccggcgcggcagcgcaaaacattaaaccatcatttgcggcggcggctgctgccggcgacgcgatgtccaagcaaaagaccgtgatccggctgggcgtaccgaacgacaagaaccggtctaaggccatgcagatggcatccaagttcgtgggagtgaactcggtggggatcgccggcgacgccaaggaccggctggaggtggtgggggagagcgtcgacatcacctgcatgatcaacctgctgcgcaagaaggtctgccgcgccgacatcgtcgtggtggaggaggtcaaggacaagaagaaggaggaggaggagaagaagaagaaggaggaggaagagaaaaagaagaaggcggaggaggaagccaagaagaagaaggaggaggaagagctcaagaagaagctctgtccgtacctgtacccgccgccgccgtgctccggtgcctgttgccgcgggccgtcgccgccgatgtttctgtgcgagccggaacagccagcgggatgccacatcatgtgacgatgaagtgaagctccgtgaataatcgtcccgtccgaacttgtgcacatgcgtggttgtggttttgctttggcatctgaattacaatcctaagtgatcatggaatttagatcactacttatatataaagtattgttttgtgagtttgtttttaagttaagatgttctaaatccgtcc

SEQ ID NO: 9831 - DNA, 822 bp, Zea mays
gcgaggcttaattggtagtaggctgctcttgttgcgccggcagcgggcaggcggcagcgcaaaacattaaaaccatcatttgcagcggcggctgctgccggcgacgcgatgtccaagcaaaagtccgtgatcaggctgggcgtaccgaacgacaagaaccggtctaaggccatgcagatggcatccaagtttgtgggagtgaactcggtggggatcgccggcgacgccaaggaccggctggaggtggtgggggagagcgtcgacatcacctgcatgatcaacctgctgcgcaagaaggtctgccgcgccgacatcgtcgtggtggaggaggtcaaggacaagaagaaggaggaggaggagaagaagaagaaggaggaggaagagaaaaagaagaaggcggaggaggaagccaagaagaagaaggaggaggaagagctcaagaagaagctctgcccgtacccgtacccgccgccgccgtgctccggtgcctgttgccgcgggccgtcgccgccgatgtttctgtgcgagccggaacagccagcgggctgccacatcatgtgacgatgaagtgaagctccttagtgctcaagatggatcctgcctgcctgggctcaacaatatgcatgcttgtgattttggtttgccacacatcatcgaccggtcagtttcactccgtgaataatcgtcccgtccgaacttgtgcacatgcgtggttgtggttttgctttggcatctgaattacaatcctaagtgatcatggaatttagatcactactatatatatatatatataagtatttttttgggaaaaaaaaaaaaaaa

SEQ ID NO: 9832 - DNA, 1364 bp, Zea mays
catctccggcgcctcgagcccggccggcctcgcatcgcatcgatcctcccatctgcgcacccgcaagcctattcgccgcacctcctcaggtgaccgggaagatgatgccgttgagccaaaccgacttctcgccgtcgcagttcacctcctcccagaatgccgccgccgactccaccacgccttccaagatgcgcggcgcgtccagcaccatgccgctcaccgtgaagcaggtcgtcgacgcgcagcagtctggcacgggcgagaagggcgctccgttcatcgtcaatggcgtcgagatggctaacattcgacttgtggggatggtcaatgccaaggtggagcggacgaccgatgtgaccttcacgctcgacgatggcaccggccgcctcgatttcatcagatgggtgaatgatgcttcagattcttttgaaactgctgctattcagaatggtatgtacattgcggtcattggaagcctcaagggactgcaagagaggaagcgtgctactgctttctcaatcaggcctataaccgatttcaatgaggttacgctgcatttcattcagtgtgttcggatgcatatagagaacactgaattaaaggctggcagtcctgcacgaatcagttcttctatgggagtgtcattctcaaatggattcagtgaatcaagcacaccgacatctttgaaatccagtcccgcaccggtgaccagcgggtcatccgatactgatctgcacacgcaggtcctgaatttttttaatgaaccagcgaacctcgagagtgagcatggggtgcacgttgatgaagtactcaagcggttcaaacttttgccgaagaagcagatcacggatgctattgattacaatatggactcggggcgtctttactcaacaattgatgaattccactacaaggcaacttaaccgatttgaaggtcagcctgctggaaatggcagaggactaagtatcacttgtactaaaccaaagtctggaaatgtcatgttgtgtcatgaaatgcatggttggtttatggaaacatttatatcttgtatcaactagttgatttgtatctcttgtgtcaacttaatgactgagccaacaaaaggaagatgtagaggcagacagacatttgtagattggctgatagctgattcgggtagctggtccaatcgcaatctggggcccaataattcagatgcaaaagcagaaagatatttcactgtcgtttcttttgatgcaaaagaaattaaattataaggaaatgaagactgttccattatttcccattagtttacccagtcatgatgtatttcatagttttaaatttaataaaagcgtgtacatttatccatttaaaaaaaaaa

SEQ ID NO: 9833 - DNA, 1612 bp, Zea mays
ccggccggggtctctgcccactccgtcctcgccgcaatgaaagctgaaagagaagctacagccagcaacagcaagcaggctgaaccaaactccagcgagcaagcaagctatagctagctagtagccaagcagaagccaaatacccaaaggcgagcgatggcgcccggaagcatcgccagccggtggcgcgagctccagggcgcggactcctggtcggggctgctggacccgctggacatcgacctgcgcgcgaacctgatcgcctacggcgagctcacgcaggccacctacgacgggttcaaccaggagcggcggtcgccgcacgccggcgcctgcgtgttcggctactccgacctgctggccggctcgggcgccgcggcggccgggagctacgccgtcaccaggttcatctacgccacgtcggcgctccccggcgtgcccgaggcgttcctgctgctgccgctgccggacctgctgcccgagtcctggagccgggagtccaactggatgggctacgtcgccgtcgccaccgacgacggcgtcgccgcgctcggccgccgcgacatcctcgtcgcgtggcgcggcaccatgcgcggcctcgagtgggtcaacgacttcgacttcacgcccgtgtccgccgcgcccgtgctgggccccgccgccgccgccaacccgttcgccttggtgcaccggggcttcctctccgtgtacacgtccagcaacccggactccaagtacaaccagaccagcgccagagatcaggtcctggcggaggtgagcaggctggtggcactgtacaaggacgaggtgacgagcatcacggtgtgcgggcacagcctgggcgcgtcgctggcgacgctgaacgccgtggacctcgcggccaacggcgtgaacgcgccgccggccgggtcgtcgcagccgccgtgccccgtgacggcgctggtgttcgcgagcccgcgcgtcggggacggcaacttcaagagggcgatcgcgtcgttcccggacctgcgggcgctccacgtgaagaacgccggcgacatcgtgccgacgtacccgccgctggggtacgtggacgtggccgtgcagctgcccatcgccacggggcggtcgccgtacctgcggcagcccgggacgatcgcgacgctgcacaacctcgagtgctacctgcacggcgtggccggcgagcagggcagcgccggggggttcaggctggaggtggaccgcgacgtcgcgctggtcaacaagggcgaggacgcgctcaaggaccagtacccggtgcccgcccagtggtgggtcgccaagaacaagtgcatggtcaagggcgccgacggccactatgcgctccaggacttcgagcagatctgatcatgcatgatgcaggtgtcgtgcgtgctggtaaactactagtacctctctatcggtcgatcacgatgtacgaataatgggcgtcgtcgatacgcatgcgtgtatgatcatccagatccaggttgtgtgtgtgtgtgatgcttctcacctcttcctcctacgaaccggagattgtgatggggagtcagttataattataaataaaccatcctctgattgtgattgtgtctcaaaaaaaaaaaaaaaa

SEQ ID NO: 9834 - DNA, 1774 bp, Zea mays
ccgccccggcccgccccgattccgggccccacttcaccgcgcggaaaaaacaaagagattcccctttgctctacaggaagcgccgacgccgttgatggaattcggaaggaccaaagctgctgccgtagccctgatccccgaagcgaccttccgccggtccagtctgtccttctcggcctccgcgacgccgtggtcccgggaggtgtgggtcaacgcatccaaataacggctcttccagaggaaaacactgctgaatttctcagctggtgcctagtggtgggaaataaagctagggacccagcatccttgtgatagcaatcacatcattggtgttgttttttcagcttacgctgaaactagactgatcaagaaggcgaccagctgtcaaaatgcatagacagaagaacccaaactctgggtgggctgcgtttgatcgcaagcagcgcagtgcagatggcagtgggtatgaaggtgatgctgatccatttccgtctctctcaaattctggagcctctaatattgctagtagctccattacagaaaagaatgggctaaaacgaaagccctttgcttcagtggttcgcccttctgttgattctggagctgttagtactggatgcggaaataagaattctgctaatcacgtggacagcgggaatcacggtgcaatctctgcacctcttaataaagttaagatcttgaaagatgcacacagttgggccgacattcacttaattgaggatgtactagctgctgtgaataatgatgtcggacaagcatctgatttgttgaaagttatggactctcctgccttgcagactggagagggcagaacatctggccaactggctgatgtgatgaataaaacacacggatcaccatcagaaagtgctgcagcaggcaaagcaaatccagatagctcacagttgttgctgcccctgatgaactttccctctatacccttgcagcctgaattcgaagatattgatgatgaatacttcagctaccggaaagatgcattgaaaatgatgagggctgccacaaagcattcccagtctgccagtaatgcatttttgagagatgaccatgctgctgccaaggaactttctctcagagctcaggaagagcgggcagctgctgaaaagctaaataacaaggcagcggaagaaatttttcgccttaggaatagcaataatgacatctggaagatagacatgcatggtcttcatgcatcagaggctgtggcagtattggagaggcatctccacatgatagagttccagcaacctgggaataagtcagcctcatctgaggacttagctaagttggaatctgcatattctgaatcaaccactggttcaaacattgagcttgctgctgagaaggtggtcttacgccggcctaagcagtctatcttacatgtgatcacagggatgggtaaccatagcaaagggcaggcttcactacctgttgccgttaggggtttccttattgagaacgggtatcgatttgatgagctgaggcctggtgtttttgcggttcgtccaaaattccgccgcaggtgaacctgtggaagtttgtacaattgtaacatggtggtggcttggggtgattatgtgctctaaattttacactaaaatttaaggatcaaatcggattaggatcagactctatttttattatgaagtagatccttcggtacctccacggcatcaccgacttcgtccttctccttcatcgatttgcgaccgttgttctcgttttctacaccgat

SEQ ID NO: 9835 - DNA, 1968 bp, Zea mays
ggtctcgggttgcgcggacctgttcatgtttaggaggatccgtgagaaaggttgatatatgtagggttttgacatgcatatatcaccataagaaatatatatgatgtattctattccctcctctttttcttatgtttttaaagaagattttaacgagacgtaaagataacatatattggaccgagggtcgggggctttgttcctcttactaaagtttagtttatgtcacatcggatgtttgaatgacaattatgagtattaaatatagtctagttataaaactaagtatatagataaagactaaacggtgagatgagtttgttaagcctaagtaatccataattatcaaatgcttattgtagcatcatatgaatgaatcatggactaattaggtttaataggtttgtcttgtcatttagtccttatttatgtaattagttttataattatactatatttgatattgacattcaaatattagatgtgacatataataaactttagtgaggtgaaccagacaaatgtgaaaacaagactatgatggagttttcatgagattgctgggagactgtgaacatcagactcctttctctctctctaaaaggaggtgaatggagagctgaagaggaacatccacatccagaaaatgtatatgtgtacaccagatacaaggaaatgaagaactctcattctgatcgcgtgcctctgttcttacgtgcaatgaacagatttctcaacaggttggagcactgcagattatttgtaccgtggagttgagcgaccgttgacaggaacgcaagtaggagtaggtgcctttctgatgggagttgccaccgctacagcagtcggcagccggccgttgagaagaaccacggaacggaacggaacggacagagaacgtgccagtgcggcggatcatcaagaccggccagaaccagaaaccaacgcccgcgcgatgcatgctcccgcactaaatgcatgcacggcggcaccatcactctccaagaacatccggaccctgtgactgtgactgtgcgtctgtgcctgcgctagctagccgttagtacaacagcaccaaaccggagacgagcagcggtaatggcggccgggtcgtcatcgtgctctccggtcctcctcctcctactactcttcctcgcctcgtccggcgccggcgcaggcgcaggagaggcttcaacgacgtcgacgtcggccccggtgccagcccctgcctcggcactggaccaggtgtgcggaagcctgggcagctactacgtgacgccgtccctctgcgagtccgcgctctgcgccgacccgtccgcgccgtgccgcgcggcgcgggacgcgcccaccgtggcggcgctcgcggccaggctggcggccgacaacgccacggcggccagggacagtatcgaggccgttttcttcccatcttcgtcctcgtcctccgccgccgcggccgcgcaatcgtgcctgcagctgtacgcgggcgcggtgccggcgctgcggtgggcggctcgggccgtggccgcggggcggtaccgcggcgcgcgggaggtgctgcaggcggcgcagtacgtcgccgcgggatgcgagggcatcgcgggcgacgcggccgccccgctgccccgcgagaacggcggattcgccgacatggccttcgtcgcgcacgccgtcgtcgcctccatgtccgccgactgatccaatccaacccgccaccgctcggcttaatgcgagaatggcgaagctcgttgtactgcagtgataatcattgcgctgccgctaccatcctgccatgtcctgtccatcggttaataacctctgaatgcgtggtgtttgtgtttcccctgtgtaaaattcagttttccgcttcatcgatctgatctcctgcaaaaaaaaaaaaaaaatggatggattggattctcttcgagacaaaatcgatcatcgatctttgtttcgaaatttggatgt

SEQ ID NO: 9836 - DNA, 743 bp, Zea mays
gaacgtgaaggcggaggacaagggcacgggcaagtcggagaagatcacgatcacgaacgagaaggggcggctgagccaggaggagatcgaccccatggtgcgggaggcggagaattcggcccgagggaactagaaggtgaaggagcggatcgacgcccgcaaccagctggagacgtacgtgtacaacatgaagaacacggtgggcgacaaggacaagctcgcggacaagctggaggcggaggagaaggagaaggtggaggaggccctcaaggaggcgttggagtggctggacgacaaccagtcggccgagaaggaggactacgaggagaagctcaaggaggtggaggccgtgtgcaaccccatcgtgtcggccgtgtaccagcggtcgggcggcgcccctggcggtgacgctgacgctgacggcggtgttgacgacgaccacgacgagctgtagatggttgtagatggtggtggtgacgtggagtgccgggagccgagccaaattttgtaacggtgtttagcggcggacaatacttattttactaatcttggtgctgctctgccaatagctgtgctgagcgtagaaactgtttgtttgtaattttttttcttctacttccttggttgttcaggattcggattcgaattttatgtgaaaaaaagaagtcgcgcttttaatcaaaaaaaaaaaaaaaaaaaaaaaaaaaaaaaaaaaaaaactcgagaaggggccgcgtgtaccc

SEQ ID NO: 9837 - DNA, 1127 bp, Zea mays
ggtccatatgctcatatctattgtggccttgtggggcttctccctcatccggtcatccctctccgccccgcatctccctcatcgccccgcgcggccgcgcctccctccccgccacctcgaacctctcctcctcctccgccgccgccttccctccggccagcgcatcctcctccgccgcctccgccgtcctccggctggaggcacatcctctgcctcctctgcctcccctcctgtgacacagcgcacatcgctcccgaagtcccaagagccacgtcgctcgtgccaccagccgccgctgtacgtccatctctgtctccagactccaacagtgtgcatctgtcccagttcctgattacttttccgcgaccgtgagctgggagtatggccgaagcagcgaacgaggaggacgccaagaggacaggactggaaggcactggcctgccgctgcaaggcggctcccacggcaaccttcgtagcgctggcagcgaccagcagttgaggcagatgctcgattcgctcaaatcctcaaagtccccggctgtgatcaactatggtgcctcatggtgccgtgtttgcagtcagattcttccatccttctgcaagtgcagtgataagttcaagaaacttactttcatctatgtggacattgacgagtgccctgaaacaacccaaaacatacgctacaccccgaccttccatttttacagagacggcgaaagggtcgatgagatgctcggcgcaggagaagagagactacatgatcggctatggttgcattcttgatcgattggcctccacttctgttgtttcatgaaccatttatgctgaatgcaactatgttgttgtctctccaaatttctacttgtcaaactcaatgtttcagagaaccttgtctaccagcctttgtgttagtcataattatttactgtttgagtgacgggggagttcggcagcaaccgcagctccagtaacatgggagagctgcaacgccttttctcaggttactgtagcagcagctgctgctgctgctgcagccgcagtcgtataattgtagttctactcattccaaacgttgagggagtggtgaatacaacatagcacctgctgcagcagccgccgaacaaacc

SEQ ID NO: 9838 - DNA, 3401 bp, Zea mays
  misc_feature (1)..(1): n is a, c, g, or t
ncggccggcacgccggccggggtcgggatcagacagacgcagactctctcacccgactcgtcagacgtcagccagcagttcgaaaccaaggatcgatccaggagcttccggaaggcgaggcgcgcgcgcagcgtcgaggtgctggtgccggtgccgcccatggatcgggctcgcggatccgcgttcctgctcggcgtcctgctcgcaggatccttgttcgcgttttcagttgccaaagaggagaccaagaagctcgggaccgtgatcggtatcgatctcggtaccacctactcctgtgtcggtgtgtacaagaacggtcatgtcgagatcatcgccaatgaccagggtaaccgtatcacaccctcatgggttgccttcaccgatagcgagaggctcatcggtgaggctgccaagaaccaggcagccgtcaaccctgagaggaccatctttgacgtcaagcgtctcatcggaagaaagttcgcggacaaggaagtccagagggacatgaaacttgttccctacaagattattaacaaggatggcaagccctacattcaggtcaagatcaaggatggggagaacaaggtcttcagccctgaggagatcagtgccatgattcttggcaagatgaaggatactgctgaggcataccttggcaagaagatcaatgatgctgtcgtcactgttcctgcgtacttcaatgatgcgcagaggcaggcaaccaaggatgctggtgtcattgccggcctcaatgttgctaggatcatcaatgagccaactgctgctgctattgcctatggtttggacaagaagggtggcgagaagaacatccttgtctttgaccttggtggtggtacttttgatgtcagtatcttgaccattgacaacggtgtgtttgaggtgctggccaccaatggtgacactcatcttggaggtgaggactttgaccagaggatcatggagtacttcatcaagttgatcaagaagaagtacagcaaggacatcagcaaggacaaccgtgctcttggaaagctgaggagggaagccgagcgcgccaagagagccctcagcaaccagcaccaggtccgtgttgagatcgagtccctctttgacgggaccgatttctcggagccgctgacccgtgccaggtttgaggagctgaacaacgacctcttccgcaagaccatgggccctgtcaagaaggccatggaggatgctggccttgagaagagccagatccatgagatcgtcctggttggtggaagcaccaggattcccaaggtccagcagctcctgcgggactacttcgacggcaaggagcccaacaagggtgtcaaccctgatgaggctgttgcctttggtgccgctgtgcagggaagcatcttgagcggcgagggtggtgacgagaccaaagatatcctcctccttgatgtggctcccctcaccctgggtatcgagaccgtcggtggagtcatgaccaagttgatcccgaggaacactgtcatcccgaccaagaagtcgcaggtgttcaccacctaccaggaccagcagaccactgtctccatccaggtctttgagggtgagcgcagtatgaccaaggactgccgtcttctcggcaagttcgacctcaacggcattgcgccagctccaaggggcacaccccagatcgaggtgaccttcgaggtggacgccaacggtatcctgaacgtgaaggcggaggacaagggcacgggcaagtcggagaagatcacgatcacgaacgagaaggggcggctgagccaggaggagatcgaccgcatggtgcgggaggcggaggagttcgcggaggaggacaagaaggtgaaggagcggatcgacgcccgcaaccagctggagacgtacgtgtacaacatgaagaacacggtgggcgacaaggacaagctcgcggacaagctggaggcggaggagaaggagaaggtggaggaggccctcaaggaggcgctggagtggctggacgacaaccagtcggccgagaaggaggactacgaggagaagctcaaggaggtggaggccgtgtgcaaccccatcgtgtcggccgtgtaccagcggtcgggcggcgcccctggcggtgacgctgacggcggtgttgacgacgaccacgacgagctgtagatggttgtagatggtggtggtgacgtggagtgccgggagccgagccaaattttgtaacggtgtttagcggcggacaatacttattactaatcttggtgctgctctgccaatagccgtgctgagcgtagtaactgtttgtttgtaattttttttcttctacttccttggttgttcaggattcgcattcgaattttatgtgaaaaaaagaaggcgcgcttttaaaatcttgcatttgcccccttgtggtaataatgctaattaaatggtgcaaagtagattgcttgtgactgggtttcgtgtgagttgggatgttagatttgaatgagttcttcaagagattctcatccataccaccattttaggtgcaattttaatctattcactactttttcttcgagttgtcattattgccccacaatcaactttttcaaagtgcagacttgggaacagattagagttcagaatattttatcaagagcacagtgtttatttatagtttacttcgaccctattctgttgtcgttttagccatttattacatggaataaggattaaacttagagcatctccaaagggagttctaaacggagttgcctttgacacactcctatgaatcaccttatatcatagactccctaacagtctcctctaacaccactgccattctacatagaagcaatcgataggagcagtttaagtgttgccttaaaaaaatgagcaacatttactgaccaaattcacttcctaggacgacatataccacaaagcctaatcacatcagatacttgtacaactctagatagcttcaaaaaaaatcacctatgtcggccacttctgctctcgaaaaaataacttgtgagatcacattagttgatcaccagtgtcaacaatcaacctatgttaccaaattgtctagtcggtcctagttgccatgggaccaaccaggcaactaatcatgattggtcggacaaccatcgaatctggtcgaacaaattgagtcaggggatataattggagtcatgggaccaatcagtctgattaatcgcgatcaatcagacagcttgataacactgcaatcaacttacaggatgttctactactcactaaaaaacattactccctccatttcatctatgatctgcgacgtcctactactcgctacaaaacattactccctccgttcatctacgatcttagatgtcttactactctataaaacattactccatctgttcatctaccatctgtga

SEQ ID NO: 9839 - DNA, 2477 bp, Zea mays
aaaaacacctcgaggccggccggggactcgtcagcaagcagttcgaaaccaaggatcgatccaggagcttccagaaggcgaggaggaagagggagaagggcgcgcgcgcgcgcagcgttcaagtggtgctggtgtcggccatggatcgggttcgcggatccgcgttcctgctcggcgtcctgctcgcaggatccctgttcgcgttttcagttgctaaggaggagaccaagaagctcggcaccgtgatcggtatcgatctcggaaccacctactcctgtgtgggtgtgtacaagaacggtcatgtcgagatcatcgccaatgaccagggtaaccgtatcacaccctcatgggttgccttcaccgatagcgagaggctcatcggtgaggctgccaagaaccaggcagctgtcaaccctgagaggaccatctttgacgtcaagcgtctcatcggaagaaagtttcaggataaggaagtccagagggacatgaaacttgtcccctacaagattattaacaaggatggcaagccatacattcaggtcaagatcaaggatggggagaacaaggtcttcagccccgaggagatcagtgccatgattcttggcaagatgaaggatactgctgaggcgtaccttggcaagaagatcaacgatgctgtcgtcactgtccctgcatacttcaatgatgcgcagaggcaggcaaccaaggatgctggtgtcattgccggcctcaatgttgctaggatcatcaatgagccaactgctgctgctattgcctatggtttggacaagaagggtggcgagaagaacatccttgtctttgaccttggtggtggtacttttgatgtcagtatcttgaccattgataacggtgtgtttgaggtgctggccaccaatggtgacacccatcttggaggtgaggattttgaccagaggatcatggaatacttcatcaagttgatcaagaagaagtacagcaaggacatcagcaaggacaaccgtgctcttggaaagctgaggagggaagctgagcgtgccaagagagccctgagcaaccagcaccaggtccgagttgagatcgagtccctctttgacgggaccgacttctcggagccgctgacccgtgccaggtttgaggagctgaacaacgatctgttccgcaagactatgggccctgtcaagaaggccatggaggacgctggccttgagaagagccagatccacgagatcgtcctggttggtggaagcaccaggattcccaaggtccagcagctcctgaaggactacttcaatggcaaggagcccaacaagggtgtgaaccctgatgaggctgttgcctttggtgccgcggtgcagggaagcatcttgagcggcgagggtggtgacgagacaaaagatatcctcctccttgatgtggctcctctcaccctgggtattgagaccgtcggtggagtcatgaccaagttgatcccgaggaacactgtcatcccgaccaagaagtcgcaggtgttcaccacctaccaggaccagcagaccactgtctccatccaggtctttgagggtgagcgcagcatgaccaaggactgccgtcttctgggcaagttcgacctcaatggcattccgtcagctccgaggggcacaccccagatcgaggtgaccttcgaggtggacgccaacggtatcctgaacgtgaaggcggaggacaagggcacgggcaagtcggagaagatcacgatcacgaacgagaaggggcggctgagccaggaggagatcgaccgcatggtgcgggaggcggaggagttcgcggaggaggacaagaaggtgaaggagcggatcgacgcccgcaaccagctggagacgtacgtgtacaacatgaagaacacggtgggcgacaaggacaagctcgcggacaagctggaggcggaggagaaggagaaggtggaggaggccctcaaggaggcgctcgagtggctggacgacaaccagtccgccgagaaggaggactacgaggagaagctcaaggaggtggaggccgtgtgcaaccccatcgtgtcggccgtgtaccagcggtcgggcggcgcccccggtggcgatgccgacggcggcgtcgacgacgaccacgacgagctgtagatggtggtggggagcggtgacgtggagtgccgggaaccaagccaaattttgtaatgatgtttaggagggagggtggtggacaaaaaaactaatcttggtgctgctctgccaatagacgggctgagcatagaactttttttcccttctacttccttgtgattgttctttttatagaggattcgcattgcagtgtaatgtaaaaaaaagaagacgcacttatgaaacttgttactacaagttaataatgaaatggtgcatcacagtgtaatgattgatatgagtacaggacgggaaagcccaaagccgagcagtgcaatctgcttgggacttggattacattattac

SEQ ID NO: 9840 - DNA, 1203 bp, Zea mays
aaagctggagctccccgcggtggcggccgcggggccgcggagagtagtccccccccccccccccccccccgatccggtggctgggagttccggaacgcgtacaggcgccagctgctggctctgtcgcggcggatccggctcctcggccccttcgccgaggagctgcgggaggcacgccgggggtccgcggagcaggaggagcaggagcgggcgctggcgcctctcgccgacgcgctggaggaggcactcgacctgctccagctcggccgcgacggcagcaggatattcctggtccttgatagggatgaagtaatgaagaagttccatgaatcaattgctcagctggagcaagccctgtgcgattttccatatgataaactggatatatctgatgaagctagagagcaggttgagttagtgcatgcacagctcaaaagagccaaagagcgggtcgacatgcccgatgacgagttctacaacgaattatgttcgctgtataacaagagccacgacccaagtgctgagttggatatccttgggagattgtcggagaagttacacctgacgaccatcgctgatctcacgcaagaatcacttgctttgcacgagatggtggcatctggtggtggcaacgatcctggagaacacattgagaaaatgtcgatgctgctgaagaagatcaaggactttgtgcagactcagaaccctgaaacgggcccgctggtgactgccaagccaatgggttccaacgggaagccaagacctgtaaacgttcctgacgagttccggtgcccaatctctcttgagctgatgaaagacccggttatcgttgctactggccagacatacgagcgggcattgatcgagaaatggctagcttccgggcaccatacctgtccaagcactcaacaaaggatgccaaacacgacgctgacaccgaactatgttctcagaagccttatcacgcagtggtgtgaggccaacgggatcgatccaccgaagcgcccgacgcagcagcctgacagacctacatcttcatgctcttcgagcgagcgcgccagcatcgacgctctcctctccaagctatgctccgcagatcccgaggaacaagagatcggctgccgcagagctccggctcctagcgaagcggaacgcgaaccacccgatcggccgcgtccgaggccggtgccatccccttgctac

SEQ ID NO: 9841 - DNA, 2458 bp, Zea mays
ctcgaagatctatcgtgcctcctccgttcttacgacacaaatatgcttcctccgatcttgatgaggcggcgacactaaggtccagcgtgatggtgcgggtctaacgagctcattgggccgatacaacatgatcaagtcctttgccatgtccagcgagcacaacagggcacaactatagctcactcccatgtcgttctaggctcggtaccatcatgtcgtgtttagaggggctcgtacgtgttgtactatgtcattcgattaagcatatgtagatgtcgtcgtgctactcttcaagacaaagcaacatgttagatcgacatgcataggcgtgcaaaatttgtgaaggatcaccatcgatgtcgcagaggataaggcaccgagaagtatccctatatctcttttgatcttaacgcctaattctctctagctcttcagcaatcagttacgtttgcggtaggcaaaaaactaccccttccatatcccccttgacccacaaaaaaaatcaactcctataaccacattagggcatgtcgatttcacccacagcggagaggattgaggggaattgaatcccttttatttaattttgactagaaagtgatttaatctcctccagtcactctcaattcactcctaaccgaacaagcatttaataaggtgtttggtttatagagactaatttttagtctctcaattttattctattttagtccctaaattgctaaatatgcccgtatttagcaatttagagactaaaatggaataaaatggtaggacaaaaaattagtccttaaacatctcctaagtcaaactatattaagtcaaactatattcagtagcttcaactttgtaaagaagacaataatatttatagcaccagataaatatattataaaaatgttttattacgtgcatacatacatataatgatatcaaatttaatgccacaaatatagtcccttttcttataataaatccaatagaaataatttaatttttagcgactttagaagtaaaagactactttccacgcgggaaccataaagtcacgtgcacgtttgacgcttggaccggccgcgcgtcaataacggaacccgtcttcgccgccgcgacggactctctcactagccggcactgcaccaatctctaccggaattcacacgctggaggactacccgcgaccgtgacgtcaggcccggcccccaacggaacaccagccgaaccccgaccgacgaccctggcgttgcacgggagacttggtgcggccggctggtgcgtcacgcgtgacatcgcggaaaattcatcagtgtttcagcatgcggagttgcggacgagggcgatagcttccgcgcggcccaagtaaccgagattctccgccgctctggcagtttcctagcctttttttttctctgctcgcgtgccaaaaagtctacggcccatgctccgctcaccgccctatatcgtgccggctataaattcggcgccgcgcgccccccccccaccccagctcgaaacgtcacgggtcacggagagaccgcgcagcagcagagctagttcgttcaggcagctttatttgagcagacatatataggagaagatccgaggagaaagatattagcttgctaagagatctcgccatggcgtccatgatgggaggagacttggtggaggcgtacgtgctcaagaacgcgtgcaaggagaagctccggcgcatggaggcggcggcggcggcggccgacgataagacgagcaagcagggccgcctcgcggagaagaaggtctcaggcacaggacgacgcctgcttgggctcctgaagaagaaggtgcacccaaaagcggccgcgtcgtcgtcgccacccgaaagcggcgctgaagaagcagcctcgtcttcttgattcagctccgtccaacaaattcgctgcccaccattgccggacgatagatcagccgtgtggtagacgaagacgaagcacgagcacgtgcgtggcctgctcgaaaccactcaaacagagacagagtgcgtgcttttctagctaggattgtgttgttgtgtactacttgtgtagccttcgttcgttcgttctttcgttctctgttcactcgcttgagatcgatcgtgttgtttcattggtaagtggtaactcagtgcaagttacgtgaaatggcaaaacgtattggccaagcgcccaagctatactatataatttacttcagctataatattgtcaaaaaaatgtgtgtaatggcccccttaattaaatgtttatcatatgaacgtccaagttatgcgtaacttaaattacgagtgattcagctttttgaattttgatggctgctccgagcacactgaaaatgggtcggcctgccttcagtctattgatcactactaaggagagcagccaccaaacaaggatggttaaatgacagcatatcatgtgtgtctatatatatatatata

SEQ ID NO: 9842 - DNA, 3573 bp, Zea mays
aaccaatagtggtcttggtctcctctttgtcatttaggtacacttgggaaacctacacacacattaatgctgtcgacctttgtaaattttgtcaccactgagatactaccttatttcttgcttgctattatgatccacctcagtctaggagtaggaaataatacatggagaaatggaaatgctacttattatttgggggctgcttgcatgcacacaaaatatactgaggtatttgcagtggtaaagccaaaatgattggtttttgtgtgccactactaggaaaaattggattgcttccaatgccactgttagaagggaaaaaagataacaaaaagaaaagacttctgctcctgagaaatgggtacaaaaatatacacctttgtaggcaaccagggcatgcaaaaacctaggttaaaaaaggaagaagccgtatgcatgctagatggtctatatcatggaggtggaagataggtagcataattctttttttcagaagcaatatatggttgctggtcaaatcgtgctagtgtatcatggaggtgggcaggactgctatcaagggaaaaccaggatccgctgaagaatggaactgaagtccttaaagaactgcgctgttctaccatctgcaggaagcagcccaggatcaagggatggctttgatcgcaaccagtgatgtggtggcctgaagtttcagatgtgccgataagcgaaagtaaacttgggctgcttgttggatgtagtaacatgttctagcaccttagtgatgttctgtttgtaatagctgcttttggctggatccattggtttggctggagtgtgtccggtcgcaattctgaccagtagttttgtatttctggttatcgtgctaggagtaatggaaacctgagtgctctattactatccagtttttatccctgtatcatttgcaacaaccgttggatgtttttacttgcaacaatctacataattttgttgctataagtaatgaaattcgagtctgccctagtgtggaaaaaaatcacgctgtcatttttgtatgctgtgttcatgccggccaaatatttttctgaacagattctttccattgccaatctctattagggttcttctttgagatgcaagatcagtgtttttattaactctaaagtttacctgcctgttggtgtgtctagttaggtcaaattcttgtcgtaatactatttgttggtctgttgttcactacatacgagtgtggttgttgtgttctaacattcatgctctgttatgattatgacatctgttttaaacttctttcaggattataactttcttgattaccatgagaaagttattgatggcttctatgacatctttggctcctctattgaatcctctacgcagggggaagatgccatcattagcagatctccaaacaggcataggggacctaggctttgaagtcattgtagtaaaccgagccattgatagtaccttgcaggagatggagcaagtggcacagtgcatcctgttggacttccctgttgccaatattgcactcttagtgcaaagaatagctgagcttgttacagataatatgggtggacctgtcaaagatgctaacgacatgctcacaaggtggctggagaagagtactgagctgagaacatcgctacaaacaagtttgttgcctattggttgcatcaagatagggttatcacgtcaccgtgccctacttttcaaggttctcttcttcggtcccttcctctttctcatgcatgcatttgcaagaaaactagctagcttattgtttcaactgagaagcacatacttagaaagtaatgtaattatgtcttgtacctctccatgcagatccttgccgatagtgttgggattccatgcaaacttgtcaaagggagcaattatactggtggtgatgacgacgatgctataaacataattaagatggacaatgaaaggtatcaatgtttaattattgtgctttgttcatacttcacagtataaatacttaagatacgtcaagttatgctatccatgtgctagccttatttactatattccaattaatttgttgctactctatgtttactaagtagttttttggttaaatttttctgtagggagtttttggttgatctgatggctgctcctggtgctcttattccagcagatatcttaagttggaaaggcaattcgttaaattctaatcgaaaactcggcctgaatcgaacagctggatcatcaagtactgttgatgctaatgtggatcctactgtattgccacttgaacctaaaggtggccaactgcctttgttcagcagtggtgattggatgtcagacattgattctggatatgaggcagcagaaattgcagcttctactcaaacctcttcgggtgtcacaccatatctgtgttctgctggaagtgtttttggcagttcatggatgctggttaatcatgaccaatcagatggaccatcaacttctgctggtacatcatcgcagcagaaagttgtacctcaaagcgagcatcagcggaatttaaaccgccttccagatctgcaggaaattccagagtcaaaatacctttttgctgaccttgttccttctggggataataagtccaagaaaacttcagtaccattcaaaggaccagatcataggaacaatgagttgcaaaagcgcagagagaacattgtccctaatgctggaagaccacagcagcggttagttatgaagaattggtctccttacaatgatgtttccaacaacaaacagtacaattatgtcgaggattcgtttgctcgtagaaatgttggtaataatgctgcatcatcatcatcccagatgccacgaccagccgtaagatctaaccttaattctggattgcataatgatgcatcatatcataattatgatagcattatggctggtacctctgccatgaagattacatctacagctgagaccgggaaggttcctgaaagggttctgcgtggtgatttggacaagggtcaaacaaattatagattggaggatcaacatgtcatagttcaaccaccacagggaagacttccatggggtaatcctgcagaaggaagagttccaatgaatagagttcagagtcaagcaaaacaacacttggaaaacatggatgcaaagcaagaccataagaaattgctccctgatccaaaaaaaaatctccccttgacagattcatggacacatcattgccttcaagaaacatggacatgaggtcacagaggcttgacttcgatgatgtctctgagtgcgaaattccttgggaagatcttgtgattggtgaaaggattggcttaggttcatatggagaggtttaccgtgctgactggaatggaaccgaagtagctgtaaaaaaattcttggatcaagatttttatggcgatgctctggatgagtttaggagtgaagttcgaattatgcgtcggctgcgccatccaaatattgttctctttatgggtgctgttacacgccctccgaacttatctattgtatctgaatatcttccaaggggaagcttgtataagatccttcacc

SEQ ID NO: 9843 - DNA, 2268 bp, Zea mays
  misc_feature (1513)..(1513): n is a, c, g, or t
ttttttttttttttttggacacagggcatcccttataaaataacaatagcgaaaaggccacaataaaaccaaccaatctcttgaacagcctaactaatagactagccattttgacgatgatatcctgttcttacagttccttacttaaactgcacaggtaagaaactaaacttttctgaatgaacatggtaacttgctttttttccataaccgtccaaactggaaaaacactttaactcatcatctccttaagaagtcaatagtgccacggccatgttaatggatggatcactgcatcttcatggtgatagcaatctgcccttcgcaagatctggagtgtagaagctcacatagggtgccatggcatatttggagcccgtcttgcctaccttcttcacctgctccgatctgagcatgactgcgaagacctccatatctatgctaatgaaaatggtatctgtgccctcttggaagccaatcacatcaagtgagtccagcggtttaagaatagggaagagcgtcctcaactttacgattctgccttgcacccattccgcaatgccgccaggaccaacctgccatgaccaaaggtggaggttgccatccttcactccggcgagtcccaaaccaccgtcctccacggtcacagcaatgccctctgttggctcaaacatatccggcgcattgatcacatgtaggctctgtccattgaggtcgtatttgacaatcattttgccttcctgtgcgctaaagtagagcgcgtcaccggcaaggaggctgggcctttgctcgacgtaggcatcaatttgaatggaggatgacgtagcccatacgccagtctctgatgagtaaacgctcgcccacctgagagtatcttcttcgtaggcgcctatgacgacgacgaggtatcggcccccgtggcagtcaagatggtcgcagccatccgcggcgcagagaacagctgcggtgcggcagaagtaagggtacccgggcacgggaattggtatgtgctgctggtcgcccgtgatgaggtcccagacgacgaggcgcgcgggcgcatgccgctcgaaagtttgtagcagcgcgcgcccgtggcggcactcaatgaaccacaaatcgaattggtcgaacgccggtgcagagaaggggaatgtggtggcggcgtcggcggcgacgacgaatcgagcacaggggcgttcgtcgtagatgttgtagaggaagccaagcaggggcggcgcgccgtggaatctgcggtagcggcggaggaagatgcggctagagaggagctcccgccaagccttgcagacaagggaggcgcgcacgaggcacgctgggtcatccggtgggaggcgaaggagaatctcggcggtggcgtcgtcgattagtagatccggcggcggagacgccatgccgtgcacgcggccgatcgaggattggatttggttttggtgcgcatttaagccgattggggaacgggaacagggagaagaggtaggaagcgacgagggcccangggccacctctccgccaggcaaccatcaattggcgtcgtttaagccttttagctaggagtatgtgataatatgaaaaagatcgatattacttccataccattaaatatttataaagctgccgtctaaattaatggtaacagcggttaacgtagaatgaaaatgatgtttttgtccctggttgtaaaatgcatcaaaacttctgtttttcctctatatcactgtgacatcataaaaaaacttcacttccactatgacagtaacataaaaaattttaggtgttgtttggttcacataattgtaacatcacggacagataacgtaaatcatgtttgtttaagtctaaccgtaatcacatatcacactagaaattgataccagtctattcacacgtataaccattgttactcgagtgtgaatcattaccgttgctatttacgaaaaccaaacattaacttagtttttctctgtaccattatgacagcttatgtgcacatgaaaattttaaatggatataataaatttataatgcatccaaaagttctgatattttaataaacaaaataagtatttaaatgaaatgtatttaggcataaaagagaggtccgaatttatcatccacatgcattgtaagtttgattataaaatcaagtttgaatacaaaagatgatcaaaataacccccttggtagtttatatattgtttggccatgtcgaccctcagtactacaaacccatgctataaaatgtaaacctat

SEQ ID NO: 9844 - DNA, 1439 bp, Zea mays
acccccacacgaagacagagagccctccgggcgtcgattccgccatactgccaccattactgccgccccctcaccgcctccgggcccaacgagcaagccagggaaggggagtcgaggcctcgcctatccacgccccccgcaccccccctgcgcgacatgtcaggggaccgctcgcccacggtagagcgccggcgggggatccggcgcctcctgctgcatccccgcggcgaggcctcatcgtcctcgcctccgcctgccggcgccggcgccggaggaggggaggcggaaggggttcgccacggcggcgctgcgcggcctgggctgcacgtcggcgtccgcgtcgcaggcgtacgcgcccggggaggccgcggcggcggcggccgtgcggtcgtcggcggactggcaaggtcggcggcgcaggagggggagggacaggaggaaggagcgtggcgggggcggaggaggaggagtaggcttcgtcaccggtgggatcggcgccgaggtgtggtgcgcacccggcatacccttcgcggcggaggcgtcctccgtgaactgcgtggtggcgcgccaccagatggtggggaggggcggccgcggcgccgaggggaacaggtcccacagagagaggccgtgcttgtcccggagggtgaccgtgcaggagcagatatcctcgtcattcatggactcgccgccgccgccgcacctcgatgcccccttattcggcgccgatctcatcccctccggccgcctccgccggatgcgcgggtggcgccactcccccggaggactcgaggaagagataaggatgtttcagacaagagtgttactgggaggaatgaacatgtatgatcgctaccaggattggcgccttgacgttgataacatgacatacgaggagttgctcgagcttggagacaaaattggatatgtcaacacagggttacgtgacgacgagattactcgcaaccttaggaagttcaagcacccatccttcagttccttacggttcgcaacagaaatggaaagaaaatgcagcatttgccaagaagaatttgaaacaaatgaagagatgggaaggctagactgtggccatagctaccatgtgtactgcatcaagcagtggctctcgcagaagaacatttgcccagtttgcaagactgccgtcagcaagaattgaaatccaaacttcagtcacgctgtctgtagatctgggtgaaaacagcaaattctgttgtcctgtacagcccgttatatatattattattgtatgaacacaatccattcgtttcatcttgcagaaagaaaatgccatgttttggtcatgttccatcaaactacagacttgataccctcgaaaaaaaaaaaaaaaaggaaaagtttttgcagtaacagataggatgaacctctttcataatgtatctaggctctatttagattta

SEQ ID NO: 9845 - DNA, 491 bp, Zea mays
atgatgatgatgccgacggcggcgtcgctgatggacgatcttgtcgaggagttcctcatccgcctcccgcccgacgaccccgcgagcctcgtcaacgcctccctcgtctgcaagcggtggagccgcctcatcgctggccgcgtcttccgccgcaagttccgcaagatccaccgcgccaagctgctgcacatggcccgggggcaggtctataggcagcggcggcgacggcggcagcggcagtgatggagcggcccgtccggtccgaccgtcgattggctgcttgctctgcatcttctggcttctgcaaccaggaagctgactgaacgctcgctattgccaataattaattagtactattttcttcgtttcttttttttatttgtcgtatacgaactaaaacagagttagtgataatgataatgataatttgtagcagtgcaaagtgccaaaaaaaaaaaaaaaaaaaaaaaaaactagttctagatcgcgaa

SEQ ID NO: 9846 - DNA, 2510 bp, Zea mays
cccacgcgtccgcccacgcgtccgcccacgcgtccgcccacgcgtccggttgtgtctgatatgatgtcccccaagtttgctgccgagctgaagaaaaccatttatgacaacatgacatttgcgcctaaacattacggaggaaggtggaacatccttgaggaccatgggaccagccacctgtccatcgtcgacagcgagcgaaacgcggtgtcgatgacgagcaccgtgaacgcgtacttcgggtcactgatcctttccccgcgcacgggcgtcctgctcaacaacgagatggatgacttctccatgccagcgaacgcgtccgagaattctccaccgccagcacctgccaacttcgtcagccccttgaaacggcctctctcttccatgactccgaccgtggttgtcaaggacgggaagctgatggctgcagtcggtgccagtggtggcggcatgatccccgccggaacgatcgaggtgttcatcaaccatttcgtcaagaacatggacccgttggcttcggtcatggcgccaagggtgtatcaccaggtttggtatctgcataaaaactccgatccatccatcttaggtgtcaccctgagactgggagacatgtcacggacgggctagatcgatggtctttctcctgagcatggttttggttgccatgtccgcagctgatcccaaacgaggtcaggtacgagaactggacgacggtgaccggcgaccacttcgagctcgacgccgccacgagggccgacctgcacaggagaggccacgtcctgacgccgatagctggagggaccataagccagcttgtggtgcacaacgtcgggcgccaaggcgacctcaccgccgttagcgaccccagaaaaggcggtgtcccggccggttactgagcaggatcggaattccaagcacggttcattagtcccctgctgatccgtgtgtgatgtgcggcgaagccaggaattatatggaatggaatatacaagagacaattcattatttgacactggtaaagtttttggtttattttcttgagcctcaaaatataattcttccctaagactaaggctaagggcatgtttgtttatctcctaaattatataaattggattacggtggaagagtagaactagaagagtaaaatatcactttgaaaccataaataagctaaaataagctagcattgaatagcttatttcagtttttttttatctcaaaatgatttgttacacttctatccttttatcataatctagatttttttatctcaaactgatatgttaacttctatctttttatcataatctagtttatataatttagaatgaaaacaaacggagccaactcccgtggctgccgcatgtcaatccgcatcctttgcgatgcgaatttgtgcagtagaaaaagtgaccccctcttgcagttcgcacatgggcatacggaatgtctctcgcagaggagagagaacaaacacatgattttgcacgatcgagtggctgaacgcacattttgcacgaccacatccacattctactggaagcgtgaatagtatgccggtgtcatacaaaatgcgtccacagctgcttgttggtgatactctaggatgactcaacctcagtgcgagttatagggtggtatcgtaccagttagatgacatcccatcctagatggggtctagaatcgatgatggtgatcttgtgggcacatgtgtatatgctctaagagttgatgatctatatgtatagttgtatacacgatcatggacattcttatgcttctcactttagcttggattggatacggggtgtttgatttctagggactaatttttagtctttttattttattccattctagtacctaaattactaaatagttttagtttccgtatttgacaatttagggactaaaatgaaataaaatggagggactaaaaattagtttctagaaaccaaacaccccataagtatcactgccatctttgtcatgcttcagaatgtgttgtaatgaatgtttgggttctatcattattaatccaacatttttgtagaatttacttttcattgtgatttacatttttgtctctccctgaatggacaatgattattttgtgaatgctgtgtcaaggagcaaagaatagtgttgttgtaatggtacccggccaatcagactgctggatgaactggccagtagcacataatgccaaaataaagaggcgacatgattttctcaaactttagatcatttatcctctatttggaattgcattacctgatagattgaattggactgcattattctagtaggatagcctttattggcacatttctgttttcgtgattcaattatctccaactccaagcattgaagttaacatttttttccctatttttaaaggtaatataagggcataggatcgtgtatataacaattagttcattagcgataaggaaattaccttattgggatcttttgctgcagctcgggcgatctgccagccaggg

SEQ ID NO: 9847 - DNA, 841 bp, Zea mays
gcacgagcagccacctgtccatcgtcgacagcgagcgaaacgcggtgtcgatgacgagcaccgtgaacgcgtacttcgggtcactgatcctttccccgcgcacgggcgtcctgctcacccccacgcgtccggacttctccatgccagcgaacgcgtccgagaattctccaccgccggcacctgccaacttcgtcagccccttgaaacggcctctctcttccatggctccgaccgtggttgtcaaggacgggaagctggtggctgcagtcggtgccagtggtggcggcatgatccccgccggaacgatcgaggtgttcatcaaccatttcgtcaagaacatggacccgttggcttcggtcatggcgccaagggtgtatcaccagctgatcccaaacgaggtcaggtacgagaactggacgacggtgaccggcgaccacttcgagctcgacgccgccacgagggccgacctgcacaggagaggccacgtcctgacgccgatagctggagggaccataagccagcttgtggtgcacaacgtcgggcgccaaggcgacctcaccgccgttagcgaccccagaaaaggcggtgtcccggccggttactgagcaggatcggaattccaagcacggttcattagtcccctgctgatccgtgtgtgatgtgcggcgaagccaggaattatatggaatggaatatacaagagacaattcattatttgacactggtaaagtttttggtttattttcttgagcctcaaaatataattcttccctacgactaaggctaagggcacgtttgttctccttctaaaaaaaaataaaaaaaaaaggggcggccgttt

SEQ ID NO: 9848 - DNA, 3248 bp, Zea mays
cgaattcgcccttgtaggtatcataagaaattggaaaatttagatatgtaccattaaaagattacaactttagatatatatatcattactatctcgcttatacgtggggttcacatgagttaatgtgaagtccatgaagttgatatatatctaaagttgtaatcttttaatggtatagatccaattattcctaagaaatttgtgtgtttcagatgctaccgggatctgtttccctaacaagtgtccatagcaagcaaactagcaaggtttatgtgtgggcatattttggtcatttgataagcagggattatttggtgaagtcttgagctctctacatgactcacagaagttagacagcaaaccaaaaaaaacatgctctaataaactccggcaacccattttctatattttctgctcttcgaaaccaccctcgatctccacttactagactataaatgcaatacattttcttatgattttttttactctagagggtctgatggaaacatgagattgatacacacgtccatgcgcaggctggcgtcgctgtagccagacagatacgataattttgagcgtataagtggatgcatgttaataccatcaaaatagcctattttgcttccacccatgcaggttgtgactctcacatacaatcaaccaaacataatctcaaataaagtcaacgcatacgatgatctaagatgagatgatgcgggtaaccaatcaggcgaatagagaacacttataagacttagatatagagaatgaaacatgcagagacttttgaaatggatctacaataaaaaacctaagctcaaaaagaaccaaaattttcatttcagttattttctaaaaaaatatttatttttgtatttacgaagaattttattttaacatcaacctaagagattaatataacaagctataatgttgatataacccatctcgatctcatagaatatgcatgaggcacagtccctagcccctatgatacctaatctagtcgactttcagtgtttgctagaccgacttttttggagtttgaatcgatttgttttcactgcttgaaatttttttattttaattgttgactaagctttttgccccttagtaacatttttcctgtgtaaacatctagtagtaggcttctttggtttctgctcacccgccgccaacgacagcgggagagggatttttcaggtgcggtcatcatcacagttcaggtgctgatcgacatatgttcaaattcgggaatgtgtggtgcggagaaattgcgactgcgtcctgatgtcaggttcatctgggttacagagcttgggcgtggtgattgttgttgacacccacctgaagtcatccaggctgaccaggcatggcttttttggcctcgacggccaccaaataccgcacctaatccgctaatccctttgaaaatgagcgcccgtacgtggaaaaccgaaccgtagacgccaccgtgttgcaaactggttcggctgtttccaggcaattcaatcaccaaacagtacctgcacaaagatgtcgtgctgcgaccaggtcaacgttctcgtcgcgttagagatagccgccacggcacgagctcgacgcggaccatcttctcactgctaagcttagcttatataaacgcaaacgggccaccgccagcctcgtattacgtactcctgcatagcgatagcatagcttagcttgcttccccaatgccaatgtcatcgacagcacaaatggcttccctcgccgttctcatcatttccctcgtctttgcggcgcttgcctccgacgccgccgcaggcgtccgcgtcgagctcacgcgcgtccacgccgaccccagcgtgaccgcgtcccagttcgtccgcggcgccctgcgccgcgacatgcaccggcacaacgccaggaagctagccctagccgcgtcgtccggcgccacggtgtccgcgccgacccagaactcgcccaccgccggggagtacctgatggcgctggccatcggcacgccgccgctgccgtaccaggccatcgccgacacgggcagcgacctcatctggacgcagtgcgcgccctgcacctcccagtgcttccgccagccgacgccgctgtacaacccgtccagctccaccacgttcgccgtgctcccgtgcaacagctcgctgagcgtatgcgcggcggcgctggccgggaccgggacggccccgccgccggggtgcgcgtgcacgtacaacgtcacgtacggcagcgggtggacgagtgtctttcaggggtccgagaccttcacgttcgggtccacgccggccggtcagtcccgcgtccctggcatcgccttcggctgcagcaccgccagcagcggcttcaacgcctcgtccgcgtccggcctcgtcgggctgggcagggggaggctgtcgctcgtctcccagctcggcgtccccaagttctcctactgcctcacgccgtaccaggacaccaacagcacgagcacgctcctcctcgggccgtcggcgtcgctcaacggcaccgccggcgtcagctccacgcctttcgtcgccagcccttccactgcgcccatgaacaccttctactatctcaacctgaccggcatatccctcggcacgacggcactgtccatcccgcccgacgccttcttgctcaacgcggacggcaccggcgggctcatcatcgactctggcaccaccatcacattactgggcaacacggcgtaccagcaggtccgggcagcggtcgtctccctggtgacgctgcccaccacagacgggtcggcagccacggggctcgacctgtgcttcatgctgccctcctcaacgtcggcgccgccggccatgccgagcatgacgctccacttcaacggcgcggacatggtgctcccggcggacagctacatgatgtcggacgactccggcttgtggtgcctggccatgcagaaccagaccgacggcgaggtaaacattctcggcaactaccagcagcaaaacatgcacatcctctacgacattgggcaggagacattgtcgtttgctccggccaaatgcagcgcgctctgatcagagctttacagaactgaaaatatgtgcgcgcaattgcataaggatcgtgatttttttaactatatattatgtaaaaatgtcgtgttgcttgggttgggttgtaaagcaggagatatttttccttcccggatcaaaaaaaaaaattctttagccccaaggtcttctcggacgcgtggg

SEQ ID NO: 9849 - DNA, 2823 bp, Zea mays
  misc_feature (2271)..(2271): n is a, c, g, or t
cttcgtattatacaagatttttctttaaaacacaccaaaagaacgatgttatttaaataaaatagatatgtttctttagatattatattacaatatatattactgtaacttgcagattgttattaatgatttttaataaaaatatagattacgctgttttagatttggcacagagtctcaaatttctctggtccaaccttgcttgcacctaacgggaccaagatagtgaaaaagaggatttggaactaacggatcaaaaaatttgcttcaatgattacatctactggctgtttgtataatagttgttgcagtatttcaggtgcggccataattcacgtcctcatcgactgtacgttcaaattcgggaatggtggagaattgcgtctgcgtcctgatgctgtccctggttggttcatctacacgtgtacagagctttcttcttccaggacggcgtccgtcccggcttgccgtggtcggttgtgttgtgaacgcacacggcacacctgagtactttgcgaccactcgttcaggcatgacctttttggcgtccatgcatggagtccaaataccacacctaatcggctaatccctttgaaattcgacgcccatgaaaccgtagacgccaccgtgttgatgttgagatgagagtgacaacgatggcaggacaacataagccgggtcgcaaaacttcttcggctgtttccaggcaattcgttcaccaaataataccggccgtgtgctccgaccaggtcaacatcaccatcgtgttagagagagctagccgccacgacgcagagcatgatctcactagcttatataaacgcgagcgatccagcgccattctggtatactcctgcggcttccagcttgctttccatcgttcgatgtcaccgccgacgcagatggcttccctcgccgttctcgtttgcctcgtctgcgcagcgctcgcctccgatgcggcggccgtccgcgtggagctcacgcgcgtccacgccgaccccagcgtgaccgcgtcccagttcgtccgcgccgccctgcaccgcgacatgcaccggcacaacgccaggaagctagccgcgtcgtcgtctgacggcacggtgtccgcgccggtctcgcccaccaccgtccccggggagttcctgatgacgctggccatcggcacgccgccgctgccgttcccggccatcgccgacacgggcagcgacctcatctggacgcagtgcgcgccctgcagccgccagtgcttccagcagccgacgccgctgtacaacccgtccagctccaccacgttcagcgcgctcccgtgcaacagctcgctgggcctatgcgcgccggcgtgcgcgtgcatgtacaacatgacgtacggcagcgggtggacgtacgtcttccaggggaccgagacgttcacgttcgggtcgtccacgccggcggatcaggtccgcgtccccggcatcgcgttcggatgcagcaacgcgagcagcggcttcaacgcctcgtccgcgtccggcctcgtcgggctgggcagggggagcctgtcgctcgtctcccagctcggcgcccccaagttctcctactgcctcacgccgtaccaggacaccaacagcacgagcacgctcctcctcgggccgtcggcgtcgctcaacgataccggcgtcgtcagctccacgcctttcgtcgccagcccttccagcatctactactacctcaacctgaccggcatatccctcggcacgactgcactgcccatccctcccaacgccttctcgctcaaggcggacggcaccggcgggctcatcatcgactctggcaccaccatcacaatgctgggaaacacggcgtaccagcaggtccgcgcagcggtcctctccctggtgacgctgcccacgacagacggatcggcagccacggggctcgacctgtgcttcgagctgccgtcctcaacatcggcgccgccgtccatgccgagcatgacgctccacttcgacggcgcagacatggtgctcccggcggacaactatatgatgtcactctcggacccggactcggactccagcttgtggtgcctggccatgcagaaccagaccgacactgacggcgtggtagtaagcattctcggcaactaccagcagcaaaacatgcacatcctctacgacgttgggaaggagacattgtcgtttgctccggccaagtgcaccacgctgtgatcagaaatctattccaattcaaatgctgaaaaaatcgaactagactacgacaatgaacaggtaagcnccagacttgtcgatcgggcagtcgcagtgctacttcccttgtgacagtctagctgtactttagtttgatgttttttttttgttttagaaaaatgattttttgggacgttttacctttgttgtgttgctagggttgtgatgtaaagcaggaaatatttaaacttatcagttactgtgtatgttatttcatccatattcatattttccctctctctacagagcacttacgtgtgcattattcatcaagtatttagttcagccttatttctgcaaatatttgttttcaagttcaagttcaaactattgtgcatattgtgtttatcaaggctctgtagaggtttggaacatgatcctatcttaggccaatctcagggccggccctgagggtatgcgaccgatcagggccccatttgtccagcttatgtccaaatacatatacattatagataatttctattcttgttcatttgttacatctcgcggattttctggcaatcatcgcttcgaggtacgcgcaataatctgtttgatgacgaatactaatattgattgg

SEQ ID NO: 9850 - DNA, 5791 bp, Zea mays
  misc_feature (5413)..(5413): n is a, c, g, or t
  misc_feature (5429)..(5431): n is a, c, g, or t
  misc_feature (5727)..(5727): n is a, c, g, or t
acgcgccgacgcgcggacgctcccgtccccatcgcgacccgtgcgtcgggtccacgctgaaccctttcaccggggcggcgaaagatctcagccgcgacgccgacgggctcgagcgccggtgagcgctcgcgcacccgggccaataaactggcaccggctcctcctcgcgtcgcagagcctagcctcgggatgacgtggcgtaccacaacaccaccacacctcactcagccctgcgggtctccgaccaaccatttctagaagcctccaaaccctagcgcaggaggaagaggagttaggaggagctccagggatggcgaaggcgaggaagcagaagggtgacggtgccagtacgggaggaggcgccaccgtgctccaccagaagctctgcctctccatcgacatggagaaccagctgatctacgggtacactgagataaaagttctagctgaaaacaacagatttgctctacatgctgacaatatgacgattcagagcatttgatggatggtgcaactgttgagtttgactattcccctcattggaaaaatgaaagtgatcaaccgaattggtcttcagtatcatgtttgaagactgctgctgatgctgcatgttcaatgtatactttgtctctaaatcgagaagctacaccaaatcttattgtgtcatctgagagatcagtcaagtcaatgactgaacagcagttagatgaaaacagtgaaaagcatgaagaaaatagtggaaggcttgaagaacatggtggaaatcctgttcaaacttcctatgatcaaattgttaatggctgcagtggaagagggaatagaaaattctgcagtggaagaaggaaaggaaaaggaaaatgataaggaaaaagaagaggaaaatggaaatgagaagagcaaggaaactggaaatgagactgaatatgaaaaggtgaagaacataaaactggttcacatagattatattttggagaaggctgaaactggcgttcagttcgttggcaatgtcatgcgtagcagtagtcagacaaggcgggcacactgttggtttccttgtgttgatagtgccacagaacgctgtccatttgacctagaatttacagttagcatggatttcattgctgtcagcaatggtgacttgctttaccaggtatgcgttcagtcttgatcaagagatctggaggaaaaatattaatttccttgtttttgaagaactaacttttgtgaagtaacaaggaagctcttttagctttaatacacttggtattacagttcatttcttttttgtgcatgttagttatgttctgtttcctgatcttagaaggtctctagtaaggaagatccttcaaaaaaacttatgtgtacaaattgaacactccagttagtccacagtggatatccttggttgttggctcacttgaagttcttcctgacagaatcacagaaatgacataaatgtctcacacatatgtttattccctgctttggcaaagcttcagaacactattgcatttttccacaatgcatacaggtgctgatcaatctttttttttctgtgaaaagtgcttagattggtgttgattttattagtatctcaataagcttatttttaattgatttctgaaatttgcatttcttttgcagctgttatgaagactatctttctgcaccatttcccttaggtttatacaagcacatttttcttccatctgaaatgacaatattaccagcaagcttaggagcctccacatgcatcctcagttctgatatcttgcatgatgagaaagttatatagatcaggtgcgtttgtttctcttattttactaccctgtcccctctgatctagaccaatgatttgacaccatactttttaatgagatccgaatgcgtggctgctatagcatgtgcttatcaattgtgcttattctttattaaactatttttcatatcagctgttgttttgaagccctcctttcactgagagcatttagtgtcagtaagcaatccatgaatgcataatttctgctccagtatttgtgttttaactaagttagattctggtttagatgcctatatgacactacattcttgttaagttgatcatttaattagtttggtacctccagcaaatactgtaaatatgtttatggaatatgttaaatacttctgtatgtttgcttgccttatattttgtattttttctgtatagggctttgtaaacctgtcatcctttggataggagtgcatgaaaatctgcaatccatgtgtctgaatcatgacctgctattacttttactttatcttcctaagcattaaccttgcttctttgtatccccttaactggtggcttgataacactttgtattatgcattaaccttgcttctttgtatccccttaattagtggctcttggtaatgctttgtacacctgcattacattatagtcaagtattatgtttcataccttgcagtctgcactaacttgtaaaatagttcagataattggcacaagaacgaaactggcttatgcccttgcaaagcaatggtttggaatatacacaagtgcagaggagtccagtgacggctaactgctcagtatgtgaatctgatgttagtggtgcaactgctttgagctctactgctgcttcaagtgatttatatggaactcaagcaatcggttcatatgggtctcttcgattcattgaccagctgtagctgtttccaaatgttggagaaagcagatgggaccagactcattttcggaaggtattttcatctttgatacggctattttctcatagttatttttttgtctaaataattgcaacactttggctaagcaactaaatcgaatgtggagatgtacaagactattcatgatatgagttactgtgtttcagatactaatcatccttttttttatctatatccatagttgaaaattctagataggtatctgggtaggagtaaagtacctattggctgttttttttgtacgcggttatttcttaattgaagattatgtatatatagattgcttctgatagatttcaattgttcacaatttcagattttgcaggtgatagtggctccaagtcgtgcataaaatctagtaagatgtgacctatatttattgttagatgcattccatcttatcagtttatgcttggtaggagcaaaatggtttgatatgattagttatgaacatacatggtgaccttcatggaaataagctagtctgttcaagatagtttttttaggttaactagactgaatagttttgtagacctgtttgctggtctaatgctaatgctttattcattcagtgccgaaatttacagtggtgacttgtttgcatgatgtttagacaatttgtctgataagtggatcctgtcctgaccaaatgtctttttgtcaaagtggatcgtgtgatcctgtccttgacttgtggtttctattgagttccaactctagcctaccccaacttgtttgggactaaaagactttgttgttgttgttgttgagtgaattttgaggcttgcttctttcacgtacaaaaagtgaaataagacctaaatatttttttgggttcttattgatcatgaatttcattataaggcattatgattgtacacaaaatgagatcaagcttttctgcagggcatgagcttcctagcctctcttctcaagcaaattgatcggttcttgcaatttgacaactttatgcctggttataatggggtcttgactgtcagctgcattcgtacccttgtacgaatagcaaagaaggtgccatcttttgtatgccttgatcacatttttgaattggttgcccctttccgcaacatggacaaaccatggaaagttcgaattgaagctagcaggattcttattgatcttgagttacaccataaaggactcgatgcagctcttttgttgttcttgaaatatgtggacgaagaaaagtctttgcgaggttggattgctagagtactttttgatggttttgtatgctttgctatcttttgacatggaagctgttgaaggagcgacaaagttggctgttcatgtcttgcgtatatgtcaaacaagtattgttcctcacgccaatgatcaaataaattttggcaactctagttggtcttcttcatctgcttgctggcacaaaggcatacaataacatatttcttcgtcatcaagtgttctgcatattgcaagttgctgctggaaggtccccaacgttatttggtgttccaaaggtcctcacaccccctctggtggtcaacgacatcttcagtgatcagcacactaaagatgattcctcaattcctcaaccatcatagtctcaggaaccttccactagcactcctagtgtccgggaggtcttaccgacctctggacccactcaagatgctgataatatatcttactgcagtgaaagaaggaatgtggtcaaaattagggtgaagcttactgcatcttccagtaaagcatctgatgctgaccatagaggccattctgatggcgcaagaaatgaaaatgaaccgggtcaatgcagctcaatgtcaatggatgcccccatggctggagcagcaaatgaaccattaaatgtaagcaatcataacattgaggaacaaaactcatgtcacgaccttggatcaaggatgtcggcaagtgttagcaatgctaaactaatggacagacatgatatttccaaggagctacagtgcactgctgattccaggctggatactgttcccaaggatcagttctgtcctgccattaatccgccggaagttttagacaaacctggcagtcagcttgaaggtgtctccaactatgatgtaaaccaagctccagagactgaacggagtggaaacagaagagagaaaaaaacaagaaagataaaaagctgaaacgtgacgaaaaactagataaaaaatatgacccagagtatctagagaaaagctccttaataagaaggaaaagaaagagttggccagaaagcagctagaaggtgaagagctacccctgaacagcggagagcagtgaacccttcaggttcacaggaagttttgccttcaaggccaccagctccagttctaagtgttgaaacacctgttcgaatctctgaaccccaggtatcaagcaaggaaacagctgtagatactgcacgtgcagcagccaaaccaaggataaagatcagagtcaagcccttggtaagaaaatctgaagggaattaaaaaagattgtagaattgtggccagtctgccatcatttgtaaggattactgtacagcaggaaaaatgcgggtttagttattttgtgaatggctgatgtatcctgtaaaaaaacattgctctgctctagtaatttctggggtaatcgaaatctgagttctagggtaaagaanaaaaaacaaacaacannnaaaaccacaaacgaacaaaaaaaaaaaataaaactcgagggggggccccggtaccccatttcccccaataggggggccgaatttaaaattccccggggcccgccgtttttaaaacaccctttggggtcttggaaaaaaacacccgggggggggtccccccccattattttttcccctctcgggggaaaaccacaccccccctctttttctttttgagggggggggggggaataaaaaaaaaaaacacaaccgaaggggagggggggggggagttcctctctattacaaatttctgnccgggtgggggggggggggggaggtaatttatctacttcttctttttttatccccccccccctt

SEQ ID NO: 9851 - DNA, 4096 bp, Zea mays
  misc_feature (728)..(728): n is a, c, g, or t
ccgggtccgagctcgaattccgttgctgtcgccgtgctgtcgaactgatcaacctaattggtcttcaatatcatgtttgaacactgttgctgatgctgcatgttcaacatatacttcgtctctaaatcgagaagctacaccaaatcttattgtgtcatctgagagatcaatcaagtcaatgattgagcagcagttagatgaaaacagtgaaaaatatgaagaaaatagtggaaggcttgaaaaacatggtggaaagaccatccaaacttcctatgatcaaattgttaatggctgcaatggttctgcagtggaagagggaatagaaaattctgcagtggaagaagggaaaaaaaaggaaaaggaaaaagagaaggaagagaaaaatggaaatgagaagagcaaggaaaatggaaatgagactgaaaatgaaaaggtgaagaacataaaactggttcacatagattatattttggagaaggctgaaactggcattcactttgttggcaatgtcatgcatagcagtaatcagataaggcgggcacactgttggtttccttgtgttgatactgccacacaacgctgtccatttgacttagaatttacagtcagcacagatttcatcgctgtcagcaacggtgacttgctttaccaggtcttaagtaaggaagatccttcaaaaaaaacctatgtgtataaattgaacactccagttagtgcacagtggatantccttggttgttggtccacttgaaattctccttgacagaaatgacataaatgtgtcacacatctgtttatctcctgccttgtcaaagcttcagaacactattgcatttttccacgatgcatacagctgttatgaagactatcttgctgcaccgtttcccttaggtttatacaagcagatttttcttccatctgaaatgacagtattaccggcaagcttaggagcctctatgtgcatcttcagttctgatatcttgcatgatgagaaggttatagatctggctaaccacacagtatgtgagtctgatgttagtggtgcaactgctttgagctctactgctgcttcaagtgatttatatggaactcaaacaatcggttcatatgggaaagttcgttcattgaaagctgtagctgttcttcaaatgttggagaagcagatggggccagactcgtttcggaagattttgcaggtgatcggggctccaaatcgtgcctctagaacacttagtactaaagagttcaggcaccttgcaaataaggtcggtaaccttgaacgtccattcctgaaagaattctttccacggtggattgaatcttgtggatgtccagttatgagggtgggaatctcatatagcaaaaaacggaatatggttgaattagccgtttcaaggggttgtacaggaaaagctacacctgatcctgatagtcacaccaacggtgacactagagaaggcgatgctcctggatggccaggaatgatgagtgtacgtgttcatgagaccgatggggcatatgatcatccagttctgccaatggctggtgaagctttgcaggtggtggaaatacagtgtcattccaaactagcagcaaaacgtgtttggaaatcgaaaaagaacacaaaacttgatggttctgatgacaacatagatacctctaatcaagagaatcgcacaagcatggattcacctttgttgtggattagagtagacccggagatggaatatcttgctgagatccattttcaccagccagttcagatgtggatcaatcagttggagaaagacaaagatgttatatctcaatctcaggcaatatctgccttggagaaattacctcagctgtcgttgcccgcgcgtccggccctcaataatttcctaaatgacacaaaggccttctggagagttagaattgaagcagcatatgcattagctgttacatcatctgaggcaactgatttagctgggttgcttcatctggttaagttctataaaagccgccgctttgattcagatattggaatgcctaggccgaacgacttccatgatgtcccagagtacttcgttcttgaggcaatcccccatgcagtagctcttgttagatcatcggacaagaatagccccaaaggagccattgagtttattcttcagctactgaagtacaatgataacaacgggaatgtttactctgatgtgtactggctatctgcaatggtcctggcaataggcgaactggaatttggccagcagggcacgggcttccttccctcccttctcaagcgaatcgatcggctcttgcaatttgacaactttatgcctggttataatggtgtcttgactgtcagttgcattcgtacccttgcacgaatagcaaggaggttgtcatcttctgtatcccttgatcccatacgtgaattgattgcccctttccgcgacatggacaagccatggaaagttcgaattgaagctagcatggttcttattgatcttgagttacaccataaaggacttgatgctgctcttttgttgttcttgaaatatgtggatgaagaaaagtctttgcgaggagcgacaaagctggctgttcatatcttgcgtatatgtcaagcaaatattgttccttccgccaatgatcaaataaatttgacaactctaattggtcttctccatctgcttgctggcgcaccgccaggccggcccggatttcttcgtcatcatgtgttctgcatattgcaagttgctgctggaaggtccccaacattatttggtgttccaaaggtcgtcacaccccctcttgtggtcaaggacatctgtagtgatcagcacactaaagctgattcctcgattcctcaaccatcaaagcctcaggaaccttccactagcactcctagtgtccgggaggtcttacctacctctggccccactaaagatgctgataatatatctaactgcagcgaacgaaggaatgtggtcaaaattagggtgaagcttactgcgtcttccagtaaagcatctgatgctgaccacagaggccattttcatggtggaagaaatgaaaatgaaccgggtccatgtagctcaatgtcagtggatgcccctatggttgggactgcaaatgaaccattaaatgtaagcaatcataacattgaggaacagaactcatgtcatgaccgtgaatcaaggatgtcggcaagcgttagcactgttaagctattggacaggcatgatatttctagggagctacagtgtactgctgattcaaggttggatgctcttcccaagaaccagttctctcctgccattaatctgccagaagctttagacaagcctggcagtcagcttgaaggtgtctccaccagctatgaaggaaaccaagctccagaatctgtgaacggagtggaaacgaaagagagaaagaaaaaagacaagaaagataaaaagcggaaacgtgatgaaaaacgattaaagaaagatgacccagagtatctagagaaaaagcgacttaagaaggagaagaaaatggagaaagagttggcaagaaagcagctagaaggtgaaggaagagctacccctgagcagccgaaaacagtgaaaccttcaggttcactggaagttttgcctgcaaggccaccagctccagtgctaagtgctgaaccagctgctgttcggagctctgaacctcaggtatcaagcaaggaaacaactgtagatactgcacgtacagcagccaaaccaaggataaagatcaaagtcaagcctttggtaagaaaacctgaagggaattaaaaaggatagtagaattgtgtccaggctgccaccatttgtaaggattactgtacagcaggaaaaaattggggtatgttgtaggttgtaccacgagtagccagtttttttcgtgaatggctgatgtatccggtaaaaaaaacattgctatgccctactaatttctggggtaatggaaatctgttctagggtagtccatgttttgtgctgctgttgctttagtatctcagcccatgttaaaaaaaaaaaaaaaaaaaaaaaaaaaaaaaaaaaaaaaaaaaaaaaaaaactcgaggggggggcccgggtac

SEQ ID NO: 9852 - DNA, 1098 bp, Zea mays
ctcgaggccggccgcgcgaacacaaacccaaagcagagagggagagaggaccgagggagagagaggagagagagcgatcgagagatgaggagggagcttgcctcccccttagctactgccgccgctgccacggccggtgcctccttctcggctgccgcctcgctccggggctggtgggacgatgtcaacgagtcgccccagtggcaagacggggccttcttctccctcgccgccgcctacgccctcgtctccgccgtcgcactgattcagctcgtcaggatccagcgccgggtgcccgagttcggatggaccacgcagaaagtcttccacctcatgaacttccttgtcaatggggtccgtgctctggtgttcggcttccatgtccatgtcttcctccttcgcacaaaagtatacaagttggtgttgctagatctccccggcttgttgtttttctccacctacaccttgctcgtgctcttctgggcagaaatataccatcaggctaggagtctcccaacggacaagctaaggcctgcatacattgccgttaacgccatcatatacgttgttcagctttgcatatggatatacctcggaataaatgataatgcccgcggttgagctggccagcaaaatattcattgtagctgtctcctttgttgcgcttcttgggttttcagtatatggtggaaggttgtttgtcttgctgagacgtttccctattgaatctaaggggcggcaaaagaagctgtatgagggtgggaccgtgacagcaatttgtgttacctgctttctgataagatgtgttgtggtcgcgctatctgcatttgatgctgatgtatctctcgaggttttggatcatcagtaataaattgctactattatattttagaaccgatactatcttatgtaatgggtgtcttgcgtacttctttatcatacttccgagcagctatcagggctttaccaacatattatcatagggaggtgactgtaactccagatgctaaatgggcctaactttaatattcttgttccgctaaaatctgaattcgcacgaattgacaggctgccacaagctatgatttcaatcaatgc

SEQ ID NO: 9853 - DNA, 2466 bp, Zea mays
  misc_feature (273)..(273): n is a, c, g, or t
  misc_feature (1250)..(1250): n is a, c, g, or t
  misc_feature (2266)..(2266): n is a, c, g, or t
cgtgtgatggtttgacctgtctcatacaaacaaacatagcggacacagtagactcatttgtaccgcacgggacgggatgctgtgtggtattttgagaagactatgagaaaacatcccacatgtatatgtatataatcgtgcagtgtttttatttctgatagttgatcctcatgtgcactgatggcaggtcgcgctatctgcatttgatgctgatgtatctctcgaggttttggaccatccagtcctggatttcttctattatatggtaaaggnactaacaccgccttgtgctccacttatatagcatcttttcatccccaaggttaatgtttcttacgatcgctctctattatatgtttgcggagatactcccttctgcgctggttctcttcgtccttcggaagcttcctcccaagcgggtatcggcgcaataccaccctattaactagggagttctttgtttttatgatgttacatgctaagaactccggataagctggaactgctgaaaacctacatccggttgtattgctgtaatattttatggaagcatcccagggttggcaagatgcatcatcaccatcatgctctatgagaaaagagttttgagtggtgctaatgagtttgtgctactgctagccagagcatcacatgacaaaaacagcagagtaccataccattatttgaattgcatgtgcattcttgacgcggacaaggccaatgatttatcgccttgttggtcccagtgacttctatggagtacttgtgtggtgcggcctggtattcctgaggactagatctgaaactgaaaatgcgttatatcagctatcggtcgtcctaatatcaatttttgttaggcttttatctgtttcagcgttccagagtagagcctttagcctaatgttgtcaggatctgtaattcgaggagcagtgttggtaggattattattgtagttttggtgctggattattctggtaaatcgatcgatcttccatgctttatttgtagttttggtccttgttactcctttgctgtagttcatcagtgtctgccagatgaattgaagcaactgacgatatagatgccgtgccggccgacgatgagcagggttgtggagatgctagagaaaacaaccgccgcggatctggagctaccgccagggtgttgatggcctgacaagatgatgggccacttttttttgacaagaggatcaccccatttctattatatcataacaaaaatacaaaantttttctgatgcacacatgacaaccagtgacaatacctggtctgatgagagaatctaattcagattacatgactaaaccgcgcaaaatgaaaggatggggcaagggatagttttctacaggatatatggtacataggcagtacaagagagcaacatgcaacaaggttcgatgaccacaaaagatatctaaagacggtatttagataaaaaaaacagacacttcacaaccgcaagcactctgtcttgaacaacgaagcatacacgaagcgtgtcagtcttccatcgcatcaccaggacccatgatctatctccccactccagaacttgcagcccgcatcaaaagtctccctccctcctgaagaagatcctgcagttcttttttgctaagtcctgcctaagacgagatcaaaacaccaatgtgacatttaatctcattaggggacttaaaccaaaatctcatcaaaacacgttttatttcttgctttccagatagcagatattagcacaacatgtgtgattttatcgatcttaaaataacaatgaagccacacaaaactttgatcaatatttccaggaatataattcgtgttaaggcatttcgcaactacaccccaactaaccttatcaaccacgcatctaaagaaaaatgtgatcaatagtttcatcctgtgaacaaaaaatgtaagtctggtcacctttcgacttccttttaatcatgttatctctagttaaaagggcttttgtcatacccgggttttagggatccaggcgcgaacgcaatcatcaggtgtgctaggaccaaatcttacacatatgatgattcatggtatagaaacgaatgccacatctttattatataataggagttctgtacaaaataattaaataattacatcatatggagacaacaatccaacaacccaaagttgactcggagacgatggcctagacctctcacgaactcatcacagcatccttaatgcgcctcatcctgcagtaccctgttcttgacctgngggtgtttttatttcctacttaatcataaccaaacacccctcctaggttcctagcaaagtggagagatgcaaggatctttttatattgattaacctctgttctccacaactgttaggctagtatgctacatgaggcccagtcctagaaaaataaacattacctcttctgaatttctcaacaacaggaagaatctcagctg

SEQ ID NO: 9854 - DNA, 1408 bp, Zea mays
  misc_feature (5)..(5): n is a, c, g, or t
ccggnaaaaaaaaaaaaaaaaaaaaaaaaatacctcggacgccgacaaacaaacccaaagcagaaagggagagagagacaggaccaagggagagaggagagagagcgatcgagagatgaggagggagcttgcctcccccttagctactgccgccgctgccacggccggtgcctccttctcggctgccgcctcgctccggggctggtgggacgatgtcaacgagtcgccccagtggcaggacggggccttcttctccctcgccgccgcctacgccctcgtctccgccgtcgcactgattcagctcgtcaggatccagcgccgggtgcccgagttcggatggaccacgcagaaagtcttccacctcatgaacttccttgtcaatggggtccgtgctctggtgttcggcttccatgtccatgtcttcctccttcgcacaaaagtatacaagttggtgttgctagatctccccggcttgttgtttttctccacctacaccttgctcgtgctcttctgggcagaaatataccatcaggctaggagtctcccaacggacaagctaaggcctgcatacattgccgttaacgccatcatatacgttgttcagctttgcatatggatatacctcggaataaatgataatgccgcggttgagctggccagcaaaatattcattgtagctgtctcctttgttgcgcttcttgggttttcagtatatggtggaaggttgtttgtcttgctgagacgtttccctattgaatctaaggggcggcaaaagaagctgtatgaggttgggaccgtgacagcaatttgtgttacctgctttctgataagatgtgttgtggtcgcgctatctgcatttgatgctgatgtatctctcgaggttttggaccatccagtcctagatttcttctattatatgtttgcggagatactcccttctgcgctggttctcttcgtccttcggaagcttcctcccaagcgggtatcggcgcaataccaccctattaactagggagttctttgtttttatgatgttacatgctaagaactccggataagctggaactgctgaaaacctacatccggttgtattgctgtaatattttatggaagcatcccagggttggcaagatgcatcatcaccatcatgctctatgagaaaagagttttgagtggtgctaatgagtttgtgctactgctagccagagcatcacatgacatctccagcagagtaccataccattatttgaattgcatgtgcattcttgacgcggacaaggccaatgatttatcgccttgttggtcccagtgacttttatggagtacttgtgtggtaattgttggcattcctgaggactagatctgaaactgaaaatgcgttatatcagcggtcgctcgtcctaatact

SEQ ID NO: 9855 - DNA, 1365 bp, Zea mays
acccccggggccggccgggacctcactgctgccgggccccagccgccgcgcacgcccaaaacacacactgacgcctgcgcccgccttttcccttgttgcctctctcctttgtgcgtcttcttcctccctcgcgcaccgcaggcaaggcacacaagagaaaagcagagggggccagatgaggagggacctcgcatcctccttcgctaccgccgcatcctcttcctcggcagccgacgcgctccggggctggtgggatgacgtcaacgagtcgccccagtggcaggacgcggccttcttctccctcgccgccgcctacgccctcgtctccgccgtcgcactgattcagctcgtcaggatccagcgccgggtgcccgagttcggatggaccacgcagaaggtcttccacctcatgaacttccttgtcaacggggtccgtgctctggtattcggcttccatgtccacgtcttcctcctccgcgcaaaagtatacaagttggtgttgctagatctccctggtctgttgtttttctccacctacaccttgctcgtgctcttctgggcagaaatataccatcaggctaggagtctcccaacagacaagctgaggcctgcatacattgccgttaacaccatcatatacgttgttcaggtttgcatatggatataccttgggataaatgataatgctgtggtcgagctagccagcaaaatattcatcgtagctgtctccttcgttgcgcttcttggcttttcagtatatggtggaaggttatttgtcttgctgagacgtttccctattgaatctaaggggcggcaaaagaagctttatgaggttgggactgtgacagcaatttgtgttacctgcttcctgataagatgtgttgtggttgcattatctgcgtttgatgccgatgtatctctcgaggttttggaccatccagtcctagatttcttctattatatgcttgcggagatactgccttctgcgctagttctcttcgtccttcggaagcttcctcccaagcgggtttcggcacaataccaccctattaactagagagttttgttttttttttatgatgttacatgctaagaactccggataatctgaaactactggaaacctacagccggctgtagttggatgcttttgcttgtgctgttatgtttatggaagcatcagtgttggcgatgaatataatgacgatcattctatatggggaagtggtgctaatgaatgaatactccttttattgatggtgaaatgaaggtaggcccccctgatgttgctcgtgttggagttgattcacagtctcgagctgcacaggctgtttcagttgaaagaaggacagatcagcttttaat

SEQ ID NO: 9856 - DNA, 813 bp, Zea mays
ccggccgggtcctccctcccggacgcacaaacccaaagcagagaggtgagagggagaggaccgagggagagaggagagagagcgatcgagagatgaggagggagcttgcctcccccttagctactgccgccgctgccacggccggtgcctccttctcggctgccgcctcgctccggggctggtgggacgatgtcaacgagtcgccccagtggcaggacggggccttcttctccctcgccgccgcctacgccctcgtctccgccgtcgcactggttgggaccgtgacagcaatttgtgttacctgctttctgataagatgtgttgtggtcgcgctatctgcatttgatgctgatgtatctctcgaggttttggaccatccagtcctagatttcttctattatatgtttgcggagatactcccttctgcgctggttctcttcgtccttcggaagcttcctcccaagcgggtatcggcgcaataccaccctattaactagggagttctttgtttttatgatgttacatgctaagaactccggataagctggaactgctgaaaacctacatccggttgtattgctgtaatattttatggaagcatcccagggttggcaagatgcatcatcaccatcatgctctatgagaaaagagttttgagtggtgctaatgagtttgtgctactgctagccggagcatcacatgacatctccagcagagtaccataccattatttgaattgcatgtgcattcttgacgcggacaaggccaatgatttatcgccttgttggtccagtgacttttatggagggccct

SEQ ID NO: 9857 - DNA, 2555 bp, Zea mays
gcagcgccgccgcccgcccgccccgccccttcagtccttcaccccctaccccttcaccccctaccccttcttgcgccgtcatcccgatcccctacgctcgctgaggcattatgggtaaatcaagcaagaagtccagtgttaaggctgcacctgctgctgtctcagttccagaggggaaatctgcaaagaaggggaagagaaatgcagaagatgagattgagaaggccgtgagtgcaaagaagcaaaagaccgtacctgaaaaagctgtgccggttaagaagcagccccctccaaagaaagttgagagcagcagctctgaggaggattcttcagattccgaagtggaggttaaggtccagccgaagaaggttattcaaccgaagaaaagtacacaacctgctaaacaggagtccagtgatgacagcagctctgagagctcctcagacgatgaaccttccaaaaaaccagttgccggttcaaaaaagcctcctgccagtagtagcagcagtgatgatagcagtgacagtgatgatagcagctctgatgaggaaccagcaaagaagcccacggtcctttcaaagaagcccactgtcctttcaaagaagcccactgtcctttcaaaaaaacctgtcacagcagtcagtaatggttcaaaacaggttaaacctgatagcagcagctctgacagtagctcagatgaggatgaaaaacctgcggctagcctaaagaagcctgttgttgcctctgtgcaaaagaagacccaagaatctgatagctctgacagtgattctgatgaggatgaatcagaagatgatattcctgctaaagctcaagtagtagccaagaaaaaggaagagtccagtagcagttctgattctgatagtgattctgagtccgaggatgagaaacctgctgctaacctaaagaagcctccggttccctctgtgcaaaagaagacccaagaatctgacagctctgacagtgattctgatgaggatgaatcagatgatattcctgctaaagctcaagtagtagccaagaaaaaggaagaatctggtagcagttctgattctgatagtgaatctgagtctgacgatgaggatagcaatgcgaaaacagtacaacctgccaaggctgctgctattaaaaagaaggaagattctagtgagagctcagaaactgactcacagtcagattcagaagattcagaacctgaaaaacctactgtccctgcgaaaaggcctctagcaacaaataaaaagaatgaacaatccagcgagaaatctgatgacagctctgatgagagttctgatgaaagtgacgaggaacctccacaaaagaaaactaagaattctgcaccttctggtgctgcaaaggctgccactaatgtttcaaagaaaaaaagcagcagtgatgaagatgatgaaagttcagaagaaagctctgatgatgaggatacagaacaagttgaaactaaggaaacttctgtagtcactacccagaagccggcacataatgaacctaaaactcctgccaaaagccaaagtcaggctactggttcaaagactatttttgttgggaatttagcctacagtatagagcgtgaacaagttaaggaattttttgaggaggctggtgaagttgttgatgttcgtttggctacttttgatgatgggagtttcaagggttttggacatgttgaattcgctactgttgaagctgctcagaaggctcttgaatttgttggtcatgacctgatgggacggcctctaaggattgacatggctaccgagaggggtgcatacactcctagcagcgggaaggacaacggttctttcaagaagttcgctccaaggtcaggcaacaccgtgtttattaagggctttgacacctctggtggagaggaccagatccgcaccgctcttgaagagcattttggatcatgtggagatatcacccggatttcaattccaaaggattatgacactggtgtaagcaaaggaatggcgtacatggatttcaaggacccagattccttgaataaagcatacgagttgaatggaaccgaccttggtggctacagcttgtatgtcgatgaagccaagccgagacctgataacagcggtggcttcagtggtgacaggggtggtggcagagggaggagtggcggcttcagtggtggcagaggagggaggagtgacagggggcgtggtggtagccgtgggcgtggatttggaggccgtggtggaaggggtgacagaggccgtggtggaaggggtacgcctttcagacagaccgctggtacagctagtacaggaaagaagaccacctttggtgatgacgattgaagatccatggctggctattatagtgaaaaacgcaaactatattgtaccgttcagacctattgttatctgaggctgtactgcttttttgcttgataattcgacaattgtttttaccatttttaacatttggtgctatcaaagacatgactttttaagtttttataatatgagtagcggcaagttcaaaaaaaaaaaaaaggcggccgc

SEQ ID NO: 9858 - DNA, 1450 bp, Zea mays
aaggaacaaaccttctgaaaaaaaactagaaacgaggtggtgcgcaacgaagcttggaagttggttccctctgcaagtctgaaacacactttccagctctcctccgacagagagactcagccggccggcggcatgctcctcctcgacggcgaccttgtcctctcctcctccggaggcaccggcgccggcgccggcgccgcctctcgcacgagcgacagcgggagggggctcgtggcggcgctcttggagagccccgggatccgccacgcggtcgaccggctgaaggtcgcaccggagaggcggatctcggcagggcaggagggggcgccgaggcacgtctacgtgttccagcgggagtacgccacggtggatccggcgcgcgtcgagttagtgggcacagatgaggctactacatgcattggtgttgtaattcgcaacaacaagactggaatgacctctgttagccatatggattttccagaaattgtggagggagggatcaagcagatgttagaattacttggtgatgacaatgcaccatttgatgttcaccttattggtggctttgctgatgcttccacaaaggttgttcgttcctctggaaagaaacacatcaaacaggaagggtattcctatccactatgttgcaaaatagttgaagtgctgcataagtcccagctacaattcaaccttcgatcattttgtgtccttgagaataacacgaagagtgactcatttggaaatgcactaccaataattggtggatttgtggttgaaacctcatctggagttgtgataccagcaacctttgacatggattcaagatgcccagatgaagttgtcaggagaattcgtgtgagcgttagctcttatgatccaacttggcaaggaaggttgctggagacttacgatactcaggacgatgttttccaaattgcacctgcctgctggatgccagattgggccgatatagcgtcctcactcaaccagctctcggactccgaagtcctgctgcggtgctccacctctccagccgcagaaccacctcacttcgtggaaaacgaaagaaggatctggaaatacctgatcgataacccggactgggaagagacgttcccaaaacacaagccccgggtgttccatagggctagtgacggaagctggtcaaggtactcgtagtgcaagccaagggcttccatcgtctgctgttatcgtcggtgctcccacacatggaacgaaccagaagggaaacccccctccgttgatttgaacagtggcatattaagtttgagtgcaaagttttctgcgcactgcgattagcacatccgtggacgcttggagatgggagtaaattttataaagtctcttggagatggcagctgctctaaggaccagctaaaaactaaaaaaaaacgcatgctcttgggccaaaaaaaaaaaaaaaatcctc

SEQ ID NO: 9859 - DNA, 4289 bp, Zea mays
gcctggacaggaggggcgagcccctactagaattttattaaaactttaaaacgacggggataggggcatacaggaagatatattacagaaggttataagggggggtttctactgccaatgttggaagttggttccctctgcactacttttcgaggctgaaacacactttccagctctcctccgatagagactcagactgacggcggcatgctcctcgacggcgaccttggcctctcctcctccggaggcgctggcgccggtgccgcctcttgcacggtgcgtcggttattcaccttgacgagctcgggggtgctggctcctgtctctgattctacgacatcgttttttttctgcagagcgacagcgggagggagctcgtggcggcgctcttggagagccccgggatccgccacgcggtcgaccggctgaaggtcgcgccggagaggcggatctcggcagggcaggagggggcgccgaggcacgtctacgtgttccagcgggagtacgccacggtggatccggcgcgcgtcgaggtgcgtggagttgccttgtcgcggcttggtctaatagggttggggaatttcgttccccacctgcctttgggtgataaaaacgggatcttgttacgtcgttgatggagttccttgtgtatctgatcgattatatgtgtagctcagtgatgatttgtgctgtgaaggtgaacttcgttttcctgtctaaatcatcactgttgctgtcgagacaaagggctcaggttctgaagtagtggatcggcaagtcttcgtagtttcacttcactcgatttgggaattggttcgggacgaagcagaaacctttttgggtgcgaaggataaagcagggattcttgtgctgggagctttggggacgttgtcaggggttactgctgctacctgtaaaactagggtttggcagtcatcttagcagctttttttttaccttttattagctggtttcttaggtttttttacctgtactttaccaactttgtggattgtgatgatttactagtattggaacctgtactcctaaagcctttgtgtccaccaaatttcatgattcttatattttttatgaatcaattacttgcattttttcatggttttcttaaaaaccagtatctgtcatagctccgctatagcggtgctatagctttatagcttctgggaaaaatatgccactacttactatagcccgcaatttgaaaccttgcatatgtcatttaaaattgaataacacctgagttaatatgtcttttgcgttatagttagttggcacagatgaggctactacatgcattggtgttgtaattcgcaacaacaagactggaatgtaagtgaaaaagaagtgagcatttatctgatcctgtaaggcttcagtttcttgttaactttataactcttgtattttctgaatgaactgagattaaggacttatgacaatgcttgtgatcttccattgcttactccaggacctctgttagccatatggattttccagaaattgtggagggagggatcaagcagatgttagaattacttggtgatgacaatgcaccatttgatgtttgtatctttaactgtggtttcaatatggggtgtactttatgcacctttcaggcattctcactagtacttactgcaggttcaccttattggtggctttgctgatgcttccacaaaggttggattcaaaacttattggtggttcaccattttgttgagtattttatttctctctttttttgcgtgatacaagacgttgtggaaccatttaccattgttaactcttcacttcttcaggttgttcgttcctctggaaagaaacacatcaaacaggaagggtattcctatccactatgttgcaaaatagttgaagtgctgcataagtcccagctacaattccaccttcgatcattttgtgtccttgagaataacacgaagagtgactcatttggaaatgcgctacctataattggtggatttgtggttagtgatttcctctcttctgcatccgttacattgttggttagttggcaccaatctgcttagaaccagtacatagcagttccgatgccttcctacagaatgtccttgaaggtctcattgaaggttaatccaaagttatattctgcagtcacctctccatttccccctacatccatttttgtgtttggtttcggtgcggatttcaaatattcatgcatacaatagagcttcagcactgtctgtgaatttgaacatacaaaacttgagattgattgttcacataggccgacctggtttcttcaggttgaaacctcatctggagttgtgataccagcaacctttgacatggattcaaggtgcccagatgaagttgtcaggcgaattcgtgtgagcgttagctcttatgatccaacttggcaaggaaggttgctggagacttacgatactcaggacgatgttttccaaattgcacctgcctgctggtatctaaaatcctcccatcgtctttatttgcatgttccaaactctttgtgcttaacatccacgtttctgaactctgagctactgtttcagtagttattttcatccagtttgatattccaacagtgcaatgggtgtagtactatctggaaaggaaaggcaaaactttcgattaatgcctatagtacatttctaaacagatgttcatctttgtttagtacctctttgcatgaacagttctatagaggcattaccatgatcatcttctttgccatcaatatatcgaatccactcggaaccagaaaaaacacagcttttttccctactgagtgatagttcttgctgtataaatttcaagaaaatattgcagtaaacaaatagtttaagagcgcatggtatccaacggactcggaaacagtacatgccttgtttgcttacagttttcccttaccataaaatccatcgcctgttgatacataggatgccagattgggccgatatagcgtcctcactcaaccagctctcggactccgaagtcctgctgcggtgctccacctctccagccgcagaaccacctcacttcgtggaaaacgaaagaaggtttgtgtgtctacagtgtagacttccctactcctttgcagtttgcagaccataaatactgtcaaactgatttatgactcacagttatcttgttcttagaattatctgtaatttttttcttgtttgtaggatctggaaatacctgatcgataacccggactgggaagagacgttcccaaaacacaagccccgggtgttccatagggcaagcgacggaagctggtcaaggtactcgtagtgcaagccaagggcttccatcgtctgctgttatcgtccgtgctcccacacatggaacgaaccagaagggaaacccccctctccgttgatttgaacagtggcatattaagtttgagtgcaaagttttctgcgcactgcgattagcacatccgtggacgcttggagatgggagtaaattttataaagtctcttggagatggcagatgctctaaggaccagctaaaaactataaaaacgcatgctcttgggcagaaaaggatgagcgattcctcacatctccgttctttttctttatcgaaattttcatttctacgcagttttgtatttttctgaagttataaggttcgttgttttgtgcacaatcttataatgcaacttccccaaaactcatataacaccactttctgcataaacttcaccgaggaacttgtgggcgtaagtttatttactcgtgcataacttttctctgatatatttaaatttgtctggacaacttctcgggattgatttttcatgaaatgctagtcaaatatgaaaaacgagaatagctctctagattgtgcaagatatatagaaaagttgttacagggtacaaaaatatagaaaacaatctttcctaaaatggttctctaaatgatgatttagagaatatattttagaaaggctcttggaaatgatcttagaacattgtagaaacatttttttctccttcaatatatgtggataaaacttgtgtggaaaaggttttcagagcaattttgccgattatttaattgtacaagacttttattggaacagctcaatcaagttttccaaaaatattaaaccctagcttgtactagaaaaaggttttagaaatttcttctaataggtttaggcaacgaaaatgggagcagaataaactgacgtacgaaaaaaaaacaacgaccggtgtaattgctgcatgtaattgctgagtgactaata

SEQ ID NO: 9860 - DNA, 1879 bp, Zea mays
tgtacaacgatgaaaagctgatcaagtaccttgcgactgcagtgcaagtagatccagaaaggcctgttttagtggacaaatatctgattgatgcagttgaaattgatgttgatgcattggctgacacagctgggaatgttgtgattggtggaattatggagcatatcgagcaagctggcatacattcaggcgattcagcatgttctcttcccactagaacagtctcagccaagtgcctagaagtcatccgttcatggaccaccaagctagcaaagtgtctgaatgtgtgcggactaatgaactgtcagtatgctatatccacttctggtgatgtgttcttacttgaggcaaaccctcgtgcatcacgcacagtcccttttgtatccaaggcgatcggccatccgctagccaagtatgcatcactggtgatgtctggtgtgaccctgccagagcttgggttcactgaagaagtgattcctaagcacgtgtctgttaaggaggctgttcttccgttcgagaaatttcaagggtgtgacattctcctcggaccagagatgcgcagcaccggggaggtgatgggcatcgactacgagttctccggtgcctttgcaaaggcgcagattgctgcgggacagaagctccccctaagcggcaccgtgttccttagcctgaatgatctgacgaaacggcaccttgctgagatcgggcgtgggttccgggagcttggcttcagcatcgtcgccacgtctggaacagccaaagtgctccagctcgagggcgtcccggtggagccggtactaaaaatccatgaggggcggccaaatgccagagatatgctgaagaatggccagatacagatcatggtgataacaagctcgggcgacgctctcgactccaaagacggcctccagcttcgtcggcttgccctcgcttacaaggtgccgatcaccacgaccgtggacggtgcacgggcctccatcgatgccatcaagagcttgaagaacaagtcgatcgagatcctcgccttgcaagattacttccagactgctgatgcttcggaggatttacaggcggtggcacgaaccgccccttagtggtgtctcttcttttcccatatataatgtgagcctagctcaaagccaaaaccacatcccaaatgaaaattttgtttatggttgcacctgcagcatgcatgcgcaaagacaggcatccagattgtatcggtcacaggcatggctggacagaatcggtgttgggcgaacgtagttgtagtttgtcatgttagaagggtgatagcatccatggaaataaggcttcttcccaactgcggttttgatgacgagtaccataccatatcatatcccttgtggaggtttatttacattgtatcattgtctcacaaaaacgaaaatgtgcgacgtacatgtattgttatgcttatgcatgttataatcagattctttgatgagtagacaggcattttactgcaaaaaaaaaaaaaaaagtcaaggaagtattattaggtggtactgtacaactagggatggcaatggagaatttatcgttggggaatagctctttatccttgtgactaaacaaattctccgtggagatattcacaaacgcttgcggaagatatttcttttctatccccgtttccgatggtgatcctgtcaccgcttaaattacaattaagatatttttattaatataaacactgtcacttatacacattgttagatgtaaaaaatcattacgtgtatattaaaatgaacacatttatacaatgagtaatcttttgataagataattatttatttttatcattagctagtacatgaaaagatcattacgtataagtttaacggatctccgcggg

SEQ ID NO: 9861 - DNA, 8476 bp, Zea mays
  misc_feature (2384)..(2384): n is a, c, g, or t
  misc_feature (2920)..(2920): n is a, c, g, or t
  misc_feature (4715)..(4715): n is a, c, g, or t
cattattctccataaacattttagttgtgttgcttttgttaattctgcattactttaaagcaatattctttgcaagcaaatgacatagttttatactccgataaattgcgcatattgttataaccactaatcaagggatcaagtatgggtttagagttataattttcaggtttcgtctattcaccccctctaggcgactttcgagaacctactccccgttgaggagtccacgtaggacatgtcagtttcaaccatttccatctttcaaacggtcatttatactagatgagtgcttcttcttaatctggagggtcatttagacccgcaaggatcaacacgcacttaggcgtctcttgttatctttacaagtgaatgagaaatagaagatgaggaaagcatgatcaagaaaaccaagccaaaagagcaacaagaaaatcacaatgtcacactctcttaagtctccaaagcattaatcattaatgatcttcaaacacaattatgacacttagagaggacttttatgctttgagtgtggatggagtaaagtcttgctctttgcaatgaatattggtgctggaagctttgatgccattgaaggggatggttgggatggtatttatagccctcaaccatcatatagtcgttgcctttttacggacagttcgcgagcctagtccgaatgatcggcacctataagatcaatgactagatcacaaagatcaattgtaatggctatatcacaaagatcacaaaatctggatccccgataaaatttcgtgtaggctataccgaacattgccggaggtaatgaggaggagaaaatgaaccgttacagtgtcttgtgtaggcatctgacagcaaggggtcctgatttctgaacctgatggcaagcggtgagacaactccctcgggaggcagcgaggacctccttgacggcgcccctcgacggcgtaccggcggttccacctccatttggcggcgcgcggggggctgcacctcctttgggcggcgtgcgcgaacaagagccgcagcctctcccgcttgtctttgggagggaacgctggcaacctcatcttctttcgacgctagatttggacagtaaagtcccgcagtgacttgccagttgccactgccagagcggtcaccgaatctgaggtctcagcccagcgggccgcggcggctatgtcctcatcctcctccttccccaactcccgcttccccttcgcagccggcgccggggcctccggcggaagcgggagcagcgtgcggccgtggggttcgagcggcgggacatcggtgtcttcatctgggaaacggatacagaaggagctgctggacctcaacgcctccgactgctccgcggggcccaagggcgacaacctctaccactggctctccaccatcatcgggccccaaggtaagagctccctcctctccgcttctccaattcgttagaggcagtccaaagctcgttgaaattttactgcgctagacggcagtttcacttgctcaactcaactagctgcctttcttttcttttctttttctctaacgatatgctgctgcaatatttagagttggtgctgtaattgggcctgtcaaataagcatgtcttataagcaagcgtgggttgagttgacgcataatttacgtcttgcaggatcaccgtatgaaggagggatatttttccttgacatagtgtttcctcctgattatcccttcaaacctcccatggtaagaattcacatttttttgctattaatgtacttttatgggacactgagtgttgaattgcgctggggaatctctgcttatagtacagaaaaaaaaactgatatgccctgaaaagcgaaaacctaagctctgatttgacatttcagctcatcttgccatgattcctgcttcttgtactctttttgaatcgtcaaggtttaactaatttgtatgtcacgctctagttgtggtgattgatgaacgtggccaccaaaagtactagaaagtattagtaagaaaaaatcaagtggcaggactgaacagttaggccggtaatagtttctagttctagttctgattgttctgcacttgggatcctgaattttcattataattcttcctaggaaactgaataaaaaaccatgcaaaaagagtgttaacagaatatgctttataaagtgcagaaggtcgattgtcctcgaagctttatacccataaaatttcaattgttatataccatattatgggggaaacttgactagttgacttgaaaaaagtagtttacgaagatttactttggcctagatgaataatagtgcattcggctctctgccagtgaagataactctagaagtgccacatgaccacacctcatctgacgatattggcanggaagcgtgtctgatggcaatgaatggaactaatgagaaaagactacatgccaaaatatagttttctttgctgctaaccaaagttaccctatttcttctgaagcggtgttgttatgttttcacgagaagtactgaaagtgtgatgtttgttgtgttcttggtatgatattgatgtatgaagaaaaactatatgaagttttagtttactggtattgtttaaaaagaaagaaagtaggctgctaagatattattattttttgtcctagcttgctttaatatttttcttagcaaagatatcctgcaattgtttttttgtcggtcaaagcctttaccactacaacatgtacctttgacatcacctcttatcacacaatggcatattgttatcttggcttagaatgtaagagagtctgctaactgagggaagtgattctaaatacatagtctactctcagtgggctatccacatttcctgttgttagctagcttgttgagagtaaataaatccagtattgctcgcctgttaggtgctctgnttgatcgcagaatagttttgtaatataagagtaatcggggagactgcttacttgcataatcctaggcttacggctatgtaagaaacctgtaaaactagcattttctcttaatgaaaaacgtgcaacgtcacggtcacaaaaataaacagactccaccggctcatgttattgatatggtgtcaatcggcaacattgccaccactgttttaaaggcgttgcctaggtagggctagatatcgagccagctcggctcgactcgtccgagttcgagctggctcgttaagctaacgagttggctcgactcaactcgttaagctaatgagccatagagtcagctccgctcggctcgtttagctcgcgagtcagagcagaaaaataatatgtatataataatcaatttctagttaatttcaaactaatttaatagtagaaaatagtaattatacttatagtttcacagaccacattaatgtaacaccaaattaacacaactcatcactcatcaattcacaatttacacacatgttaatcaatttaacccacatttatattcgcagaccaatttaacacatagacacaattcatcaatcattagtttaacttataggctataaacaccacacatgcattgatgcatataacaataacatgttcatcaatggttacgtaaatgatatgcatatagtttagttttgctgaaatgtgatagcttgtttagctcgcgagctggcttgttaagaaaccgagctcagttcgtgaaaaaaattcaaacgagccgatccgatccgagccgatgagccacaagcatttcgtgcagccctacgcctaggcgtcgcctaggtgttcaggcggtggtccaacgccttgtctcgccataccactttaaaaatcatggctgccaccatctatttcatgtttactttctgacttctgacaggttgcttgacatatgggggaccagaaacagtggatctccattttgtctttcacctaccatacaaatcttcagtggcatagttttaccataaccagccaatggaactattcgtgtagctaatgctgtctactgcaactatcatactaaactactaaaactactaatgtgatgttccagatatggtagtattaaaatatttttcaatgcttctgttctcgaaacatcctacgccaacttgctttggattaaaaggctttgcttttgtgtgtattttcaaaatatctttctaatgctctttgatgttctcgaatccaaacttatgtgcatatagtgttacaattgatgtcaatcatgacttgacatttcacatgttaatattgaaagtttcacaagttatttctcttctggtgaaatctattcaaattgattactttttagtttggattggacaatttagtttaacaactccgactgtgtgttatgctggtattctcccaggtaacattcaaaacgaggatttaccactgcaatattgattccactggtaaagtgcatttggacattctgaaagatggctgggagtccagctttcactattttctaaggtgttatttggccatcaaagacatcatcagcaatccagatccatgtacttaccattatctgtactactttctgtaaacagtcatggattccggtgcagattaaacgtgctgtctacatattttctattttacttcagcaattgaaagccttgtgttttgctattagattggcaggctaaagttatgatctttgtttgtgcagactccccgcttatgatgagcatttcacgtcagtatctgactgatagagctnaacacgatgaaatagcagctgagtggacaatgagatttgcaagataggggatctatttgtatctaagcatggttgacattgtaaaaaaacaactcttaatgtggcctgagatggtgaatgttggcaacggagccatgtttggtttggtgtgacgtgacataaatgtgtactttatgcttgagtattatttaactgctccttttaggtgaagaataatcttttagattttgtacttatgccaagttgtacaagcatctattcagaacctgctatctgagtttatttcttgaaatgatttctattgaaactggcatcaggtcctggttgatgatgtcagtttcatatactgaaaggaaataacataaatcagggaatgtttagaaaccaacaacctttagcgttacagctatagaaatgttcgattagttttctacagtcaaagtatgtaaagcatgacattcatatctttcgcttgaaaccaaatcctgcgggttatcattcgggtgttgttgttggacaaggcttcagttacacaggtaaatttccttggttccagaactttgtccctagttcttgggcgttccttggacagaatagatgtcatactaccatccagcaaagcacaaagataccagatgtttatggcagaatatttgtcacttgcctactgctgctaacttggatctcacttcatgtaggggtgatagagctgccacgacaggcactctgatcttacaaatgaccaaactggacttcacctctgaagttgacggctcactagttcactgattcccagtacggactgctgagttgatcacatctggggaccttataactccattgggtaccgcggcgccggccgggccctccttctggtgcactggtggtcttctcagaccatagacaatggccaccgaactagatgtgagcaagtctcgccgcttcgacattgccatgtcgaggcgaacccggcgatcgacaagcctggtagcctgctttcaagatcagtatacaccatccctggcacagcatcgccaccaagagctgaaggcgtttctgcaatgccaggatgaagagctgaaggcactccagcgatgcgaggatgcagagcacaagacactgtgtttgaatgaagacgaggagctgaagattccacaagtaccactgcagtatgaagatgacaagcaagagacgccagagcaatatgaagatgggcaggagaaggagtcgcagcaatatccagaccaagagcaggagataccagattcatgtcaagacgatgagaagacaccgaaccagtatctagacgaagggaagatgctagagcagtatcaagatgaagatgatgagctgccatcacaataccaagaccatgagctggtgacacagaagctacctgaggaagatgaggggactgcatcagagcgattccaagacgaggagaggaaggaacttcatcagcaccaagaggcagatgagcagacgtcacagtctgaggacgaggaggagcccaagtctcagcaggaacgccatgacgtcgagcagaaggcaccgaagcaattccaagtcttgaagaaggtagccgcgccaccacgtcctgtggagaacgtgccccggttctccctccaggagcttatacggcagaagcagcagcttccaaccggcgaggcgatggctaccagcaaggtaggcggccgtggggagagtgtcctcgctgaccatatggtttcaggagcaggtgcagcagccgcagagggcacggcactggcgatggtgataaagcgacccgagggagggaagaagcccatgggcatgatacgccggtgcgtcaaggccctgaaccagatgatcaaggccaagcacgggtccaagaagaacctgcatttctagtgttcaacagagtttcttagtagattgcacatctctgaataatgcacgcgcagttggggagaaccacaattttgggcatggtgcagggtgtgaaagatctggcgagaaactttttacgctctggtctatactgtcttcctatagcaataaactgtggaacttttaatagctgaagatcacaaatctgctactcctatgcgagaagatggtctactcagtgatgctctacgcgatttgctgaacgatgcaatgggtgacgagtccaagagccaagaccaggctcttgtgttgttgaattcccctgcaatagcttctttgcttttagaagtatatgatcgcgattagaaacagccgacacctaccccccaggcctgcagcggtattggtgcagactccttttctgcctttctgtgccgcgtcccgtctgggtttggtgtgtgatactactaagtgctgagaacataagttggtgcaaaaaaaaaggtgaaagagctgaagcctgtgaagcgtcttgagttatcggttgaggatgcagcgcatggtacgccatcatacatctcttcttcgtttatgatcactttcgttttaaagatctgaacgcgtgtgttgttggcgttggcacctgggactggaagccagtttatgatctaaacatttgctactgtattcttgtggaactgaaaattgaacgagtagtttttattcacctttttttaggaaacattcggtagtggctctaccgtttcattatagtagaatagaagactgttcagataaaaaaagagatagggggaggggtattatagttgattggatacaaagaatatggattacagagttgttgtggaagccaaccgaaatgagcagttctcctcttggatttgtgaggtcagcacgtgaaagacttgttctttgtattgaaaaaccctacgacatcgctttttacaaatattccatatagtgtagatcatcacttgcagttgatgtgcgtcccgcgccgaccggacctatgtctgccaccaatgcgatattccatgtgagacttgtgatggcagattaagatggaaacagattgcaattagttgccagcaatagagggcgtaactgcaagatgccatcaagtgtatatgagattcaggatcattctggcaaagggtgcaggtaagaacggcgtgtccccaatgcctgacaattctattcgcagtaagtagtcgactctgtaggagaagctagagaaaaatcttgcatttacttgtcacctttgccttccaaatctgcatccaattgtgcttgttcatggtaccaaagaattggacttgatacgctgaactagccgtgtagcaattggtgttcccaaaattcaatgtgacggtgtcctgttggtcagttaactgaacagaccttacagcaagccaaaggtgaaggaactgacgagcctagtcattagtagtaagatgttgcagacccaccatccacctgttccttgcaagggcattttttactgagtgattcttcctccttgcaagtctgaagcagctagaggctatgtccataggtgttgtaccattaatccacctatccttccagaaatttgttctttcaccatttcctagagtgagaaatgtacatgcccggaagagtgccaattcagcttcggtggcggcatgaggtaaagtggcccatggtttgcatgtgtcagcccatttataccaaagccatcgaagcctcagggctctgttgaagcgggccagatgcttaactcccagcccgcctaatttctttggtcgacagacattgtcctagctcaccgggtagtggcccctcatatgatcatcattgctcttgaataggaaattcctcctcaagcggtc

SEQ ID NO: 9862 - DNA, 986 bp, Zea mays
gctagagcagtcaccgtccgaatctgagcctcgcggtgggcatgtcctcgtcctcttccttccccacctctcgcttccccttcgctgccggcgccagggcccccggcggcagaggcggtggaggcgggagcagcgtgcggccgtgggggtcgaccggcgggacgtcggtgtcttcatctgggaaacggatacagaaggagctgctggacctcaacgcctccgactgctccgcggggcccaagggcgacaacctgtaccactggctctccaccatcttcgggccccaaggatcgccatatgaacgagggatatttttccttgacatcgtgtttcctcctgattatcccttcaaacctcccatggtaactttcaaaacaaggatttaccattgcaatattgattccacccgtaaagtgcatttggacattctgaaggatggttggagtccagctttcactatttcaaaggtgttattggccatcaaagacatcatcaacaatccagatccatacaccccgcttgtgatgagcatttcacgtcagtatctgactgatagagctaaacatgatgaaacagcagctgagtggacaatgagatttgcaagatagaggattctgtttgcatctaagcacgattgaccttgtaaaaaaatcttaatgtggcctgacgcctgaaatggtgaatgttggcaaaggagccatcagccatgtattatttgatgtgagttgtgacataaaggtgtactttatgcttgagtgttctttaatcgctgcttttaggtggagaataatctttttcgattttgcacttctgccaaagttgcaccctgaactcttcagaacttttcttccgagtttatttctaaaaatggtttctattgaaaaaaaaaaaaaatgctgctgtcctggttgaggatgtcagtttcatatactggaaggaaaaagaaacataaatcatgggaatattcagaaacccatagcctttaa

SEQ ID NO: 9863 - DNA, 1233 bp, Zea mays
  misc_feature (1161)..(1161): n is a, c, g, or t
cattgggtacctcgaggccggccggggtgtaggcatctgacagcaaggggtcctgatttcggtacctcgaggccggccggcaactccctcgggaggcagcgaggacctccttgacggcgcccctcgacggcgtaccggcggttccacctccatttggcggcgcgcggggggcagcacctcctttgggcggcgtgcgcgaacaagagccgcagccgctcccgcttgtctttgggagggaacgctggcaacctcatcttctttcgacgctagatttggacagtaaagtcccgcagtgacttgccagttgccactgccagagcggtcaccgaatctgaggtctgagcccagcgggccgcggcggctatgtcctcatcctcctccttccccaactcccgcttccccttcgcagccggcgccggggcctccggcggaagcgggagcagcgtgcggccgtggggttcgagcggcgggacatcggtgtcttcatctgggaaacggatacagaaggagctgctggacctcaacgcctccgactgctccgcggggcccaagggcgacaacctctaccactggctctccacaatcatcgggccccaaggatcgccgtatgaaggagggatatttttccttgacatagtgtttcctcctgattatcccttcaaacctcccatggtaacattcaaaacaaggatttaccactgcaatattgattccactggtaaagtgcatttggacattctgaaggatggctggagtccagctttcactatttctaaggtgttattggccatcaaagacatcatcagcaatccagatccatactccccgcttatgatgagcatttcacgtcagtatctgactgatagagctaaacacgatgaaatagcagctgagtggacaatgagatttgcaagataggggatctgtttgtatctaagcatggttgacactgtaaaaaaacaactcttaatgtggcctgagatggtgaatgttggcaaaggagccatgtttcgtttgatgtgatgtgacataaatgtgtactttatgcttgagtattatttaactgctccttttaggtgaagaataatcttttagattttgtacttatgccaagttgtacaagcatctatttagaacctgctatctgagtttatttcttgnaaaaaaaaaaaaaaatataaaaaaaaaaaaaaaaaaaaaacaaaataaaaagaaataaatggaaaggaaatg

SEQ ID NO: 9864 - DNA, 2208 bp, Zea mays
tttcggtattcccctcgcgtcgcgtgattcgattggattccgttcccccgccccgttccgttccttcagcgccgctgccgctgcggctgcgccgaggcccgaccccaaaggctgcggcctgcggccgtcgcagtcccatcgattcctcccgcttggctttcccacccctcgaagccgaatccgatggttccacccgttgaccgcctccgccatcggaggccgcgccgcctcctccccgccttcttcctcggtccccgcgcccgcctcctcctatagatataccgcccgcgcatcgctccatggcggtcggcggcgacgacgacagcatggagcgggacttcgccgccaggctgcgcctcgcgcattcgccctccccggccacgcctgccgccgccgcctcatcctcccccaccgccgctggggggatcgccttccgcgcgccgcaggagcagttcaccgccgacgacttcgtactcggcaagatctacggcgtcggctcgtactccaaggtggtgcgggccaagaagaaggacactggtcgcgtctacgcgcttaagatcatggacaagaagttcatcaccaaggagaacaagatctcctacgtcaagatggagcgtattgtactcgaccagctcgaccaccctggcgtcatcaggctcttcttcactttccaggacacatactccctctacatggcgctcgagtcgtgcgaaggcggggagttattcgaccaaattgttcggaaaggtcggctctctgaggacgatgcacggttctatgctgctgaaattgttgatatattggagtacttgcatggccttggcctaattcatcgggatgtcaagccagaaaatctactgcttacttctgatgggcacatcaagattgctgactttggtagtgtgaagcctacaagggatactcctatcaaagttctcccaaattcaactactgaaagggcctgtacatttgttggaaccgctgcatatgtaccacctgaggtcctgaactctgccccagcaacctttggaaatgatttatgggcattgggatgcacactgtaccaaatgctttctggctcttcgccatttaaagatgctagtgagtggttaattttccagagaatcattgcaagggacctcaaatttccagagtatttttcagctgaagctagagatcttgttgacaaattgctggatgttgatccaggcaaaaggccaggtgcaggacctgatggttattcttccttgaaggagcatcctttcttcagaggcatagactggaagaacctgaggaagacacggccacctaagctcgcaatcgatgcaaatgcaaatgaagatgaggatagccaagattcaaattggttggcacacatgggaagtgtggcagtcaaccaacagtcaaatactgttggtaataatggtgccccgtcatcatctgaagtgcgctcccatatatctaaattagcttccatcgactcctttgactcaaaatggcaagaattcctggaccccggcgagtctgtagtcttaatatcaaagctgaagaagattaataagctagcaaacaagaagatccagttgatcctcactgacaaacctcaattgatctgtgttgacccttcaaaaatggtggccaagggaaacattatttggtctgatgacccaagtgaactcagtgtgcaagtatcagattcttcacattttagaatatgcacgccaaagaaggtgtcaacatttgaggatgcgaaacagcgtgcttggcaatggaagaaggcaattgaagacctccaacgctgccaaaggaattaattttcaattcaaatcaaaactctaaaatgtcgaattaggcactgttaatacatcatatccttttcacttgggaggaacatgagggggtttatttctcctgcatcctgctccaatgcctggttgcaaggaacttgctactcgctaattcacacactgaatgatggcccccaattttttcccttcccatccatgttttcaaatagtacacaattttgtttgtcacttttgtgaaccgttggagcagatatcttcaaaacaggctgcagtctggaaatattgacacaggaaactattttaacagtctgccatacttgattctctttgttgtcttttgttcaagagcatctatatcagagtaattctttggttttgcgagaaaaaaaaagaaaaaaaa

SEQ ID NO: 9865 - DNA, 1426 bp, Zea mays
tcctctccccattccggtagatctaacacgtttttgctaaataatttgtgaaatggcttcagtttcacaaaacagcttaggaaaaaaaaacaagaggccgagttgtttttgagcaatcttgctctcacggctgcttaccgttttcacggcatatatatccagctagcaagatcgtcttccatcagccccaacagcactctacgcaagcaagagacgctgctggaaggagagaccgccgaccggggcaggcattagctttttggtgcccgagctgtggtagtagccggccggacagcttcaccgagatcttcggctcgccttaaagtcgctttttttggattttggataggaaattaagagcttaaccaaaagcgagtcgcctccatgaatttgcggtaacaattggttggcaggtgtttgtactatacgctcatccgtcgaaagttgctaagacaaaaactaataacgacgcatgaatgtttgccagctagcgagcggctgatacgtccccaaccgccagccaccgaactgaacgcctgccatctgtactgtgctgtgctaatggcctcctcggcgagagagagagaggagacctccgtatatatataggcatatagctggccggccccctccccgatagcaacgctcatctacgtgtgggggggcatagcacctgcagccaccaccagcttgcattgcacatagcatttccaaggacgacgacgacacgcgcgcgggcagccatggacagcaaggtctgcgtctttcagctggcgctgctcggtgtcgcgctcgccgcactcgccggccctaacatcgccggcggcatcatggaggttgggctagccagtagtagggttaccggcgcggcgcacgcggcgcggcagatgatggctcaagcgacgacgacgatgtcggtgatgggattggaggtgcaccgccgcatccttgacagcatcagctcctcgtcctcgctcaatcctgaccgcgctgcctgcctcggagcgtgcccaggtcgcggccggccgtacaccagccgtagttgccagcatgtgtaccagtgccctagctcctgaacacacccatgcatggacgtgcgtgcttcgttcctactccagtccggccggcggcagctcgtccagcagtgcatccgattttttttttgtctttgtttttaattaccatcgtaagagctagccaaacgcatgatgtgtgccgttgttgcagcaacaacgatataacctgtataccagcgcatcagcctagctactagtccaaaactgttggcattcgtcttttgttgcatttggacttcccaaacttctccaaatgcacggtgtcgaagagattaattaggacgcatggaaacgtcagaaccatacacacaagtgtcgggccccgatgcgaaactctgatgcattgttaa

SEQ ID NO: 9866 - DNA, 1603 bp, Zea mays
cattgggtacctcgaggccggccggggccgaggcagggtctggggccggtcagtgttgtgccgcccgttgaaaccaccacgcgtctccggccgcgagacgcggtccacgctagctcctcgctatctccgtcctactcctcctcactcactagtccccccccccccccacgaattgcacctacccatttcgctaatctccctccacgagccgaccaaatcgaatcgaatcgcgcgcagcgcgcccgcgcagcgattgccggcgatggcgagcctcaccctgccgccggcgccccccaacccacggcaggacgccatcgacctccaaaaggccttcaaagggtttggctgtgacagtacaacagtgataaacatacttactcatcgcgattcagtgcagcgtggactcattcaacaggaatacagggctatgtatcatgaggaactctcccatcgcatttcatctgaactcaatggaaaccacaagaaagctatgttgctgtggattcttgatcctgctggacgtgatgcaactgttttgagagaagctctaagtggtgacactatggatctgagagcagccactgatattatatgttccaggacgccatcacagttgcaaataatgaaacagacttattatgctagatttggtacttatcttgagcatgacattggtcaccacacatctggcgatcaccagaagcttttacttgcctatgtggggattccacgctacgaaggtcctgaggttgatcctaccattgtgacacatgatgcaaaggatttgtacaaagctggtgagaaaaggctcggtacggatgagaagacctttatccgcgttttcactgaacgcagctgggcacacttggcatctgtttcgtctgcttaccatcatatgtatgaccggaaattagagaaggttatcaagagcgaaacatctggaaactttgaattcgcacttttagctatcctcagatgcgcggaaaacccagcaaagtattttgcaaagctcttacgaaaggccatgaaaggtctaggcactgatgacaagacacttataagggttgtggtgacgaggactgaaattgatatgcaatatatcaaggcagagtacttcaagaagtataagaagccattagctgaggctatccactccgaaacatcaggaaactatcggacattccttctttcacttgttggtcctggacattaggttatgtttcgaccatgggacatgatattccatccatccaccctaaatgcagcgacctacctggaaaacttatgatgttgccatttgtcagtggtgactcgtggattcgtctaacttccacatatgcggtatctagtatgcttgactaaagtattcgtgtttaaatttgtatctgggtttcttgttggaaaattctgtgcgggggcacaacagctgttgttggtcacgctaggcttgacttgtgtctccatgacatcaataatattatgtcatgttcgtgtgtggtcattccactattagagaaaaaaaaaaaaaaaaagcggccgaattggctttaaagaggagattttagtaccggttcttggtatgagctgatactaaaggttaccc

SEQ ID NO: 9867 - DNA, 1545 bp, Zea mays
  misc_feature (1529)..(1529): n is a, c, g, or t
agggtctggggccggtcagtgttgtgccgcccgttgaaaccaccacgtaacgtctcggacggctagacgcggtccacgctagctccttgcgggctacgccctcatcctccttacctcttaacgcaaagcgcgcaccaaatcgcacctaaccattttcgctaatctccctccaccgagccggccgaatcaaatcgaaccgcgggcagcgcgcacgcgcagcgactgccggcgatggcgagcctcaccctgccgccggcgccccccaacccacgccaggacgccatcgacctccacaaggccttcaaagggtttggatgtgacagtacaacagtgataaacatacttactcatcgcgattcggtgcagcgtggactcattcaacaggaatacagggctatgtatcatgaggaactctcccaccgtatttcatctgaactcagtggaaaccacaagaaagctatgtcgctgtggattcttgatcctgctggacgtgatgcaactgttttgagagaagctctaaatggtgacactatggatctgagagcagccactgagattatatgttccaggacaccatcacagttgcaaataatgaaacagacttattatgctagattcggtacttatcttgagcatgacattgctcaccacacatccggtgatcaccagaagcttttacttgcatatatggggattccacgctatgaaggtcccgaggttgatcctacaattgtgacacatgatgcaaaggatttgtacaaagctggtgagaaaaggctgggtacggacgagaagatttttatccgtgttttcactgaacgcagttgggcacacttggcatctgtttcttctgcttaccatcatatgtatgaccggaaattagagaaggttatcaagagcgaaacttctggaaactttgaatttgcacttttgactatcctcagatgcgcggaaaacccagcaaagtattttgctaagctcttacgaaaggccatgaaaggtttaggcactgatgacatgacacttataagggtggtggtgacgaggaccgagattgacatgcaatatatcaaggcagagtacttgaagaagtacaagaagccattagctgaggctatcaactccgagacatcaggaaactatcggacgttccttctttcacttgttggtcatggccattaggctatgtttcgaccatgggacatgatatttctatcgatccaccctaaatgcagagacctacctggaaaacttatgatgttgccatttatctgtcgtgactcttggatctaactgccacacatcacatatgcggttcctagtatgcttgtgtaaagtattcgtgtatatatttccatctgggtttcttgttggaagattctggatggggcaccagatcagctgttgctggtcacagtgggcttgcctggtgtctctatgacgccaatattattatgtcatgttcttgtggtaaaaaaaaaaaaaaaaaaaaaaaaaaaaaaaaaaaaaaaaaccaaaaaaaaaaaaangaaaaaaaaaaaaaaa

SEQ ID NO: 9868 - DNA, 1738 bp, Zea mays
ttttttttttttttttcaccaaagaaagggctcccatacttctcatagttatatgtatccatctgttaagtcacaccatgtaaacaagctccgaccacctacatgtgtcctgaagattttacatactatactggtagcaaggcctcggacagcacatgctcggctcctgctagtaagctacaggacttacaacctacagcaaaacaagatattctgcatacaatcagaaagtcgctgagccggttctcctcagttggtacttgggttccggaagaggctcagagaaaagtatattttccaactcctttaacgtggttagcttcttattctcctcttctaatcgagaaaccttgttttccagttcattagtgtatgcctgcttcctagcccttgaacgagcagctgactccctattcttgatcatcctcttctgccttctctccaccaacttatcagccacatctcctggggaaccacgctttctaccaggcatcggagaatcagaaagtgcacccatcatcggtgaagaaatgtggccatcagagtatgactccaaaatagcacttggtccaacattcagggactgaaggcttaactgacccggtatgtaagcacctggcaaactatgttgcctgtgctgatggggctcgatagctgtaatccgctgctgatagtggtctaaccattgtgcccctgctgtcaaacccgcagccccagtgctaccaacctgttccacactgcctatgccattcaagtccttcagatatccttcggcgacaaccccagctttcaccaagaaatcctcaagcgtcatctctccaagcgttggctgccgctcccgcttccgccgaccactctccccaacatttctgtttggtgcatcctggatgtccttccacacctcgtccacagttctcctgctgagctcaggcggcattgtgatacttccctgtcgcaagaggcccgaactctgctcatattggctggtagtgccaccatcagggtccaggtcatcaggaaagacactcttcagcagctcctcaaggttcatgctgtgtaggggttctcccaaatggctctgcacctcatcaagggtaaggttatacagagacccttgtcttgccagactctgcatctgcccgcgttgcgctgcaccggcaccaccactactacccatgcctcttccacctcccccagcctgtgatgcgattgtctggctccccataaatcaacaggtttcaggaacaacactagccggtctccgttttactgtcactcagatcaagcgaagacaaatcgcacatctctgggcagaaagatcacaacctacacgtgagacgcgcagcccttgccagcaccggagacggtgacgacatcgcctatcagctcaccacaggcgtcgaccactggcctgggcgcctggcgtcggtctggggctgcttcagtgcttcgaacgaaacaggaatgggtcaggcaacgaggcggaaggcgctaccttgtgtggcccgaccgaggcggagcgcctgagcagggcgcgggcggcaaaacaaatctttccctttcacttctcaagaggggcgccgccgcctagcatctgccattaggggaggaggtggaaggggaggaggcggccatgtgatgggtgtgcgaggaaaccatcggggtcgggggcctgagagagagatcgtgtagtgtgagggcccggcggtcctcccggcccccctcgagggtcccaatg

SEQ ID NO: 9869 - DNA, 2031 bp, Zea mays
aaaaatagtccaattagttgatactttatcaaataaccccctaaatggcattttatctgtaatccagtgtttgaaaatggcgtaataacgaagcgtgttctcataatggcaattcggcgcgagcccagatcgcacctaaccattttcgctaatctccctccaccgagccggccgaatcaaatcgaaccgcgggcagcgcgcacgcgcagcgactgccggcgatggcgagcctcaccctgccgccggcgccccccaacccacgccaggacgccatcgacctccacaaggccttcaaagggtttggatgtgacagtacaacagtgataaacatacttactcatcgcgattcggtgcagcgtggactcattcaacaggaatacagggctatgtatcatgaggaactctcccaccgtatttcatctgaactcagtggaaaccacaagaaagctatgtcgctgtggattcttgatcctgctggacgtgatgcaactgttttgagagaagctctaaatggtgacactatggatctgagagcagccactgagattatatgttccaggacaccatcacagttgcaaataatgaaacagacttattatgctagattcggtacttatcttgagcatgacattgctcaccacacatccggtgatcaccagaagcttttacttgcatatatggggattccacgctatgaaggtcccgaggttgatcctacaattgtgacacatgatgcaaaggatttgtacaaagctggtgagaaaaggctgggtacggacgagaagatttttatccgtgttttcactgaacgcagttgggcacacttggcatctgtttcttctgcttaccatcatatgtatgaccggaaattagagaaggttatcaagagcgaaacttctggaaactttgaatttgcacttttgactatcctcagatgcgcggaaaacccagcaaagtattttgctaagctcttacgaaaggccatgaaaggtttaggcactgatgacatgacacttataagggtggtggtgacgaggaccgagattgacatgcaatatatcaaggcagagtacttgaagaagtacaagaagccattagctgaggctatcaactccgagacatcaggaaactatcggacgttccttctttcacttgttggtcatggccattaggctatgtttcgaccatgggacatgatatttctatcgatccaccctaaatgcagcgacctacctggaaaacttatgatgttgccatttatctgtcgtgactcctggatctaactgccacatatcacatatgcggttcctagtatgcttgtttaaagtattcgtgtatatatttccatccgggtttcttgttggaagattctggatgggataccagatcagctgttgctggtcacagtgggcttgactggtgtctctatgacgccaatattattatgtcatgttcttgtggtatttccttcatttgttattctgtttttcgctgcttatcccatatccctgttttctccgtccttcacggagaccaacgtcttaggacataacccagagatataggggtacgtttcttggagtataaaagataggttttgtatcttattgtaagatatgactcatacgagggttgtatatatgaagctgtttgttggacttaaaaaaaaaaaattaaagatatgtcattgttagaacaacccccccccccgtttctttttatttgttgctggatagtgtaattttacactatacaccgacaaataaaaagaaacagagggagtacaagagcttcctaaaaagttgttccccaaaacatcatattaagggctgctgaaaaacaaactcctctaaaaaaaatctaaacccacatcagaatgctaataacttgtacctaaaacttttcaaaggggtaggcccacggtatggtagcaggtagattatttgacaattcagtccgcagactgctaggtattggagttcatagtgtcaagtgtaattggaaagtaggctaaacctgaaccatggtctt

SEQ ID NO: 9870 - DNA, 2580 bp, Zea mays
gcacgagaccattacctagaacatcctaatcgaaaagatacgatggttagaccttagtggaaaaccgttcccatagcccagtgttgtactgttgtgcgcctttgccactggttcatttcttttttttttctccgctcgaagccctcctatctcgatcgatttcctctctgctctgacggctctcgggaaaccctagccgtcgggcgccctgggcaagcccaccggaggacgccggagccgaaggggagtcgcaaagcagagatccggctacaacgtggccttcccgaccggttgtggcggcgatttcgcatcacatagatccgctcgtggccttcccttctgcgcggtcggtggatcctctggagctccgctggcgccccgagcagggctctctcggcgtggagggcggaggcaagggacgggtgtggcagcggcttcggccagcccacggctcccagcccctggcgggcagcactcagtccctggcggcgagctcgtattcccagaccttgcctccactttctggtggttctagcagcaattcgatttatggtgagaaatttcactccgaagatggttcaactctttttgcaagtgccggcagaatgtggcagtgttaatacagttgccgtggaagggaggagatctctttgtcacaatgttgagtccataatcaagtcattgacaaaatcagcaggcaggtatgaagctcggctgtggctctgtgccactgtctcgttggtccattcgctcagtgactgtggccagagggacctgtttcttgatctcttagagaggaagaattccaggcgtgatgtcgctgctcgcttgctgcgtatgattttcgataagaaacccaaaatggttgggtctattctagcaagaaaaggccatatactggaggatttcttccgaggaaatccaaacaggataatgcagtggtttggccactttgctgttactggggaatccacacatagaaagggagctaaggcactttcgcagtttgcatttgtaaatcgtgacaggtgctgggaagaacttgagtggaaaggcaagcatgggcaatctccggctgtagttgctaccaagcctcactattttcgtgatcttgatgttctcgagacagtcgagaatttcttatagtatgtcccagatttctggtcttctgatgagcttgctaattctatcaaagatggtgaaatactgcaaatcgatgaagaatattttgtagatcaatttttatacttaatgtatgaggagaattccaaagatgcatggcatgtggttgaagattttttgatggacgagcagttctcttctctttgccagcatcttcttatccatctggatgaggaaaggcttcttggtttcttaaattctttaggcaagctcatcaatcctactaggcagtgcaaggaattgacattcccgtgttgttggcttgaagttcttttatcaggacattatgatcacatatctcttgatgatcttgtctttttgaactgtgtcattgccaagggtagacaactttggcggctcatgaacgatgaagaacaacacgaagaatgggggcaaatggaagaacttttgaagggtgtaaaccatttgactgatgctgatcattttgctctcatgaaggaacatgtggagacagaattacctggtatgcttaagtgggtaggcattcagtcctggataattttctgtgaattgtcgaaagaatgcaaatcaggagattcttgtgaatcttttttctctcataacaaaatagaatttcacaaggctgatgattactcattggttcggaattatgggttctcaatttcacatacgcctgatattgatgttgaagatctaactggaagcagcaataaaaggagaaagaggaataggagaaagcgccataggtacgagtctgatgaggacaagtttgatgaactgcttgaacttggatcatctgatggaaagaatggtgttgagtcacagcgtggaagctggcgcctttcaactgatggtttctctgcttcttgggacatttcagacataccagatcacctttctacttgttatttcacaatttgggtaaagtgggcttgctttagatgattgtctacacagtatgtgtagtatatcaatctgggtgccttttcagctacagaatctatgagcatggcgctcaggcaggcatatttctgcaccaattctgcaacattttggtgatgggttctgatgatgcattctgggattgctgaacgctgcatgagatccaggacaactctctttagttgggatgctgaaggttgacacctgttgaagaattttggttgcataggcattgaatatggtccaggcatttccttgaaacccatttggactttggagttagttgtagagatctcaggtattgactaagctaagcaaaaacgagtttgtaattgtgttgtccagtgctagcgacattttgccaactacacctgttgtaaatgtaccagattgttgctgtgaatttgacaaccttaaaggaattattatactggaatttaattcttgggctgccagccaaaaaaaaaaaaaaaa

SEQ ID NO: 9871 - DNA, 1952 bp, Zea mays
  misc_feature (9)..(9): n is a, c, g, or t
  misc_feature (1935)..(1938): n is a, c, g, or t
  misc_feature (1943)..(1943): n is a, c, g, or t
  misc_feature (1949)..(1949): n is a, c, g, or t
ccggccggngatatctggccgcccgggcgccagtcccagtcccagtcccagtcccaggacagtcccgtcagcagccacttccccggcccctcccgctcctgctcgccggaggccgggccggcggcgatggggcacggcgctagctgcggccgaccaagcgaggaggtagacttcttcggcgcggcgcagtccggggacatggcccgcctcgccgccgctcttcgctcccgccccaccttgctcagccgcaccacgctcttcgaccgcctctccgcgctccacatcgccgccgcacacggccacctccaggtggtctccctggcattggatctttgcgtgcaccccgacgtcgttaaccgccacaagcagacggcgttgatgctctcggcgatgcacgggaagaccgactgcgtccgccggctgctcgacgccggcgccaatatcgtgatgttcgattcctcgcacgggcggacgtgcctgcactacgcggcgtactacgggcacgcggactgcctccggaccatcctctcggcggcggccaagtccgcgccggtctcggaatcctgggggttcgcgcgcttcgtgaacgtgcgggacgacaccggagcgacgccgctgcacctcgcggcgaggcagggctggcggcgctgcgtccacgtcctactcgagaacggcgccatcgtgtctgcttccagtggcgccttcggattcccgggcagcacgccgctgcatttggccgcgcgcggcggcaacctggactgcgtccggcaactgctgtcctggggcgccgaccgcctccagcgagactccgtcgggagaattccgtatgaggtcgccgcgaagcgagggcacgtcgcgtgcgcggcgctgctgaacccgtcgtccgcggagccccttgtctggccgtccgctctcaagttcatcagcgagctggaacccgatgccaaatctttgctcgaagcatccctgatggaggccaacagagagagggagaggaggatcctgaaaggcgccaagaatgcattgccctcgccatcgcaccccgatgacggcgctcatgacaccgccatagctgaggctagcgacgcggaggtgtgcagcatctgcttcgagcaggcgtgcagcatcgaggtccgggagtgcgggcaccagatgtgcgcggcgtgcacgctggcgctgtgctgccacgccaagcccaacccggcgacgcagtcccagccgctgccgacctgcccgttctgccgcggcggcatcgcccggctggtggtggccacgcggacgagggccggcgacgacgaggagcggtgcaagctggagtctcccaggcactgccgagcccgccggtccatgagcctcagcggcgacgcgggcagcaccagcaccctcatgggcagcatcgcctcctccatcggcaagatgggccgccggcgaacagagagcagcgagcaggtcgacgacaagccgtagcaaaatcattgtttcctttcatgcatccatccatgcgtaatccacatgtgaaatcggtgcgtatgataatcctgcaatgtcggcgtcgaacaaggcagcttttgtagattattttttggcaagtgagctattcacctgtgtaggttcattcaagagagagtctgtgcgctgacgtgctgtctaggctagatccgatcagcgatgatccgaataagcagctcgtccttgcctgtcagcccccatgcggccatgctccccgtggtccgtggatggagttcttgaaaggttgctgagaaaacatgcctgattcgcagagacctggcccggcatggcaatgagaaacggtacaaatccatgaggctgattcacacctcatttgcccgaataggggcagccccgctcaggttttggccagttcccgctctcagaatttagtcccaatcacatcttgattctggttctgaattnnnnaaaanaaaaanaaa

SEQ ID NO: 9872 - DNA, 1954 bp, Zea mays
ccggagccccaggaggacagtcccgttccagtcagagcgcagccagttcccccggcccctcccccctcccgctcgccggcggcgatggggcacggcgcgagctgcagccgcccaagcgaggaggtggacttcttcggcgcggcgcagtgcggggacacggcccgcctcgccgccgctcttcgctcccgccccaccttgctcgcccgcaccacgctcttcgaccgcctctccgcgctccacatcgccgccgcacacggccacctccaggtggtctccctagcattagacctttgcgtgcaccccgacgtcgttaaccgccacaagcagacggcattgatgctcgcggcgatgcacgggaagaccgactgcgtccggcggcttctcgacgccggcgccaatatcgtgatgttcgattcctcgcaccggcggacgtgcctgcactacgcggcgtactacgggcacgcggactgcctccggaccatcctctcggcggccaagtccgcgccggtgtcggaatcctgggggttcgcgcgcttcgtgaacgtgcgggacgacaccggggcgacgccgctgcacctcgcggcgaggcagggctggcggcgcttgtccacgtcctgctcgagaacggcgccatcgtgtccgcctccagcggtgccttcggattccccgggagcacaccgctacatttggccgcgcgcggcggcaacctggactgcgtccggcaactgctctcctggggcgccgaccgcctccagcgagactccttcgggagaattccgtatgaggtcgccgtgaagcgagggcacgtcgcgtgcgcggcgctgctgaacccgtcatccgcggagcccctggtctggccgtccgctctcaagttcatcagcgagctggaacccgacgccaaatctctgctcgaagcagccctgatggaggccaacagagagagggagaggaggatcctgaaagggaccaagaatgcattgccgtcgccaccgcaccacgatgacggcgcttatgacaccgccattgctgaggcgagcgacgcggaggtgtgcagcatctgcttcgagcaggcgtgcagcatcgaggtccgggagtgcgggcaccagatgtgctcggcgtgcacgctggcgctgtgctgccacgccaagcccaacccggcgacgcagtcccagccgctgccgacctgcccgttctgccgcggcggcatcgcgcggctggtggtggcgacgcggacgagggctggccacgacgacgagcgggacaagctggagtcgcccaggcaccgccggtcccgccggtccatgaacctcagcggcgacgcgggcagcaccagcagcacactcatgggcagcatcgcctcgtccatcggcaagatgggccgccggcgaacagatagcagcgagcaggtcgacgacaagccgtagcagaatcctttcatgcacccgtccattcataatccacgtgaaatctgtcgccgtcgtggccgccgccatcccatccctccaggaacgaacaagccgctgtttttgtagattatttttggcaaatgagttattcacctgtgtagatgcaaaaaaaaaaaaaaaatcctgtagataagctttgatccgatctgcgatcatccgaataagcagcccgttccttgcctggcagtggcaggccccatgcggccatgtgataatccatggatgggagtctcgaaaggctgctgtacatgtcttgattcgcagaggtatggcccggtccggtaatgagaagccggtacaaaaatccatgtgattgattgcccggggctgcggcgctcagggtttgcccggggctgcggccctcagcatttgtcaaaatccagtgaagatcttggttactgttctggataggatgaaaaggtctattttaccttctctagctatcgcaaaagttagttttttcttaactattaaaccgaccgaacgca

SEQ ID NO: 9873 - DNA, 2058 bp, Zea mays
  misc_feature (53)..(53): n is a, c, g, or t
  misc_feature (1951)..(1951): n is a, c, g, or t
  misc_feature (1996)..(1996): n is a, c, g, or t
  misc_feature (2008)..(2008): n is a, c, g, or t
  misc_feature (2012)..(2012): n is a, c, g, or t
  misc_feature (2041)..(2041): n is a, c, g, or t
  misc_feature (2055)..(2055): n is a, c, g, or t
ccaaatcgccaaaggatgttcgggtgcaagcatccttggttcttcagcagctntgtcaagccagcaccctgacattgcaaatgtttgttgcatgccaagggatccctgttttggtaagctttatggagcctgactatgcaaaatacagggatatggttcatcttgcaattgacggcatttggcaggtcggcaccccccggccggccgcgccaagaaacaacttctgtcgtatagcggcaaaaaatgggatgcttcctaggctggtgaatacactatatagcctgaacgaagcaacaagatttgcttcagtctcagggtcaggtgcttcagtaacacagaatggctcaaccccccgacgaagatctggccaattagacccttcagttcttgaaagttgcaaggcaaggctggatcatcatcattcatctggttctctgcaatctctacaaacagacgcagataagcaccatatattaatggactcgtcatctcctaggtttagtgataaaaccggcagtaacttggagaggaatgataacgacttggttattcggccacagaggcttagtgtttctgctggaaggacatctacagacagatcaccaaagcatgtagaactagtttcaaatggtcatattagcggtcaaaatgaccaggtccgacctctactgagtttgttggagaaagaaccaccttctcgacatatatctggacaacttgattacgtttgccacataactggattggaaaggcatgaaaccattttgccactattacatacatcgacagaaaggaaaacaaatggtgaacttgacttaatgatggattttgctgaggtctctagacatggaagagagaatggccatctggactcgagtataaaagtttcaaatagagttcatagtatgaaatatgcaccttcgacaagtgcctctaatgaaggagcatcaacttctggagctgcatcgcaaacagcatctggtgtgttatctggatcaggagtgctcaatttaagaccagggagtacaacatcatcaggcccattagctcagatgttctcttccatgagcgcagatgtggcacgcgaatatcttgaaaaagtagctgatcttcttttggagtttgcacaggcagacactgtggtaaaatctctgatggccagccaaagccttcttacaaggctttttcagatgtttaacaagatagaacctcctattcttcttaagattcttaggtgcattaatcatttgtcgggtgatcctaattgtctcgagacacttcaacgcacagatgcaatcaaacatctgataccgattcttgagcttcgtgatggacctctggtttttcaaatacatagtgaggtcctcaatgctttgttcaacctttgcaagattaataaaagaagacaggaacaggcagctgaaaatggaatcattcctcacttgatgaattttgtcatgtcagactcacctctgaggcagtatgccctgcctttgctgtgtgatatggctcatgcttctcgcaactctagagagcagttgagggctcatggaggactagatgcgtacttaaatctgttggaggatgatgtatgggcgtgcacggcattagattctattgctgtttgtttggctcacgataatgatcatagaaaagtggagcaggcactgttgaaaaaagaggcaattcaaaagttagtgaagttcttccaagactgcccagaacagtattttgtccatatattggactctttcttgaagataataatgaaatcttctaggctaaacacagcaatggccaccaatggcttgacagcattgctcattgcaaggcttaaccatcgagacgctattgcccgcctgactctgctgaaactcataaaggttgtctatgagcatcatcctcgaccaaaacaggtcatagtagagaaatgacgtccctcagaagctancaaaacctggttgaagaacgcagggtggacaacggggggggcatnaatgtttgggcnaacnaatgggcacctcattgctgaaggggtggnacatcaatacagtnttg

SEQ ID NO: 9874 - DNA, 4590 bp, Zea mays
cggaatgaccaaaaaagagtaagaattacagaaaagcccctccggtagtctctctcttttccgtttctctgcccccccccgcgtccgcctgcttctccccgtccgccaattcccttccccacccaaaccctagagcaaagctcaatggccctcgtcacgagttcgcgagagactctgcaccgccgccgttgactgctgatccaaccgctcccgcggcgcccggggccctgtcacggaggcggcggcgacatggcgtcgaggcagcacaatgcgcagttccacaaatccaagacgcttgacaacaaatacatgcttggagatgaaatagggaagggggcgtacggccgcgtatacaaggggcttgacctggagaatggcgatttcgtggccatcaaacaggtctcgctggagaacattccgcaggaggatctcaacataataatgcaagagatcgaccttttgaaaaatcttaatcataaaaatattgtcaagtatttgggatcattgaagacaaagagccacctccatattattttggagtatgtggagaatggctcacttgctaatattatcaagccaaacaaattcggaccttttcctgaatctttggtggctgtatacattgctcaggtgttggaaggtcttgtttatctgcatgaacaaggtgtcattcatagagatatcaagggcgcaaatatactgactaccaaagagggccttgtcaaacttgctgactttggagttgccactaaattgactgaagctgacatcaacactcattctgtggtcggcactccatactggatggcgcctgaggtcatcgaaatgtctggtgtttgtgctgcctctgatatctggagtgtgggttgcaccgtaattgaattgctgacatgtgtcccgccatattatgatctccaacctatgcctgccctgttccgtattgttcaggatgtgcatccaccaataccagaaggactgtcacctgagattactgattttctccggcaatgttttcaaaaggatgcgatgcaaaggcctgatgcgaagacattattgatgcatccatggttgcagaactcaagacgtgctttgcctgcttcccttcggcaacctactccattaaggaatatcgacggggatgatgaaagctcaagaggggacaataactcgggtttttgcgacacaccaggagatacccgagcaactattgcttctaatgttgaccaggtgaatgggaggaacggaccaaatatggactctgctgcgcaaagtaaatctgaagagcttcatgatggaaatttagaacttacagagggcattagttcgaacaatgtggcgcttgtgaaagataatgtggtccttaataaagatccgacactagttttacatgagaagttaccggtggaatcttcatttggagatgctgatttgaatggcaaagtaatggcacatgaactattgcaaggtggtctgccaagtaagatagagctggagaataaagaaagttcaactgttgaggatggtgatgtattctcatttcaggctggaagacagaatattgacttccaaatggtggttgaaccttcagttgttgagggaccgaaacagcttagtagatttagtgacaaacctgaagatgcctctttggaagacttatttccaccaatcgacaaacggggagataatggggctgaaccttcaacatcaactactgtccaagaacttcaatataatggtgtacacaatggattcgtgaaggggctcaatgccagggtggagaagcaaaaagaaaatgatagcgagtccatgaatggtggaaaactaattgaatttgccatgcagctagaaaatattgatgcatcgggttttggtgaacatattcctggagagagtcttttccctctgcagtctgtggagtacagcaaaatagtagcacaactgaaaccaggggaaagtgaagatgtaatactgttggcgtgccaaaagcttctatcaatcttcagtcaccggcctgagcaaaaacagatctatatggcacagaatggtttcctcccgctgatggaactccttgaaattcctaaaaatcgtattttatgctcagttctgcagcttatcaacaacattgtaaaagatagtacaggcttcctggaaaatgcttgccttgttggccttattccagtggtgatgaattttgcagaaccaaatcgcccaaaggatgttcgggtgcaagcatccttgtttcttcagcagctttgtcaagccagcaccttgacattgcaaatgttcattgcatgtcaagggatccctgttttggtaagctttatggagcctgactatgcaaaatacagggatatggttcatcttgcaattgacggcatttggcaggtctttaagctccagcactcaactccaagaaatgacttctgccgtatagcagcaaaaaatgggatgcttcctaggctggtgaatacactatatagcttgaacgaagcaacacgatttgcctcagtctcagggtcaggtgcttcagtaacacagaatggctcaaccccccgacgaagatctggccaattagacccttcagttcttgaaagttgcaaggcgaggctggatcatcatcattcatctggttctttgcaatctctacaagcagatgcagataagcaccacatattaatggactcctcgtcatctcctaggttcagcgacaaaacaagcagtaacttggagaggaatgagaacgacttggttattcggccaccccagcgtccggtttctgccgggaggacatctacagacagatcaccgaagcacatagaactagtttcaaatggtcataataacagtcaaaatgaccaggtccgacctctactgagtttattggagaaagaaccaccttctcgacatgtatctggacaacttgattatgttcgccatatatctggtttggaaaggcatgaaaccattctgccactattacatacatcgacagagaggaaaacgaatggtgaacttgacttaatgatggattttgctgaggtttctagacatggaagggagaatggccatctggactctagtataaaagcttcaaatagagttcatagtatgaaatatgcaccttcagcaagtgcgtctaatgaaggggcatcaacttctggagctgcatcacaaactgcatctggtgtgttatcaggatcaggggtgctcaatttaagacctgggagtacaacatcatcaggcccattagctcagatgttctcttccatgagcgcagatgtggcacgtgaatatcttgagaaagtagcagatcttcttttggagtttgcacaggcagacaccgtggtaaaatctctgatggccagccaaagccttcttacaagggttttccaaatgtttaacaagatagagcctcctattcttcttaagattcttaggtgcattaatcatttgtcgggtgatcctaattgtcttgagacacttcaacgcacagatgcaatcaaacatctgataccgattctggagcttcgtgatggacctctggtttatcaaatacatagtgaggtccttaatgctttgttcaacctttgcaaaattaataaaagaagacaggaacaagcagccgaaaatggaatcatccctcacttgatgaaatttgtcatgtcagactcacctttgcggcagtatgccctgcctttgctgtgtgatatggctcatgcttctcgcaactctagagagcagttgagggttcatggaggactagatgtgtacttaaatctgctggaggatgatgcatgggcatgcacggcattagattctattgctgtttgtttggctcacgataatgatcacagaaaagtggaacaagcactgttgaaaaaagaggccattcagaaattagtgaagttcttccaagattgcccagaacagtattttggccatatattggacgctttcttgaagataatcacgaaatcttctaggctaaatacagcaatggctaccaatggtttaacaacattgctcattgcaagacttgaccatcgagaagctattgcccgcttgactctgctgaaactcataaaggttgtctatgagcaccatcctcgaccaaaacagctcatagtagagaatgacctccctcagaagctacagaacctcattgaagagcgcagggatggacaacggggcggccaacaagtgttggtcaaacaaatggccacctcattgctgaaagcgctgcacatcaatacagtattgtgatattggtggatcatatgttttcctctcaagttgtatatgcttgccctagaggagaaggtgccttttccttttgctctgctgtggtggtttctcatgagcaccagactcatctgttgtacctgatccctcttttttcgggagaaaggttttttaggtgcaggatgaaatggacgttctgtccttcagtgttgtttatatttagagtgttagtgaggacattgtaaattaagacatataattaataaacaaaacccatgttgagatatttgtttcatgtgttagtaaattttgcaagatatttcttcaaccgagaaggggggccggtac

SEQ ID NO: 9875 - DNA, 1090 bp, Zea mays
gccggccgggccgggtttcaatacatagtgaggtcctcaatgctttgttcaacctttgcaagattaataaaagaagacaggaacaggcagctgaaaatggaatcattcctcacttgatgaattttgtcatgtcagactcacctctgaggcagtatgccctgcctttgctgtgtgatatggctcatgcttctcgcaactctagagagcagttgagggctcatggaggactagatgcgtacttaaatctgttggaggatgatgtatgggcgtgcacggcattagattctattgctgtttgtttggctcacgataatgatcatagaaaagtggagcaggcactgttgaaaaaagaggcaattcaaaagttagtgaagttcttccaagactgcccagaacagtattttgtccatatattggactctttcttgaagataataatgaaatcttctaggctaaacacagcaatggccaccaatggcttgacagcattgctcattgcaaggcttaaccatcgagacgctattgcccgcctgactctgctgaaactcataaaggttgtctatgagcatcatcctcgaccaaaacaggtcatagtagagaatgacctccctcagaagctacaaaacctgattgaagaacgcaggggtggacaacggggcggccatcaagtgttggtcaaacaaatggccacctcattgctgaaggcgctgcacatcaacacagtattgtgattttgatgggtcatgtgttttcctctcaagttagtgtttacgttttcgctagaggaagaaaaggggcgtccttctctttttgcctccttttctgctgtggtggcttctcacgagcaccagactcatttgttgtacctgatccctccttttttgggagaaaggttcaacgttttggtgcaggataaaatgggcttgctatcctccagtgctgtgtatatctagcgtatgttagtgaagaaattgcaaattagacaatctaattaaaaaaatttaaaccatattgacatttaaatcaaaaaaaaagtaaaaattccctagcctgacccaaaaaaaaaaaaaaaaaaaaactcgagaggggg

SEQ ID NO: 9876 - DNA, 1935 bp, Zea mays
tctatgctccaagtatgtgtttgataatggcgagtcctaatattgttagtctttattattatgctttggttaggaagagcataggatatgtgaataagcgtattatctcgtaaagtttgaattagcccgaataggttggagaaatgtaattactatgtttagtgatatatcgatacctagtgtttacttgcgaatgtttcaatgtcatgacattagaagtttaatttattatcgtgtgattttgtttagccttatgttattcatctttataatcattcatatgcatctggcatatcagataggtacgctagatgattatgcgatatgaagggcatgaaccagactgaaccacaagatggatgatctgacccagtgccaggatgagagatgctcaccgagtggtcgtcgtttgacaacactaacttagtgttattcgaggcaactctttcacatggatttttaaaatctgtagtgtttaaagaaccagaaatggatttgcttgtttctaattcattttgcttgttggatgtcgatatgcacatgcattttcaggtaaattcattccttctactttacatcccttttttatttccttgcagccattgtctcatatagataaccttctgcagtcagcttatgatcaaggggacaaataagatcatgccaactctactccatgtactgctggtgtcacaggtttgcccactaatcttgattgcattttgcttcacttatctatggatttatggttctgcactacaattctaaaacctgtttttgagttggatcgtttagctgtattccccaagagctttttacttaagtatctgggacatgagagaacatagttttgttcacaataatgcaaccattacatcttttttatcacagccttgttatagcagaatatggctaaacgagtgaaccataatatacttcattcgatgctttgttaactgttatagcagtatgcaatgcatatagatatagcatactcataattggagtagcaaaccatcttacttattgtttagagtgagaaaactatagacaacagaacattttgtctacaacatgacaatgtgctcgtggctgtgctcctttttttgtgctttttagttgaaatctggtgctacttaaatctaactaatttctcagcacacaacttgccttctgttgcactattttctgagcacataattgtctgtctctgcctttctgtttctaggtccttaatgctttgttcaacctttgcaaaattaataaaagaagacaggaacaagcagccgaaaatggaatcatccctcacttgatgaaatttgtcatgtcagactcacctctgcggcagtatgccctgcctttgctgtgtacttaaatctgctggaggatgatgcatgggcatgcacgacattagattctattgctgtttgtttggctcacgataatgatcacagaaaagtggaacaagcactgttgaaaaaagaggccattcagaatttagtgaagttcttccaagattgcccagaacagttttttggccatatattggacgctttcttgaagataataacgtaagagtacaaggcatattttctgattagttgcaatcatgctacagattgttgattggtacattgtatgcatgttttcggcaggaaatcttctaggctaaatacagcaatggctaccaatggtttaacaacattgctcattgcaagacttgaccattcaaatttggtggtcacaaaagtgtggagacttgaattcatataatgttaggcttaacattagtgcaaacagttgtattttagtttagatttagagtacacttatgtgtgcgttgtttgataatgcttatttatgatatattgaatggtacttatttatattatattaattataatgttgttcaatatatgtgtatgtatatttctc

SEQ ID NO: 9877 - DNA, 2094 bp, Zea mays
gagtgacactcagcaaacgagccgtctgcctgtctcttctgtcttctcccaatcctgtccatttcaattcaagcacgcgcccctcgggacgcgccccattgaacagaagcaaccaacccaggccaacccgaaccccagaccaaactgcccccttccgcctcgccgccggcgatcgccggagatgtcgtggctcgcccgctctctcgccacatccctcaacatccccgacaactccggcgctgacgatgacccggatgcctcccacaccccttctccctccgcgcgcatcccgccgtcgccgccgctacccactcaccctccgcattcgggcgcggcggagggcgtcaaggaggaccttaccgagctctccaaaaccctaacgcgccagttctggggcgtcgccaacttcctcgcgccaccgcccggggagacgttgccgtcaccctcgcactctccccaatcagcggggggtcaatccgccgatgcgaggacaccacccgagatcgccgggatccggaacgacttcgctgagatcggtgggaggttcagaagcgggatctcccggatctcaggtcacaaggccgtctctgggttctctaagatggcctctagtttcttcgctcctgatgacggcgaggaggacgagtgggaagaggagcggagacgacagattaggcatgagatgggagaggaggcggtatggcacgaggaggcggagggcgacgaggagtggcatcagtgggaggagagggtaagacttagggtggaggatggcgatacaaggcatgagttggagatggagagagcgagggatgaagaagatgacgaattggaagagcagagagcgaggcatggggatggtggcgaatcaggggagcagacaacaaggcctggtgaggatggcgaactggaggagctgaggataaggcatgaggaggaagtggaggaggaatgggatgtgattggaatcactgaggaggttcttgcattcgccacaaacattgccaggcacccggagacctggctcgatttcccgttgctgcctgatgatgatgagtctgatggaccattctcatattttgatatgtccgatgctcaacaagaacactccttggctattgagcatcttgctcccagattagcggctttgcggattgaactatgcccaatacatatgagtcaagaatgtttttggaaaatttactttgttcttctacatcctagactgaacaaacatgatgctgagcttctatctaccccacagatcgtggaagctagagcaatgcttatgcaacgtttgcaataccagtccaaacttgaaactgagcatctaggtcatcataaggatgaccttggagttcaattacgaggagacaccttgaaagatgctacagaagcattcccattcacgcgatgggaagcagcttctgttatgcccataacagaaattgagattgagaagcatcctatccaagtaactgaagttgcagttgtggacaaatcggtcatcgaagaggagctgcccaagggtcatgctgagacctcaaatgttttgcaagaggcctttgatgatgacatagacgattggttcgaggaggctgatcttgctggccacccaactatccacataggtgacgaggaagacgtgtcttttagtgacttggaagaggatgacgtgaaatgatttatagttgcaattgcaatttgcaaagggagaaatcgacctgtgtattggaaactggacacctctgctgtaaaagaaaatggaggtgaaagttgttcgtagacacctctgctgtgcaagaaaatggagaggtgaaagtttttcgtgaatgggattgggtgtacattgaaaactgagcggtgttgttcgcgaaaagggtgtacattgaaaactgagcggctttgttttgcactcaagctgctagggtgaacgcaatgtgatccactcaagatatgatggggtgctacattttactagctttacagtttgtaatttgattcatactcttgtgtacataagcattcgtgatgttctaaggtcagacaataaagttccatgtgttacaatcaaattttttctgttatttggtc

SEQ ID NO: 9878 - DNA, 1990 bp, Zea mays
  misc_feature (831)..(831): n is a, c, g, or t
  misc_feature (866)..(866): n is a, c, g, or t
  misc_feature (1035)..(1036): n is a, c, g, or t
  misc_feature (1044)..(1045): n is a, c, g, or t
  misc_feature (1055)..(1055): n is a, c, g, or t
  misc_feature (1069)..(1069): n is a, c, g, or t
  misc_feature (1073)..(1073): n is a, c, g, or t
cgaaccaaacacacctaagttcttgataaattgaacgtcactctgcttacttttatctgatacactttatgtacagttttgtactgcttcctgacataaattcttggtactcgaggtccaggaagttattggaaccgacgcaccaatggaagcgtctatgcagaacaacaggtgcattctgcgaacaggtatcaagacctgatgttgttgaagttattcgagagcttcccaaggtgtgaccataggaggctccccagggaaggtctgggcctctcctgaggctgagacccggcggcgggcggggctggtacgctagtcttcctcaccggcggccagccaggggcctccttcacaacgtcgagcgagatatccatctcggcgaccctcgcctgcacggcgcgcaacgactcagcgcgcacctcgcctccggtgtccgtgacgaggtaaaatatgccgaaggcctcgtccttgtgcctcttgagctcaactctcagcagcgacaggccgtgctcccgcagcaccctggtgaaatccgatagcaagcccgaccggtcggcggcgcgcacctccaccctgacgccctgcaacgttcaacgccggccgcgtgttagtttaacgaggcggcggtcggcgcccgataagtatggcggcgaggaatggtcgagcctgacatgagtggccctccgctccaccgcggccacgaggcaccgggagaccttctgcctctcggcgctgttgtcgaccgtgcgcccgtccttgtgccggatgtaatactcctgaatggcaagaggcccctgggatccgacggtagcgtggaagacgacgtactgnatgtcggtgagcgcgcacaccgtgtcgaagagcancctggggcggtccctgctcgtcatcttgacgacggcgtagccccgctcctcccagctgtcgatggacacccgcgtcacggcgcggcgggccgtccgcgcggtcgccgccttttcgcccacgctgaagaggtcctcgtcgacgggggtcggggccgggccggactcgtannccctgtcnncgtgcatganttggtgcaggcggngctncgtgtgcacgcggccctgcgcgggctccgacacgcgcacccagtggcgctccccggtcacgttctcgcgcgcgtccaccacggcgttcaccagccgctcgatgcgcgcgcaccggcccgggagcagcgcggcgccgcccgcggtgtccgtcacgtacagcaccccagccgcgcggccgttgtgcgtccacgcctgcccggacgcgacgtggcacccgttgtcggccagcacggacgtgatggaggacaggagccccgggcggtcgtgcaccgtgaactcgagcgcggcgcagcccgaaacgtcggggccgcccggcccgaccacgttgcccaggcacgtggtgaacctcggagacgggccgttgcccggccggtgggtcggcacgagcgcgcgctggatgaactcgggcagcgacgggtccgtcagcttgcgcccgatctggtccgtcacatggaacacatccatgagccagccgccgtcggaggagatgtacgacttggagatgacgaggtcgagatcggtgagcagctgcaccatctccagcagcacgccgtcccggttcacgctgtcaaccttgacgagcgtgcagtcctcgcgtgtctcattgtcgacgacgacccctggggtgccgaagcggtcgagtagcgggtcgaagtccggttcgaagtacggcccggagacgtacttcatcaccgccgagggcactgccgtgccgctggcttcctccttggacagagcttcttgattccgcagatcttatttatctctgcctaggtggaaacgatgaacgcgccccgtgttcacatgcgacgccgcgggtcgccggcgcggcggcgtggcagcgcaatgacagcatcctcgctggggacgcgggatatcaccaacgtacccttctcccttggggtcgacgcggccgc

SEQ ID NO: 9879 - DNA, 7057 bp, Zea mays
  misc_feature (524)..(524): n is a, c, g, or t
tttatttacacatgttgctgcatgcatgcaggattaagtttcacaagtttacaaagctagcttttatgcgccaagatatatgatcatgcatgacaggtagctcgatagatcacgtgaaggtcgggcgcgtatgggatttattctaacgattttttttttttgctactatatatatgcagagaacttttaccatctatggtcgaagaaaactagatcgctggtgaagaacggagaaaacaaatgacgtttcgacgacgaccagcagctagcatgcatgtttttgcctagctagttcatgtacgttattgcatcgtccgtcgtctgctctggttgacgattaaaagcttgcagcactagaaaccacacacgcgccatcgaacatctacatcgaacaccgacatcgaatcgcgcgcgcagcattgtcggatgatggagcagtacgtactcatgtgtgtttgtgtgtgtgatggaattcattactgttatcgtgcggcgctttgatttgttttctgttgccggtacantccaaaagaatcgatactggtaaccggaagaaaacccaaaagctggctggctatcagcacgtacggtctattaaaattcgcataaaaaagggggaagtgtgctgaacatgtaaataaattaaatacacatcaaagcaggagtacttaatttattagctgctgtgtatgcatgtgtgcattgatatgaaaattagcatgcatccgtaccttgcgttaggatcctaaagcaaagcctgataatatagtatccatgtagtaattgttagctccctttctctattaatacatggctcgtcttctttggcgggtttattttggttcgtggctaactgtatcatatatattttgtctaagtttaatcgtgcgaattgagaaactaattttaaatagaaaagaatagatagacgtaacaagttaggcagcaagccaaaaacaagtttctcggtttaattttatgcgtaagccggctgtacacgcttctgttgtctttttttttacacctcagcgttgagtcctcttacgataaacaaacctcagaatggtgacacgcctacacaatcgccaaatatcaaatcaataatctaaaggtaaaaaagaaggggggaaggcgctttatagctagcttttctcctttacccaccgagtgtatttggacatatataataatatgaaaaaaaaagaaagggaggcgctttattttaatttctggctcgctctcgcccagctttcctcgtctttagctaattgcgacccatggaggagaagcactcacataaaatactccccgcctgcaggattattgctgcatatgccggccgtgcctcatgttatatttgcagcagctacacatacagcagcacatatatataaataaacatagatgatgcatatgtgtacactctatagctagctagtgttattcgatctctctctctatatatatacatatgtgtcactcacgactccacagatagatagctacacgtacgtacgtgtgtgtgcaaacaatccgatcagctgggaagcaaacaacaacgaacgaacgccatgatggcggcgtgcttggaggcgaagaaaccctacctgatcgctcttgccatccagatcatcggcaccggcatgttcgtcatctccaaggcagccttcgacgacggcatgagcaccttcgtattcatcttctacaggatggccgccgcctcgctcatcctcgtgcccacagccattgtccaccaaaggtatatataatttcatccatatcgtcgtaagaagggtgcggtgcatgcatttataagaagtgcacccagttaattaaccatgcacatgcatgcatgcatgaagatgcagcaaatatacgactgcgcgcgcgcaggtgtgtcgtgtgtgtgtaggtaggtactcctactttcgatgacatgcatgcatggcaaattaatatactacgtacggtgctcggtgcacacgccctaacgacgacgtcgtatcgtacgactctctttttcgaattaatttaaaaaaacagaaattgtacagctctttatttgttggccgtatatgcatgcaggaagaatatgcggtccatgtctgggaagctgcttctcaagctcttcttgctcgccttgatcgggtacgtacgcatatacatggctcatgcgtgcatgtgttaatttggaatcgatcgatagacgatgatgtctttgctcatgcatgcacgcattcacatgcctgaaaaaaatatattaaatttttttgcaggaacacattcagcttgaacacgtacaacctgaccctgaagctgacgtccgcgacggtggggtccgcgctagccaactccgtgcccgtattcaccttctgcctggtgctggtgctgaggatggagacggtgaacctgaggacggccgccggcgtggccaaggccgccggcgtcgcgctctgcgtcgccggagtcctcgtcctcgccttctacgccggtccggccatgagccccgtgaaccaccaccgcgccttcgccgccccgaggcagcacgccgcctccaccggtggtccgccgagcaggtcgaggtggatcacagggacgctgctcatggtcctcgccaacgtcacgtgggccctctggatcgtcctgcaggtatctatctatctacctatccatcccctctcctttccttgctgtcagtatcagatgtgtccttagctatttattagtactcccttggttcctgtatataagacgtaatcacttctgaattaaagaccaaaaaatacatttaattctctttattccattacgccttattatattgtgggacaagaattaaaattagttacgcgagtagcagatcccctggtggtttgctaaacaagtttcatccagtaaattaagagcaagtacttacttactagaaggcgaataatctagtttgattaggtatgatatatagtgatgtgtgtgtgcagtgtccactaataacatgcatgatgcatccaagttaagcatgcatatgtcctttcacccggtgcctgctgtgttggactattattccatgcaaacatgcaacgttaattttcaggtagaagctagctagattaaaaaaacaccccgaatatactgctacaagctatgctaggcacataattaatgtatatatgattctgttaggtataatagagacatgtatttatatatattgctagcagtggcaggggaccgagcaataaagttagttacttggaatcttgagaccaaataattaaataaatatacatgttcttaatatatgtttgtggcctgcgtgcgtgcagtcggcactgctgaaggagtacccgaacaggatgcttgtgacggcgacgcagtgcgtgttcagcatgatgcagtcattcgtggtggcagtggtggccgagaggggtgacatgtccaagtggaagctccgatgtgacattaccctcgtagccgtcctttacgtggtaattatatctagaatttatttactaacttatatattgatagaatattttttttattattgtctttttttttctgattcatgcatgctatgctaccgccagggttttgtggtgacgggactgtcccattacctccaagcatggtgcatggagctgaaaggccccgtgttcctggcgatgacgaacccgctctgcttcgtcttcaccatattcagctcctccttcttcctgggagagatcgtgcacctcggcagcatcttgggtggagctctgcttgtggccggcctgtacagcgtgcactggggtaagctcaaggaagacaggaggtctgaggcggcggaacaggagaagaccaagccgcaggaagaaccagcagcagtagctggagtgccctccgtgctcgaccaagcgtgatgctcatacatatggttgcttcatcagagcgccctagcttgagcgagctccatcgaccatcagctaactaatgaactgttgggaccaatatgcatgatgcatatcactgtgcatgaagaaccaattaattaactgtggattattaagagagtgagcatgtagttctacttgcatgcatctgggtattttgtatagaacacatcaagttgcgtctgtgacatcaatgcaagctagggcatgcatgcattccatcattcaatgcatgcataactcacttgaatgctgttgtatccactccacccatgcactttgaataaatacatatgtcgacttatatatgcgtgaagttattacgacataaaataaatcgactgagatcgatcaatcatatatgtctcctcttgttggatccaaaggcatgcaacacctaagggccggtttgggaactatgtttctcaaagcaacagtttataatagcacaattcaccgcatgccatgacataactatgatatatttaacatcaatccaatccaatatctgtttagagataaaatatttcagttgtagtataagagaagaggagactgcagctgcgtgcaaatgcaagctagaccaaagtcttttaaacccaaaaatatgcgtgcaagtgcaagctagaccaaagtcttttaaacccaaaaataccgtggtattgataaaagtatggtttaaaatacaagatttctagatatgctcccaaacgtgttttggtctaaaatattatggtatgtttaaataccacggtattatcttgtaactaaagaaaatacaatattccaaacagggcataataagtgtctttccatccaccgaacggtggccctcgtgggatgggacgttgacgtcagttcaatggtttccatacggggatttgtgtgtggtggctagctatagacagggagaggatttgctttatttaatttagttcttattaaaaaaacagtgaagatccatggaccacatcaacagagcttagctgctaaggaagaaagaaacttgtggctaacatagctcgttaattacaccgagtgcatgtacaaataaaagggtccttttgatcgattggctatagctagtaggccgcgggagccgggaggtcccccgcccgcctatggtcgatgtgagagctaaagaaggccagcatatatatgtggctgctatgcatgtctttctcctttttcgtggcatttacttgattgttggtgttaatttgtaatggttttttttaacgtatatagtttatttcttgatgcccaagttcataaaaaagttttttttaaaagaactaagctaatgagatttgttgtcaccagtagtagataattgtagcgagctgctaaataaaagaacacatcttcgtaaataaaacaacaaattaataatgaaacttgtcctgcttatgacatttaggggttgtttggtcgtctaaggactaaagtttagtctctacgttttttggtttcaagaactaaaagtattcaaaacatattaaataatttataagacgaccaaaatactcacttagcattatcctgtaattagtgcaactaaaataaagagggaaatggaattaacatgatttagtccatttagccatcccttaaaagactagatactaaaatactttagtctttattttagtatcaccgtttgataatttagagactaaataagattaaaatagagggactaatccctcgaaccaaataggaccttacttgggcagggcaagagctagcagtttggcaatatatgggtcgtcgcgtgcttgtcgattcacacctcactaacacgtacgtgctttgtttctgatctggttttgcagttaactgtctgctgctcaatttcattatgtttgtggtccagagagagctaggacggaccgtggatgcgtggttagcactgaacacgtcgacaagcaagtgtacatgagaggatggtgatgagaatggcgttgccgttgaccgaagccaagacagcgattggaccaattaagttaagatgggagcacttggtagatggacggggtcgccaacaaacagcacgtacaggtgtcgatccacatcattaagatggcgtagaggctccagaaaattttaccaaattggatctacagccggtagtcaacagagactggatagcaatttatcttgactagccaaagtagtcatcagcaattctacctcaatgctcaacggtgagatcattggcagagtgtgatacctcacaagtagagtcgtcggtaatatcctcgttgttgccgtccaccacatcatcaccgagcgccatggtgcaaagacctcctgtggtgtcggcgaggaagcagagtctgtttagcttgtcctcgactcgcctgtcgatctcctcatcgctcgaggaagacgttgcgtcgttggagtcgtggtcgaggttgctgagagaggcgaggaaggcatgctccttgatcatggccttctggaggtacttcttgttaagcgcctccttgttgaatcctctcgtggacttgtgcttgctggaggtgtgtacttccgcttgcccttgcgtcgaccagagtggtggtcgcgcgggccagcctcctgcttgcccttcttgaggcaactggcgataaagtggttgaggtcgccatagttgtagcatccatcctttgaccagccacgccaccgactcatacggttgttgtggaaccacatgaactgactggccacagtgccagctcttcatccccatggttctccacctgctcctctggtaatggtgaacaaagaagaaatagcaaacatagtaggtgaggggttagaagcagaaccacctctagagaccatggccatggtgggtgcaccaggattctcaatcttcccaggactggtgctcaatctcagtggacttgagcttgctgaacaactcatccacggtgagagtctcatagttggacgactcaatgatcgccgagaccttcacctcccaaaccctctgatccagagcatgaagtagcatgagcgctctctcactatcatcataaggtaactatgctttgttgacacacatcttgttcacaatggactggaaccaaagaaaacaaagtgtctatgatctctccaaccaactgaacaaagttctg

SEQ ID NO: 9880 - DNA, 1633 bp, Zea mays
cggccgcgatagctagctagtgttattcgatctctctctctatatatatacatatgtgtcactcacgactccacagatagatagctacacgtacgtacgtgtgtgtgcaaacaatccgatcagctgggaagcaaacaacaacgaacgaacgccatgatggcggcgtgcttggaggcgaagaaaccctacctgatcgctcttgccatccagatcatcggcaccggcatgttcgtcatctccaaggcagccttcgacgacggcatgagcaccttcgtattcatcttctacaggatggccgccgcctcgctcatcctcgtgcccacagccattgtccaccaaaggaagaatatgcggtccatgtctgggaagctgcttctcaagctcttcttgctcgccttgatcgggaacacattcagcttgaacacgtacaacctgaccctgaagctgacgtccgcgacggtggggtccgcgctagccaactccgtgcccgtattcaccttctgcctggtgctggtgctgaggatggagacggtgaacctgaggacggccgccggcgtggccaaggccgccggcgtcgcgctctgcgtcgccggagtcctcgtcctcgccttctacgccggtccggccatgagccccgtgaaccaccaccgcgccttcgccgccccgaggcagcacgccgcctccaccggtggtccgccgagcaggtcgaggtggatcacagggacgctgctcatggtcctcgccaacgtcacgtgggccctctggatcgtcctgcagtcggcactgctgaaggagtacccgaacaggatgcttgtgacggcgacgcagtgcgtgttcagcatgatgcagtcattcgtggtggcagtggtggccgagaggggtgacatgtccaagtggaagctccgatgtgacattaccctcgtagccgtcctttacgtgggttttgtggtgacgggactgtcccattacctccaagcatggtgcatggagctgaaaggccccgtgttcctggcgatgacgaacccgctctgcttcgtcttcaccatattcagctcctccttcttcctgggagagatcgtgcacctcggcagcatcttgggtggagctctgcttgtggccggcctgtacagcgtgcactggggtaagctcaaggaagacaggaggtctgaggccgcggaacaggagaagaccaagccgcaggaagaaccagcagcactagctggagtgccctccgtgctcgaccaagcgtgatgctcatacatatggttgcttcatcagagcgccctagcttgagcgagctccatcgaccatcagctagctgatgacctgttgggccctatatgcatgatgcatgtccctgtgcatgaagaacccattaattaactgtggattattaagagagtgagcatgtagttctacttgcatgcatctgggtattttgtatagaacacatcaagttgcgtctgtgacatcaatgcaagctagggcatgcatgcattccatcattcaatgcatgcataactcacttgaatgctgttgtatccactccacccatgccctttgaataaatacatatgtccccttatatcgagagaaaaaaaaaaaaaaaaaaaaaaaaaaaaaaaaaagaccg

SEQ ID NO: 9881 - DNA, 2357 bp, Zea mays
  misc_feature (709)..(709): n is a, c, g, or t
tttttgaattcaaaattaaacatgattcttaaatttgaatgaatgcacaccaagacacttcaactaataagtatatagatgtaccagtctgtgatgcaacaatccatgactctgttaggttatattatttgccaagatacaaatacatattcaaaataactctccctttttagagaaaaggaaaagaaaataaatctttcacggtggtagatttcatatttgtatttctaagttgccacataatcatgaaagaaatgaaaccttggttaaaacagcctctcatagtgaagagtttcattcagcacagtttcacaattaatatgcaagagataatatgtctaggtaatgattaacatgcgtgagaagggctttcttcttactccctccgtttctttttagttgtcgctggatagttcaattttgcactgtctatcgacaactaaaacgaaacggaggaagtactatctacccaaagttgtattaccccctttgttgagttttttttttaaattttttttgttggacctaatatgccgagacgaagatctgttccccactaatgattacttatcaaatatgtaggtaattgagaaaacggatttagaaggttgatttgatatatttcatgatagatggaatcaatatctaccttaattagatgaagattttagatgttactttagatatgttcataattgtagagatgagnaatttgggaaaataaattagatccaaatgctaattattaccagtgatgattatgatggtctaccaaatgacgaccagagatatttctatatatcgtttatttacaaaaagaagttggttgatgatctaccaaatgctcggtgtcgctcaagtctcactgtctaattaatagccattattgccttccgtgttaacagatccacctaagttcgaactttgggtgataatacttttagctgttgcgagtgtgtcatttgctgctttagtggctgctctactttggattatcatgcacagacattattcccgtgcctcatcgatgaagatagagttgcaaggtaataaccctatcatttaacttcataatcccctaataaactaaacatctagtcatattaatttggagcgaaaaatctttctattcgtcgtcccagttgcaagggaattctcgtaccaggagctgtctgcagcgaccagcaacttcttcaaggacaggaagctcggcgcgggccagttcggggaggtgtacagaggtgagctgccggaccctctcatgccgccggtggcggtgaagaggctgacgaggcagatggaggcgcggacccggaaggactacgtgaccgagatcatgaccttgggccggctcagccaccggaacctagtgaagctcgtcggctggtgtcaaggcggcaatgagctgctgctcgtgtacgagctggtaacgaacaggagcctcgacgagcacctccacaggtcagagcgcctgctggcgtggcctgagaggtacaggatagtgctcggcataggctccgccatagagtacctccacaccggcgaccagaaccccatcctgcaccgcgacatcaagcccagcaacgtgatgctggacgatgacttcgaggccaagctcggcgacttcgggctcgtgaggcagatccatccaggacatggctcttccctcgagggcaccgtcatgatcgggactagggcgtacatggatcccgtatgcatgagcaccaacacggcgagcacagcgtccgacatatacagcttcggagtgctgctgttggagatcgccaccggcctgatgccgaccgaggtggcgggcccaggaggcctcctctccaacaccctcatcagcactgtccgggaatactacggcaggggatcggtcctcgagatggctgataggcggctgaacggcgacttcgacgagggcgagatggagcgggtgctgctcgtcggtctcttgtgtgtccagcaggatcgccgtcaccggccggaaatcagaatcgctgtcaacatgctctcgaatctcaagcttccgagtcctagaattcgttcctgaaaagattcactcgccaataatagggtgccttgcctctcgaatctcaggcttccgactcccagattcgttcctgtatgtacatagtgctttgtgagttagcatttggtctggctttgatcacgtattcctctataaactagcaagctggctcgcacaagaactaatgtgatgtttggttcacatatttgtaatgtaacgggtaacagataacgttaaatcatgtttatctaagtccaatcacaatcgaataccatactaaaaattaatatcggtcagcggccaaaaaaaaaaaggggcggcc

SEQ ID NO: 9882 - DNA, 1861 bp, Zea mays
acaactacttcactcgctcgctcgtgaagcgtctcgctgccctgcccccaccgatccaccacccccccactcatcacccctcagccaccgcccaccggccatgtcgtcgccgtcggtagccagcctccgtctcccgatgctcccagcgtcgccgcccctctcccgccgcgctatcgccggagttaccccgagcgcggccgcaccccgcgctcttctcctacaacccctcgcgcccaaggcgctcgcggcgtaccaccagcctgcgctcctcctccaccagcgacgccggcatggaccgccccccgtcgccgctgtcactgcctccaagccggttctcaaggacccgaagaagtaccaggagtgggactccatgacggccaagttcgctggcgccgccaacatccccttcctactgctccagctcccgcagatcgtcctcaacacccgcaacctcctcgccggcaacaagaccgcgctcttcgccgtgccgtggcttggaatgctcactgggctgctgggcaacctctcgctcctctcctatttcgccaagaagaaggaaacggaggctgtcatcgtgcagactcttggcgtcatctccacctatgcggtcctcgtgcagctcgcaatggcggagtccatgccggtgccgcagttcgtggccacttcggttgttgtggccgcagggctcatcctaaacttcctcaactactttggctggatccctggaaccctcttgctgctgtgggaggatttcattacagtcggcggccttgccgtgctccctcaggtcatgtggtcaacttttgttcccttcatccccaatagcgtactgcctggcataatctctggttctttagctgttgcagctgttgcgatggcaaggatgggcaagctttccaatgcaggggttaaatttgttgggtcattgtctggttggacagccacacttctcttcatgtggatgccagtggcacagatgtggacaaattaccttaacccaagtaacatcaaagggctgtcagctttcagcatgttgcttgcaatgcttggaaacggacttatgattcctcgcgctgtattcatccgtgatttgatgtggttcactggttctgcatgggcatctgtcctacagggttggggtaacctggcgtgcatgtactgctttaatagcatcagcggagaagttttctttgcaacatcagctggtctgcttctatggctaggatttactctatggagagatgccattgcctatggcaacagctcgcccttgtcttccttgaaggagctgttttttgggaagtgatgaaccgtcggcaaccttgtttctcttgcactttaagcagctaactgttcccgggtaggacgctctcctgcaataaatcatggtagctgttaagaacggtggttcagttgctcccatatggtctgaagaaacggtgcttcagtctttagcattttgaggaggaaacgtgaaacttactggtcagctgaaggctataaacattgccatggccctggactggaagccccaactttcccaagcctgtagaaagcgccgtgtgcctctacagaagccaccgcgtgatgaccagcttcatccggcagggtgggtacagtagcaagctatagccctagtctgatgtaagaacaaatttatattatccatcccatattgtctttaattagattcatttttgaaaccaatgcaatttcagctcttgctgtcgtgcaaatttgtacccattgtccatggatgagtagatgacctgggagaatcacacaatacatattgtaattgtaaaggctctcaggcctactggctatatatataacctatagttcttaggaactaatcatc

SEQ ID NO: 9883 - DNA, 1763 bp, Zea mays
ttgggtccctcgaggccggccaactcaggcagacactcgccgccgccacgacgtcactagtagagccgtagagggcaagaggcgacggaatgacggagcggcaggtggcggagctgggtcccgggacggcgtgctgcggctggaaccactgtggccgccgcctcgccgctggcgccgtcgatggctccgtctccgtctatgactcccagccgccaccctcgttcaagtggcaggcccatgagcaagccattgtgaatgtcgtctggcttcctccagagtatggggatgctatagcttgtgtttgtgctgatgggacactgtctttgtgggaggaggttgctgctgatgatcaacttccaacctggagaaattgtaaaatcttcgaggatggcaactctcatatactaaatgtacattttggattacatctgggaattctgaaaatggttactgcatactcagatggccaagtcaaggtctacgagctcttggattcattggaattagacaagtggcagcttcaggcagagttccaaaacattactgatccaatctctagatttggaaaacctgcatgcacttctgcatccatagcatggaatccaagaagaggtggaagccaacaagctagttttgcaattggctttaattcagattcgcctcatttcaactcttgtaagatttgggagtttgaagaagctcatcagcgctggcttccacttgttgagctaggttcacctgaggatacaggagataaagtgtgtgctgtagcatgggctcctaacattggcagaccatatgagattatcgcagttgcaacctgcaaaggaattgcaatctggcatataggtttgaacgctgatgctgatggcggaccttcgacgcagaacgttgctttacttaatggccacgatggcgaggtgtggcaactggaatgggacatgggcggtatgacactcgcatcaaccggaggagatggcatggttaagctatggcaggctaatttggatggagtttggcatgagcaggctgttcttgactgcagtggatcacatgtctagggtctacgtgtttcagaaaacattttttttttgttcccagcactagaagttgctgctcttgctgcagaattatcaagtacttctttcgcttatccgcccaactattgctgtctcctgtgtggctggttgggcgctatcaaaactgggccattaacggccgtgggaccgcattgaaaagtccagaaaacgaaggtacatttgcttgtaaccttgtaattggggaagctacacagacgttgagtctaagctagtggacggaggtcgagatcaaccacgtgatgtacacgtggtcatgttcctcaaaatcttccgcaggtcctttcagatatcactgatatgcttgtaccattaaaagcagattaacacaggacgaccttcggctgcccacagatcagctatccacaatcaatgtttattttcatggcatattagatttaatattagcgctaggtttttcagatttggaggtagggagatggcagacggaaattgtggcaggatcaagcttcgctagttagctgtgacagcgttttacactaaaactgagtggtgcccagcccataagtgaggccattgtaatactgattctggcgaaccctatttgtggaagtacccaacgataaacctgctgcaggtagggatgtttttttacaattcgttttataatctgatcttatacttaaaaaaaaaaaaaaaaaaaaa

SEQ ID NO: 9884 - DNA, 1634 bp, Zea mays
atcgattcgatgatccgcatatgcgcggtcagcgagagttaattactgggagggggacagacagactgcaaaaacagacactcgccgccgccgcgacgtcactagtagagggcaggaggcggcggaatgacggagcggcaggtggcggagctgggtcccgggacggcgtgctgcggctggaaccactgtggccgccgcctcgccgctggcgccgtcgacggctccgtctccgtctatgactcccagccgccaccctcgttcaagtggcaggcccatgagcaagccattgtgaatgtcgtctggcttcctccagagtatggtgatgctatagcttgtgtttgtgctgatgggacactgtctttgtgggaggaggttgctgctgatgatcaacttccaacctggagaaattgtaaaatcttcgaggatggcaactctcatatactaaatgtacattttggattacatctgggaattctgaaaatggttactgcatactcagatggccaagtcaaggtctacgagctcttggattcattggaattagacaagtggcagcttcaggcagagttccaaaacattactgatccaatctctagatttggaaaacctgcatgcacttctgcatccatagcatggaatccaagaagaggtggaagccaacaagctagttttgcaattggctttaattcagattctcctcatttcaactcttgtaagatttgggagtttgaagaagctcatcagcgctggcttccacttgttgagctaggttcacctgaggatacaggagataaagtatgtgctgtagcatgggctcctaacattggcagaccatatgagattatcgcagttgcaacctgcaaaggaattgcaatctggcatataggtttgaacgctgatgctgatggcggaccttcgacgcagaacattgctttacttaatggccacaatggcgaggtgtggcaactggaatgggacatgggcggtatgacactctcatcaaccggaggagatggcatggttaagctatggcaggctaatttggatggagtttggcatgagcaggctgttcttgactgcagtggatcacatgtctagggtctacgtgtttcagaaaacatttttttgttcccagcacactagaagttgctgctcttgctgcagaattatccagtactttcgcttatccgccaaactattgctgtctcctgtgtggctggttgggcgctatcaaaactgtgccattaacggccgtgggaccgcattgaaaagtccagaaaacgaaggtacatttgcttgaaaaaaaataattggggaagctacacagacgttgagtctaagctagtggacggaggtcgagatcaaccacgtgatgtacacgtggtcatgttcctcaaaatcttccgcaggtcctttcagatatcactgatatgcttgtaccatttaaaagcagattaacacaggacgaccttcggctgcccacagatcagctatccacaatcaatgtttattttcatggtatattagatttaatattagcgctaggtttttcagatttggaggtagggagatggcagacggaaattgggcaggatcaagcttcgctagttagctggacagcgttttacactaaa

SEQ ID NO: 9885 - DNA, 2915 bp, Zea mays
gagcagccccgtggcgtggcggcaatcatcgctagcaagacgtgaagagttctcaagcaggaggcgtgtgacgtcagcaaggacaccagtattttcagtggagtggtggcgccagcaggaggccggcgaggggtcttctcttctagtagatgatgattgatgtggacttgaatttggaagttctaggaggagtaggagtatataaactggaggaggagtggaggagaggagagccgaatgcgagcgcgatccatggctccaaatcgaatccaaagaaactagtagaagtaatgcgggcgagggatttgcacccgctgtgctgcctccccgccgccgacggaggaccccctccgcctccccttggtcatgcaccgccggccgtggctgggctgctctacaagtggaccaacatcggcaagggctggcgcccgcgctggttcgccatccgcggtgccgtcctcgcctactccaagattccacgccgctccacgtcgcccccctcctccgcctcttcctccacagccacccggatcattgggcacgcccgatacggccacgacagccccgtcggcctcgtgcacctcaagatctcctcgttccgtgaaagcaagtcagatgacaggcggttctacctaattactccagccaagacgctgcagctgagaacagactctgctaatgaacgagcggcttggattgaagcccttgtttctgctcgagctgaatcttctcctgatgggggtttattgactaaccagaatgatgcatcattttctacggagaggcttagaaatcgcatgcacgaggaaggccttggtgaggaaataattaaagactgtgaacagattgtccattcagaattctcacagtatcacacacagatgaaacaacgctgtgaagaatatgtaagctttctcagcaggcttccacagcagtttgaggtacttagcgcagatgataatgctaatatgattgagctccactcgcacttgatgaaacctgactattccagctctggacagggaaaatgtagtgagagcagcaatacagaatcttctgatgatgttgggcaacaggagttggatgaacttttggatgacgatgactatcaattttatgatacaaggcagagtttcagtgattcagcaggactttcttgcttgaacatgaaatgttcagattctggcaaggatacctttctttatggtgataaatttgtgaaaccaaaagctggtacgggtgacagtgagtgcctgccaccgtttttcaagcgtcgcacgaagttgcctgatccagttgagaaggaaaaaagtgttagtctttggtcaatgatcaaggataatgtcggaagagatcttacacaagtatgtcttccagtttactttaacgaaccattatcatctcttcaaaaatgctttgaggacttggagtattcttatttgttggatcgtgcatatgaatgtggcctaaaggtgagtcatcatccgagagttctgacttgtcctgctgttgcggtttctgggtatgcttcctcggttgcgcgcccctgcaaacctttcaatccattgttaggggaaacctatgaagctgattaccctgaaaatggaatccgtttcttttctgaaaaggtgtattctttgttaaaaagtcacccctttttcgttcctgttaaatcataagaggtgggcttggtcccctgacaagacaaattaatgggctggcaatattaactgaattatgcagtgtgactagtttctaaatcagtattttaattcaatgaaaactaaatcagtatttcagttgaaaaaaaaataaatattgctgtttcatgacctcagtagaaactatagctggagttcatgttatgatgctgtatttgttgcgataggttagtcatcatccaatggtcatggcttgtcattgtgaaggaaaagggtggaaattttggggagacagcaatgtaaagagcaagttctgggggcaaacaatccagctggatcctgttgggggggtatctgtagaatttgatgatggagaaattttccaatggagtaaggttacaacaacaattaataacgttatcattggtcaagtttattgtaatcactatggaacgatgagtataactgggaacaggggatattcatgcaagctgattttcaaacggcaatctttccttgagcgcaaccctcggcaggtaaaaagaaatgcagcatcccattttggaatcgatttgatggatgttactaagatgtagctgtatgcaaggttgaaggattggttaaggacggtgatggttcgacggtggcaagcctaatgggaaagtgggatgagaggatgtactgcagcgcatcagggcagaatgtgattctgttgtgggagaaaaatgaagcttcgactaatcccactcgctataacctctcatcgttcgcaataactctgaacgagttgactccagaactcaaggagagccttccaccaacggattcaagactgagaccagatcagcgacatgtagagaatggggagtatagtaaggccaatgctgagaagctgcgactggagaggaggcaacggatgtcacggaagatgcaggacaatggttggaaaccaagatggttccgaagggatgatggcacattccgctatgtgggaggttactgggaggcacgacagcagcggaaatgggacggatgtcatgatatatttggtgaattcgtgtgactcaacagtgaggctgctcggagcttatatatatgtgtctaatacaacaagtagctagatagtcgaactggacaattgggctgtacactttgtcgggctgccgtggtcccccacccgcgtcttgccggactcgttggtaacgcgcatggactgtatcaatttggtttgtatgttctaccaatttccctccc

SEQ ID NO: 9886 - DNA, 2719 bp, Zea mays
cattgggtacctcgaggccggccgggaaaacctaaaaaggactaaattaaaaaagacggacagcccagcccatctcgtcttgtctcggcgataccggctaccccgggggaccttccgtctatccaactcgcagcgtcccacgccggtgaccccgctgggcggcagaaggagacgtcgggtgccgcggagcgccgcggagcgccgccgccgtccaagctgcctccctcggctggtggactgtatcactgctcctcagacacccgctgttctgtccggcaacgtgcctccgccgcaaacccgctcgatcagcctgaggcatcgcacgatttctgactcatactttatcgccaattggctggggtggagcacatctctacccggacttgatagattccaatccttcccaactcaacgttgggcagatggcgcagatccccaatcttgacaacgcgccgctcaaccttgcggccctcagggagcagtcgcagaaggacttgttcggcatcctaaaaaatataaggggaaagaagtgcttggttatagatcccaagctcgctgggactctctcattggtcgtgcagacatcgctgctaaaggagtatggcgcggaagtgcggattctctctcccgaacccctgcagacggaatgccccaaaattgtatatcttgtgcactctcagctgaggttcatgaagttcatcgcaagtcaaatcaagaacgatgaacctaaagggctccagagggaatacttcctttactttgtacctcgccgcactgttgcttgtgagaagatcctggaggaagagaaagttcatcagaaactgacattcggagaatatcccttatatctagttccattggatgatgatgtcttgtctcttgaacttgaccattctttgcaggaatgccttattgaaggagatacaagttctatctggcatgttgctaaagcgatccataaattagagtttgcctttggagttatcccgaatgttagggccaagggtgtggcgtcaaccaaagctgcagagttgttgaatagtatgcaactagaggatccagtcaacatggatgatatggggattccagagataaacactgttattctgttagacagagaggtggacatggtaacaccaatgtgctctcagttgacgtatgaaggcttgttggatgagatgctacaaattaataatggttcagtggaagttgatgcaagcatcattggagctcaacaagatgggaaaaaggttaaggttccactgaattcaagcgataagttgtacaaggagattcgagacctcaattttgaagttgtagttcaggttttacgtcaaaaagcaacatctattcagcaagattatgcagaagtgaaatccaccaacactcagtctgtttcggagctcaaggattttgtgaggaggttgcactcgctaccggagatagctaggcatgttcatttggcacaacacttgcaatcgttcacggggaaaccctcctttcatgcccgactagacatagaacaaacaatactggaggttcagaactttgaaatatgctttgagtacattgaggagatgatacataagcaggaagttattgaaaacgtccttcgccttttggtgttactttctcttacaaatgccgggcttccaaagaagaattttgattacatgaggcgggagatacttcatagttatggctttgagcacatgcacttattatacaatctggagaaggctggccttcttaagaggcaggaatcaagaagcaattgggttggtattacaagagcactgcagcttatagttgacgtaaatgatacagcaaaccctactgatatatcctacatcttttctgggtacgcacctcttagtattcgccttgttcagcatgcagtgagatctggatggcggtctattgaagaactgttgaaactattgccaggcccacatctggatttgaaaagaggtggtttgacaattaattcatcaccggaggtacatccaggtttaggggctcaacagagtattgacagggttggtcatcgctctctggttttggttgtattcattggtggtgtcacatttgctgagattgctgcccttcgcttccttagtgcacaggaaggaatgggctacgactttcttgttgcaacaacaaaggttgtcaatggaaacacaatactcagacccattatagcaaatagcaaagaggggatgatgtaattttattccttttctgtgcatgtgttttttgtaattgcaattgcagacaaacccaagcttgtgggttttcttgtttggctgtgagttcgtgtttggtcagcaactggacgataaggctaaccacgcttgttgatagatggaatccaacagtcccattttttgttctgttctgttctgtagtacatccgctaaactgtaaatcctgggtttcatgtgttcgtctgtctttttattcaataattgcttccttgaaggccgtttatgttgtttgtggaccaatattgtgaaaaaagaaagaatgtatggaacctgttgcaaatctgcaaaaaaaaaaaaaaaaaaaaaaaaaaaaaaaaaaaaaaaaaaaaaaaacaaaaaaaaaaaaaaaaaaaaaaccctgcgcaataagaacagctctagctcccttcgtcgtggttttttcctccgcttcccggtcccccgttccccgccgcccgccgcataaaaccccg

SEQ ID NO: 9887 - DNA, 1899 bp, Zea mays
cggccgcgtgggtgcatgagcagaaactccaaagacgggctgagaggtgctgtgacactgcaggcgataaaggtatataagccaaacgcttttgcaaactgggagcctgggatcaccaaatggaccgtgttcttctgagctcccacctgccatctcacgctcttgcaaacacgaggttgcagctgggtcctggtggcctcaacagtataggatttgcagtcataaaaaagggatgcttgaagttaagatgttacgcgatcggcgatgaactcggtggtccagggcgcttaagtaagcattttgtcgagaacagtaatggacctgttttccagggactcgatgcgtctgctggttcttttagaactgtcggtgctgaaatcactcaggacactggagatttctttgtcagtgacgcagagggtgatccagacaaacctaccgatgggttctcctcgatcgaccaggctataggtgctttgcgtgaagggaagtttgttattgctgtagatgatgagaacggcgacaacgaaggcgaccttgtgatggcggccactctagtggaccagaagtcagtcgcattcatgatcaggaatggctctgggattatctcggtaggcatggaggaggaggacctgactagactgatgattccgatgatgtcccctatcacagaaatcgaagatatcacggctgctgcttccacggtgacagtggatgccagggttggcatatctacgggtgtctcggctgcagacagggcgaagaccatcctcactctagcctcctctgactccaagcccagtgatctgaggagaccaggccacatattccccctcaagtaccggaacgggggcgtgctgaagagagctggccacacggaagcgtcggtggatctggttgcgttggcaggtctccgtcctgtgtccgttctctccaccgtcatggaccccagggacggttcgatggcaggcgtaacggttctccagcagatggctatggagcatgacatacccatcgtttcgattgctgatctcatccggtataggagaaagcgggagaagctggtggagctgattgctgtgtctcgcttgccgacgaaatggggcctcttccgagcctactgctaccagtccaggctcgatggaaccgagcacatcgctgttgtgaagggcgatatcggcgacggcgaagaggtcctggtgagggtgcactcggagtgcctgacgggggacatcctcggctcagcccgctgcgactgcggcaaccagctggagctggcgatgcagctgatcgagaaggccggccgtggcgtgctcgtgtacctccgcggccacgagggccgcggcattggcctgggccagaagctccgcgcctacaacctccaggacgagggccacgacaccgtcgaggccaacgtcgagctcggcctcgccgtggacgcccgcgagtacggcatcggcgcccagatactccgtgacatcggcgtgcgcacgatgcggctgatgaccaacaaccccgccaagttcatcgggctcaagggctacgggctcgccgtggtggggagggtgccggtgatctctcccatcaccaaggagaaccagaagtacctcgagaccaagcgcaccaagatgggccacgtctacggctccgatctcccgggaagcctgccggagttcgccaacccacaagaggcccccacagaacaagacgacgacgataaccaaaactgataaaaaaactatacggtgtcgtttttttaggaaaagataccaatataaccacaaattcttgtattccactgagaacgagtattgcagagtatttatttatcaactgcaaaattattaagtataatagagatacaaacttttatcgaaaaaaaaaaaaaaaaaagcggcc

SEQ ID NO: 9888 - DNA, 1263 bp, Zea mays
cacggcaccgcagcacaaggcacggcgcgcgcgcccgcccgcccggtctgctcctacgccctgcagagccctcgtcttcccctccccgttattcccgggattcccctgttgctgcgtgcgactgcgccccgccccacccacacccacctacctacctacctaccaccaacgcctccgctcccctctccagcgagccgcgaccgcgcggcaggggaagcttagcacggacgggaccagctgacgaccaggccatggggaagtacatgcgcaagggcaagatgtccggggaggtggccgtcatggaggtccccggcggcgcgctgctgggtgtccgcacccgctcccgcacgctcgcgctgcagagggcgcagaggccgctcgacaagggggacgcggatgacgccgccggacagtacctcgagctcaggagccggaggctcgagaagcctcataaggaccatcagccgctgccgctgccgccgcccgcccccgcagccaagaggggcgccgggaggaaggccgcctccgccgccgccgcgccgcacgcgctggcggaggacgaggtcgaggtcgaggtctccttcggggagaacgtgcttgacttggacgccatggaaaggagtaccagagagacaacaccgtgcagtttgatcaggaacccagagatgataagcaccccaggatccacaactaaaagtaaaaccagcaactcgacgacttcccgtcgcaggatggaaacctcagtctgccgtttcataccgagttcgcttgagatggaagagttcttctcggccgctgaacaacaggagcagcataacttcagggagaagtataacttctgtcctgtgaacgactgccctctcccgggtcgatatgagtgggcgaggctagactgttagattcctccaagcacaagagcaccatttatctgatgtgtctaccacatgaccagcgccgccgacgccgccgaggaggcgtaatcaactggatcgcattagctttcttgcctgttgtaaaaattagagtagttagcctgtagttgaatggtcctgtgtaacgaaacaggcgcggttctgagttacattacaccccgatccccaacctcactgcgacccgcttgactgctcaagctgtagctgaaccatccatctcaagtagcgtaggcctagcgtattcatctgttcctagttctagttcttggattgaatgaattaatcgaatgagatcattgttagaatctgcatgccaaaaaaaaaaaaaaaa

SEQ ID NO: 9889 - DNA, 1564 bp, Zea mays
attatgaaggatgtaagaaatgtacccacgcgtccgcaaaagaaaattgaaaaattgaggcagctattatcaggagttttcagtgagcttacaaactttgatgagccaattcgttcaccattagcaccaactcttctcctaacaggagttgtgcctcaagaatcgtctatatttaagagtgccttgaaccctttgcgcctgacatttaaaacagcaaatggcggaacatccaagattatttacaaaaagggtgatgacctccggcaagatcagttggttattcaaacggtttctttgatggaccgactactcaaattagaaaatctagatttgcaccttactccataccgagttcttgcaactggacaagatgaagggatgcttgaatttattagttccagttctcttgcacagattctatcagaacatcgcagtattacaagttacctacagaagttccatcctgatgaggatggtccttttggtataacggctcaatgtttggagacattcataaaaagctgcgccggttactctgtcattacatacatattgggggttggagacaggcatctggataatcttcttctaactgatgatggacgcctttttcatgttgactttgcttttatccttgggcgagacccaaagccatttccgccaccgatgaagttgtgtaaggaaatggttgaggccatgggtggtgcagaaagccaatattacacaaggttcaagtcctactgctgcgaagcatacaacattctgaggaagtccagcagtctcattttgaatctattcaagctgatggagcgatcaggcattccggacatctctgccgatgaaagcggaggtctcaagctccaggagaaattccggttggatctggacgacgaggaggctatacatttcttccaggatcttatcaacgatagcgtgagtgctctgttccctcaaatggttgagaccatccatagatgggctcaatattggcggtaacacaagctaatgtcgtagaagcaagtgtgaatctgtacatgctgactgtcacaagccacggtaataagcgagaaacgacactgatggatggaagcctaggcgcctagcatttgggggttcaagctgcgtagcatctgcgaattgattgggctgatgcagggcatgggcaatcttctcgtgccggtgacacccaggaattcgggttgtcagttgtcacttgtgatagtagaattccgtcacgcactgctgtagacctatgggcattcgtcagatgtatatatgcgttaatgtataaaatcaacttcagtagcaaatttgtgaataccggaatacgtgatggtttaagttctttagtagtttgtaatgataagactagcctgccaggtgccagcagtctcaggagcatgtgggctccacaaggagattagcagctgctggagcattaatgtgaaactccctccttttatataaaagcaacatcttctgccccaaaaaaaaaaaaaaaaaaaaaaaaaaaaaaagggcgggccgtccgctctataggatcaagcagcgtgcgcgtgccgtc

SEQ ID NO: 9890 - DNA, 2248 bp, Zea mays
ctctttcctgtaggctgcagcaacccgctcccccgctcacaccgaaatttgaaatcctcctcccagtctcgtccttcgaacgaagcaacagccgccgcgccatggagaagatctccgtcgccgtccgcttccgccctcccaacctggtggccgctaagagctcactagtcccccccccccccccccgcgaccgcgagtggcgtatcgatgacacccgcgtttccctcctccaccgcgccgccggccccatcaccggtgcctccttcgccttcgaccacgtcttcgacggtgcggcgaacaacgagcggatctatggcacggtcgtccgggaactcattggcgccgtcgtcggcggattcaacggcaccgccttcgcctacggccagaccagcagcgggaagacattcaccatgaacggctccgacgccgacccgggcatcattccccgcgcggtccgcgacgtcttcgacaccgtgcgccaggctgacgaccgcgagttcctcatccgggtgtcctacatggagatctacaacgaggaaatcaacgacctcttgacacttgaaggccagaagctgaagattcatgagagcttagatcgtggagtgtacgtgtctggtttgcgggaggagatcgtgaacagcgcagagcaagtgtttgagctcctccagcttggagaagcgaacaggcattttggagagaccaacatgaacatgcggagcagtcggtcacacactattttcagaatggtaattgagagcagtggtaaggaccagacagacggtggagatgctatccgcgtatctgttttgaatttggtggatcttgctgggtcagaaagaatcatcaagacgggggcagaaggggtacgtttgaatgaggggaagtatattaacaagagcttaatgattcttgggaatgtcatcaataagttgagcgagaacggaaaacaaagagggcacattccgtatcgtgatagtaagttgacacgcattctccaacctgcacttggaggcaacgcaaagacatctatcatctgtactgctgctcctgaagagattcacattgaggaaactagaggtactcttcagttcgcaagtagagcaaaatgtgtaagcaattgtgcccaagtaaatgagattctaactgatgctgctttgctgaagaggcaaaaactggaaattgaagaacttcgtaaaaaactgcagggttcccattctgaagggttggagcaggttgtactaaaactacggaacgacatgcacaagtctgaacttgagcgtgatcgattggccatggaacttgaagacgaaagaaagttacggatgactctagagcaacatttgactgagcaacagaagctagaggccatatcgtcagaccactttacagattcaatccagctggatcttctgaaaactccagattcgaagtctgtaccagatggctttgttgcctgtcgctcacgttactcacaagatgttgagttcagcccaatacctgaaaatttggataatattgctgaagaagatctatggacacgtctgaacaaaggctgtgttaccgatcttgatatgcttgagatgacacctaatctcaaacgcgagtcatcctttctacaagaaaaatcatcagctgcgccattggaggaacctaccaacgccatatgccagaggttagcaaaggagtgcatctatgatcagcaacagcttgaggaatcaaaggcgagatgcgccaatctcgagaaagattgcgacgtgctgagggacgagaacttgtccctgcaacaggagctctccgagtccaagctagaggcggacagcctcgtagccgagaagcaggcacagctggatgatttgaggatgaggtgcgtggccctcgagagggatctctccagctccaggcaggaggcccaccgccttgccaccgagaagcaggagctggccgggcagctgggcacagagaggcagaagatggatgagctgaagcaggatatccgggtgatctgcggcgacttgctccagcgggaagggcagctcacgtcgatttacaccaagtccaaggccatcatagagagctgcaaggcctcccaggtagctactctgctttgatggtttcaatgaccgctgttggcttgtgcattttttatacataaaaacagaaggacagcatttttatgttgagattatatccttcgttggcgttgcaattataatttcatcctcagttttttttaaaaaaaaaaaaaaaa

SEQ ID NO: 9891 - DNA, 2598 bp, Zea mays
tgcagaacaattggaaaaacatcatccgagataagactgtattttgcagccgcaaatatacatgctgtttctgatatgtcaaaacacgcgcttgattctcttggagatggtgacatcaactggcaagtaaataagcgagcttcctacatttgtggccaaacaatttatggagatgcactcttggcaaatattggatacacaaggagagattcggaacttcacactgaagatgtcaatctatgttcctattacaggtaaagctttattgaacatttcactacaacggcattgttaaatacaatttcgctatgctaatcaatgaatcaagatgcattccattttatattgttagtagatattgtcatttttttctcaggaatcatcacatgattcaagctgcagaggttggctcgtgttctgtttgtctttcatgtctgtgctgcttttatctattatttaagcaccaaacttcctatagttcttcagagtgacacgctgacatgcttttgcctcaggatacttctgggcaagttacctgatggaaattgtaagatgtctagggattcgattcttgcagcggagcttccatctgcatactctcgttttagttggaaaggcctctctccacgagatctcctttgctcattttgtcgccttcagaggttgccagagccccattttgctgtcagtagggtctcctgtgatacattaatgtcggctgtgagctctgaagaaagaggagcaccagcaggcagcgcagaaaatcagtacaccaatgatgtcaggatcaacaaggaaaaaccagatctttttaaatgtgaagtgaacatacgttcacggaagcaagaacttttactagagtattctgcagctgacacttggagcaaggaatctgatgctattcagaattcttcattgaaggtcttgatttggttcaataattattttaagaaactaacctcaaaaacaggcaagctatatctttctgagtctactgctggtgtcaaggtacattcaaatatttttcttcaagagtttgcaatgtgtctatctgtttatggcaagaatggaggcagtgattcagcaatgtgcagtgcagttggaccattttctatggatacacaaaagaagcaccttgaaagcactgcaaagttaacacacattgaaggtccagactctggtgttttcccgtcccacggatcattaacttgtataagttatactgcttcccttgtgacgaaggataaagcaaaaacatatttgttggagagccacaatgagtttgagtttgagattgggacgggtgctgttagtaatcagcttgaatcatgtgtaactcagctgtcagtgaatcaaactgcacgttttgtagctgaactgcctcctagggatttaatcatggctgcatcttgtgagttctcacatgacctctccaatgtatctagtgagagctgcttcctggagttctctgtaaaggttctgcaggtaactgaaccattagaagatagaatggagaaagccttgttcagtcctccattatctaaacaaagagtcgaatttgctgtacggcacatcaacgagctgcatgctaccacacttgttgattttggctgtggatctggtagccttcttgattcgttgttagagcatccaaccacgctggaaaagcttgttggcgttgatatttctcgaaaaggcctcacacgtgcagcaaagagccttcatcagaagctgagcaaaaaatcaacgatgcagacaaatgttccaactgctgtgctgtatgacggatcaataacggactacgattctcgcttatatgggtttgatattggcacttgccttgaggtgatcgagcacgtcgaggaggaccaggcgactttatttggcaacgtcgtcttgagctcattccgcccgaccgtgcttattgtttccacacccaactacgaatacaatcctatcctccaggggtctgctatgcccaacaaggacgacgaggcagacgaaagcactggtccctgcaagttccgcaatcacgaccacaagtttgagtggaccaggttacagttccagtgctgggctactggcctcgcggtgaagcatagctacagcgtggaattctccggcgtcggtggctcaggcgaggagccaggctacgcttcccagatcgctgttttcagaagactggtgcagggccaggaagcgatgtgcctggacaaggatggcgatcagccttacgaggttctctgggagtggcctaacgcgtgtgtgaactaggtaaattgcacgtctaatctctctagggcttggaactttgaatcgtgcccccggtttggaactgagtaatatatgtgtcaggaaagtgggcatccgacttgtggcaagaacacaaaaaattaacattgctgcatgcaagtgcagaaattcagtctgcttctaggttctggatgtacggcagttactacactgtatatgatacaccctttattcgaataggccccgatggttcatgaaaaacttaatctctactactttctgcaagagtagtctgtcattccgtgttctgccaccaatcctgttctgtcattctcgttctgccac

SEQ ID NO: 9892 - DNA, 1829 bp, Zea mays
gaaacaaaaggaaaggagaggagagggaatcgaatacgataccttctcttctccctccattcctttcctttgccccaaccatgccatattggagaggcgtcgagatcttatccctcgatccaattccaaacagaaaccgccggagctggaacaagagccgctcgcagcttgctggactctcccgctcctggccccggagccgccggccatggccaagcacaagcagcgcagggtgtaccaagtctggaaaggcaaaaacataatactatgtggtggaaggttgatctttggaccagatgccaaggccaccctgatttccttcgccctaatcgccatccctgtccttgtcttctgcgtctttgtggccagacatctcatacacatcttccctgcatataacgcaggatacgcaattcttgctgccaccataggccttaccatttatgtactgttactgctcttccttacatcatctcaagatccaggtattgtaccacgaaattcacatccacctgtggaagagttctcttatgatgcttcggctccacatgctcttcagttccctcgagtaaaagaggtcatggtcaatggagttcatgtgaaaatgaaatactgtgaaacttgcatgatataccggcctcctcggtgctcgcactgctccaaatgtgataactgtgtcgagcgctttgatcatcactgcccttgggttgggcaatgtattggagagcgaaattaccggtacttcttctgttttgttgcttcagcggcagtgctttgtatctatgtatgtgcaatgtgtggattgtacatcaggcttctcatgaataggggtcattattcggtggggaaagccattaaagaatctccagcttcattggcagtcatggcatattgtttcatttgcttctggtgcgtccctcggcgcccgccgctccactcttatcttattgtgacaaacaagacaacatatgagaatatcaagtacaagtacagcaaccaaccaaatgtgtatgaccatggttgtgtgctcaactgccatgaggttttgtgcaaaaaaaggaaaccttctaagatcaacctaagagctattgtccaagaagaacaagaggtagcacggccacagaccagctcttccaatatacgagaagatgaggcaccccaccgtccacgagccaaggttgaggatgatctagaaatgggtcttgacatcctcaagaccacagggcgcaggacggataaattcagcgatgaggaattggagcctgcaactggaagcaatggtattgaatatcgcacgccagattcagagactgagattcctgttaccagaactaagacagagatctttaatgaagttagggatctggacttatcggttagtaatggtgcacaatcttcatctcctgaacaagaacagcacccagacaaactttgctgatggaacaaatggtctctctgcatttccgtagtgcagacaccaaattattcaccagggctgtgaatggttggatttgaaggcagatttcctcctttgccgtctgctttcaggatttaagcctttgcttggccaatcatagattcataggtgtgtaaggatcctccagtttgtgcggtttatggaggttctaaaagattctaggaactgtttgagattcttctggtgtgtgaaggctaattgtacataattttcatagctatatgatcactgaaatgcaaaaaaaaaaaaaaaatgcggcctctcggcatgggaatgggaataggctgtacctggtcttttctagaaccatacacatcatttggtgaatgctcgatctaaaaccttggttgtc

SEQ ID NO: 9893 - DNA, 643 bp, Zea mays
  misc_feature (643)..(643): n is a, c, g, or t
acatatccccactctagccaagtagtcagtcctctccaatctccactctcctctcgcaccaccaaaaaaccggtcccaccgttcgccatgagctccgaagccggatgctcagctccagccgccgccgcgccggatggggcgggtggcggcagggtggagatcgacacgtccgcgccgttcgagtccgtgcgggaggccgtcgaccgtttcggtggcagcgccgcctggagctccgacctcgtcaggcgcatgttcgcgccctccaagaaacatgaacactctgaccaagctgcagaggccatcaacgccgaggagcaagctgcacagctagagaacgagctggcagttaaagaaagggagactcttgatgtgctcaaggagctggaggcaaccaagaagatcatagcagacctgaaactgaagatacggaaggaagccactgaaacatcccctgaagaggctgctgaccaggtttctgaggcgggagctcaacagcagaaacctgaaaacaccaacattgatgtggtggtggacatggaaggtgtagaggagaaccattcaggttcggttccggtggatctcgagcaggcgaaggcaaacctgaacagagctacatgtgttctggctgcggtgcgggctgcan

SEQ ID NO: 9894 - DNA, 2034 bp, Zea mays
tgcagtgcgcgggcgcggcggcctgcaacggcaactcgtcgtacagtgtcccggcgttcggctgcatcgttttcggtttttggcggagctgagctgagaagggggacctgtgtggcagtctggcagaggagggagcagccgctgaggcctgctgggaaacggtaacatgtggcagccttgtgcgtggggtgtgggaacctttttctcttttttttagtttttaaattaggaggggctgtgctctcaacggccaacggctccttggtgcggcgggcggtcaacgtctctctcgccggggcgctctccatgactccatcttaaaacccacagctttcttcccgtcttggcgtcttcccacatatgagtatatgacatatccccactctagccaagtagccagtcctctctccactctcctctcgcaccaccaaaaaaaccggccccaccgttcgccatgagctccgaagcagaatgcgcagctccagccgccgccgcgccggatggggcgggcggcggcagggtggagatcgacacgtccgcgccgttcgagtccgtgcgggaggccgtcgaccggttcggtggcagcgccgtctggagctccgacctcgtcaggcgcatgttcgcgccctccaaggtgaccgaccacccgccgccgcctcttttcttctcccattttctttctcctccgtccatcccctgccgtggcatagtccgctccgtttgctgctgctgcatccacctggtagttgatcaatgtgagatccgaggttgctggctcctcggttttgctctacttgcttggtccccggagtgactggccccagcaagccagcaacagagtagatcgatggtgctgtttcttactttgctttccatgtttgcaacctgcagaaacatgaacactctgaccaagctgcagaggccatcaacgccgaggagcaggctgcacagctagagaacgagctggcagataaagaaagggagactcttgatgtgctcaaggagctggaggcaaccaagaagatcatagcagacctgaaactgaagatacggaaggaagccactgaaacatcccctgaagaggctgcaaagtctgatgaaactgaccaggtttctgaggcgggagctcaacagcagaaacctgaaaacaccaacattgatgtggtggtggacatggaaggtgtagaggagaaccattcaggttcggttccggtggatctcgagcaggcgaaggcaaacctgaacagagctacatgtgatctggctgcggtgcgggctgcagtcgagctactgcgaaacagcatagcgaaagagaaagtgttgcttgaaagagcccgagagaagctctcctctgatacttcgtcggtttcttctttggaggatgacctggatcagacagcgcaaaagatggaaacgctgaaggatctgcagaggagacgcaaagacccctcagatatttttgtagagatcaagaaaatgaccaccgaggtgcagcagctcaggagcatggcagacgattcgaaatctgaggcaatggtgttggctgcagaaatcgagcaggtaaaggccagcatttgcacggctgaggtcaggtgcattgcagccaggaagatggaagacgccgctagagcagcagaggccctcgcgctggccgagatcaaagcgctagtgagcagcggaagttctttcgaaggagacaccgcttccgatggaggaggggtaactctctcgatggaggagtatttcaagctgtgctcccgagctctggaagctgacgaaagctccaggaggaaagtggagaacgcaatgctgcaggtagacgcagctgacgattcagagtccgagtctgtcaagaggctcgaggatgccagagtggaggtcgaggagtgcaagaaggcgctgcaagaggccctgaggagggtagaggctgcaaaccatgggaagtttgcggtggaagagattcttcgtagatggaaatctgagagcgggcacaagaggccgtctcttgggtgccccccaagattcaaaagggcg

SEQ ID NO: 9895 - DNA, 819 bp, Zea mays
  misc_feature (734)..(734): n is a, c, g, or t
  misc_feature (767)..(768): n is a, c, g, or t
cctcgaggccggccggggtcttcccacatatgagcgtatgacatatccccactctagccaagtagccagtcctctctccactctcctctcgcaccaccaaaaaaaccggccccaccgttcgccatgagctccgaagcagaatgcgcagctccagccgccgccgcgccggatggggcgggcggcggcagggtggagatcgacacgtccgcgccgttcgagtccgtgcgggaggccgtcgaccggttcggtggcagcgccgtctggagctccgacctcgtcaggcgcatgttcgcgccctccaagaaacatgaacactctgaccaagctgcagaggccatcaacgccgaggagcaggctgcacagctagagaacgagctggcagttaaagaaagggagactcttgatgtgctcaaggagctggaggcaaccaagaagatcatagcagacctgaaactgaagatacggaaggaagccactgaaacatcccctgaagaggctgcgaagtctgatgaaactgaccaggtttctgaggcgggagctcaacagcagaaacatgaaaacaccaacgttgatgtggcggtggacatggaaggtgtagaggagaaccattcaggttcggttccggtggatctcgagcaggcgaaggcaagcctgaacagagctacatgtgatctggctgcggtgcgggctgcagtcgagctactgcgagacagcatagcgaaaagagaaagtgnttgcttgaaagagcccgagagaagctctctctnnatacttcgttgggttctcctttggaggatgacctggatcagacaacgcaaa

SEQ ID NO: 9896 - DNA, 4175 bp, Zea mays
  misc_feature (1579)..(1579): n is a, c, g, or t
  misc_feature (1766)..(1766): n is a, c, g, or t
  misc_feature (1786)..(1786): n is a, c, g, or t
  misc_feature (3770)..(3770): n is a, c, g, or t
cggcctaacgaactcttaatattaggctcaattttcatatatgtttgtagcttgcacatctaacatgttatttgctaataataatccataatttttttttattttattgtttgacatagaaaaagggaaacaactagtgtggatactatgttcatgaatttattcacacattcatagctaacaagttagtggccaaatatatcgaggtatgttgacattttctacagttttgatgttgatttcattataataaagtgtctcggtttttagtttaatgcaataacactctttattaatgttttttggcaaatcatagataataaagatgatgaaagaaatactccctttggataggatacaagcaattccagaacaacataaatggtttatgaataaagagatcatatacaaagacggagagttgtattgtgatggaggaattcttctgccctcaacataagacgaaggcgatttatattgagaatatatagatatttagggcccgtttggcacagctccagctcctgattctaagcgaggatctggaggagccgtgccaaacgggtatttttctaaactgattctcgtgtggagccgaaagattgggagtcgtttttgtgaagaatggtgggatctaaaaaaacctgctccaccctctcttaaaacagctcctcaaccaaccaaatatggacctccccttaaagtttgatcgaaattacccgcaattgccattggacaaaaacataacgagccaatttatggattaaacatttgagaccattttatgcactactatgatgggaatattttatatgttattgtttcataatttttttccgtatatgcatcctacttattggtttgtaacaaagttgaactgcaaagggtaaaacagacaatcgccacagaccaccaactctcagcagacaagaatcagtttacttgccaaacggttttaaaaatgattctgattctctaggagaatcaggaggatcagctcctcacgaggatcaagatctggagctaaagaagcaggagctggagctttgccaaacgggccccttagtccaccccctgggtccgaaccggtgttaaatatggactcttgagtaccggttcaaaccaagaactaatactaatcatccctctataggaccaggccttgaacctggctaaaggttgaggtcttaagcctagatgcccagtacccgttagaaatccgatactatggacggcttcccatcggcacagatagcccttttgtctctctactagtggccgagtttgtaggcatcacgaccgagtctacggacccacctatcatggtcttgttcgctaaattagaattggtactcttggtatatatttgtaacacattgatcacacgtataatcatgattggtaggcctcgtgtggtaataaaagcccattatgtgaggcagttgtgttagaagaaacgcattcatgatccttgcagatatgaggcagtagtgcatgtgtgatcccatttggtcaggcatagccgggtagtaatggtaatagtattcgtcctcccttgtttatttttcgcttcatgctntgtactaacctctgagctagtatcatcattcatcaacgcacttgatcccccacccaccacacacacctcgctatatacttcaggttccatcaatctgcactatatatatccacaccacaaaacgtaaccataccctcctacatagtcttttaatatggttttggtgttgtagctactcccttctctntctagttgtgccctccattnatcagactcgtcatttttaagcacctgggatcagtttgaactttctacgtataaatctcccatttatttgaagctgtagtatagtagtgtgctgctcctaggatgaccgtggaatcagtggaagctatccggttgcttctcatctgctacttctactgttctacccatcaccagcaacctcctagcttgttgtagatgatgtaatttcagtacacaacgatgatccatatcaacggaaaaccctataaaaaattatgcattatttattaccattgcttgataattacgcatggcaggtatcaggagatccaattaaatcctcggtcatgaatccttgcagatcatctcatcacgtagaaagagaagcagtcatgtgacatgttcttttttcgtgaatgcactttgctggcaaagttgccctacatattttctgctcctaacgggttgtaattatcgaggtgatagtgactgggttttgagccatgctcattgtatatgttgtactgccgtagcattgttccaaccaaactaatattaattaggttgataaaacaactaagtactatacttaaatatatacttgggtgaggtcccaatattttgtagaccctgggcggccgtcctgctggcgccccctcaggtccggccctggaattgtaatataataacacattatcgactccttggctgaaaaaatataattaagaatttatgtaagtttttagaacaagttaagaaacaagataaaagtctatcacaatcgttaatcattaaacagccagatcagctctttgattgccttaactttggtttatttgggcctactcttagttaattgtccctcatcaaataacccatggggttgggtgttgtgtgtttttttaaaagttcttatattttgtgtatgtggaattttatgtactccttccgtataggattttgaagtcgtttatgacttgattgtgtatatcaaggagtgagtaattagggtggagtttgtcctgtatgcccctattaaataggtgaagtatcttgtgcacataagcaatctcacgtgtcggtctattatctgatggtcaatctcccatccttggtgacttagcaaagaaacactcccacctctagggctgaaaaataagcaaataagctcgaggctcgtgagctggctcaagctcggagcggctcgcgagcctcgaacgagcgagccgagccaaccttttaggttcgttcctatagcgagccaaaccgagccggctcattctggctcgcgagctgcgccaaattacttaatatgtaaaataattatggatattggataattttatagattgtcagtttgtttcttagcgtttcatgatagatatatgacaattaataatttaaattactcataataatgaatgatatttatatatttcatatttatatactaataattcactatatattgtaattatataatatcaggttgtggctcgcgagccgccttcgagtcgagccgagcccgtttccccagctcgtgaaatggacgatctgagttgttccgctcatttccagccctacccacctcccccttccgtttccttctgggctgatttggtgacaaggcgatcacgagaggattggacttgtgatgtgatccctgttcaccaaatcagttcggacctggtttgcaaataccccatgcgcccctcccaagagaatgcatgcccaagcgccgctaagagccgtcgcatgcccaagcgccgctaacaccatgaatttgttacaggaaggcatgggtattgtacccttagacgtcccaagtagcagcaccaatgctgtagaaaaatccggtcattatgataacggtgatggaattggaacacccaaaaaaaagtccgagagcactaacactagtgagaatttcaaattggtttaacctgatgttcatgcagcactagatattcatattgattctctggtttaacctgatgtttgcggnttacatcatttatacctaattgcaacgaggaattcaagtctacagttggcatgtcatttgcttctctagaggcagttgaagaattctactagacatattgaaagggaaatgtatctttgggctatatctattttattttggtaattaaatgctcaacatattgtttttagacaaacatcatcttgtatgagcaatgagaacaataagttaaatcaaatgagaaaaatgcacttttaggcttgaaagtgggcataccacaaattcatatggtgccaagcaaaaaaggtaagctcctaacacttagtcaattgttttgggtactaatcatatgtgtctaagtgttagggactagcgaagtcaagtcaaaaggagcaaaagagaatggaaagaaaaagggaaaagttg

SEQ ID NO: 9897 - DNA, 3022 bp, Zea mays
aggggaagagggaagaaaggtgaggagaccaagcgaaaaaaatcacgctttcattgcgaggggggaggatagggaggaagacgccaagccagctccagtccggcacccgatataaagcggcaggcacttggattgctgacgagatgggactcacacgccgtcacaatgctgtgcctcgtgtcgccctcttcctcgccgactccgcttccgccgccgcggcgctctcgctcgcatgctgatcgggcggcaccgccggggatcgcgggtggcggcaatgtgcgcctgagtgtgttgtctgtccagtgcaaggctcgccggtcaggggtgcggaaggtcaagagcaaattcgccactgcagctactgtgcaagaagataaaactatggcaactgccaaaggcgatgtcgaccatctccccatatacgacctggaccccaagctggagatattcaaggaccatttcaggtaccggatgaaaagattcctagagcagaaaggatcaattgaagaaaatgagggaagtcttgaatctttttctaaaggctatttgaaatttgggattaatacaaatgaggatggaactgtatatcgtgaatgggcacctgctgcgcaggaggcagagcttattggtgacttcaatgactggaatggtgcaaaccataagatggagaaggataaatttggtgtttggtcgatcaaaattgaccatgtcaaagggaaacctgccatccctcacaattccaaggttaaatttcgctttctacatggtggagtatgggttgatcgtattccagcattgattcgttatgcgactgttgatgcctctaaatttggagctccctatgatggtgttcattgggatcctcctgcttctgaaaggtacacatttaagcatcctcggccttcaaagcctgctgctccacgtatctatgaagcccatgtaggtatgagtggtgaaaagccagcagtaagcacatatagggaatttgcagacaatgtgttgccacgcatacgagcaaataactacaacacagttcagttgatggcagttatggagcattcgtactatgcttctttcgggtaccatgtgacaaatttctttgcggttagcagcagatcaggcacaccagaggacctcaaatatcttgttgataaggcacacagtttgggtttgcgagttctgatggatgttgtccatagccatgcaagtaataatgtcacagatggtttaaatggctatgatgttggacaaagcacccaagagtcctattttcatgcgggagatagaggttatcataaactttgggatagtcggctgttcaactatgctaactgggaggtattaaggtttcttctttctaacctgagatattggttggatgaattcatgtttgatggcttccgatttgatggagttacatcaatgctgtatcatcaccatggtatcaatgtggggtttactggaaactaccaggaatatttcagtttggacacagctgtggatgcagttgtttacatgatgcttgcaaaccatttaatgcacaaactcttgccagaagcaactgttgttgctgaagatgtttcaggcatgccggtcctttgccggccagttgatgaaggtggggttgggtttgactatcgcctggcaatggctatccctgatagatggattgactacctgaagaataaagatgactctgagtggtcgatgggtgaaatagcgcatactttgactaacaggagatatactgaaaaatgcatcgcatatgctgagagccatgatcagtctattgttggcgacaaaactattgcatttctcctgatggacaaggaaatgtacactggcatgtcagacttgcagcctgcttcacctacaattgatcgagggattgcactccaaaagatgattcacttcatcacaatggcccttggaggtgatggctacttgaattttatgggaaatgagtttggtcacccagaatggattgactttccaagagaagggaacaactggagctatgataaatgcagacgacagtggagccttgtggacactgatcacttgcggtacaagtacatgaatgcgtttgaccaagcgatgaatgcgctcgatgagagattttccttcctttcgtcgtcaaagcagatcgtcagcgacatgaacgatgaggaaaaggttattgtctttgaacgtggagatttagtttttgttttcaatttccatcccaagaaaacttacgagggctacaaagtgggatgcgatttgcctgggaaatacagagtagccctggactctgatgctctggtcttcggtggacatggaagagttggccacgacgtggatcacttcacgtcgcctgaaggggtgccaggggtgcccgaaacgaacttcaacaaccggccgaactcgttcaaagtcctttctccgccccgcacctgtgtggcttattaccgtgtagacgaagcaggggctggacgacgtcttcacgcgaaagcagagacaggaaagacgtctccagcagagagcatcgacgtcaaagcttccagagctagtagcaaagaagacaaggaggcaacggctggtggcaagaagggatggaagtttgcgcggcagccatccgatcaagataccaaatgaagccaggagtccttggtgaggactggactggctgccggcgccctgttagtagtcctgctctactggactagccgccgctggcgcccttggaacggtcctttcctgtagcttgcaggcgactggtgtctcatcaccgagcaggcaggcactgcttgtatagcttttctagaataataatcagggatggatggatggtgtgtattggctatctggctagacgtgcatgtgcccagtttgtatgtacaggagcagttcccgtccagaataaaaaaaaacttgttggggggtttttcttctaaaaaaaaaaaaaaaaaaggagacccggcacccaaaaaaaaaaaaaaaaaaaaaaaaaaaaaaaaaaaaaaaaaaaaaaaaaaaaaaa

SEQ ID NO: 9898 - DNA, 889 bp, Zea mays
tttttttttttttttttgtatcttacaagatgagttcacttaatcataacacaagtatacaaactatatcatattacaatattcataagaatttacagagcttaaataaagatgtacagtggccagcgagatgctttcatagtttcatgtggggcggcccacagctatgcaagtaacccaaaggtcatatttcttacaaggtggattgctatataaaagcaggccatgtcaatgcatgtgtattcggcttcagaggaaagcaaagtcagtgtctgtttgccacgagtgccacctctgcaaattaaatctgcgaggccaatcaaaactgatcttccatccgaatgcttcgtgcgaatttacagcttttttccttaaggcggatcgatcacagcagcgcgataaggacgaataacaggagcgcggcgacaaacgagtacttgacagcggcggcaaagattgccgcggagatgagcgcgagctgcagcagcagtgaggcgccagcccatacgagcgcgcccgtgagcaccacagccacggcgttggtggggtccggggatagcagctccccccaccggatctccgacagcgctgggagtgacgagcgccgccgctccttctccccctccgctggaggcccgccgtcgccgtctccgtttccgcgggaggccgcacgggcgaccgcgaggcgggggagacagtggctcagggagtaggaccccggggtaatggatctgaggtgggagaccgcgaggcggacggtgaggaagggtggaactagggttccggcgtatgccgccatggaagggaagagtagtaagcaaacagagcagagctgcagaggtgcagctgccccccggccggcctcgagatacccaatcgcccataggag

SEQ ID NO: 9899 - DNA, 716 bp, Zea mays
gaattgaacagcactttattctggttgttcttcttaggtatcccctgtttgctgagactaatttgcaatccaaatatctcagtgtgcagaaaaattttaagcacttggcagttggcactggcagacaaatattttctactgctccatacaaaaatggaaacatttgaaatcctctgttttttcctctacctgatcttccatccgaatgcttcgtgcgaatttacagcttttttccttaaggcggatcgatcacagcagcgcgataaggacgaataacaggagcgcggcgacaaacgagtacttgacagcggcggcaaagattgccgcggagatgagcgcgagctgcagcagcagtgaggcgccagcccatacgagcgcgcccgtgagcaccacagccacggcgttggtggggtccggggatagcagctccccccaccggatctccgacagcgctgggagtgacgagcgccgccgctccttctccccctccgctggaggcccgccgtcgccgtctccgtttccgcgggaggccgcacgggcgaccgcgaggcgggggagacagtggctcagggagtaggaccccggggtaatggatctgaggtgggagaccgcgaggcggacggtgaggaagggtggaactagggttccggcgtatgccgccatggaagggaagagtaagcaaacagagcagagctgcagaggcgaagccaatgggt

SEQ ID NO: 9900 - DNA, 940 bp, Zea mays
caaatccaccaagcccactcctctgctgccgcattccaagtttccaacccattcccatcctcttcaacggtcaacccagcgccaccagcagcgccatcagcaggagagagatcgccggagccatgacgaggggcggcggaggcgacatgaagtccttcttccgtcagcagaagacgcacgccgccgccgccactaccaagcccactggcggcgtctccaagaaggcggcggcgcatcaccacaagaaggccgcactcgccaccaacatccacccggccccagatcacggcgccggcagccgccagcagggggaggcggaggcggagcagcgggagagggcgggccgcgagttcgacatggacacgcgctacgggccatgcctcggcgtcacccgcccccagcggtggcgccgcgccgccgcgctcggcctcgcaccgccgccggcgctcctcgccctctgcgccgacgaacagccctgcctctgggagggccgcgtctaggctactggcgggatgcacattccttccccgcgtttcgccgacatgctccatcagtgttcagtactagctctgtgttggagatgcggtgtcgcgtccatccgttctgctcccgtctaccgcatctcgtggtagcagtggcaccagtagtagtacaatctgtgcctgtcacgtgttgtgttgcctctagtatccacatgatgaacccttcatgtctggtgtgttatttgtgatcagagcagaaatggcatgtcttcctgcaacatggtaaaaaaaaaaaaaaaacttctgttgcagtttcattggattgttctagtactgctgaatactgcacagcatagtttgttctacattataggacgaattaagtttgtcctaagttagacgaaatttataaaaaaactggatcaaacatctagtacattaaaaaaaaaaaaaaaaaa

SEQ ID NO: 9901 - DNA, 1718 bp, Zea mays
ctgcagcaagccaccgggtatacctgacgcctttgtgcttgtttgtttagcatactagacttagttgcttccaagttccaactctgtcggcggttggtcttttgcatgcagcgtgcatgatctgtttgtatgaattatttcgggaaatgagactatttcaggtagttgatggtcaccttgaaaccttcagagagtaggtgcgccatcagctgtcagtaccatgtgcttgtcaacattgtttgtgttgaccatcttcatagtatgtcatgacatgagacatctaaactttccttttgagtgttacacctgtggcgtgattgaatctggagctggcaatatccccaccaaaatgaagaaacattttacccgagaatcatagtggcaaagacacatcatgtcctgtgtgttcgagcgcaagaccagcagatctgtcagctgaaacggttccttacctaacatgcactagcttcagttttatgtgaatggattagagtaattccagccacattctgtggtccgtctgagctgattgtgcttggcaaactcgtgcagattgcgaatggaaagacgcaggcaggaacatgtgtgttgcatccttccactggagttgcagtggcatctgcaaatctgctgattggatcagtaaagtccatcaacgttgcgtgagagtgagaatgcacttttggtaggttgtgttgatttatggttatctgtttaaatcatggctcaaacatggtgttttgttttctatcatttttttcaaaagcagatttattgcatgcttgtgcagtttgtggcatttcatcaaaaaaaatgaaaacttctatgtcatttagaaacatacttctgtttgttagaagtagtacaaagcctttcattcgtttactcatataaggaatcagattttctaaagaacaattaggatatagagatgtgtttgggacattataaaccaaaaaaattatttagagctcgtgaaatatcgctaaaagattgaaatgttagttttttgtctttgaaaaatgtgcaattagttccttatggagtgtgcaataaaagatacatatgataacttgaatgcctcaaaacttcctgaatatttttaaattttttatgccataataaatacttatagctagctgaacattattttatttcctctcaactcagcaactcaatattaggctgtgggccaattaaattgttgattatgagcttcttttttgcctgttttgttttagggctgtgattccattgcaatgacatctgtaactgataagaaagctaagatggagagttaaatatcttctgcgccctttgtggagggtggcattcaggaggcatgtggtgatgcatgcaacatttgccttgaggttttctgtgagagtgacccttctacagtttggtgtatgcttctcagtgacaaagtaccttttaaaatgcaagacaatggtatatgcattgacttattatgtatagtgagtcatattttgataggtttttggtacagacttatttagttaaaaacctatagtgacgtctatttgatcttttacaatatgtacaagattggaagatcctctttattttttttttttgttcttctttatgagttgattgtcacaacatcaactttaaattagtgtcatatgttacctgcgttctattttggtatgccatcattatacttcatgtcattacaagaaaaaataattatg

SEQ ID NO: 9902 - DNA, 2854 bp, Zea mays
ctctttattaaactgtaaggtgaacgatatgggtgttttttttctaattgcagtggtggataatttatagtagtaggtatgtaggggtatttttagattagttttttagtgatagtggtgggttatttttaatacatgatatagatggggttgtttcaggttagttttttatgagtgcaatagtggttaatatgattttgggtgcttccattgttggctaaggattaatatttcatttcatagtacagttagtaccagtggcgtagacaaggcggctagcagcccccaagattttttttgcttgtatatctacggttaaaataagagggttagtttataataagttaaaatttattatgtactcattgcatacatgtgttaattgttatgactagcgatgatatattctatttactggtattatatataaggttggtccttcctaaagggaaattttggttatgcctcttatcagtacaatagtggtggtggtggctacaatagttagatagttacagggtattttaggttttcttagatattggaaatagtatgtaatttataaataaacatcgaggtgctttgggttaagttctcataatagtgctggcagtattaaattttttcatagattaaaatcagtgattttgattgttaaggtttcatttgcaggccaattcagttactacgatgtttattcattcggtaaaaatgtacacatcatcgatgtgtttcaatattaatacttcgtcgcagctctagcctcctacatagcagtcaaccagtagacatttctactcgaatgctccacaatggcctcctacatcggtagagatgcaaggtatcattgaccatggttggacggtgacattttcaggcatgttctgcacaaaaacgctaatgaagacgtaccaatgggattttggttcatcggattggacgtcgatgatcgccgtctttgctgcagcaagccaccgggtatacctgacgcctttgtgcttgtcttgtttagcatactagacttagttgcttccaagttccaactctgtcggcggttggtcttttgcatgcagcgtgcatgatctgtttgtatgaattatttcgggaaatgagactatttcgggtagttgatggtcaccttgacaccttcagagagtaggtgtgccatcagctgtcagtaccatgtgcttgtcaacattgtttgtgttggccatcttcatagtctgtcatgacatgagacatctaaactttccttttgagtgttacacctatggcgtgattgaatctgaagctgccaatagccccaccaaaatgaagaaacattttacccgagaatcatagtggcaaagacgcatcatgcgcaagaccagcgaagctgtcagctgaaacggttccttgcctaacatgcactagcttcaatttgatgtgaatggattagagtaattccggccacattctgtggtccgtttgagctgattgtgcttggcaaactcgtgcagactgtgaatggaaagacgcaggtaggaacatgtgtgttgcattcttccggaccggagttgcagtggcatctgcaaatctgctgattggatcaggaaagtccatcaacgctgcggtgggagtgagaatgcatttttggtagattgtgttgatttatgtttaactgtttaaatcatggctcaaacatggtgtttcgttttctatcattttttttcaaaagcagattattgcatgcttgtgcagtttgtgggatttcatcaaaaatgaaaacttctatatcatttagaaatataattctttttgttagaagtagtacaaagcctttcattcgtttactcatataaggaatcatattttctaaagaagaattaggatatagagatgtatttgggacattataaaccaaaaaaattatttagagctcgtgaaatatcgctaaaagattgaaatattagttttttgtctttgaaaaatgtgcaattagttccttatggagtgtgcaataaaagatacatatgataacttgaatgcctcaaaacttcctgaatatttttaaattttttatgccataataaatacttatagctagctgaacattattttatttcctctcaactcagcaactcaatattaggctgtgggccaattaaattgttgattatgagcttcttttttgcctgttttgttttagggctgtgattccattgcaatgacatctgtaactgataagaaagctaagatggagagtttaatatcttctgcgccctttgtggagggtggcattcaggaggcatgtggtgatgcatgcaacatttgccttgaggttttctgtgagagtgacccttctgcaggtcgactagccaggttgttagttgagctattttgcatataaatgttatttctgtaaccaattacttagagttcgaagtgtttttcttatgcaggtttggtgtatccttctcagtgacaaagtaccttttaaaatgcactgccctttacactctgacatgcaagacaatgatatatgcattggcttattatgtatagtgagtcatattttgataggtttttggtacagacttatttagttaaaaacctgtagtgacgtctgtttgattttttacaatatgtacaagattggaagatcctctttatttttttgttcttctttatgagttgattgtcacaacataaactttaaattagtgtcatatgttacctgcattctattttggtttgccatcattatgcttcatgccattacaagaaaaaataattacattctatttaagctacaacatttaaaacttttaaggctcatagcagagggtagatcttcagcacttcaactacaaac

SEQ ID NO: 9903 - DNA, 3255 bp, Zea mays
ccatcaaaacatatatgaatcctctgtgtgccattacaaattataagcttccttcgaaaccatcgatttagattttgagtccctttaatgccatcgccgtcacggttaccatttgataccgttactcgttcgtatgggcccacttgtcaaacactaacatatgttcctgccgacctcgccacaggccgcgtcgtccacgcacagcttgaatggcatcttctaagtgtcctggcagtccctcattgccacgtcgctcgctgacatgtgtttctaagtgtcgcagccccgccgacacacgcagggtgtttgatcggatgactgccagggaccgtgtcgcttggaacgcgatcgtctacgaaggaggcgtcgtccgcaatgttggcagctcgcccacttcttcttccccttcgtcggccgtgtcgtcgccaacaccgacaccggcgtgcccgagatcgcctgcgacaacgccggcgcagagctcgtggtggcacacgctgcgtaaggctaatggacgccgacttcaccaacgccgaccgctcgctgagtcgctgggctgcatcgcgatgccgttccggcaagaccttgcgttgtcgcgcgctgcagctggtgcggttcgcacgtagtgcagcgggttcgtgctacagtgggtgaccaaccaccctgatcgtggacgaacccagcctgatagcactgcccagcgtgcgggcggagctgctccgcaccggcggcctctcgtgggtgcctcccctccataggcggacattgctcttccagtcatgagccctgccatggtacaacagacgctggataccgagttcacgcggtatgctacctcggaggccgtgtcgttgtccccgctgactgacattgtggcgatggcgggcactaccatcgccgaggtgttctattccgagcggtacaaggagctagtggactgaatggacagagaaatgataggaacaaagctgagggtatgacgagtgggttcaaataagctagtaacggcggtagatggcagcactaacggtaatgataattaagggacttaaaatctaaattgatggtattgaaggggagctcataatttttaatggcatacgagatcgatttaggttttgatgatggcaatgagggaattttctcaaaaagtattgacttgcctccctgcagcagccagcagatgggcccactttggagccacgacggacggatggctggccagatggaagtagattctcgaagaaggaactcgcacgacgcacgagtacacgaccgcacgcacgccaatttgaaagttcaaaaaaattcgaatcgcctctcacaacggccgcagcgccgtcgggtgcagccaccctaatatataaataaacagcaaccccctctcaatccaaatccaccaagcccactcctctgctgccgcattccaagtttccaacccattcccatcctcttcaacggtcaacccagcgccaccagcagcgccatcagcaggagagagatcgccggagccatgacgaggggcggcggaggcgacatgaagtccttcttccgtcagcagaagacgcacgccgccgccgccactaccaagcccactggcggcgtctccaagaaggcggcggcgcatcaccacaagaaggccgcactcgccaccaacgtccacccggccccatgtaccgatcccggtccgaatcccccgatcgctgttcgcttccgcggcagtaccggcggatcgaccgattgattcgattttgattcgtctctcgtcaccgcagatcacggcgccggcagccgccagcaggaggaggcggaggcggagcagcgggagagggcgggccgcgagttcgacatggacacgcgctacgggccatgcctcggcgtcacccgcgcccagcggtggcgccgcgccgccgcgctcggcctcgcaccgccgccggcgctccccgccctctgcgccgacgaacagccctgcctctgggagggccgcgtctaggctactggcggcggcggggtgcacattccccgcgtttcgccgacatgctccatcagtgttcagtactagctctgtgttggagatgcggtgtcgcgtccatccgttctgctcccgtctaccgcatctcgtggtagcagtggcaccagtagtagtaccatctgtgcctgtcacgtgttgtgttgcctctagtatccacatgatgatgaacccttcatgtctggtgtgttgtttgtgatcagagcagaaatggcatgtcttccagcaacatggcatttctttcgtgtgttcttctgttgcagtttcattggattgttctagtactgctgaatactgcccagcatagtttgttctacattatacgacgaattaagtttgtactaagtttgaccaaatttatacagaactggatcaaacatccagtacattaactcgtttgagtcacatttatttgcttttgcgtataaatatttgtctataaacttgatcaaaattggagcagtttgacttaggggagggcaaaattaaaacaactgcatacctgacatttctttcgtgtgttctgttgcagtttcattgggttgtttcctaaacgagtcatgaaggggatggacgaacatacccttcaaccagaacaggatcagagggactaaaaaccgctaattcgtataaagccatcgaaccagcctaaccagaaactagagttgtgtgcattatatgcaccgaaagcaatcgacctagatcattcaatacaacagtatgaacacgataccaaggcaaacccatggaaatacctctttagcaaagaaaaatagacatgatatcgctttattttatcgcattggaaaagactatatatatacatattctatatacccaacccttcaaggggattctatgtcaaaaagcgtgaatatttatttcattccattaaaaataacaagtcaattctgtttgtaagaagaaagagaaggagatctattctatactcgataagtgccaatatgcaatttatagccccaactcagctttctcgtgttttttttctttctgcagtacattatcatcgccgttctatagctgatatgacagtacttacatggtcagcatgatcaggaagaaacaacacagatacacgcatatgtgacatgtccttgtgtctaataacgggaacaataagctctatgcagtaaagtgctgtcataaacagactgaatttcacagcatcagcattaagagctctgtatccatgtttagcaaaccgtgtt

SEQ ID NO: 9904 - DNA, 848 bp, Zea mays
aaaatcctccaagcccactcctctgctgccgcattccaacccattcccatcctcttcaacggtcaacccagcgccaccagcagctccgcaggagagagatcgccggagcccatgacgaggggcggcggaggcgacatgaagtccttcttccgtcagcagaagacgcacgccgccgccgccactaccaagcccactggcggcgtctccaagaaggcggcggctaaccaccacaagaaggccgcgctcgccaccaacgtccacccggccccagatcacggcgccggcagccgccagcaggaggaggcggaggcggagcagcgggagagggcgggccgcgagttcgacatggacacgcgctacgggccatgcctcggcgtcacccgcgcccagcggtggcgccgcgccgccgcgctcggcctcgcaccgccgccggcgctcctcgccctctgcgccgacgaacagccctgcctctgggagggccgcgtctaggctactggcggcggcggggtgcacattccccgcgtttcgccgacatgctccatcagtgttctgtgttcagtactagctctgtgttggagatgcggtgtcgcgtccatccgttctgctcccgtctaccgcatctcgtggtagcagtggcaccagtagtagtaccatctgtgcctgtcacgtgttgtgttgcctctagtatccacatgatgatgaacccttcatgtctggtgtgttgtttgtgatcagagcagaaatggcatgtcttccagcaacatggcatttctttcgtgtgttcttctgttgcagtttcattggattgttctagtactgctgaatactgcccaaaaaaaaaaaaaaaa

SEQ ID NO: 9905 - DNA, 1887 bp, Zea mays
  misc_feature (491)..(491): n is a, c, g, or t
  misc_feature (635)..(635): n is a, c, g, or t
tagagattatttattagttggctaactattacttctagggtttcttaatgtggcctaactaggtgtagtgtcactcttaggtcttaaagtgtaatacatgcatgcatatctcactttaaaagccaactgatttcaaaaatatttctagcatctcttaatctgcaacatgtttagtaagacaactagtatgaattaaatataatgatatttatttgctatgataaaataatatatacagtatgctttatagtgttgatttttttaataacgtgagtttgtgtgcttcttttttggggacggaacggtatttaatgagactattagaaacattttggcaagatttgttgtttaatgccacaagaaacgggtctggaaactcgatcctaatgactaggtggtgcatgcatgagagtgcgatctgaaagcagtgtggatatttgtggactggagtattagattgaaggtcgttttgatcatctaaacgtacgtgnataaccatgcctccatttgtccctggcgattccgtgcatgtaatgtaacaacctggcgtccgtttgttactagcgattgcatgcctgcaataaactccgtcaaacttatcctctgatcagacgtagcgtagtgcatctgttacnaacccccgcccgccaggcctcatgagcgtgaagacgcgcgccgccggcgggcctgcttgctctctatataaacagcagtatcctattcgaacgaaccataccatccatcgatcgatcaacaatacataggcaatccatctcctcccacatgtacagctcgctttccgatctagcaatgtcaacgggagcaacggagatgatcgtagccaccgccgatgccgccagcagcaccaggtgcatgtcgtcgacggcgagagcagaggacgtgatcgtgtccaccgccgtggccaccgcggccggcaccaagtgccacatgttcaagatcgacggctacaagcggatcaaggccatgtacggcaagggcaggagcatcgactcctgcaggttcgaggtggctggccgcgcatggaagatcctcttcttccccaacggcgactgccgggacaccgcgggccacgtctccctcttcctcaagctggacgacgacgacaccgtcggcggcggccccgacgacaacgacgacggcaaggtcgtggtggtcgagctcaggttctcgctgctgtgccgccccggctgggcgccggacgaccggccccagagctggacccgcacggccaccttcaccaacaagggcaacaagaccatgggctacagccagttcatgaagcgctcggagctggagatgccgaggttcctcggggacgactgcctcgccatccgctgtgacatgtccgtcctcgacgaccccgtcgacgtcaaggaggagcccgcgcagccgctcgacctgcagcggcttggggtgcctctcgactgcaaggtcgtcgacgacggcgcgtgcatcaagaccgaacacctcgttcccgttcccctcagctacttcaagttcacggaggcgctcgtcaagctgttcgtcggctgtttcgacgtctgaccgaatggatcctcgccggctgggttttattgttgcgttatatagtttcgacaaccatcatttcgagtatttcaagataaaagtacactgtcatcgttcccccaagttttgtttagatcgatcagggtgctagtttatttaatttatgtgtaaatcatcagaatttccacattattagtgaataaactgaatctagttttttccaaaaaaaaaaaaaaaaagaattgataatgcatcaataatagaacgagaaaagtactcgtccgtttaaatcaagatcatgcctagagatggcaacgggtacaaacccgctgggttttg

SEQ ID NO: 9906 - DNA, 1903 bp, Zea mays
  misc_feature (205)..(205): n is a, c, g, or t
  misc_feature (635)..(635): n is a, c, g, or t
  misc_feature (1368)..(1368): n is a, c, g, or t
cttatttttatgagtatcaaatataattatgtaccgtcccaatacagggacattgagtaatactgaatccacctcttcctctcacaagctgtcttggaatctatgagtaactcactctcagctaggtattagtgactagcccaattatcttctcttcatgtatcttttatagcatctccaagagggactctaaacatggccctanccataaaatactcttccaacgatggttctattttataaaatttcatccatgactatagtgatcggtctctcgggtccttaaatataataccctatatgctataaccatatcctcgttttatcttattttctaataatatgatttattttctaaatactattatttaagactcaactgttgaagtgaaaacttttttaggctctaaacacgttaaatatgatactattttaaaatttaggactctattttagagtttattgttggagatgcttttagtggtaggattagtggtatgagaagatagatggcaaaataaaatgatgaaagagaccattaaaaagaggaagcaatagtaaatttgtaaaacacgtgaaatcaggaatcaggaaaggaaaggagcaaccgccgctctctccatccatcgccttcncccatctcccccagttcccctcgtcgtcgctcttccaaaccctagcggcctagcctgcctcctacctcgcccgccgacctatctctgccagtcctattccccgcggcagcgcgggatctcctcgctcccgtcgctccctgcacctacggtacaaccgctccatccaaacgagatccagcggatggaacccccggcggcgaaggaggcgccgccacttcagcctgcggcggaggaggacgcgatgctctctgcgacggcggccatggcgaaggaagccgctgtagcgttccagggctgccgctacgccgactgtgccgcagtgctcacgaggctgctggacaagaaagagggcgatctcaaggtgcacttgtaactactctttgtgtctttcctaaagaggagttaggagctcttgcagtttaagtttgtgtgcggaatctattgttggacactaacatagcaaatcaataggttagacacatctgtggttatgtacaattggtctggtttggctgtttgggttccaatcatgtatgtttgagttccaagttccaactgtgtagttcatagttgtttgagttctcatggttgttttgagttccaactgtactgtctgtttgagatgtctgttaggcgaggggttcaagacaggttcaagtttgcttatgaactttgctgtatggattcatcttcgaaaaaaaaaaaaaaaagtgcgtgtgcatgcagctgtttnttgagctgccttttcgaatgccaccacccagttttactcaacatccatgttattatgtacggttctgttttctcagaaattgtgcctaaggtaacttgttcagtgaaactgtttaatctggccgccttattatgctataaattcagaacataatctatctgaattctgaaaacagcaaggtaaacagttactttggaatggtggacaatatggttttccaatttccattgtctttgtataggacaaccattagcttagaccaatacactttcttcttttgctttgagaagaaataattcttctatcagaattgttttcctttcatgtgatgtcacaattttgaaatttcaggtacaccataacatggccatcactgaattcttcttggatgattgtcctgattcaaacaggctgcttaaaattcttggtgattttaaggttagcgaatctgcattattcattgtgctatcattttattgacatgttaatttgcagtgaagtaacataaatgactgtattttatataagtaaatgt

SEQ ID NO: 9907 - DNA, 1061 bp, Zea mays
  misc_feature (162)..(162): n is a, c, g, or t
aggcgccctacgccaggtgtccaggtctcgggcccttctccggcaccgagcacccaccagcggaatataccatggaggtcaggcccatggtagctctgcgtgccgccctagttggtggggtagcggcatttgcgaagatcggtggggcgatgaaagccgcantgtgtcaagattggtgcagccgctgcagccgtcacggctaccaatcagctgccatatcgggaaaagacgcaaaagaagacacttcaaagccggaaacgaaatgatatgacccatggattggtcgacaagtatgaaatcgcctctccagaggtttagaagagagagggtgccatagtcaataagttacaggagtaaattttgatgctccgtgtgtttttttatctcgggaataagaatgacagtacagttttccccagaagtatgattttgtgttgtgcaacagtttcggctgttgaatgcttttagtcatactgtctgagtggcctgatttctgctgtgccccattctggggcgcgatgcacctgtgatctgttgccatattctgtttgcacatggagatcctgaaggatttgtgccgtttcatgcgtaaggcagtgcatctatgatctgcttgccaaattctgtttgcataggaagatcctgaaggccttgtgctgtttcatgcgtgagatcctagtgatctacatcagcatctgtataattgaagtatctcaaactgtagaacgctgtaagttttactatgccgctgtttgtatctccgtttttttcctggacatgctccatgtaatgatgaattgatgagacagtgttattcaaacataaaaaacatagagcacaaactcgagcaattcttcctttttttggactggaaaagtgcttccattggcctctccctctccctttatgctagttgctagccaaatcgcaagcaaaaacattattatatagaaaatccagaactttgccagaaggagcacttgttttttttaagagtgaacagaaacaagagaattagtatgggccgattcgtgggcctcgattcagggggatcctttaaa

SEQ ID NO: 9908 - DNA, 2865 bp, Zea mays
  misc_feature (911)..(911): n is a, c, g, or t
ttgccgcccgcgtccccagcccatatgcctcaggccctcagcacaaggcccgtgttcgtgtccgcaccctcggccgaacagttccccgagtccccgactgctctctgtctctctattggcgacgactgggctaccgccgccacaggcgccctacgccaggtgtccaggtctcgggcccttctccggcaccgagcacccaccagcggaatataccatggaggtcaggcccatggtagctctgcgtgccgccctagttggtggggtagcggcatttgcgaagatcggtggggcgatgaaagccgcaggcggtgtcaagattggtgcagccgctgcagccgtcacggctgcaacatcagctgccatatcgggaaaagacgcaaaagaagacacttcaaagccggaaacgaaatgatatgacccatggattggtcgacaagtatgaaatcgcctctccagaggtttagaagagagagggtgccatagtcaataagttacaggagtaaattttgatgctccgtgtgttttttatctcgggaataagaatgacagtacagttttccccagaagtatgattttgtgttgtgcaacagtttcggctgttgaatgcttttagtcacactgtctgaatggcttgatttctgctgtgccacattctggggcgcgatgcaccagagaacaaatgccatatcctgtttgcacagggagatcctgaaggccttgtgcagtttcatgcgtaaggcagtgcatctaagatctgcttgccaaattctgtttgcacaggaagatcctgaaggccttgtgctgtttcatgcgtaagatcctagtgatctacatcggcatctgtatatttgaagtatctcaaactgtagaacgctgtaagttttactacgccgctggttgtatctctcggnttttttttcctgggcatgctcccttgtaatgatgaattgatcagacagtgttgttcaaacataaaaaagtacaaactcgagctattcttccttttttttggactggaaaagtgacttccattggcctctccctctccctttatgctagttgctagccaaatcgcaagccaaaacattattatatagaaaatccagaactctgccagaaggagcacttttttttaagagtgaacagaaacaagagaattagtatgggccgattcgtgggcctcgatccatgtgacacgatttatttagcccactgtccaatttccgttgcacagtatcacgctgtagttccttttcgttcccccggcggccaccgttctattccttcccgctgctccgctcaacgaaaatggcgccttccctcgaagacctcacccgggtactcgccgagctcgctgcacgcctctcccaacctgccaccggcggcgtttcctcctcctccggagactccctctcagccaccatattctcctcgcccccgccctcaaccccagtgccgacggcggcggcgcttcatctggaaccagggttctggactccgcgttctccctcatgtgcttcgactcgctagaggaagggagactcccacgtcgtatctcctattggattgttagcgctgttggcattttagctgaaccatcgcgctgatggaactgcgtgtggatgcaggtgaatagtgcccgagtcgactgccttgtccgcagttccgcaccctcgtctccgtgctctcggcatcagtctcgtgccgtgtggttcggcccaatggcgacgctggtcaggacatgctctgtgtcgggagctccgtctcgcccgtgcattgccgcgagctgctccgatcgatcgtgtattcgtgtgcagcccttgtggagaaattgggagattgtgagatttttttaacagggatctcttcctacacattgtaattgcgcatgtctaatgtcacacgaagtgcccatcaatgctatggtcagatgatgtgacactcataatgtttaggagtattcgtgagcagtttcacagttgggagttcagcttataaatgatgtgttctccctgtaggttggttatctgtttttttgttaatgttgacaaatttttatttctttaatttagatggaagacattcttatgatatgttgtatgctgttgcgaaaaccatcgtgctatcccctaactaccagtgtcttttccttttaccatattataaggaagagggagaaatagtatctcgtatgggaaccattgctgcggagttaataaaccatccttcctatcatgtccttcctagtgacgattcaaacccaccaaggtataagtatacttgcagcaattacttgtggatcatcatgtgctattaataaagggaagatttaaggaagtaaaagatgtgttgttattgtagtttctgtgttgttattaaatgtataccatttctttgctgcaaatgtgtaatatgaatacggaaacagcccctctgatttcaaagtaagtcatttaggacattgccatggtctctaatctgatactttgaccaatgatttctgtgaaaatatgttattccaggaaaaaaagagttacaaattttcaaaggatttataacgaggcttgaggagtgtgggaataacaactttatgttctcagtcttagtagctgtttatatattggcggcgataatttcaacaagtttgagtgttttaccagcacaaattcacttacattttgaatttgaggagtgcttgtaaagtgcgaagggggcttttgaaagcttggagtgcaattttgtgcttactggatgataatctctgtagttttgttgctcaccaggaaaccactgactgtacactgtactttatttttatctgtatagtacactgacaggcagtaccatcttaattatgcttaagta

SEQ ID NO: 9909 - DNA, 2381 bp, Zea mays
agttatgtaaataagattagggaatgagtggtaatgttagatgacctggtagtttcataataagataagatttaacatttctggtgtacccatagtcacaaagtttccggatcaacagggtcgaggaacggtgttgagaaacatggtacgctacttgtgagtggtttttacatggtgggaacgaaaatgtccctgcattcgaggacgtttccggttgagggtcgctaccactgtacccgtttcttgtgactatgggtgtacataggatacaccagtggcagatctagcctattgctgtgcgggcacatggctccacaactttttgtcagaacatgtttaggcccttattaaaattacaattatatactacaatcaacttgcttggccccataggttttcaatcctagatacgccactgggatacaccaactgtttgtgctagactgaaagtttgaaacactgattctccaacaggtataaagtattcatcaatcccagcaccacagatgtggtctgtacgaccaccgctgaagccctggcaatgggaaagatagttatatgtgccaatcacccgtcaaatgagttcttcaagcagttccccaactgccgtgtctcgggcggcggccgcgcgggggtcccgcgaaccctgaatgctctatcagagcagcctgctccactgacagacacgcagaggtacgagttgtcatgggacgctgcgactgaaagattcatcgaggcctctgatataaatcctcatgtgccggagtccagggcccatcaaaactctagggctttgttgcctgcttttctaagaactcgtaaactgaaacagaacttagaggatgcgtcagtttacctgcaccaagccctgtcaggtctggaagtcactcgctgtgcgtttggtgctgttcctaagacgctgcagcctgacgaacacctctgtaaagaccttggtttggctcctccggcaaagaagagaaggctgaaaattaagaagacgtaacgttggtgctgttccaaagatgacgtaacgtttaagatgagcaatgcttcgcctcatgtacagcacaatgtggtagacatttttactatttttcttctcaaaagagacattatcatacagtccggactccggtgggatttctaatggaggtttaatgcttcttttgactatttattactgggacgtgtgaactggggattagcacattgtaaattggtgtgctagcagctagcttagagagctaaggattctttgaatagtgctgtaattgtgtgagccgattaatggatcgtaatgaactgtgatgtctggtgtactcgagctcaccgtttaggccctcttttgaatgtgagaatttctgtttgcggtttatttcctttgaaaatcaactgattcttataaaatttctaggaaatttgtgttctaaaggcctaagttatctgagtcattagtcatgtcgctaaagtgctgtgcttctatctgagttggttggttagatggtctgagagtgaatttcatgcccctctgtatcttgcatgccaaaccacaggtctaagattcagtccggggctgtcttccatcaacagatgagttttttattcgagtcctgtcagcatcagtatcgaatgatcagcagaaggcacctaggagtgccgataggagcagtgaggtgatatatatttcctccgtcccatgccaaaataagttctcgtttcttgaagaatcaaaagttttaattttgaacaaaccagtacaatgtctatgtcttgtgattacaaaaaaataaataatagatatattattatcgaccttaatatcttacaaattatttatgaataatcaatacaaaactaaacttgggatatgaagcgtctcctcttcctctccctcagctaagcatcagcgacggtatggtggtggagagtcgcagcagcagttcgagatgcttgccgatgggaaaggtcgatgtcatgcgaagttgagagttaatattcgacggcaatagcaaggagaaagcgcttgtggtggttacatggttggttgcacatgtaaaagataaggcttattttatctggttgttaggcaagacattggggaaaaaaacagatctatgcgaccttaatatctcaaattctttcctaacaaccaatacaaaactaaactcgaaatcaggagtgtctcctctcctccggttgttcatccacgcttcatcggcttctcctcctcaactgtttttgcctcgctacctatagagacacatggtacataagaatctgggtgtggatgggaggttggggtttaatatatgacgcccaatggtgaagagaagaaagtgctcgtgatggttatatggttggttgtgcatgcaagaggtgag

SEQ ID NO: 9910 - DNA, 876 bp, Zea mays
actaacttgtatgatcttagcgggcggactccgacgttagtcctaggccgacggggcctcctacgggcccaattaattgagacgttggattcgaggctacgcgaatctcaacgaattgccagttcccgtcctcatccagtggaaggcagctgtgccagctcaaatgctcgaatcagcagacgtgggaatctcggcagggcgccgcagggaagaggaggccgagcgctctacgtctgccatggcgagctcttccgaccccgacaagctcatgagcaaagccgacaaactgtaattaggcttgcacggaagctaccaacaggtgatctgcaggccatcaagaaatctgacgatggcgaggaatccttggacgaggatgacctgacttaaaacgatctcccgagccaaaaggtgcagagaacaaacgtcatagtttgccatcggtgggggaacaactgtaaaaagaagttatgcgagttacatactaaaaacttgtgggcagcattcccatatctataaacatgaaatttgtagggcccaattatgttgtatccgtactggtggtttggtgttaccgaaacttagtggtatgtttatggtttcttgtactacatgattcttgcaaatccagcatggtgtaaaattaatatgttggccaatcattactcctacatttgtagctgtgcagtggcccacgcgcttccgttgcaagtattcggataatttcgtgatgaaatcggtttcagtgttgactaaatgttatccaaaattgttgcccaaaactaataattgaccaaattaggtgtcgatgtagtccaggacgtttctcgattcatatcaagaatggggtcttatctactgatctagagggcactattt

SEQ ID NO: 9911 - DNA, 550 bp, Zea mays
ccggccgggagtggaaggcagcccggccagctaaactgctcgaatcagcaggcgtgggactctgggtagggcaccgcggagaagaggaggcccagcgctctacgtccgccatggtgggctcttccgaccccaacaagctcatgagcaaagccgacaaactgtaattaggcttgcacagaagctaccaacaggggatctgcaggccatcaagaaagctgatgatggcgaggaatccttggacgaggatgacctgacttaaaacgatctcccgagccaaaaggtgcagagagcaaacgtcatagtttgccatcggtgggggaacaactgtaaaaagaagttatgcgagttacatactaaaaacttgtgggcagcattcccatatctataaacatgaaatttgtagggcccaattatattgtatccgtactggtggtttggtgttacggaaacaacgaaactttagtggtatgtttatggtgtcctgtgctacatgattcttgcaaatccagcatggtgtaaaattaagatgaaaaaaaaaaaaaaagcggcc

SEQ ID NO: 9912 - DNA, 3606 bp, Zea mays
  misc_feature (3004)..(3004): n is a, c, g, or t
caccaaccaaacagaggaaaaggaggggaggaagaagcggaggagagagaaaccctaatcgagatgggcaagcttctctgcgacccctccgccgccgccgtcgccgaggccctgccgccgtccccagcccccgctccgcctccgccgctcctcgcttggtcctccccggccccggcctcctcccccgaggcctccatctcgcccacaggctgggacgcggtctgggcgctcgaggaccagcagcgccgccgcctccaccggatctgggagcggggcgtcgcgtggaaaccctcctcgccgggcgccggcgaggccgcgttgccgcccgtggtcttccgcctcgaccacggcggggaggtcgacgccgatggcaactgcctcttcaccgccgcgcggacggcagccgctgccaaggccgacgcgcgcgagctgaggcaccgcgcagtgcgccgattcgccgaggtctacgccgccgctggggaggacgacaagaacgccgtcgacgccgccgtgaggcacctctacgcgccggatctcaaggccgggtggggcgtccatgtcgtgcaggagatcaaggcgctcgtgcccaaggcccagcgccacgcgctcgactccgccatccaggagctcgtcgatctcggtatccaaagggaaatagcagctgaaactatctacaaggaaagatgcatcactgtagacaatggggatagttggaccaagtacatgtccatttctggttcttcagaggacgagcatgacattatcaccctgcagtacacagaggaggggttactgacaatagatgagaaccgagatggccgtgcagctgcatttggcgatgatattgccattgaatgcctagctactgagttcaagagagaagtttacgtggtgcaagcccatggagcggatgcaatggttgacgaggataactgtgtgttcttcctcccacacagtcctcgaggagaagtttgcgagccaccgatttttcttttcatgaaaggaacagcatggtgtggtgctggtgctgaccattacgagcctttgatcgccactgtcctccagcatgttactccagacaaggcagctgtcatcctttgagaatgactgcagttttttctacctcccttagcttttagtcagcggtggagttgagacaattttgttattggagctagagtgctgaattgaggagcgacatcaatatgcccaagagattagagagacggccaacctgagtatcttgctctgttgcggggttttgcctgcttatgaagctgtgtatggtgattttgttgttgtatgtttatgagtaggctctgactagcgaggatattctgagtgtagaacgtcgaatctagattttttgagggtctgatgttgtttgccattgtcggccggcatttttgtattgcttattgtgaggattttcgtttcttgacgcctgtttctagggacatcatgattggacatttggaatgcaaacaattcctttgtggtgttgggttaaaaaaaaaaaaaaaataatttttattgctgaacgtagagtaattattgaaattgcgggtgtaaattacatagttaagggtgcccttgttttgacaaaacgttataatctacttgtgcaaaatgtgagtttataggatgtatgcagatcagatctgtaattacatcctctgagcctccagactttagatagaaaacgagcaattactcgcgggtctgtaaattacaaaaagtgatggctggtgcctacagaccggagtggggtttcttcttggctatttggttcggatttaaagccatctgtttgaactgctacagttacaatccatatagataaaaaatattgtagaaaaaatagaagccaaacgaacatgtcaactctggtagtacttttgcattatttggtcacttttctcatttctgatcagagctgtgttttgaaacttgttatcatttagcaattatcagctgcaatttggttgacatccaaattacaagcacattttaagccatcccaacatgtggtaatccttaattggtttttgttttttcaacgtgttacatctgactgtagttaaaatgaccctcgtccaggcatccaacaataatcaggacagacgtttctatgatcatgtttagatccatagggctaatagctagctgctaataattaggacaacgactgttcaaacaagtatttttgggtctataaatcgtgattcaactacagttgcacatttaccttccactggaaactgttttttttttgttaagctgcgcgagctggaggggttttttaaatccaaaatatgcaactacaattagatcacgacataaaagcccaaaagactcgcttgcacatttatatctaaggcttttatgtaacattgttgccgctaatatatagatgagaacgtatctagtgtacatggaattttagtgcacatgatgcacatattaaatcatcaccacacatcttagatctaacgtctgtagttgtttgatatatttgctaaggacatcctctgacgtggtgggctgtaatggtggaaggtgttatttataaattataatgatcaactagagatgttagatttgagatgaatagtgatgatttaatatgtgcaccatgtgcataaagctttcatgtgcatcggatatgtcttctatatagatatatcgatattaccattttatgtcatttagcagaaaaaatgttatacgacatcctaaatacttgcataactgtttagcatagctctagagcagaactacaagctgcaataacaattttctatccaaatatcttaactctagagcaaaaagaaactctgaagtttttggagttgtagtacaaaaaaacggagtacctacttccctactccaaaaacagccaaaacgaacataaaagttgagtttacaaatatttacccaccattgccaactcattacacacaaaacagtctgtcctttaaatgtaccatagcctttctaccanatcgttctttctagcccatagtcttccttttccctctctgcacctctcggtgtgactgctcggttcctccgacgtgcctcttcctcccgatgtgcctcctcctccctccaccgcccgtcgtgcttctcctccctttgcccgctgcgcttccccctgcgtcgtccgccacgcctgaagtagggtggagggcgatgtcaacaatgtcgttggctcaggcgtggagggcgtcattccccatctcgagccaaaaggcacagaggtgagctttcatatgtgttctctactcgtccatggaggtggtggtgagctaaggaacgcggggcagggcttcccgtcgggtttcgatgtagcaaactagtgtctgcttcaaacatgtgctttttgcatgttctgtattggtatgtggtaggatatgtactattgtttagcagtatatccttagggtttgtagttgtctgacacctaatgttgatgttatatatgacctcattaaatgaaaaaattgttgttaaacatggcttgttcatgttccatatctgcacaacacttatttttgtgcactagtacatgaatttgaatagtttatagttttgatgcatatg

SEQ ID NO: 9913 - DNA, 1386 bp, Zea mays
atcgcagcggcgcgtttgggttctccgccaggccggcgcgttcgacccggtagcccgaaaccgcccatatatcttgccaactttctgcgacacggtggaggcgtggagctaactacccccgcgctggctcgccaccgccgccgcagcaggcgtgggaatctgggcagcgccccgcggagaagaggaggcagcgcgctctccgtccgccatggcgggctcttccgaccccgacaagctcatgagcaaagccgacaaactaacaaaattgagttttacaagatggaatgctgattggaaaagcgctacctccttgtatgagcaagctgcaattgcgtataggttcagaaaggacaatgagaaagcaaaagatgcttttgagaaggcctcaaaaggacaggaaatgatctcctcaccatgggacgctgctaagcatatggaatctgctgctgctttagcaaaggagcttgggcgctggaatgaagtatctgatttctatcacagagcttcagaattataccgtgaatgtggaaggccacaacctgcatctgatgctctagcaaagggtgccagtgcattggaggagaaatctccagaagaagctatcaaaatgtatgatgaggcttgttcagttctagaagaagatgggaaggaacagatggcttttgacttgtaccgtgccgcagcagctttgtatatcaagatggagaaatattcagatgccgctgctttgtttttaagacttggttcagctgctgataagtgcaatgccatcaatagccaatgcaaggcctatctgagtgcgatcatcatctatctttacgcacatgattttcagcaagctcaaaaatgctacaatgactgctcagaggttcaagccttcctcaatagcgaccagaatcgatgtgcaacgaagctattgtctgcttatgaggaaggtgatgctgaagaaatcaaacgcattgctcaatcaagtgccttcaatcaccttgaccatgtggtaattaggcttgcacggaagctaccaacaggtgatctgcaggccatcaagaaagctgacgatggcgaggaatccttggacgaggatgacctgacttaaaacgatctcccgagccaaaaggtgaacgtcatagtttgccatcggtgggggaacagctgtaaaaagaggttatgcgagttacatactaaaaacttgtgggcagcattcccagatctataaacatgaaatttgtagggcccaattatgttgtatccgtactggtggtttggtgttacctaaactttagtggtatgtttatggtgccctgtgctacatgattcttgcaaatccagcatggtgtatatttgttggccgaaaaaaaaaaaaaaaaaaaaaaaaaaaaagcggcc

SEQ ID NO: 9914 - DNA, 1712 bp, Zea mays
  misc_feature (1670)..(1670): n is a, c, g, or t
ccacgcgtccgcttgccttcgggtacccccggccggccggggtggagctaactacccccacgctggctcgccaccgccgccgcagcaggcgtgggaatctgggcagcgccccgcggagaagaggaggcagcgcgctctccgtccgccatggcgggctcttccgaccccgacaagctcatgagcaaagccgacaaactaacaaaattgagttttacaagatggaatgctgattggaaaagcgctacctccttgtatgagcaagctgcaattgcgtataggttcagaaaggataatgagaaagcaaaagatgcttttgagaaggcctcaaaaggacaggaaatgatctcctcaccatgggacgctgctaagcatatggaatctgctgctgctttagcaaaggagcttgggcgctggaatgaagtatctgatttctatcacagagcttcagaattataccgtgaatgtggaaggccacaacctgcatctgatgctctagcaaagggtgccagtgcattggaggagaaatctccagaagaagctatcaaaatgtatgatgaggcttgttcagttctagaagaagatgggaaggaacagatggcttttgacttgtaccgtgccgcagcagctttgtatatcaagatggagaaatattcagatgccgctgctttgtttttaagacttggttcagctgctgataagtgcaatgccatcaatagccaatgcaaggcctatctgagtgcgatcatcatctatctttacacacatgattttcagcaagctcaaaaatgctacaatgactgctcagaggttcaagccttcctcaatagcgaccagaatcgatgcgcaacgaagttattgtctgcttatgaggaaggtgatgctgaagaaatcaaacgcatggctcaatcaagtgccttcaatcaccttgaccatgtggtaattaggcttgcacggaagctaccaacagatgatctgcaggccatcaagaaagctgacgatggcgaggaatccttggacgaggatgacctgacttaaaacgatctcccgagccaaaaggtgcatagagcaaacgtcatagtttgccataggtgggggaaccgctgtaaaaagaagttatgcgagttacatactaaaaacttgggcagcattcccagatctataaacatgaaatttgtagggcccaattatgttgtatccgtactggtggtttggtgttaccgaaacagcgaaactttagtggtatgtttatggtgccctatgctacatgattcttgcaaatctagcatgatgtatatgtgttggccaatcattactcctacatttgtagctgtgcagtagcccacgcgcttccatcgcaagtagtaggtcgggacattcggttaattccgtgatgaaatcagtttcagtgttgactaaatgttatccgaaattgttgccaaaaactaataattgactaaatttggtaacgatgtagtctaggacgtttctcgatccatatcccgtatggtgtcttatctactgatctagatgacactctatatagggtaaatgcaccggtttctagaacatatctctaaaatggcaatagaagattagcttagctcatcattgacgataactgccaacaacctttgctctattgccaatgcacattcaactcacatcttgcnagacacgggtacatatgagtaccacaggtctctgactgatac

SEQ ID NO: 9915 - DNA, 667 bp, Zea mays
ccggccggggaactgccagttcccgtcctcatccaggggtaggcagttgtgccacctaaactgctcgaatcagcaggtgtgggaatctgggcagggcgccgcggagaagaggaggcccagcgctctacgtccgccatggcgggctcttccgaccccgacaagctcatgaacaaagccgacaaactgtaattaggcttgcacggaagctaccaacaggtgatctgcaggccatcaagaaagctgacgatggcgaggaatccttggacgagaatgacctgacttaaaacgatctcccgagccaaaaggtgcagagaacaaacgtcatagtttgccatcggtgggggaacatctgtaaaaagaagttatgcgagttacgtactaaaaacttgtgggcaacattcccatatctataaacatgaaatttgtagggcccaattatgttgtatccgtactggtggtttggtcatttggtgttaccgaaacagcgaaactttagtggtatgtttatggtgtcctgtgctacatgattcttgcaaatcgagcatggtgtaaaattaatatgttggccaatcattactcctacatttgtaaaaaaaaaaaaaaaaaaaaaaaaaaaaaaaaaaaaaaaaaaaaaggactcgagaggggggccgtggcccctagggcc

SEQ ID NO: 9916 - DNA, 2007 bp, Zea mays
ttcagttagatctgaagctcttgcacaaagtctcttccactagatgggcataaaggtggattaattaggacttataggctagaactcacaccacaactaactaataggtaggctcaatatgccgctggattaggacgctgatatgataacaataataaaaatggtttatagtggtttgaccgtgtaagcatgcataatactctacatcatctttatgatggatgggtaatgggttgatgaaaatggagatgaagattgcatgcttagatatggtatactggtatgaacattggaacatgcatgaggaccgatcgactagctccacctttatttttattccgttgagagttatcgtcatctaagtttttaagaagcgtaaaatctagcaaagctcggactaagagcatggatctgaagccagcgttcggaaccttcggaccctcttctacattgctttaaataatatgacaatatcatacagctaagctagcggtactggccatgtttgtgtgactgagccggccagctccgccaatcccgttggcttggctgcaactaacgaattggctataaatatcagcagctccgggcgccggtccggaaccaaagctagctactttgttgctgtttttattcgtttgtcacataagcagtggtggtcggtcggccggcgacaatgagcggccgtgtgttcgtcctggccgctgccttcggcgtgctgctcgccgcagccgccgtgtcctcgaggcccgtcctgactccgctgggtactagccgccctgctgccggcgacctgtccgtgtacttccacgcggactcgtgcccgcagctggagacgatcgtgcggtccagcgtggacgcggcgctccagcagaacgtccgtctgacggcgggtctcctccgcctcttgttccacgactgcttcccgcagggctgcgacgcgtccatcctcctggacaacggcgagcgcggcctcccgcccaacgtggggctgcagcaggaggccgtgcagctggtggaggacatccgcgggaaggtgcacgcggcgtgcgggcccaccgtgtcgtgcgccgacatcacggtgctggccacccgcgacgccgtgagcctgtccggcgggccttccttcacggtgccgctggggcggctggacagcgcggcgccggcgtccagcaacgacgtgttcacgctgccgccgccgacggcgacggtggacgagctgctgacggcgttcgggagcaagaacctgtcggacccggcggacctggtggcgctgtcgggcgcgcacacggtggggaaggcgcggtgcagctcgttcggcgacgtggcgggcccggccaccgacgacgtgacgcggtgcgtgacggcgacgtgctcggcccccgggagcggcgacacgctgcgggacctggacttcctgacgcccgccgtgttcgacaacctctacttcgtggagctgacgctgaggaagaacaagggggtgatgctgccgtcggaccaggggctggtgagcgacccgcgcacgagctggctcgtccagggcttcgccgacaaccactggtggttcttcgaccagttcaggacctccatgatcaagatgagccagctcaggggaccccaggggaacgtcggcgagatccgccgtaactgcttccgcccaaacaccaacggcatcgccgcctctgcttgagttgactgaccaggcaccgatccattacttcactttcactgtgtgtaataattaataataataaaacaaaaacaacgccagcccgtacgtgccgtgtgaggggggcacgtggttgtggctatactgtagccgtcaccaccatgtcggcgtcgtccatgcatgtcgcattaccgatttttgttcatgttccgatctcatctcatcatctcgctatcaataacaattataatagtgtttattagtagtacatcgcatcacatggcgactctgactctcaactatgatcacctactcaccagtttcttgtcccgtccccg

SEQ ID NO: 9917 - DNA, 1873 bp, Zea mays
acgtacccgttccatctcaagtgaaagagatgacaactgtcctaacaaacaaactagggctcaaaactaacttcaaaaaaatcacccactaaaagcaccttcctcttcctcttcctccgcccccaatccccctcgtctcacaaccctagctgcccccgaatccatggatcctaacaaatccagcaccccgccgccgcctccagtcatgggtgcccccgttgcctaccctccgcctgcgtaccctcccggtgtggccgccggcgccggcgcctacccgccgcagctctacgcaccgccggctgctgccgcggcccagcaggcggcggccgcgcagcagcagcagctgcagatattctgggcggagcagtaccgcgagatcgaggccactaccgacttcaagaatcacaacctcccgctcgcccgcatcaagaagatcatgaaagccgacgaggacgtccgcatgatcgccgccgaggctcccgtggtgttcgcccgggcctgcgagatgttcatcctcgagctcacccatcgcggctgggcgcacgccgaagagaacaagcgccgcacgctccagaaatccgacattgccgctgccatcgcccgcaccgaggtattcgacttccttgtggacatcgttccgcgcgacgacggtaaagacgctgatgcggcggccgccgcagctgccgcggctgccgggatcccgcgccccgccgccggagtaccagccaccgaccctctcgcctactactacgtgcctcagcagtaatgtatcatcatcacgttattgttccgtctatgtgcctgagcaataatgtatcatcattgccttattgttccggggcagttgtgttatttgtgtctgtttagttgctgctgctgttaccgcgtaatagcatatgtgttatctgtgtctgtttagttgctgctgctgttgccgcgtaataaaacttggtcatttacggggctccctcaagattaagaattgagttgtttgatggtagaatcctggtaaggttgttgtaactggggggcgcctttgtttgggctggtagtgtatgcctaggcctcacttatctgatgctgtaatgcgacaagtattatgtggttgtctggtaattattgtgcaattactgctcttcaaaaaaaaaaaaaaaaaaaaaaaaaaatgtttctgtgtaacactcataagggcttgttggtttcatcccaatctaagtggattggatggaattaaagggtattgaggacgattttaatctttagggctagtttgaaagctcaaatccccctgaattccctccaatcctcaagtggatttaagtttccaaactagcccttaagggatcaaatctctctcaatcccctccaatccacacatggactgagattaaaacgaacatgcccttaccagaatatggctgtcatgaaggttctgtttgtgtgatgctaacaagctttaattatttaggtgatttgttttgagctttgaagagtgttctttgagttctgttttgttgcactgcgccgagtagtgctttggcatgacatggaatcggtcgatgaattcgatgggtgtatgtattcgattggataacatgtttcttctttgtgtgattgtttcgtgatctggttaattggatatgcattagttctttcaccttttcccgttttagatgatcttcttttgttgacacatgtttgtttcaagctggtctttcaatgcgttacataaacttgtatcatttctttctttaaaaacctttcaaagtcggtatatttaagcgtgatttttttccattattgatcaattagtccttagcaaccagacaaagcctgatgatctatctgtcgaagtgtctaccttaaactgcag

SEQ ID NO: 9918 - DNA, 1613 bp, Zea mays
tgggtacctcgaggccggccgggccgacatcttaactttgcctcgctcgaaacccaagtcggaagccctcaggcgtagcgcgtccatggcgtccaccgcgctggtggcagtggcagtggggggcgccatttctctcggtctcgtcgcctcctctggcgtcgcgtcctgctccctgcgcgccggcggcgactcccggcggtttggcccccgactcgtcctcctgcggagaggaggcgccgagggggaggggacgaggacacggaattgcccaatatttcgttgtgccaataaggtggacgttgtgaccgaggatgacagcgtcgatggtgacgttaccgacgatggagaagaccttgaggatgcagctgatgacgccattgatgctgatgttggtaccgaagatgaactggagtcttcgctgcctgaggatgttgagtggataaagcagcagccacttccttatcctttggatgctctggagccatacataagcaaggagacggtggagcagcactggggagttcaccagcagattcacgtggaccggctcaatggcatgatcggtggcagcgagtgggaaggcatgtcgctggggcagatgatgctcgcctccttcaatgagggcagggagcagccccatcctcccttcttccatgccgcacaggtatggaaccatgatttctattggcgatccatgaaacctggtggcgggggcaagccaccggaacggctcctgaagtttatcaatagagactttggctcccacgagggtatgatccggcaattcatggatgctgcactaactcagttcggttctggatgggtttggctttcctacaaaggaagcgggttgccttatgtgaaatcgagaagccccatcccatcggacaaccatggtaggctggtgatctcaaagactccaaatgccatcaaccctcttgtctggggccactctccactcctcgcgattgatgtttgggagcatgcatactatctggattacgaggatcgaagggctgactatgtttctgcgattctggagaagcttgtgtcgtgggaaacagtcgagtccaggctcgcgaaagccgttgcacgggcggtagaaagagatgagcatctccgcagaaggattctaaggaaacagcgtttagctcaggcaaacggacagagcagagctaggtctcgcgctcggcaagggaggcaaggagaccaggaagtcgccaggagccgtcccgtggaggcatgacaacgcagctggtaaatggggtgcatcaggacaccgttatgtagctgaatggcgatcaaccttttccctggtgacagtcttgagagcttgcatggtcatattggtctgttttaggccgcatccaccctcagcactgcgaggagggtgggataagttttgctaagtaggattaggggtagaggtagagatgtaaaatagacagaatttcgtcagacttggactcttggagaattcgttttgctcgttattctttgtgggatgtgagtgacaatgtaagaggacatgattgtgtgttctgatttctacaaaaaaaaaaaaaattttggtgaaatatatggatttaagatctcaaaaaaaaaaaaaaaaa

SEQ ID NO: 9919 - DNA, 1374 bp, Zea mays
aattcggcacgaggcggcttgtcgccgtgcgcgccgccaccatcaccacacggggcccccgggctgcacgtcaagcgcacgcccatggccatgacgcctcacgcctcggcggccaccgtagccgttacccctgcgttgcgctttccccacactttgtctgccacgggcctctcctcaccgcctctggctgggggctgcggcggctgccgggttcggttccggcccagccagcgcggccgaggcacgcaggggcggcgaggtggctctcacgtgtcgcgcgtggggggcctgctgggcaccgtattcggcgggggcggtcgcgacgatggggaggccacgcggaagaagtacgcagacaccgtggcgcgtatcaactccatggagcccgaggtctccgcgctctcagacgctgatttgcgtgcacgcaccgctgcgctccaggaccgtgctcgctccggggaatccctggattcccttctccccgaagcatttgctgttgtgagggaggcttccaagagagttctaggcctccggccctttgatgtgcagttgattggtggtatggttctgcacaagggggagattgctgaaatgaagaccggagaggggaagactcttgtggccattctgccagcatacttaaatgctttgagtgggaaaggagtgcatgttgtcactgtaaatgattatctcgcaagacgtgattgtgagtgggttggtcaagtcccccgatttctaggactgcaggttggcttaattcaacagaacatgacacctgagcaaaggagggaaaattactcatatgatattacttatgtcacaaacagtgagcttggttttgattatctaagagataaccttgcaatgactgtagatgaacttgtcttgaggaacttcaattactgtgtgatagatgaagttgattcaatccttattgatgaagcaagaacacctcttataatatcaggcctagctgaaaggccaagtgatcggtattacaaagcagcaaaaatagctgaagcttttgagcgagacattcattacacggtggatgaaaagcagagaaacgttttacttacagaagaaggttatgctgatgctgaagaaatactggacatagatgatctgtacgatcctcgtgaacagtgggcttcgtatattctaaatgcaatcaaggctaaggagctcttccttaaagatgtcaattacattgttcgtagcaaggaagtgctaatcgtcgacgaattcacggggatcgttatggcgggcaggcgatggagtgatggtctccatcaagcaattgaagcaaaaaaaggtgtacctatacaaaatgaaaccataactctcgcatcaataagttaccaaaacttcttt

SEQ ID NO: 9920 - DNA, 5963 bp, Zea mays
  misc_feature (1503)..(1503): n is a, c, g, or t
tgcagcaattcctcattcctctcgtgcgccacaaagcctatatcctttctctggcttgctccatacctggtcccgtgctagttaaatctgcatagggtccttgctgcgccccttctagggttcgcttgcaagtttgctcgggcctccgccctgccgccaccacccctgcgagagatgccacgaggctcgtcgagcaggggcgcaagaaggggccgcggaagaaatcagggaaggggtggcgctaggggaaaggtgcacagggcaaccctggtttggtcagatctggttccccgtccccccccccccctagagacccatggtaatcgtgttgaaggaaaacatggcaacgggcatgaaatttttccatcttctgaccttgttcgcaagagcaaaaggattcccaagaagaaaacacttgacggagattctgatgatgaagatggtgaattacgctatctggaaaaactcaaaggggctaaagttgcaccagatcctgtgaacactagccataaagcttatgattttggtgatgatgctctcaagaaaaagaagctatccaagctttctagaaacaagagcaccccatatgaagtggacgacgacttcagaatgtctcgatctggcagggatggtaggaagaagttgaatttaggggatgacaatgagtttatagaagaggaggaatctgagatggatgaaaagaatgggctaaaggaacctgattcacctcaaggcgtgaagatcgaaacccctggtcttacaacaagacagcgagcccttcaaggcaggggtggcaatggtgaaagctttattgagtttcctgatggattaccagcagcttcatcaagaagtaaattcttagcttatgttttgagctttttttgcgtttaacatttctgcttctgacaaaattccatccctaattatgttgcagagcaaaaggagaagctctcagatatggaggtacaagccaaaaaggcagaagctgcgctgaggcgcaagatgcaagttgagaaggcagagaaagaacagcaggtttgcatctgtgcttctggttcagagctttatatggcagttcttttcttttggctgagtgtgatgcaattttacaacctcgaactacaaactgtacaggctgaagcgatgaggaagatactgggaatagattctgagaagaaaaaggaagagaagaagctgaaagaacgagaagagagggtacaacttcctgaagcaatatagttgctgcattgccctatttgctattgtctatcatggacttatctttgcaccgtctcttctccaggaaaaacaggcaagattggaagaatacaggaaaaactgcgtccagactgtcatgggcccaactgggactgtgattacattccctgagagcatggggcttccgagtatatttaactccaaacctgtcaggttacgttgagcactagtactcatctctgttcatttgatcatttcgactgcagctctgcaggcttattcccntcttgcagccttactgttacttgtgattgactccccactacctgcttgatttcatttcatcagctatccgcctccgagggagaagtgtgcaggcccaaacccgtacaagtaccgccactccaagactctggtccctctctgcagccttgcttgctataaggccgtcgaggaccgtcctcctgcccaggggagtgaaggtggtggtggccagggaagcgatgctgggcagggaactgatgacgcgcccaggagagtgctgggaagcaagcatgatgaatctagctgcctgacgcgattcaaccgtgaccgtcagttggctggagaagtgtaatgtcgacatggccagctcgctggtgtgttgttttcttggtctctcctctggtagtgtgtcgtctaacaaccaatcaacctgacaaaagataggtgtgtgactgccggtttccttctgcccgtcgtgaaccaagccgggcttcgttatggtggattggatggatcgagtttaaaacctatggtgtggtcggttcgatgtatgagactactctagtcgagaaatatgaagggaaacaaggtcgtgggagacctcgggctgtgggcgtctttttcgggttcctctcctggttcagattggttttgcttcgtaggcctgtgatgttgatctgattgcaaggtcgcgttgcctgcgtttcgtccaatgttcctttcgcgtcgagagccaacgggagctccacgctgttcatggtcgtcagaggaggaaccgctatcctgcccagtgccaggtaaacctagctgtttcagttagtacgacatgggccggttgttatgggctagtatttttggcatgggcttcttggagagatgggccataagaataacatgggccgagcaaagagcaggaagcaaacaaactcatagccgcgtttttgccctttttcataaggtgggctgtgtacagttcgtctgcaggcgacggcgtggggggaatggccatggcagaagggaacagcacagcagttatattgcctgacgctcggctactcgatgaactgatgatggcgcgtcacgctcggctgccgctgacccacaccaccggggactgtctgtcctccgatcaacagcgtggaccagcgaccgatccatacgcaaacaggattcggaccgggggcctgcctgtacgcagacgtgtacgtacgtgttgacctcgaaagcgctcctctcctctgacctacgctgccgcgtgcagtagcaatcaatggcacgaccacgaccaaaagcgagcggtggccggccggatggacgccggccggccgctgctcgccgggcaggcgccggccggccaccaccatgagtgcctgccggcgcacacgcgcgcgacgacgcagcgcagctttgctttctgcgaaagctgtggcacttgctgctgctgggctgtgctgctgaaaagatcggaacggcatctctgtctctgtctctgcgagctgcgacgacggatgcctcgtcgggactgggactgggagaggacgacaagctatgaactgaacggtcgccatcgtcgtctttttttctcgcccccattcatttcactcataactgaatgtctctctgaatctgaatcccccgcgggacaagctagtgcccgtaactgtgccacggtatgcgcgcgaccgtatgcgactgccgctgctactagcatatattgtagctgccggcctgtacatatatgcacaaaagctgctctcacatttcagatactgtacctggtcaggatcaggtcgggcccgggccgtgccatgacatgacacacaggcatacagcaccagctagctacatgcttgcaccgttcagctcagcatccttatcaggagggagaaaactacctgcgttgttcatgttcatccatcatcatgcgtgcattcagctaaaccaaacagtctgtgagagctgcacgcatccgtgcgaccgtgcctaagctgagctcgaagctggagagaagacacacacagtccatgcatgcatgtacttggcttccatcgtcgcgcgcgtcgtccgtcccagcagagaaaggaagctgtagatcgcgtcgtccgtcctgtggcctgtgggaagggaaagtagcttttgggggggccggggccaggccaggccaggccttttcgcttttttcatttccatgcctgccctgccctgcatcgcagtcgcagcaacatgcgtgctgcttcccactggcgacagatcgagagacggtgcatacagcacagtaacacaagtcacaagggatgggtgcactgcacactcacacacacacacacacacacacacacacacacacacacgggcatgcttggcgaggccgcgcgctcacacgatctcatcacttggatggacgacgacgacctcacttctctcaggaccagcggcagctgctgctgctgctttatgggttttggacattttcgtccacattcactcgctcgtcgcaaagatccctagcttttgcctctgcttgcagagatcagacttgcagctgcatgcgttgcctccttgccccagacgcgcacccagttctttttatctcgctgtctcgctctatgtgtatatatgcaatgccacggtggtacttggtacggcactgttgcattgttgttgtggttgtttttactactggtatggttggtctactctctgcatcgatctgcatggtgctgcgtgcgtgggagagagagagagagagagactgctagcctgggcgacagacagacaggagacatggagacatcgcacaggcggactctctctgaatccatctcgtcttttcattcgattcctttcctcctcctcctcctcctcctcctgagcgagcgcaaggagagagcaagagcattccctgactgactgcatgcactccgctgctggtttgccccgtcttttgccgcccgccctcatgatcgcccaagcatgcatgcatctgactgactccacaccacacacacggttaatcatggcctctcgagcgcgcatgtcaaaagccctgcttattattgcctcgctagctctctcgccttttcactttcatctcccggagtaatcgagtggcgcgcgcggtgtgtgtgtgcatgtatactgctgcctgtgcatgtgggtaaataaaagaggagatcgatgcgcaagggatggattaatggaggagtcatgttagctgctaactaatgcctgatggcgatagatgctgctgcgtcgtttggaaagctagatgcctttgcgccgtatagatcatgtgtatatacatgcatgcatggctgtgcctagctagaacggaagtcgtcgtggccgcgccgtggcgcgtgaaaggcaaacatgaatgcatggccaaaaggaatggaaggaaggaaagaaagcggtaaagtggttaattggatggtggctagctaggcttggccgtgattacttactagctggtgattagagagacaagtaaagtttgagagagagagagagagagagagagagagagagagagagagagagagagagagagagagagagaggtatgcagcaatactactccgtttctccacatgtcgggtttgatttgttcaaagttaaatggttttaattttgcccatcgttttttagaacacatatatattttttatagtaaatctggaaaaaaggaatcttcttcttgtgttggctatatatacaaaaaatttaaattgatggtcaaactagaataaaacgaagtttgcaggattaaaaaaaaaactgtataggtaccaaatggcatgcaagaaatgtactggtatgatattgtgtcgacgaaaggagatggtaaaaaaaaactagagtacaagcagagagagcttcttttccgaaaactgaaagctgggatatgaaatctcggctgacgtgcaccgacggacaggtttttaccggggcatgacggcatgagcgtcacgtgcatgcgtgtgccttgggcggcggccatgaatgagttacttgtgcgctagctagctgctgcagggcagggcaggccacgcacgcacagcgccagaggcggccgggcggcctatggcctatggggttgggacggggttgaagacgacggccggggagagagtgaaagcgacgtggggaggaaagagaaagagacagagcggcgttccgtttgttggttgggcaaagggaatgattgccagcgggggggccctctcgtccctcctcctcctagcgttattgctgacactgcccgcagcacgcgtgccccggatcctctgtgtctttgcttgctggttgctgcatgctgccgtgccaccccgctcgctcgctttcacgccacgccgggtctgcactctgcagatgggagcgcaggaacacggcctgcaatgcaggtggctggtacattccatgctacaacgggcacatgaaatgagacgaggggcgtagtatgtcgccgtcgccatcgg

SEQ ID NO: 9921 - DNA, 3702 bp, Zea mays
ctgcaggagtcaatctaatttaaattttggttccatactcatcatggctttgcaagtgagtgattttgtatgggaccaatccccttatcttttcttcttaatataatgatacacaactatcttgcatgtttgatataaaaaaattcttggtttgcaatgtttgcttgctgttcatactacgatcttgctgacttaaatggtaactgtaagttgatattcttatttcaaccattaatcgaatatatatgttcattattttgctgtgtatgttttcttttgtcatcacataagtgttcattacttgctccattttttaaaggattctggtggccacacaaacaaagagacccatggttatcgtgttgaaggaaaacatggcaacgggcatgaaatttttccatcttctgaccttgttcgcaagagcaaaaggatgcccaagaagaaaacacttgacggagattctgatgatgaagatggtgaattacgctatctggaaaaactcaaaggggctaaagttgcaccagatcctgtgaacactagccataaagcttatgattttggtgatgatgctctcaagaaaaagaagctatccaagctttctagaaacaagagcaccccatatgaagtggacgacgacttcagaatgtctcgatctggcagggatggtaggaagaagttgaatttaggggatgacaatgagtttatagaagaggaggaatctgagatggatgaaaagaatgggctaaaggaacctgattcacctcaaggtgtgaagattgaaacccctggtcttacaacaagacagcgagcccttcaaggcaggggtggcaatggtgaaagctttattgagtttcctgatggattaccagcagcttcatcaagaaagcaaaaggagaagctctcagatatggaggtacaagccaaaaaggcagaagctgcgctgaggcgcaagatgcaagttgagaaggcagagaaagaacagcaggctgaagcgatgaggaagatactgggaatagattctgagaagaaaaaagaagagaagaagctgaaagaacgagaagagagggaaaaacaggcaagattggaagaatacaggaaaaactgcgtccagactgtcatgggcccaactgggactgtgattacattccctgagagcatggggcttccgagtatatttaactccaaacctgtcagctatccgcctccgagggagaagtgtgcaggcccatcgtgcacaaacccgtacaagtaccgccactccaagactctggtccctctctgcagccttgcttgctataaggccgtcgaggaccgtcctcctgcccaggggagtgaaggtggtggtggccagggaagcgatgctgggcagggaactgatgccgcccaggagagtgctgggaagcaagcatgatgaatctagctgcctgacgcgattcaaccgtgaccgtcagttggctggagaagtgtaatgtcgacatggccagctcgctggtgtgttgttttcttggtagtgtcgtctaacaaccaatcaacctgacaaaagataggtgtgtgactgccggtttccttctgcccgtcgtgaaccaagccgggcttcgtaatggtggattggatggatcgagtttaaaacctatggtgtggttggttcgatgtatgagactactctagtcgagaaatatgaagggaaacaaggtcgtgggagacctcgggctgtgggcgtctttttcgggttcctctcctggttcagatttggctttggttcgtaggcctgtgatgttgatctgattgcaaggtccacgctgttcatggtcgtcagaggaggaaccgctatcctgccagtgccaggtaaacctagctgtttcagttagtacgacataggccggttgttatgggctagtatttttggcaagggcttcttggagagatgggccatgaggataacatgggccgagcaaagagcaggaagcaaacaaactcgtagccgcgtttttgccctttttcataaggtgggctgtgtacagttcgtctgcaggcgacggcgtggggggaatggccatggcagaagggaacagcacagcagttatattgcctgacgctcggctactcgatgaactgatgatggcgcgtcacgctcggctgccgctgacccacaccaccggggactgtctgtcctccgatcaacagcgtggaccagcgaccgatccatacgcaaacaggattcggaccgggggcctgcctgcctgcctgtacgaagacgtgtacgtacgtgttgacctcgaaagcgctcctctcctctgacctacgctgccgcgtgcagtagcaatcaatggcacgaccacgaccacgaccaaaagcgagcggtggccggccggatggacgccggccggccgctgctcgccgggcaggcgccggccggccaccaccatgagtgcctgccggcgcacacgcgcgcgacgacgcagcgcagctttgctttctgcgaaagctgtggcacttgctgctgctgggctgctgaaaagatcggaacggcatctctgtctctgtttctgcgagctgcgacgacggatgcctcgtcgggactgggactgggagaggacgacaagctatgaactgaacggtcgccatcgtcgtcttttttctttttttttcttctcgcccccattcatttcactcataactgaatgtctctctgaatctgaatccccccgcgggacaagctagtgcacgtaactgtggcacggtatgcgcgcggccgtatgcaactgccgctgcctgctactagcattgtcgtagctgccggcctgtacatatatgcacaaaagctgctctcacatttcagatactgtacctggtcaggatcaggtcgggccgccgtgccgtgacatgacatacaggcatacagcaccagcagctacatgcttgcaccgttcagctcagcatccttatcaggagggagaaaactacctgcgttgttcatgttcatccatcatcatgcgtgcattcagctaaaccaaacagtctgtgagagctgcacgcatccgtgcctaagctgagctcgaagctggagagaagacacacacaggccatgcatgcatgtacttggcttccatcgtcgcgcgcgtcgtccgtcccagcagagaaaggaagctgaagatcgcgtcgtccgtcctgtggcctgtgggaagggaaaagtagcttttgggggggccggggccaggccaggccaggccttttcgcttttttcatttccatgcctggcctgccctgccctgcatcgcagtcgtcgcagcaacatgcgtgctgcttcccactggcgacagatcgagagacggtgcatacagcacagtaacacaagtcacaagggatggatgggtgcactgcacacacacacacacacacacgatctcatcacttggatggacgacgacgacctcacttctctcaggaccagcggcagctgctgctgctttatgggttttggacattttcgtccacattcactcgctcgtcgcaaagatccctagcttttgcctctgcttgcagctgcatgcgttgcctccttgccccagacgcgcacccagttctttttatctcgctgtctcgctctatgtgtatatatgcaatgccacggtggtacttggtacggcactgttgcgttgttgttgttgttgttttcactactgcatcgatctgcatggtgct

SEQ ID NO: 9922 - DNA, 1323 bp, Zea mays
gccgactctagattatccctctgcagctccgcaggtctattcctttctgcagtcttagtgttacttgtaattgattcgcctctacctgcttgatttaatttcgtcagctatccacctccaagggagaagtgtgcaggcccgtcgtgcacaaacccgtacaagtaccgcgactccaagacgctgctccctctctgcagcctggcgtgctacaaggctgtccagggccgccctcctgaccagcgaaccgacgctgcccaggggagtggaggtggccaggaaagcgctgggaagcaagcatgatgaatctagctacctgacgcgattgaaccgtgaccgtcagttggctggagaagtgtatgttaacatgtccagctcgctggtgtgtggtttcctttggcggtagtctaacaaccaacctgacaaaagatggggtgaccgcctgcccgtcgtgaaccaagccgggttttgttaatggtggttcgagtttaaacccatggtgtggtcggatcggtgtatgagactagtcgagaaatatgaagggggaaaaaaacttgtacagcaatcttgtgcttgcgtggttggttgggagcccagcatgctgcatgcatctgtggcacgttgaaagtgatattatcggaacggcatctctgtctgatccgtccgactccggtggaggagtggatgcctcgatccttgtttgcacttgcagctgcgtgctgggcgggaggaatggacaagctcgcaatctatctctgaatcctccccgggaccgggacaagtgcattgtagctgcctgcctcacatttcagctactgtacctggaggatcggatcgaacactacgtaccatgacactagctagctacggtacaggtcgtatacagttccgatcacagccgcagccttttttccccattccatgcctgcacagcaacatgcgcgctgctgcttctcactggcagagtgacagatagcgcatatacggttgtagtaacgcatgactgatgatgggtgtgatgaacacatgggaatggcgacagtctatgtatgcatggatggagacacagagagacagacagacagaggagagatgggatacatagagctgccggacagacatgaatcaatgtacaggcagaggcgaatagagatagagtgagtgctcgatcatccatccagagtagacatacaggcaggagtaggcaacctgagtgttccagagagggaaaggagcgtacgtgttcacccgtcacgctggagcggatcgaagggagatgtgacgagtcctgcgaggcagggatatgcccccgagacggcactgcag

SEQ ID NO: 9923 - DNA, 1340 bp, Zea mays
tcgagccggcaggccggggccccggccccgaggactggtttacgcctttacggctcgcccccgtcttttcttctcgtgttctcccctccccgcgtgcgctccctttcgtggcacgactgggcgaccgccgctgtacgccagctgctcagatctcgtcgggccccttcgccggcgaccatcacctgttagggcaatgatgggaggctggggggtttcggatgggtacgagggatcaaagaggacacgaatgatgatggaatcgaatccctacttcgcagtgaacgcagggagtccattggatgtctcaaagaggtctaggattgttgaaccaggcccgccctattttggggccatgggcagcaacactggtggtgccagtggtggcttctaccagcccttcaacagcagcaacttagctggtgcaggggctagcactggcatccaaaactttccaggtgtacggctgcgaggtctcccttttgattgcaatgacattgatatctgcaagttctttgtgggactggacatagtggactgcctcctggttaacaagaatggccgcttcactggtgaggcttttgtggtcttcccaacagctatgcaaacagaatttgctctgcatcgtaacaggcagaacatgggccggaggtatgttgaggtgttcagatgtaagaagcaggagtactacagtgcaatagccaacgaggtgagccagggtggttactttgagtcggagtatcgccgctcctcacctcctccgaggccccctaagaagactgctgaagacaagggcagcatggagtacactgaggtgctgaagctccgtgggcttccctactctgcgaccactgaggacatcatcaagttcttcctggagtatgagctgacagaggagaatgtgcatattgcgatccgctcagatgggaaagctaccggtgaagcctttgttgagttcccaacagctgaagttgccaagacggcgatgtgcaaggataagatgactatcgggacgaggtatgtggagctgttcccgtctaccccagaggaggcgagcagggcgagaacccgaggcaggcattgaagaaacgaatggcttggctgaatgatctctggttgcatgtggctgcaatcgactgtagttttcacttcgcatgcttatctgtatcgcttttagattgtgttagttgtgtgtatttgacttcttatatgcgaactgaactgtaacaactttcctttgttggccggccgcacatgtacggcataatcatttatggattttgctacgtttgagtttcaaaaaaaaaaaaaaaaaaaaacagacgcggggcccggtacccgga

SEQ ID NO: 9924 - DNA, 1047 bp, Zea mays
cctcgagggccccgcccgggcgagtgccctagtaaccctagccgcctgaggccgacgccaactctctcctgaccgcaacggggaactcgacccccgcctccgccaccgccaccgcgccggtcgccgacccactcagatgaacacgtctccgtccagatacagtgaacgcagggagcccactggatgtctcaaagagggccaggatgatggaaccaggtgctccctattttggggctatgggaagcagcgccagcggtgccggcggcggcttctaccagccctttaacagcaacctagctggtgcagggtctagcaccggtatccaaagcttcccatgtgtccggctgcgaggcctcccctttgattgcaacgacattgacgtctgcaagttctttgtggggctggacatagtggactgcctcctggtcaacaagaacgggcgcttcaccggcgaggctttcgtggtcttcccaacatccatgcaggcagagtttgcgctgcatcgcgacaggcagaatatggggcggaggtatgtcgaggtgttcaggtgcaagaagcacgagtactactgcgcaatagccaatgaggtgaaccagggcggttatttcgagccggagtaccgccgctccccgcctcctccgaggcctaggaagccgtctgaagataagggcagcatggagtacacagaggttctgaagctccgcgggcttccctactctgccaccactgaggacatcatcaagttcttcctggagtacgagctggcagaggagaacgtgcatatcgcctaccgcaccgatgggaaggccacgggtgaagccttcgttgagtttccgacagctgaagtcgcgaagacggccatgtgcaaggataagatgaccattgggacgaggtacgtggagctgttcccgtcgaccccagaggaggccagcagggcgaaatcccgaggcaggcattgaagaaacgtgttccagtgatcttctgtatgcatgcatccggcccttcatacgagcttacgtatgcgtgcatgtgcatgtcatagttctt

SEQ ID NO: 9925 - DNA, 1338 bp, Zea mays
cattgggtccctcgaggcccgccggagtgccctagtaaccctagccgcctgaggccgacgccaactctctcctgaccgcaacggggaactcgacccccgcctccgccaccgccaccgcgccggtcgccgacccactcagatgaacacgtctccgtccagatacagggcaatgatgggaggctgggggggttcggatgggtacgagggatcaaagaggacgcgaatgatgatggaatcgaatccctacttcgcagtgaacgcagggagcccactggatgtctcaaagagggcaaggatgatggaaccaggtgctccctattttggggctatgggaagcagcgccagcggtgccggcggtggcttctaccagccctttaacagcaacctagctggtgcagggtctagcaccggtatccaaagcttcccatgtgtccggctgcgaggcctcccctttgattgcaacgacattgacgtctgcaagttctttgtggggctggacatagtggactgcctcctggtcaacaagaacgggcgcttcaccggcgaggctttcgtggtcttcccaacagccatgcaggcagagtttgcgctgcatcgcgacaggcagaacatggggcggaggtatgtcgaggtgttcaggtgcaagaagcacgagtactactgtgcaatagccaatgaggtgaaccagggcggttatttcgagccggagtaccgccgctccccgcctcctccgaggcctaggaagccgtctgaagataagggcagcatggagtacacagaggttctgaagctccgcgggcttccctactctgccaccactgaggacatcatcaagttcttcctggagtacgagctggcagaggagaacgtgcatatcgcctaccgctccgatgggaaggccacgggtgaagccttcgttgagtttccgacagctgaagtcgcgaagacggccatgtgcaaggataagatgaccattgggacgaggtacgtggagctgttcccgtcgaccccagaggaggccagcagggcgaaatcccgaggcaggcattgaagaaacgtgttccagtgatcttctgtatgcatgcatgcggccgcgttcgagctcagttttcattttgcatgcttgcctctgtgtgtcgctgttaggtggtgttaacctgagctgtcatgtttcgctactgatcgtgcagtgatttgttatatctgaagttctgaactgaattgtaacagttgtcttctgttggatgcacttgtatggcatatcgttttctataaaaacacgaaggttgcttgtccaaaaaaaaaaaaaaaaaaaaaaaaaaaaaaactcgagcccgg

SEQ ID NO: 9926 - DNA, 2498 bp, Zea mays
ctggtggctgcaacttgattcagtgacatatattagattttttcccataaggaatggcatatatataatagctataatgctggcatgctgcattggttacatgcaggtagcagagttgcttgcgtgcgaaggccgcttggtctggagttaagcgcgtgttgtaatggaggggcgtgggaaccctccgcacaccaccactgatgctgtgatcaagaagccaaggagcgtcgcatccaggaagccaaggtccacggagcagctcacgtatgagtacaatggcatttgcccgccatcttggagcgctccccatgacgatgacactggcgttggagctggtggacatcggaggaaagagctacacctaaatagccctgaaatgaagggctccatggctcataggagcgacgtgcccaggaagataaggagggatgatagatctggaggcgaccatgatggccatggtcggagcagcaaagcaaaggatgctgccaagcatggaagtgaaaatgttcttgccctagagtgcacagcaagaaacaatggatcccctgataacccacagttggtccccagagatgactctatgccttgtgaaaataggtcgagaaaagtaaagctcaaagttgttagtcgaaccctacatgccaaaaatggccaggatgctggtggcagtggtattcctgccacgttggatggctctattcatcagtacaagcaaaaggattctggtggccacacaaacaaagagacccatggtaatcgtgttgaaggaaaacatggcaacgggcatgaaatttttccatcttctgaccttgttcgcaagagcaaaaggattcccaagaagaaaacacttgacggagattctgatgatgaagatggtgaattacgctatctggaaaaactcaaaggggctaaagttgcaccagatcctgtgaacactagccataaaggttatgattttggtgatgatgctctcaagaaaaagaagctatccaagctttctagaaacaagagcaccccatatgaagtggacgacgacttcagaatgtctcgatctggcagggatggtaggaagaagttgaatttaggggatgacaatgagtttatagaagaggaggaatctgagatggatgaaacgaatgggctaaaggaacctgattcacctcaaggtgtgaagattgaaacccctggtcttacaacaagacagcgagcccttcaaggcaggggtggcaatggtgaaagctttattgagtttcctgatggattacccgcagcttcatcaagaaagcaaaaggagaagctctcagatatggagatacaagccaaaaaggcagaagctgcgctgaggcgcaagatgcaagttgagaaggcagagaaagaacagcaggctgaagcgatgaggaagatactgggaatagattctgagaagaaaaaggaagagaagaagctgaaagaacgagaagagagggaaaaacaggcaagattggaagaatacaggaaaaactgcgtccagactgtcatgggcccaactgggactgtgattacattccctgagagcatggggcttccgagtatatttaactccaaacctgtcagctatccgcctccgagggagaagtgtgcaggcccatcgtgcacaaacccgtacaagtaccgccactccaagactctggtccctctctgcagccttgcttgctataaggccgtcgaggaccgtcctcctgcccaggggagtgaaggtggtggtggccagggaagcgatgctgggcagggaactgatgccgcccaggagagtgctgggaagcaagcatgatgaatctagctgcctgacgcgattcaaccgtgaccgtcagttggctggagaagtgtaatgtcgacatggccagctcgctggtgtgttgttttcttggtctctcctctggtagtgtgtcgtctaacaaccaatcaacctgacaaaagataggtgtgtgactgccggtttccttctgcccgtcgtgaaccaagccgggcttcgttatggtggattggatggatcgagtttaaaacctatggtgtggtcggttcgatgtatgagactactctagtcgagaaatacgaagggaaactcgggctgtgggcgtctttttcgggttccgcccctggttcagattggttttggttcgtaggcctgtgatgttgatctgattgcaaggtcgcgttgcctgcgtttcgtccactgttcctttctcgtcgagaggcaacgggaggtccacgctgttcatggtcgtcagaggaggaaccgctatcctgccagtgccaggtaaacctagctgtttcagttattacgacataggccggttgttatgggctagtatttttggcatgggcttcttggagagatgggccataataatacatgggccgagcaaagagcaggaagcaaacaaactcgtagccgcgtgttttttttttgccctttttcataaggtgggctgtgtacagttcgtctgcaggcatgc

SEQ ID NO: 9927 - DNA, 3374 bp, Zea mays
tttctgttacgtgatatgacagttctcactatcaaactatagggggtgtttggttccaaggactaaagtttaattagttcgtgtccgaattgaatgtctatttacaagtattaaatgtagtccaattataaaactaattacatagctaaagattaaatggcgagaaaaatttattaagcataattaatctatgattagcaatcccgagcccccaccgcaatcgggcgggcggagcgcgaccgccgcatactccgccgcgcgctccgagctcaatcccccgcgcgcccagccccgagctcaatcccccgcgcgcggccccgagacttaatattcgttcacccgtcgattccgcctccgatcccctccctccttccgttgcggagactcccgcttctgcggcggaggccaagcaggagtcggtgttggagacggaggaaactaagcaggcggtggcagcagcagcagcagcggcaggaggtgtgcaggccatggcggtcaccgtagtgcgggacgtcgagacgggtctggacacgagtaccagcgaccgggacggcgacaagccttcctggttcacacctaagaggtaatccccccaacccgtagcagagctcgattgtgtaccatcgtcgtaggctcggctgtggtaggctttatctgtttccgttgcatctggtttgaggagctctgagggcggtgttgaccttgggtttgggcgatttgcatgcttgtttgttttttttttttttttgcttctcttgagctccaattggtcgtactgggactcgattttgctgggtctgagaaattgggttatccgggttatccggagctccagttcaacgttgtgttgtagctcatttgagctgttgggttgcttggcagctgctcgggattaacttgagcttctggcgatgctcaagtgcggtgggatctgagcagaccagcgaaggtagcagtttagtagttcgaactggagcaacaaatcatttggtgcggtgtgtttcattagttaatttggagcttgcttgtcgctctggttgttccatttgtgactcggagttctcgaatttctacgtttctcctcgtttgctcgctttcgtggtatggaattgcgttttcaattcagtgttcgctcgatgcacttttttttattaggcaactgctgtgctggcaacccttttcagcgagatagctagattggttaaatttagtttactgtgcattgcaattggaagggacctttttcagttgaggtcaattgtaggctgtagcttctattgcctgtatattctgctgagacagggcgactgttggatcccaatattatcgagatggaagctggagaattggttatttggtttcccacatgtcctccggtcatatgagcatctgatatgaaagtttggttctgttctgttgtatggttactgcctctgagttgattatttagtattgtaatcgtattctcaggatgctgctgaattttattcatgttttcaagctcatcttttctcatttttttctgttgggtttcaactgtagcctgacatgacttattgccacaatcaactgttatgtagtctttagtacgaattcttctaggatttttgaaccaggcccgccctattttggggccatgggcagcaacactggtggtgccagtggtggcttctaccagcccttcaacagcaacttagctggtgcaggggctagcactggcatccaaaactttccaggtgtacggctgcgaggtctcccttttgattgcaatgacattgatatctgcaagttctttgtgggactggacatagtggactgcctcctggttaacaagaatggtcgcttcactggtgaggcttttgtggtcttcccaacagctatgcaaacagaatctgctctgcatcgtaacaggcagaacatgggccggaggtatgttgaggtgttcagatgtaagaagttggagtactaccgtgcaatagccaacgaggtgagccagggtggttactttgagtcggagtatcgccgctcctcacctcctctgaggccccctaagaagcctgctgaagacaagggcagcatggagtacactgaggtgctgaagctccatgggcttccctactctgcgaccactgaggacatcatcaagttcttcctggagtacgagctggcagaggagaacgtgcatatcgcgatccgctcagatgggaaagctaccggtgaagcctttgttgagttcccaacagctgaagttgccaagacggcgatgtgcaaggataagatgactatcgggacgaggtatgtggagctgttcccgtctaccccagaggaggcgagcagggcgagaacccgaggcaggcattgaagaaacgaatggcttggctgaatgatctctggttgcatgtggctgcaatcgagtgtagttttcacttcacatgcttatctgtatcgcttttagattgtgttagttgtgtgtatttgacttcttatatgcgaactgaactgtaactactttcctttgttggccggccgcacatgtacgacataatcatttatggattttgctacgtttgagttcattcaagtggtgtttctttcgctaatgttggggatgtgatggaattttcagttcattagcagcacttgtcaatattgcttatcttctcaccgacggcgtgctatcctgtatttaaatagtaaaacaaaactaaaattatgtataaatgagatttaaaccatgtttgttgctgcaatattgtttagagaattctactacactgcatcatggcaggtgttgtttacttgagagttttatgcatagtgtgttattatgcatcatggcctcatggggttgtcgtattgttgtagtgctttctaacttactcataataacaacttcatatatcatttacattgtttttttgtttgtctatctgatcataagtttgtagcaataacttttttgtttgtccatttacgtggggcagcaggctgctgcgctcttgggagagcagcccgtctaccatgccgtacagcgttccattggctgcggggccgccatgcccccagtggcgctgcccggcaaggaggctgggatttggggattatcagcaaagcatcatggctcccgacgaagcaggggctacgaccaacgcactggacgttgctggggggccgcctgatgctggcgtcggctgctgcctgggggcagcggcagagcttatgattgtcgagacctttgataccagattggtaggagttgcattccctataccgatgatatgtttccgttgcaacgcacgggcatccacctagtataatataggatagtaatattctatagttatttatctattgccatctctaaccggccgaca

SEQ ID NO: 9928 - DNA, 1531 bp, Zea mays
aaaaaaaaaaaaaaaaaaaaaaaaaaaaaaaaaaaaaaaaaaaaaattccgctgcgcacaggcgcacagcccagtccagtacaaacagcagcagcttcgcctccacctccacgcgagccaagcgcccggcccggctcccgcagcgcaaaaccctagcctcgcccgtcccaaaccctggcggctacggtctctgatcccggtccaatggcgtcgtcgccggacttgttccctaacgttgccttctccgacgtctctgccgccgcccccgcggccgaggccaccgccgcgttcgggctcggcgccgccaccggggccccgcgcctctgcctcgtcaagtccgggaaggacgaggcggagcccacggtcgacatcgacctcgccgatgcgcaggtatttaagttgggaccgatggagtggctgtgcgtgtgcgacgagtcggaggctaaggctggcgtggaagagaagtcattttcaagagcaattaaggttgttcttaggacagaagctgagagcaaagccttctctttagcttttcaacaatggaaacatcaagttattagtggaaaagctggtgagaggttggagaatggatcaataattgcttcgaaaagcaaatttgatacaaaaattgaggcatcctcagcaaagatgtatttcccctactacgggcaattattacatcagcaaaacatggttacaagattttgctcggacaggaacatactatgctgctgtaatggaaaaccgatctgactttgagggtcgagttgtggttgatgttggggctggaagtggtattctgtcgttatttgctgcccaggctggtgccagacatgtctatgcagttgaggcatccgaaatggctgaaaatgctcaacgtctaatgtccgggaatccgtcacttggacagcggatcacggtcatcaggggcaaggtcgaggaagtagagcttccagagaaagctgacatattgatttctgagcctatgggaacccttttggttaatgaaaggatgctagagtcctatgtcatagctagagacagattccttgctccagatggtaaaatgtttccaacaacaggaaggattcacatggctccattttctgatgaatacctttatgttgaaatagcaaacaaggctctcttttggcagcagcacaatttttttggtgttgatcttacacctttacatggttcagcattccagggatatttttcacagcctgttgtggatgcatttgacccaagattattaatttctccaccaatatatcatacacttgattttactagcatgaaggaagaggagctttacgagattgatatccctctgagttttgtagcatctgttggcactagagtacatggattggcttggtggtttgatgtgtcgttcaatgggagcactgtgcaaaggtggcttaccactgctccaggatctcctaccactcactggtaccaactgcgatgtgtgctttcacagccattggatgcgatggccggtcatgaaataactggccgcctcatt

SEQ ID NO: 9929 - DNA, 2118 bp, Zea mays
gcccgcagaaaagaaggctggtggtcgccgctgcacgcggcccagtccacccacgagtacaaacagcggcagctcgcctccacgcgagccaagcgcccgcaaaaccctagccccgcccgccccaaaccctaggcggctacggtctccgatcccggggtcacgtcctaatggcatcttcgccggacttgttccccaacgttaccttctccgacgtctccgaagccgcagcagggcctgcggccgagggggccaccgccgcgttcggtctcggcgccgccactggagccccgcgcctcagcctcgtgaaggccgaggcggagcccacggtcgagatcgacctcgccgacgcgcaggtatttaagttgggaccgacggagtggctgtgtgtgtgcgacgagtcggaggctaaggatggcgtggaagagaagtcattttcaagagcaattaaggttgttcttaggacagaagctgagagcaaagccttctctttagcttttcaacgatggcaacaccaagttattagtggaaaagctggtgaacggctggagaatggatcaataattgcttcgaaaaacaaattcgatacaaaaattgaggcatcatcagcaaagatgtatttccactactatggccagctattacatcagcaaaacatgttacaagattttgtgcggacaggaacatactatgctgctgtgatggaaaaccgttctgacttcgagggtcgagttgtggttgatgttggggctggaagcggtattctttcgttatttgctgtccaggctggtgccagacatgtatatgcagttgaggcatctgaaatggctgaacatgctcaacgtctaatctctgggaacccatctcttggacaccggatcacggtcatcaagggcaaggttgaggaagtagtgcttccagagaaagctgacatactgatttctgaacctatgggaactcttttggttaatgagaggatgctagagtcttatgtcatagctagagacagattacttgctccagatggtaaaatgtttccaacaaccggaaggattcatatggctccattttctgacgaatacctttatgttgaaatggcaaacaaggctctcttttggcagcagcacaatttttttggtgttgatctcacacctttacatggttctgcattccagggatacttttcacagcctgttgtggatgcatttgacccaagattattaatttctccaccaacatatcatacacttgattttactagcatgaaggaagaggagctttacgagattaatattcctctgagctttgtagcttctgttggcactagagtacatggattagcttgttggtttgatgtattgtttaatgggagcactgtgcaaaggtggcttaccactgctccaggatcccctacaactcactggtaccaactacgatgtgtgctttcacagccattgtatgtcatggccggccaagaaataactggccatcttcgtctcgtagcccatagtgctcaaagctacacaatatacttgacaatgtcagctaaaatgtggggtgtgggtgcggagcaaggcggtatcctacagacatctactgggaaacttgaactgaaggagccatactacaggttgtctcagccacaatcatgcacgttgccacaagatcagcaacagcagcaattgccatctttgcaggcacagggatcggagcagcagatgcaggaagggctcagcccagccttcacgatagaccaagattgcctcaactagacagcctggagtcgcgtatgctaggattccagcaacgagctgaggtctgtacaagcacaagagtttagagtagccgatattgtcaggcgttagctgccaaaggctaatatcacgatcgaggtgtaccgtgtacgagaccattcctgagttgcgcagctggcagctaaactgcggtcgcgccttctccgagggaatcgagaaaaaggaaattataaagtgtatttggtttcaggtaaagtgaagagcgaagggcacccctaacaaggacgggtgtatgttgtttgatatattatattcttgctaggaattaattattttcatgttaagtatgtttaattcaatttgcttc

SEQ ID NO: 9930 - DNA, 2548 bp, Zea mays
ttggaaacctccttttcacatccttgtatccttccttatttggccctttacaatatcacttcacaattaaggtaatatcgccaatctcttcaaattgctcttcatcactttcacttatgaggtgttggtttgaggaatcactatatccaaaatgaaatgatgcatcatgtgtccattcctcaaatttagtgggatgactccattccatatattagtactaaataactaactatgaggaatgaggtggtgatggattaactcattccattccacaaaccaaacaaaaaaatgaggagtgagaagataatggactaactcattcctcaaaccaaacaccccattaatgaggatgttgattctagcctttctttagtctttgcgtgcacttccaccctactagatgatggttctttcttggtttttgtcttgttattgatggattgcttggtagtattgttggcccttaaagctatagattatgggccatgactaggctagcctgatcaaggctacatgaaaatagtttgccataatctatagcaacaaggatgactgtagcataaatttagagaaattcgatgaggttgatggtcccattgtgtttctctagaaggtgaaggcaaaactattttgtccattcaacctgataaagaacggagaatagtgacatgcagcggacaccaattgggtgccctaggttcgatgctacgccccccggtaaaagtgctttaaactggcgccatgtttctctggtcctatgattaagctccgaagtcttggaggagcttcaagcgatagaagccaaggatactatcgacaaggaatgataccatcatgtttccatgttggttttagttgcatttcccgaaatatgaagtaatctagggttacctctagccatcaaaatgaacttggtgacatgacgtcgtcattgcttggtgaccaccttgccagtgtctatcccaccgtatttgccagtgtctatcccgccgcggggcccctgcagggagccctagaacttgccgttgcatacatccgttcttttctaactttcgtatacctgctatcctaaaaataataataactcatagtacaatctaaatagtgggatatgaattcagacaatagaagcactattggtcattgtatcaattttagcgctaattaagggtacgtttaattagagagtcaactaaaataaaatagttctattctaattttgttttagaatgaagccgttctattaccggccagatcaatcggccacccgcgggtcgaggttgctcgcgcagccgaggatccctacgctacgcacgctattctttttggtgagcgcgcgtcggtatcgctatatgagccccacgcgcaccgaagcgaggagaggggtcgcactttgcttcaagtcccttcccttcccgctcatccaccacgtgacgccatctgggccccaccgttgggcgtcgccttccgcctgacgtcactcctccatgtgcggcagctcctatatatacgggcctcccccacgtcctccggcccggatcttgacggcgaccaccttaccaggcactgacgccgtgaactagttagtcatagcccccctgaaatccaagtctcccaagtcccaaccaaggagccttgtgcccatcccatccgtcgtcgtctggacatgcagggaggtgtgagctgcgtcggcgggcggctgggcctgaccatcgacccggctggcgacggggaggcccccgcggagcgcgtggggcggttggtccgcgagagccccgtggtgatcttcgcctggcgcgggtgctgcatgtgccacgtgatgcggcagctgctggcggccgtgggcgcgcacgcgacggtgatcgagctggaggaggccgccgaggaggccgcggcgtcggccgccgccgccgccgccgtgccggcgctgttcgtgggcggcgcgcccgtgggcgggctggacgggctcatggggctccacctcagcggcctcctagtcccgcggctccgggaggtcggcgcgctctgcggctaggccgggccggggcggcgtcgtcacttgctggtggtctggtctctctgtcgatacacgggtacggtacgttacgttacgtaatttaggggaagctgaggggggttggagcgaaatggccgtgtgacgtttgtatacagacgtcgttgctagttctgtctgctttgctttgctgtgtggcgctggggccgggtgaggtggttggctaaagttgaagacctatgtgagaaatgcctgggtgtaactgtaattaatacgtttgtcctgcacgagtttgttaactgcgtccctggttctcctctgcttttgcttggctggtggtataaccatgtgattattgcacaagcgcccccacgctatatattcgtattgtatgtatgcatgcgtgtattcgactgcaatatagtcgaaagggatagaagaattgaattcaaaatgtaaaagtgtactctggtcctacttgtagttggagtgaccatcggcgagcgagcgagataagctattaaacgaggaggg

SEQ ID NO: 9931 - DNA, 2059 bp, Zea mays
ggataatcggcccagagacccagactcccccgctcccaatcccaccaccacccaccttcttgcaattgcagccgccagccggtagtggcagtacggcaatttcagcctcagctgaaggtcactgtctctcttccatctttttctctctcaacaaaactccctgaattgcaaactccaccaaaacaaactccaagcccatccatcaccagtcctctgtcccctccccgaccgcaacgatctgctttgcatcttccccttcctccaattccagtcccatgcgtaatcgtctttcggaattgaatctctccatgtcatggcgctctgagcaagtacagctgcagtcagtgagagaaatgtaggcaccacaaatcagtccagcaaatccctgctcgtgctctaccaaaaaatccagtctttttccagcccaaatccgcctcttccgctgctgccataaagtccggactttacgaggctttcacgacgtgcgagatttctgttatcgatctccacgaacccgatagcctgccataaagtctgcacagacgcttcgcattgcttcaaccaaagatccatccaaactctgcaccccagaaagctagtacgatctcggggggacatgaagcgcctgcagtgcttcaagcagagcagcggcggcggcaatggtggcgggccggggaagcgcctggagcggcggctgtcgctgggcgagtacaagaaggcagtgtcgtggtccaagtacctcgtagcgccgccgggcgctaggatccggagcggcggcgaggagctgtggagcgccgacctgtccaagctggagatccggggcaagtttgcgtcaggccggcacagccgcgtctactccggcaggtacaccggccgcgaggtggccatcaagatggtcagtcagccggaggaggacgccgcgctcgccgctgagctagagcgccagttcgcctccgaggtcgcgctcctacttcgcctccaccacccaaacatcatctcgtttgttgcagcatgcaagaaaccaccagtattctgcatcatcactgagttcatggcagggggctcccttaggaagtatctacatcagcaggagcctcactcagttcccctcaacctagtgctgaaattagctctagatatcgctcgcggaatgagctacctacactcccagggtatactccatagagacctgaaatcagagaacatacttctgggagaagatatgtcagtcaaagtcgcagatttcgggatttcatgcttggaatcacagtgtggaagtggcaaggggtttacaggaacctacaggtggatggctccggagatgatcaaagaggaacatcatactaggaaagtggacgtgtacagctttggaatcgtcatgtgggagatcttgactgctttggtcccgttcagcgacatgactccagagcaggctgctgttgctgttgccctgaagaatgcaaggccgccactgcctgcttcatgccctgtggcaataagccacctgatcatgcagtgctgggcgaccaaccctgacaaaagacctcagtttgatgacatcgtggcgatcctcgagagctacaaggaagcccttgatgaggacccgtcgttcttcttgtcgtatataccacctccaccggaccacggccaccaccaccatcatcagagccttctccggtgcttccctcgctccatgcgaaggtctgcatctctgaaagtatgatcaggccgggatgttgcctctgctcatcgatgctgtgtacaatatgcaccccctttcgactttctttgttttctatgcgcgcgtcggccctctattatgcggcattagcatgctatatgagctagtttatgctctcattttctccttgttggttaattatttccgtcattgatgccttgagtaatgtagagatgacaggcaggcatgcagcttccggttattatctatggatgccatttgcttttggtgatgggaaacatgaaagagccccagtaaatgtaatataattaagctctccatccaaaaaaaaaaaaaaaacgagagtacttctagacg

SEQ ID NO: 9932 - DNA, 1886 bp, Zea mays
ttttttttttttttttggaagcactagcagccaagtttgcgctgcgctttaatatatagaaagaaagaaagaacgattgctgtctaggaaaagctcggcggccggcggccgctcccaaaacacaagcctccaagaactaaggccaagagaagcaacaacggccatgactacatctcatgttccttcccaagccgaccacgtcgccatcttcccgctcatggcgaaaggccacaccatgccgctgctggacctcgcctgcgtcctgcgcggccgggggctcgcagccgtcaccttcgtcacaaccccgggcaacgccgccttcgtccgcgccgctctgcggcagggcggggccggcgacgcggccgtcctggagctggcgtacccggccagcagcgcgcccgcgggcggtgagggcgccgagggcgtcgcctcggcggcctccttcgctgcgttcgcggaggccacgtcggcgctccggccgcggttccaggaggcgctcgcggcgctgcgcccgcccgcgagcctcctcgtcgccgacggcttcctgtactgggcgcacgcgtcggccgccgcgctcggcgtcccgagcgtgtcgttcctcggcacgtctgcggtcgcgcacgtcgtccgggaggcgtgcgtgcgggacagaccgggagccggtgccgacgtcggcgcatccgctggcgccaccacgtgctacacggtgccggagttcccgcacctccagttctccctccgcgacctcgtgccgccgccgccacagatgatacacctggatgctaagatggcggcggccgtcgcggcgagccgcggcctcatcatcaacaccttccgtcaactcgagggccgctacatagagcactggaaccagcacatcgggcctagggtctggcctataggccctctgtgtctggcccggcaatcctactcccccggcggcaccggcagtcaacaacgacacgacgccaagccctcctggatgcagtggttggacgacatggcggctgccgggaagcctgcagtgtacatctcactggggacgctggcatccatatcacaggcgcagctgaaagaggtgtccgacgggctagacagtgccggggtgaatttcctgtgggctgtgcggcggcctgacaacgccgatgatcttggcacggggtacgaggaccgtgttgttggacgaggcaaggtggtcagagaatggttagaccaacggcgggtcctccggcacccatgcatccgaggatttctaagccactgcgggtggaactcggtgctggagagtgtcgccgcgggtgtccccttggtagcatggccgtgcgacttcgaacagcctatgaacgccaagttcgtcgtcgatgagctgcgcatcggcgtcagggtccataccagcgacggagcggttggaggtttggtcaagagcgaggagatcgcgacggcggtcaaggagctcatgtttggggaggcaggaaaggcgatggcactgagagcgaaagggatagcagcacaggctcggctagccgtgtcagatggtgggtcgtcatggaaggaggtcgaggagatgattagtgagctacgtctacgtggggtagatatgaatggaaaagccaacggaggtacctgtgcaagcatactgtagtaccgtacaagggataactcaaaaagaaatggtgtgttggatctttgcactactttggttctgacttctgaacctctgctgtagctccttttctaaagtgctttttgtaaagaaagttctcctgtggccaccagagcaaaagcaagttttcaagccgaatttgtacgattggaaaacaaatctatgaattggatttggaaagactataacataaaactgaatacatattaggctatctcccgca

SEQ ID NO: 9933 - DNA, 1436 bp, Zea mays
gggacacgaaggtgtgtggggtcatgatctatgccaagctcgggcgctagggctggggtgtacgggtgttgatgtttatgcaaaaactacagcggaaataagccatgaggcgtgctctgtgtcacaggatcacgtgctatggtaggaccgggccccggattttgtctacgccattgattccagcgatttggccggggtcagtagctaacgttccatcccagaaaaccccatcttatcataggaagtctaccagttttgccaccaaggtcacaccatccaccacggccatggagtccggcgcagacgaggtggcgttcgagtccccggcacatttccgcatctacaagagcgggaggatcgagcgcctgaaccggcccccggtccttcccgccggcctcgacgaggccaccggtgtcacctcaaaggacgtcgtcctggacgccggcaccggcctttccgtacgcatctacctccccaagctccaggaaccatccaagaagctcccggtcctcgtctacttccacggcggcgcgttcctcctcgagtcggccggctctgccacgtaccacacctacgtcaacccactcgcagccgccgcgggcgtcctggtggtgtccgtggactaccgcctggcaccggagcacccggtcccggcggcctacgaggactcgtgggccgcgctccagtgggtgacgtcggcgcaggacgagtggatcgtcgagcacggcgacacggcgcggctcttcctcgccggcgacagcgccggcgcaaacatcgtgcacgacatgctgatgcgggcgtccggcgccggcgggccgcgcgtcgagggcgccatcctgctccacccgtggttcggcgggaacgcgcccatcgagggcgagccggagggtgccgcagcggccaccgctgggctctggacctacgcgtgcccgggcgcggtcggcggcgccgacgacccgaggatgaaccctctcgcgccgggcgcgccgccgctggagaggctcgggtgcgcgaggatgctggtgtgcgccgggaagaaggacgcgctctacgtgagggaccgcgcgtactatgaagccgtggcggccagcgcgtggcccggggacgtggcgtggctcgagtccgaaggagaggagcacgtcttcttcctcccgaagcccgagtgcgagaacgccaagctgctcatggaccgcgtcgtggccttcattgccggggcctgacttgctctcttgtggccttgttggcgcggcaccgcgcgacgcagcatcaggtcgccattgaagattgaagttgtggacttgtgggcaagtttctctcgctgaatattggtcttgtctaaatttttttctggtacaagtgtggtactgaagtcttgaaactgattttttaataagcaaactataagtccacattattcattaaaaaaaaaaaaaaaa

SEQ ID NO: 9934 - DNA, 2527 bp, Zea mays
cctcgaggccggccggggtcttatcccctcgcccctcctcccctccgccgctccccccagtccccacctcacctcgtcaaccccctccttggatagggttagagttcccccggcacgagcgcgagccatggcctccttcacctgctcccaggtcggcgctgcggcagcgggcggagcctcgcccttcctcggctaccggcggcggagcggccccgggggcgccattccgtcgagctccctcttcgtgggccggcggttggcggcggtgcagatgcgcgcgccctctcgcggggtccgcgggggctccgcgctgcgggtcacgtgcgagaaggtggtggggatcgacctgggcaccaccaactccgcggtcgccgccatggagggcggcaagccgaccgtcgtcaccaacgccgagggtgcgcgcacgactccctccgtagtggcgtacaccaagacaggggagcgcctggtggggcagatcgctaagcgccaggcggtcgtgaaccccgagaacaccttcttctctgtcaagcgcttcatcggccgcaagatgtctgaggtcgacgacgaggccaagcaggtctcgtacggcgttgtcaaagacgagaacggcaacgtcaaactcgactgccccgctattggcaaacagtttgctgccgaggagatctctgcgcaggttttgaggaagttggtggatgatgcatctaagtttcttaatgagaaaattacaaaagcagtggttacagtaccagcatacttcaatgattcacaaaggacagcaactaaagatgctggccgcattgcaggactggaagttctccgaattataaatgaaccaactgctgcatcattggcctatgggttcgagaagaaaaataatgaaacaattctagtgtttgatttgggaggtggtacctttgatgtctctgtattggaagttggagatggtgtgtttgaggtgctttccacatcaggtgatacacaccttggtggtgatgactttgataagagaatagtagattggcttgctagcaacttcaagaaagatgaaggtattgatcttctgaaggataaacaagcccttcagaggcttactgaggcatcagagaaagctaagatggaactgtcaacgctgacacaggcaaatattagcctgccattcattactgctactgctgatgggccaaaacacattgaggcaaccctctcgagagccaaatttgaggaactatgttcagaccttatagacaggcttaaaactcctgttaataatgccttaagagatgccaagttgtctgtcagtgatctagatgaagttattcttgtgggtggatccacccgaatccctgcagttcaagaacttgtgaggaagcttactgacaaagatcccaatgttacggtcaaccctgatgaggttgtttctcttggggcagctgtgcagggtggggttttggcaggagacgtgaaagatgtagttcttctggatgttactccattatctcttggtttggagacattgggaggagtgatgacaaagattatccccaggaataccacactgccaacctcaaaatcggaggtattctcaacagctgcagatggacagacgagcgttgagattaatgttctccagggagaaagagagtttgtcagggacaacaagtccgttggaagcttccggttggatgggatccctcctgcacctcgtggtgtcccacaaattgaagtgaagtttgatattgatgcaaatgggatactctcagttgctgccattgataagggcactggaaagaaacaggacatcaccatcactggtgctagtacgttacctaaggatgaggttgagagaatggtagaagaagccgataagtttgccaaggaggacaaagagaagagagatgcaattgacacaaaaaatcaggccgattctgtggtctaccagactgagaagcaactgaaggagcttggcgataaagtccccgctcccgtgaaagagaaggtggatgtgaagctccaggagctcaaagaggcaatatctggtggatcaacacagagtatgaaggatgccatgtctgctttgaaccaggaggtgatgcagattggccaggcaatgtataaccagtctggtgccagtgctgctgggtctactcctggtgctgaggctgggcctacccctggtaccggaccagcgcagaatgatggggatgtcattgatgcggacttcacagatagcaattgaggggtgatcgatgcatgaccatgtgttgagcatggttggcataaaggagagtgagcaaatagttccttttttgtgttgggatttttactgtaggctatctagtatggagttgatagcggtagtgtttcgcgaacttttctctcgtgattttgactcaacaattggctgaatgctatataaagttcaaagaagggcacaaggtttttattcaaatttaagttgatcgatcgaattgttgcgacagaagtattgaacagatcagttgcctgtccaaaaaaaaaaaaaaaa

SEQ ID NO: 9935 - DNA, 2592 bp, Zea mays
tgtgcggcgctcgagccggcccggctcgcccggttcctaccttcctccccgtcctatcctctccctcgccatcctcgtctccgcctccgccgctccccctcggtccccgccccacctcccgttctctccctccttggatagggttagagactgagttcacccgcacgcgcgcgagccatggtctccttcacctgttcccaggtcggcgcgacggcagcgggcggagcctcgcccttcatcggctaccggtggcggagcggccccgggggagccactccgtcgagctccctcttcgttggccggcggctggcagcggtgcagatgcgcgcgccatctcgcggggcccgcgggggctccgcgctgcgggtcacgtgcgagaaggtggtggggatcgacctgggcaccaccaactccgcggtcgccgccatggagggcggcaagccgaccgtcgtcaccaacgccgagggcgcgcgcaccacgccttccgtggtggcgtacaccaagaccggggagcgcctggtggggcagattgctaagcgccaggcggtcgtgaaccccgagaacaccttcttctctgtcaagcgcttcatcggccgcaagatggctgaggtcgacgacgaggccaagcaggtctcgtacggcgttgtcaaggacgagaacggcaacgtcaagctcgactgccccgctatcggcaaacagttcgctgccgaggagatctccgcgcaggttttgaggaagttggtggatgatgcatctaagtttcttaatgagaaaatcacaaaagcagtggttacagtcccagcatatttcaatgattcacaaaggacagcaactaaagatgctggccgcattgcaggactggaagttctccgtattattaatgaaccaactgctgcatcgttggcctatggtttcgagaagaaaaataatgaaacaattctagtgtttgatttgggaggcggaacctttgatgtatctgtattggaagttggtgatggtgtgtttgaggtgctttccacatctggtgacacacaccttggtggtgatgacttcgataagagaatagtagattggcttgctagcaacttcaagaaagatgaacgtattgatcttctgaaggataaacaagcccttcagaggcttactgaggcagcagagaaagctaagatggaactgtcaacgctgacacaggcaaatattagcctaccattcattactgctactgctgatgggccaaaacacatcgaggcaaccctctcgagagccaaattcgaggaactatgttcagaccttatagacaggcttaaaactcctgttaataatgcactgagagatgccaagttgtctctcagtgatctggatgaagttattcttgtgggtggatccacccgaatccctgcagttcaagaacttgtgaggaagcttactgacaaggatcccaatgttacggtcaaccctgatgaggttgtttctcttggggcagctgtgcagggcggggttttggcaggagatgtgaaagatgtcgttcttctggatgttactccattatctcttggtttggagacattgggtggagtgatgacaaagattatccccaggaataccacactgccaacctcaaaatcggaggtattctcaacagctgcagatggacagacgagcgttgagattaatgttctccagggagaaagagagtttgttagggacaacaagtcccttggaagcttccggttggacggaatccctcctgcacctcgtggtgtcccacaaattgaagtgaagtttgatattgatgcaaatggtatcctctcagttgctgccattgataagggcactggaaagaaacaggacatcaccatcactggtgctagtacgctacctaaggatgaggttgagagaatggtagaagaagccgataagtttgccaaggaggacaaagagaagagagatgcaatcgacaccaaaaaccaggcggactcagtggtctaccagactgagaagcaactgaaggagcttggcgacaaagtccccgctcctgtgaaagagaaggtggatgtgaagctccaggagctcaaagacgccatttctggtggatcaacacagagtatgaaagatgccatggctgctctgaaccaggaggtgatgcagattggccaggcaatgtataaccagcctggtgccagtgctgctgggcctactcctggtgctgaggccggacctacgcctggtaccggaccaacgcagaatgatggggatgtcattgacgcagacttcacagatagcaattgaggggtgattgatgcatggccatgtgttgagcaaggttggcgttaaggagtgaacaaattgttccttttttgtgttgggattgttactataggctatctagcatggagttgatagagatagtttttcgcgaacttctcctgtgattgactcaacaattagctgaatgctatataaagtcgaaaggagcgcataaggtttttattcaatttgtagctgattaattgaattgttgcaataaaggtgttgaattgatcagttgccttctataaaaaaaaaaaaaaaacaaacaaacaggcggccgct

SEQ ID NO: 9936 - DNA, 3145 bp, Zea mays
  misc_feature (1725)..(1725): n is a, c, g, or t
cgatccttgctcctttacaccgtgcctagattgcgacacaacaccacaaaggggtactgactcggccctttcccatttaaatcgacccggttctgatatggcacaaccctagccccgacgattttctttcggatttcatctctattagatataatggctaggtttaatgttggcttgacaagcctatcacaaccctcctcctttaccagggctcgagacctgttatgttgagacatcataggcagggttcttccccacataattgtaaagttgcatttatattgaattgcattacacatttcattacaatgtaagtcatcattttgactcatccaacatgccacatttaatgtattctgcttccattgcacaccagggtggggttttggcaggagacgtgaaagatgtagttcttctggatgttactccattatctcttggtttggagacattgggaggagtgatgacaaagattatccccaggaataccacactgccaacctcaaaatcggaggtattctcaacagctgcagatggacagacgagcgttgagattaatgttctccagggagaaagagagtttgtcagggacaacaagtccgttggaagcttccggttggatgggatccctcctgcacctcgtggtgtcccacaaattgaagtgaagtttgatattgatgcaaatgggatactctcagttgctgccattgataagggcactggaaagaaacaggacatcaccatcactggtgctagtacgttacctaaggatgaggtatgttacaaatcttcggtgtagcattcttgtgtctgacaactgtagtgatctgttggtgccttggtggttagacaagttaccaggtttcattcttgtgccaatgatgtgatgctggctactttatgatgctgtgatatcattgttattttctacgatcatgtagtagactagtatggttcagctaatttctatattggtgcgtgaaggcaacaactacctccttttgcaggttgagagaatggtagaagaagccgataagtttgccaaggaggacaaagagaagagagatgcaattgacacaaaaaatcaggccgattctgtggtctaccagactgagaagcaactgaaggagcttggcgataaagtccccgctcccgtgaaagagaaggtggatgtgaagctccaggagctcaaagaggcaatatctggtggatcaacacagagtatgaaggatgccatgtctgctttgaaccaggaggtgatgcagattggccaggcaatgtataaccagtctggtgctagtgctgctgggcctactcctggtgctgaggctgggcctacccctggtacctgcccgggcggccgtgcgggggatgtcattgatgcggacttcacagatagcaattgaggggtgatcgatgcatgaccatgtgttgagcatggttggcataaaggagagtgagcaaatagttccttttttgtgttgggatttttactgtaggctatctagtatggagttgatagcggtagtgtttcgcgaacttttctcgtgattttgactcaacaattggctgaatgctatataaagttcaaagaagggcacaaggtttttattcaaattttagttgatcgatcgaattgttgcaacagaagtattgaacagatcagttgcctgtctatatccttggcgtactttttttaaatactagtatttgacaacttttggntactagtagaaaccaacgtctatgagtctatcagacacttgtagcaaaaaacattacaatttccataaaaaacctgcaacttttttccatggcgaggaaagtgttgtttttgcaacgaacctccaagacagttatatgctttatgaagtaggctctagagtttgatttactcataataattaccgttgcttttatgtatgagtcatgctgacggtccgaccgcttcaccagtccagtgccataccggtcagttggtccagagaagaccaaaaacatcctaaaccatgatcagccatatgggacagtccgggctcttcggacaccctaaaccatgaccaaacaccttcaggccacgatgatccgaaatagttacatggaaacagaacacaactaaggtatttggtcggttgattaaagttagttatacttttgaccaattattagctaaatatatcaacaaaaataccgtttcgcgtgaccgaccagcaaagcaacctcagtcgcctacccaagagagacgaaagaaaatggttcatctcaagaggtaaggccaaataaattggaccgagatgttgtctagctactcccaaataaacaatcaacaccaccaacatcatggacacctccaattatgcactcatgtatccaccagtttatccacctcatgcatttacatgtccacctccaccataagtgcccaaccaaatgtggggagcacctatgttgcatgcacaatatctctacgggatgccacaacacccatcatgggcgccatcccaaacttcaatatttgaccgattgagtgctcctcaatttggtccctaggcacaagtttagcaagaatgatggaatccctggccataaaggccgaccaatccggcaggggatagggagaaggagaaaactcccacagttgcaattcctgagtcatcggcttccagttctaaaaaactagagagaatgacattcgacgatgttattaaggtaagcactatatatgtcattatcaatgctaacaatgaatggtcaatgacctttagtgaatcgaccaaggggaaggaagttgctatggctagtgatgataaagccgatagcaaagtgccggacgctaagtattctaaacaccaatggtgcccatcaggagtgacacgatctcaaaagcgtaagcttcagcggttaagacaaaagaaaacaaggaaaaagaagttgagcgggtatattcaatgaaacacatcctatttaccctcataaacaatggaaaattaaggtcgccagcactagcacacaagcggccacgacgacagaacataggttaccggaccgtccaacacctcggactggactacccggggcagcggggaccgtctagcacctgagacaagatcgcccggtggcactagggaccttgcctagacaagca

SEQ ID NO: 9937 - DNA, 1504 bp, Zea mays
gacacaaggaatcaggcccaacggctaataagaaccccaaaagtattcaaaaaacggaccgcatcggccagccagcgccgcctcgcctataaatacgtcgtctcctgccggccggcccaaatcaccaagttttggattccagcagcggcgcccccaggccaggccccacccgctcagcctcctcagctgcccaaccttctccccatctgctcagcctcagctgtcattcccgcgaagcgccgtctcccggctctatcgatggaccgagtcgccgccctcgtcgtcgcgctcctcgccctcttcttcgccgccggggccacggcgcaggccccggcctcgtcgcccaagcgcactccagcgccagcgccacccaggacggccttcctcccgccgccgccggccagggcgcctatggcctccccgccctcgcctcccgcgatggcgccggtgcccgcgccctccgccggcgtgccggccacgagccccgtcggcgcgggagctggtgacgacgcgatggcccccgccggagccgcggcggctctgactccggctgccgcgcccgtcacggagaagagcgccgccgtctcagcctccgccgccgccgccagcctcgtggccatcgttgccgccgtggcagccgccgtcgcgttctagaccgggaccgaccttgggacatctgatatgtcggtggatccgtggaggagctagagctgcactctttctctgctgtgtgtgttgggtgttttcctcctcttttttcggatcctatttatttgtttattcatttgttatttcgaggcttgagacggagatgaggacgtgtaatcctaccaatttttcagacgggagctgatttctatgcttatgagaagattttatattctttcaaaaaaaaaaaaaaaaagccgccaagccatgacaacagcaacagacgactttaccagccaagcaaaaccgtaataacggtcgtctagttattcttatatctcatggattaaaaaagattgcaaggatttgaatgagcccctaataaaaacttacttgacagaaagaatcttagtgttggtgtctttttggcgccaatcactgcgtgagaaccagcggagcggctggtaaagtcggacgatccgcgacttggggcagggtttcctgtctgacaggccggacggtccgtgcgtatacagggggcgtgtggcgcctgaatctcggtcccgggagggatcccgtcggagaggagagatctaaactcctctaggctcgacaggccgacctaaactcctctaatcgacatatagtataagaaataaattgaaagactaaactagaactagaataaaactacctctaatacaagaaataaatgtgagataaattgattattaccgtattttctgtatttatagaggagggggctggacctgttacaaacaaattcccttagctaattccgcaaatctagccaacaattatagtaataaaacttgaaaccctaattaactctgcg

SEQ ID NO: 9938 - DNA, 764 bp, Zea mays
ggcccccccgcggcgccaatcaccaagttttagactccagcagcggcatccccacccacccatctgctcagcctcagctgccattcccgcgaagcgccgtctcccgggccctatcgatggaccgcgtagccgccctcgccgtcgcgctcctcgccctcttcttcgccgccggggccacggcgcaggccccggcctcgtcgcccaagcgcactccggcgccagcgccgcccaggacggccttcctcccgccgccgccggctgccagggcgcctatggcctccccgccctcgcctcccgcgatggcgccggtgcccgcgccctccgccggcgtgccggccacgagccccgtcggcgccggagctggtgacgacgcgatggcccccgccggagccgcggcggctctgactccggctgccgcgcccgtcacggagaagagcgccgccgtctcagcctccgccgccgccgccagcctcgtggccatcgttgccgccgtggcagccgccgtcgcgttctagaccgggaccgaccttgggacatctgatatgtcggtggatccgtggaggagctagagctgcactctttctctgctgtgtgtgttgggtgttttcctcctcttttttcggatcctatttatttgtttattcatttgttatttcgaggcttgagacggagatgaggacgtgtaatcctaccaatttttcagacgggagctgatttctatgcttatgagaagattttatattcttccaaaaaaaaaaaaaaaa

SEQ ID NO: 9939 - DNA, 2937 bp, Zea mays
atcgacaagtacatttttggaaaaaatcatgaactagattggcacacgcgttacaaaatgattaaagggatttgtgagggtttacattacctccacgagaatgacagagctccaattattcatttgaacttgaagccagcaaatgttttgctagacgcagccatggaacctaggatcacagattttggtttatcaaggcttattggtgaagggaatactagaatagtcaacacacacactcttggaccaatagggtacatggcacctgaataccgtgacatgggggaagtttcacgcaaggtagacatattcagcttgggtattcttatactagagattgtaactggtcaagacaatagtaccaaggttgactttatcgatcatgtatgtgaacactgcatggaagggccacaaataaaatttatgtatccctctctggaacctgaattacatgatcaggtagaactgtgcatcaaaattggcctagagtgtgtccagacagatcgaaaaaaaagacctactgcaggggacattatacgtaagctcgaggaaggaaccaaattgggccctacaccatcccgtgaaaatattactacagagcagcagcacaccacctcactcgatgttctcgatggagcgcagcacaccaacaatacaaatcatttattttaaaaatgattatttccttcaaggacaggtagcaaaaaggacaagcctgcacatgcatacttgggaaaacaaaggcaacaatactgcaagcaaaacatccccgattgatttaacaagaaattggtaagccacagatgttttcgtttgaactcctgaatgacatcacagaaagcttcagtccgggatgcctgcgtgggacaggtggatttggatatgtttatgaggggataccacatggtaacgagggagcgatggccgtgaagaggcttaaagaaaaaataggtatatcaccgaaacagtttgagaatgaggttcataatctgagcagaatcgagcacaggaatattgtacggcttataggctactgcgatgaaatacgggaaatactatctcatggtaagaacaagaatgatccacctattcgcgaacatattcaagaaaggttattgtgttacgagtatatgcctaagggaagccttgacaagataatttatgataacctcgattggcatacgcgatataaaataatagaaggtatttgccatggcttacattgtcttcacgagggtcaacaggatattcagattgcgcatttggacttaaaaccagcaaatatattacttgacagtgacatggttcctaaacttgctgattttggtatgtcaaggctcttcagtctcgaacaagtttatatccttgcttccaagcctatgggaacaattggctacatagcaccggaataccttgaccacaaaaaggtatcaacaaaggcagatatatatagtttcggcattgtagtactggaaatcgtaacacgaaaacagtgcccacgcagttacgcagacataaatgctcagcattttatccaccatctgcgtcaaaatttgacaaaagataactacgtcaaatccatgtacccggcccttgaagcggactgccttcagcaagtgaaactgtgcatagaaattgggctgaactgcgtggagaaggaacctacaaagagaccaactgccagggaaataatctctatgtttaatcagaaaaaggattcgagcagatctggggtatctaactgcatcgttaatgtgatagaggcgtggctatcaaggcttccatggcatccttggcctctaactttgctccgtcagacttaagcttgatggcaacagcggtatttggaagatttgcaagggtgtccgcttgagttcctgcgatgcagcggaaggaagaaaaaaactagcagattaaaaatgagaatggggatcttgtatatctatttatgttttatccttttcatagaaaaattacaagctatgatttttatggtatattggcaatattatgtcaatgtaacattcaatgggcatcgaattaaaatataatctaagtattttttttcctagcattgtagggcgtagaaatatatgtcaatactcctttcattttaaattggaagtcgttctggatttgtttttacatacatgacttttagtttttggtatgtactccaaatgggtgattaaggtgatcgacaaaataaggagagggtttatttggaagggttgcaaggatgtgaaaggctgacattgtttggtgagttggcaaagagtttgccggcctcagtcttggaggcttgggtgttcacaacttgaaatttttgggttgttccttgacagagatgggcgttcaggttcgtcctactgctgctgctttatttgccatttcggtccagtcaagagttggtgatgaagcttgcacaggtggatcgttggtgtcagggacagtcctttaagctttgtttggatagtctagtattgacctcaatccatatataatctatatatgttgaggtggattagggtgtaaattagtttaagttacactctaattatgcttaatacatgtagattgagctcaatattagagtacacaaactaagctttaaagatttagctccgaatttagctacatgtgtgcctaaaaggattttaaaatctagcacaatccaggaagcacgggcaggctctctttgggttaatgatattagaggcaatatttcagttcaggcttttatgagttcttgttatagactctttctatggttcttaaactcagatacattgtcgctcctcatcttcttcaccttgagctcgaacttattttgagctctccttaagaagcgctttaaagtaccttaggtttcagaattatcctaaaaaagaatacccaaatgaagcgggaaagtcatcaacaataacaagaccatac

SEQ ID NO: 9940 - DNA, 923 bp, Zea mays
tttttttttttttttggaggatctggaaggtcgttcatgcctctgctttgccaaagtttgacggctgatccatgaagcggtcaatatcctggacatacaaatgcccatgcaacgacaggagaatccagaccgtctaacagcattcgtatactacaacaaaagaaaccaggccgaacctccggcaacttaacgttaatattagccagccactgttacccactcatcattaggagttaattaaaagctacgacctaatgctacccagtatcgactatcgagttaatatggaaaactcaggagagggcaggcagaagaacccaccaaccaatttgctcagcgctttctcttgtgagacttccactgcctcatgacgtgctggacggcttccttcagtgttgctttacggccctccttgtagttccacagctctggtacaggatagcggccactagggttgtactcattgatctcaagcagggcctttgttaccaacccataaatttcttcaccgtgctcttctttcagctcctgcagcatctcatcgtcctctttgagaatttccatttctttcccatccaccaccttaaccttaaaagggtgccagcttgggtttctaatttcttcttgccactttgaacaaagggtagcagaaatgacttctgcatcctcctttggcaaccttttcttgcaagcaattccgaatgctttgagatcaagctcacccattctctttatacctatgttagctcggccaacaacagcaagctccataaagccatctatcagctccttccgagcgtgttgcaactcatcgttgctcttcctttccttgataatcagagtttggttcagagactccattgcttccaattcatcgaccttttccttcagctactcagcaagttcatccatcttcttctttg

SEQ ID NO: 9941 - DNA, 1923 bp, Zea mays
cggaccaccactccacaatacacaaagcggctgcggatgtgagtactataaagaaagcgatgaggcgccaggccggtagccaaggatcgagtcgtttaattttctactaggagctagcagcgagcgggttatttgcaacgacggcatcgtcttggcgttggcgggcgtgtttggcaccatgggcgactactactaccgccgccgctcgccgcacctcctcccggcggcggtgctggcgctgctcgccgtcgtcgtcgtcgtgagcagcagcctcccgagtgcggcggcggcgggggcgggccggaatgtgatcacgcacatcaagggcttcgaaggccctctgcccttccacctcgagacagggtacgtggaggtggacgaggagcacggcgcgcgcctcttctactacttcatcgagtcggagaggaacccggcggaggacccgctcatcctctggatcaccggcggccccggatgctccgcgctctctggactcctcttcgagatcggacccctcaagttcgatgtggcggggtacacggaagggttcccgcggctggtctacttcgaggattcatggaccaaggtgagcaacgtgatcttccttgacgcgccggtggggacgggcttctcctactcgcgggaggaggccggcctgaacgtgagcctgacggagtccgggcggcagcaccacgtgttcctccgcaagtgggtggcggagcaccccgagttcgcgtccaacccgctgtacatcggcggcgactcctactcgggctacaccgtgcccgtgacggcgatggacatcgccaccagcagcgacgacgaggagccgccgaagctgaaccttgtgggctacctggtgggcaacgccgcgacggacgaccggtacgacacggggggcaaggtgccgttcatgcacggcatggggctcatctccgacgagctgtacgaggcggcgaagcagggctgcggcggcgacttctacgtggcgccggaccccaccaacgcgcggtgcgccagcgcgatgatggccatcaacatggtgaccttcgccgtgaaccccgtgcacatcctggagcccttctgcggcgcggccgtgcgggccggcggcggcagcatcttccagggctacggcggcggcgcgaggcggtcgatgctggtgcgggacgacgtccgccacccgggcttcttcgccaagcagcggctgggcctgcccgtggagtgcagggacaacgggtaccggctgtcctacatctgggccgacgacccggaggtgagggaggcgctcggcatcctcgagggttccatcgggtcgtggagccggtgcaccatgctgtcgcactacaggcacgacgtgaccaccgtcatcccctaccatgtcaacctcaccaaggcaggatacagggcgcttgtgtacaacggcgatcatgacctagacatgaccttcgtgggcacccaagagtggatcagaagcatcggctaccccatcgtcagcgactggagaccatggttcgccaaccgacaggtcgcagggttcacaagaacatacgcccacaaccttactttcgccactgtgaagggaggaggacacacagctccggagtacaggccgaaagagtgtcaggccatgttggatcgatggacatcagcagcaggccaactctgatgaatatggtgaccacggaattaacgaagtactacagctgtagtcgtcgttggtgtctctccgtcgaattactcatatttagtagtaataataataataataagacgggctttaatttgattcatagctacttagctagggagaggcaggctgcttgtagtacttttggctatgatccatgccagctccgaacatgagcatgtctcacgcgtgtggcttccaagaacattcgatacaacaaaatgctgggtcccccg

SEQ ID NO: 9942 - DNA, 1438 bp, Zea mays
aaggatcgagtcgtttaattttctactaggagctagcagcgagcgggttatttgcaacgacggcatcgtcttggcgttggcgggcgtgtttggcaccatgggcgactactactacagccgccgctcgccgcacctcctcccggcggcggtgctggcgctgctcgccgtcgtcgtcgtcgtcgtcgcgagcagcagcctccggggtgcggcggcggcggcgggggcgggccggaatgtgatcacgcacatcaagggcttcgaaggccctctgcccttccacctcgagacagggtacgtggaggtggacgaggagcacggcgcgcggctcttctactacttcatcgagtcggagaggaacccggcggaggacccgctcatcctctggatcaccggtggccccggatgctccgcgctctctggactcctcttcgagatcggacccctcaagttcgatgtggcggggtacacggaagggttcccgcggctggtctacttcgaggattcatggaccaaggtgagcaacgtgatcttccttgacgcgccggtggggacaggcttctcctactcgcgggaggaggccggcctgaacgtgagcctgacggagtccgggcggcagcaccacgtgttcctccgcaagtgggtggcggagcaccccgagttcgcgtccaacccgctgtacatcggcggcgactcctactcgggctacaccgtgcccgtgacggcgatggacatcgccaccagcagcgacgacgaggagccgccgaagctgaaccttgtgggctacctggtgggcaacgccgcgacggacgaccggtacgacacggggggcaaggtgccgttcatgcacggcatggggctcatctccgacgagctgtacgagtcggcgaagcagggctgcggcggcgacttctacgtggcgccggaccccaccaacgcgcggtgcgccagcgcgatgatggccatcaacatggtgaccttcgccgtgaaccccgtgcacatcctggagcccttctgcggcgcggccgtgcgggccgacggcggcagcatcttccagggctacggcggcggcgcgaggcggtcgatgctggtgcgggacgacgtccgccacccgggcttcttcgccaagcagcggctgggcctgcccgtggagtgcagggacaacgggtaccggctgtcctacatctgggcggacgacccggaggtgagggaggcgctcggcatccacgagggttccatcgggtcgtggagccggtgcaccatgctgtcgcactacaggcacgacgtcaccaccgtcatcccctaccatgtcaacctcaccaaggcaggatacagggcgcttgtgtacaagtacgtacgtacgtgttagctagtatgtatatactattgatcgatgcttattaaactaggattattatttggacaaaaaaaaaaaaaaaaa

SEQ ID NO: 9943 - DNA, 761 bp, Zea mays
ccggccgggccggccggggcccggctccgtcgctcggggagtttttcccacttccacctctccgtccctgccgagctgcggcggccgcatcgactgttagggcgaaaatccgttctagtctctcggcgattttcggttcgcaggcggaggcagcaggatctgcgggaagggtttcgtgtcgagatggctgggcgcaaggaaactgcactcgacctggcgaagttcgtcgacaagggcgtccaggtgaagctcaccggcggccgccaagtgacaggaactctaaagggatatgaccaactactcaacttagtgctagatgaagcagttgagaatgaaagagagcaagatgatccattgaagctatcagggaaaactagacaacttggcctcattgtgtgcagaggcacggcagtcatgctggtctcaccgactgatgggactgatgagatcgccaaccctttcctcgcggacggagcatagcttgcgcccctcggaacaatatgtccctgtgggaaaagaacccgtttctcgtgtatttgttgtacatgttgctacggttactattgtgctgctgctgagtacttccgttttctttcctcttttctgagttctgttgtatcgtgtgcagctgtgcgtcttattaagggtatttgaatgcactagatctaatagttagtggctaaaattagttggagacatccaaacaccctagctatgagttcttttttgcgctttttgtggtaagaaaaaaaaaaaaaaaa

SEQ ID NO: 9944 - DNA, 746 bp, Zea mays
  misc_feature (741)..(741): n is a, c, g, or t
caaaaaaaggaaggagagctgctagtgcttttcttctcggcgagtctttctctttccccaccttcacttggccgtcctcccgagctgcggcggccgcatcgattgctagggtgaaaatccgttctccggcgattttgggctctcgggaacagacaggaggatccgcgggaaggattcggctgcgtcctagtgtagtgtcgacatggctgggcgcaaggagaccgcactcgacctggcgaagttcgtcgacaagggcgtccaggtgaagctcaccggcggccgccaagtgacaggaactttaaagggatatgaccagctactcaacctagtgctagatgaagcagttgaatatgaaagagagcaagatgacccattgaagctatcagggaaaaccagacagcttggcctcattgtgtgcagaggcacggcagtcatgctggtctcaccgactgatggaactgatgagatcgccaacccttttcttgcggaaggagcataagcttgcagttggtcgattatttagaaccgtgctctcatgtcaccctcagaacgatgtgtcccagtgggaaaaagaactctattctcgtaccggttggtgatgaactctgtaatattcaccgtgcaagtgcaacttaaaacatctgtgatacgagctatttttttttaaaaaaaaaaaaaaaaaacaaaaaaaaaaaacacagcggcgcgaccgctcgtgccgccggacggcgtgggtcgacnccggg

SEQ ID NO: 9945 - DNA, 910 bp, Zea mays
aaaactcttttgaaaacgtctaagaatgtacggacaaggacctgctctgtttctcggcgagtttttcccacttccacctctccgtccctgccgagctgcggcggccgcatcgactgttagggcgaaaatccgttctagtctctcggcgattttcggcaggcggaggcagcaggatctgcgggaaggatttcgtgtcgagatggctgggcgcaaggaaactgcactcgacctggcgaagttcgtcgacaagggcgtccaggtgaagctcaccggcggccgccaagtgacaggaactctaaagggatatgaccaactactcaacttagtgctagatgaagcagttgagaatgaaagagagcaagatgatccattgaagctatcagggaaaactagacaacttggcctcattgtgtgcagaggcacggcagtcatgctggtctcaccgactgatgggactgatgagatcgccaaccctttcctcgcggacggagcatagcttgcacccctcggaacaatatgtccctgtgggaaaagaaccggtttctcgtgtatctgttgtatcgtgtgcagctgtgcggcttattagtggtgtttaaatgcactagatctaatagttagtgactaaaattagttggagacatccaaacatcctagctatgagttcaattattagctatttttagtaaattagttaataattagctatctatttgttagctagctaaatccactagtatttttttagccaactaactattaactatagtacatttaaacaccccttagaatttagggacaaaatcagatctcacgttagggttgtttgatagatatatttagcccgtaagtttaaggggctgtttgaattcaaagttttttaatactatggtattttgggtgattggtttct

SEQ ID NO: 9946 - DNA, 6645 bp, Zea mays
  misc_feature (3142)..(3142): n is a, c, g, or t
  misc_feature (3471)..(3471): n is a, c, g, or t
  misc_feature (3651)..(3651): n is a, c, g, or t
  misc_feature (3655)..(3655): n is a, c, g, or t
  misc_feature (3709)..(3709): n is a, c, g, or t
gagagattttttggggtcctatttcttgcctttttctaataataaaaaatgaacggtttccataagacccatctcactctattcttttttatttgttactgtttagtttaaaaatgaactcgcgggcgacaaatattcgagaacgggatagtattatatatcatgtattcatgtggcggcctcacaacagtgtagcggcacaaatatttaaaacttgggtattgtcactttgatgtcacacaaaaaaactagaatcaatgggattaaaatacaattatgagtggcacattaccgataattaaagccatgaaatagttaaacaacaatttgtccaactaatcatctctaaaatatgcataaaacatacatccgtttgcattcttgccttccagcgctcattacctctaatgcttcatcttccacagagcactcttgccctaattttcttcgtcgtcgctagatctcgaactgctgccatggtcgcctcctatccgcacttccgcacgaattcaaagattatgccatcaagtccaaagacttgcgcgcttcgattatgttgtgccccgtggccaccgaggatcttcgatggcgtgaggtgcgtactcaaacgaacgagggagaggtgggggctcgccaggaaaggttccggcggcaagtttctgtttctttttctttcttggctctcaagttcccaagtctcgcttattacatactctgcacataggcattgacgactgggcccacaggtggggccctgattacagactccatgacatctggcatacttaggccactaacccaggcttagacacgtcggcttcagtcattgaggcgcgtccggcacaccggccgcgacagcttcccccctgcagcggttgcttgtccacaagcaacgaacgaaggaaacctggcctgtaaaacataccagtcttcccaggtcgccgagtccactggaaggggagtccatttcaccagcacctgtgggacagccttaaagcctttcttcaccaaacgacgctccaaaacccgctcaggttgaagatcagtggtactgaaatccagcagcattttgggatctgcaaaaactcaaagagcccgctgtgtgaagggtttcagttgactgacatggaagactggatggatgaggcagccatcaggtaatttaaggcgataagctgcagaaccaactcgctgaagcacttcaaatgggccgaaaaaattgaatgctagtttggggtatggtcgattcaccactgaactctgggcatatggttctaactttaggagtacttgttctccaacttggaattggcgatccacacgatggcgatcggcgagctgcttcattctgttttgagctctagcaagattgtccttcagctgttgcatatgagcatccctttcagtgacccaagtgagagcttcggttggagtgtcttgtgtaggagcaatggaaaaaccgatgtcaggctcatagccatacaatgccttgaagggagaacaacccagggaagaatgaagacaggtattgtaccatatttcagccaaggaaatgcagtgcttccaacgcttgggattgtcatgaactgcacatcgcaagtacatttcaagacattggttgacgcgctccgattggccgtcggtttgagggtgataggctgtgctccgaagtaaaccagtgccaaataaagcaaacagttctttccaaaatgcgctgagaaaaatgcggtcgcgatctgaaacaatggtcttgggaaaaccatggagcctcaccacattgtctagaacagcccgcgccactagctgtgctgtgaatggatgtttcaatggaatgaaatgtgcgtacttagtgtgcctgtccacgaccacgaggatgcaattataaccctcagatgatggcagcccttcgacgaagtccatagtgatgtcttgccatgcgccagcaggaatgggcaatggctgcaaaagaccagctggatgagtgttactgtgtttggcgtgttggcataccgagcactgacgcacaaaatcctccacaacacttttgagacctttccagtaaaacaactggctgatgcgatgataagtccctttagaacctgaatgacccccaaccgccgttgagtgaaaactgttgatcaatttggtttgcaacgctgaattattggccacccaaaatcttgttgttgtagcgaatgataccctgggataaagaaaatccttccttatccggagaatggagggccagtttagcaagtaagtcctgtgctgctaggtccgtattgtagctgttcaacagctcttgcagccaaactggttggacatgagacactgttgtagtgctgcaaaggtgccccacccgggacagggaatcagccacaatgttctctttgcccttgcgatagactactttgaattgcagacccatcagacgagtcatggcctttctctgcatgtctgaatgaagatgttgctcagtgaggtatgagaggctttgatggtcagttcggatgataaactcctgtcgttggagatatgtgcgccatctttccaccgccatgataagcgctaggaattccttctcataaattgaaagtttctgatgttggggcccaagtgctttactgagaaaagccactggttggtctcgctgaattagtacagcgctaatgccgatatcacttgcattagtttctacaataaagggttgtgaaaaatctgaaatagccaacactggggcagtgaccatggcctgtttcaattgattaaaggcttgttcagctgttggggtccatacaaattgtttagtacgaatcaaaccagtcaggggtcgagctataagaccataatgtttgatgaatttgtgataataaccagtgagtcccaaaaaaccctgaagttcagtaactgtggtgggaatgggccactgtaacatcacatctgtttttgctgggtcagtagcaacgccctcctgagagataatgtggcccaaataatgcaaagaagtttggccaaaggagcatttactcactttcatatagagctgatgcagtctgagttgagccaacacttgctgcaaatgagaaatatgttgctgcatagagcaactgtaaatgaggatgtcatccaagaaaaccagcangaacttccgaaggaatggctcgagtatggtattcataagacattggaacgtagccggggcgttggtgagtccaaatggcatgacgcggaattgaaaatgaccatggtgcgtcttaaaagctgttttgggttcatcctcaggccacatgcggacttgatggtacccagatctcatgtccaacttagtaaagaatttggtgcccgccagttcatcgagaatttcatcaatcactggaataggaaacctgtttttcactgttatggcattcaacttccggtaatcaacacagaatcgccaggtaccatctttcttttgaacgagaagcactngagaagcaaagggactagtactgtgcacaatcagaccagtctgcagaagttccttaacttgtttttcgatttcgtccttatgtaaaggagaataccgatatggtctggagtttactggaggttggttgggcagcaaaggaatgcgatggtcgtggagcctaggggttggtagtttcttcngatnctcaaagacatctgcatattcctgtaggacaggccgaagttccagtggaacttnggcatctggcaactgtgaaagaatttcgatgacagctaaagctgcaatatcattgcctgctgcccacttggccaactcatgtggagaaacctctggaagaatggactgattttggataattccttgtagatgcactgactggtgacgatactgaaaatccaaagttctatcttcccaatggcagatcatgggactaagcggagctaaccaatcatagcctagaatggcatcaaaagccccaaagtccagtaccaacatatctgaatagaaggtgtacccctgaatccaccactcgagttgatgaacttgcctggtcaaccaccagtagctctccattggctactttcactgttaaaggcggccgaggtgtagatggaataccacaagtcttcaggaaagcggcactgacgaagctgtgcgagctcccactgtcgacaagggtcagcatgaccttgtttttgaccatagctcggagtttcaatgtatggcccgtatcagttcctgcaagtgcatttagggacaactgaccaaactcagaggaaagagcatcttccatgtccaactgatgaagaatatcttctgtgagaggaatatccaaatcattcaccacgacggcattcaactgtgttttgggacgctggggacagttggctaaatgagcagggtcaaaaggagccagacaatagaaacatagattattggcccgacaatagtccctcttctggcgttctttagtcagtggggaattgaaagtagaactcatctttacctcagggcgaccagaaattccaaactgagccttgtgtggaaatgcaggtttactgtacttgaattgtggacgatcgaataaggcttcttgaatcttggcaatatgcaccgcctgttccattgtacgaggtatgtgagattggaccagcgcagccaattcgggttttagattgcgagtgaattgattgatgaagaacattatgtcaaaaccactgttatgcatctctagccgaaattacagagactgaaactggaaataaaattcatcaactgaaccagtttgctttagagtgaacaaatcctgcatagcatgatcataatcataagcaccaaatttatcctccacatcggtcatgaattgggcccaggaaggaaaaccccccttgaggcgctgcacctccatccacctcctagcattatccctcatatgcattgttgcagaagtaacccaaaggtgctcaggaacattgtagaacagaaagaaatcctcacactgctgccgccagatacatggatcacgcccattaaactctggaaagttcaacttgggtgtggtatgacgatacccttgcataccttcattccaatcgcgaggaataactggtgggggcgatgatgatgatgctcaccagggtggtaaccagcgggacggggtggacgctgatgcagagagggttgcgcctccgtgaagaactgtgaggaagtgtcccactccaccgaaggtcggcgctcgcgtgtgagaagatccaccgccttgcctgtggcttcgagttgttgcgcgaaggtggcttgatctttgagaacctgctccatagccttcacccccaagtcctggtggatctgcatctgctcttgtgcgcacgtgacgtcgcccaaccttgtaaacaacagatcaatgctctgattgaggtgattccagtgttcctcctcgcgttcccccgcgacggccatcacgtctaggacgaaacgagtctggacggaaggtttcggcggcgccgtggagactacccgcaaatcggaccgtggtggcgtgggaattacggggattcaatcgacgccgccggtgctgcgtggcaaacgtcgagaactcaccaaactcgtgcctattacggtgacgatcgacggaatatgcagacactcgcggtagcgtgccgaagatcaactgggctttgataccaactattgtgccccgtggccaccgaggatctccgatggcgtgaggtgcgtactcaaacgaacgagggagaggtgggcgctcgccaggaaaggtttcggcggcaagtttctgtttcttttctttcttgtctctcaagttcccaagtctcgcttattacatactctgcacttaggcactgacgactgggcccacatgcggtgccctgattacagactccatgacatctggcatacttaggccactaacctaggcttagacactttggcttcagtcattgaggcgcgtccggcacaccggtcgcgacagattacgacgggttggcttcaggagaataaaatagtatggtggaaaatcattggtaaggaaaactattccatggctgatgttaaaagtgaagttgttatctgcacattgccctgcacagcaacgtcgtgcactacgtttttgacattaaaaagcagagaaccatatccgcgataacctaggtatatgtatgtgtatcattgaagcataagtgttttcactgcacagagcttgtcctacgaacttagaaaatcaatagatttagagcagtttcacggaaccctagtttttgtatatgttatttttgtttttttccggatcaaggtttatggaactatgtatgtttagtaagaatatagagaaagcaatctcagccaggccttaaattccttggttctaatttctaaagaggtggtgtatcgctttcaccaaaatgatcgtgtagcacgtttaaacaccgagcatatatacattacatgatgacgtgtgacgtcccttggccggcagcaatcaccaatgtgagatcgacccaggaaaattgccttggacgacgccacagtacgagcgttgctctgtttctattctgtttttgcatacccgacatacggtgcttacagaccttatacacggctggccagcccatgccacaattctgtagtaacaaaaaaatctggcccagctagaccca

SEQ ID NO: 9947 - DNA, 814 bp, Zea mays
  misc_feature (23)..(23): n is a, c, g, or t
ttttcggagcttctaaagaatancaagatggttgtgttgtttcttagcaagaaaccaagctaatgatccaagaaggaagaagcttgtacaccgcaaatccagtatcgcccgctacttctgacaggataaacacaaacgcgcattccaagagcggtgaggggtaaaaaaaaaaacaaggcaggccgcaaagccgtggaggcacaggtcgacatacaactcactcacaatacccagagatttgcatgggatagaagacgaacaaaaagcagaccagaacgtctacttgctagccgattttgacggggaaccgtgaccatcattggctaggcctgacctctggagagcttctacaatctctgccaccgcatgaccgctcctgtcgaggacgccctccagtgccttcaccttctccagcagctgttccgcgttcgtgtccgcgcaactcatcagcctatccgcagtcttcagcgccgcgcacagcttcagcatcagtgagggccatgaaggatccttctcttgtagagccttcatcaaatcgtcatagtgttcctcaaagagccggctgagatcggacggattggccttccccgcttgctgcgccgccgatggagatgatgggacagacgcatctccgacgccgacgagtgggtcgtcgacagcgaggtcgctgagtagatccccgatggtgagcagcggacctccgactccccgcatcatcctctttccgtcgtcgtctgtacggtacgagacgagagggacgtgggcctcactgcgttctgtatcagcgaaccggttatgggcctcaatgaaccct

SEQ ID NO: 9948 - DNA, 2323 bp, Zea mays
cgttttcttaatcttaattaagtttgatggaaataaatgtaaaaatagaaacgtgtctataatatcgagtaaatattgataatacttttgaaaaaaagcctggccaaactaatgaaaattgacttgtctaaaatccagaactggaccctttctatgacggaccgcgcgcggaaccagcgagcaagaaagcatacgcagacgcagcgcactctctgtgacgtgaactcggtttcgttgcaacataaaccggaagaatcgatcgagaggatagagagtttccagagatgttcacgagacacgtacagtactttttaaagccatgatgctatgatcttttttcaggaaactgtattgtcgttggaattaagtactccttttgtacaatatcaatagagggtgctttagggagcagggatacatgtacatatcagtatataattttagagaatatttcccagctttctttgtaacaagtggaataaagccgatatggtttagtacattatacttcggacgagtttggcatgcatgtgctctttctgttctaaattgaaagttctctctctctctctctctctctctctctctctctctctctctctctctctctctctctctctctctctctctctctctctctctctctcacggtggcgtctaggttgtgtttgcagtcgaggatgaataggaaatgagcctagctagattaatataggtgccgggaagagtggttgtgcatgttggggtctgctcgcttctggttttctgtagttgttttggttggctgtctgcctgtccagcccggtccattggttgcggctggtagattttgtacatgctgttagtgctagttggatggctgttgcagctttgtttagccgctgcatggttggcaacacgagcagctacagcacacagaggcaagttgctctaacatgatctaacgatcaatcttcgaagtggctgccaaatggctcggaaaaatgtacgtgtttaatgtttagaagataaatgcatcttttttcaaaggattcgatgctctgtcgtgtttagtagttcttcacagctcaggatttggccgtgcggcgctctgtatgaccctctcatagccaatgcaaagacaaaccccgcccatcagtctacgcgaatcgctgtggcctcgctcgttgcaaaccttccagcctgtcttgcctccacgcgaggctacatgacacttcctttccttcttcatcctcccgctatatatagccgccctcttcgggtcctcctcctcggccgtccatcgccatctccatttccagcatagaagacgcgatacagctcaaggacagcgctccgcacccgcacgcaagccagaccggaccgaatcgaagcagcagcagcgtacagaagatcacaccctactgccgcgctgcactgcacaatgggcatctgcgtgtcgtgcgacgcggcggacgagggcgccgcgacggcggcgcgggtggtgctccccagcggagagctccgggagtacgcgccaccggccaccgccgcggaggcgctgcaagcggcgggcgagggctcgtcgtggctcctctgcgacgccgacgggatggcgttcgagggccccgtcgcagtcgcggcggtcgcgccggggtccgagctccaggcggggcagatctacttcgtgctccccgccgagatgcagcgccgccgcctcgcccgcgccgaggtcgccgcgctcgcggtccgagccagctcggcgctcgccaggggccgcggcgctcgcccagccatcgtcgccctgccgccgccgccgccggcgcggcgcggcggcgcagctcgtgttcccggtccccgaggaggagttcgcggcggcggacccggtcgcgtcgaagcccgcggctgcggtgggtggcgcatcggaaaacgggagggtggccgtccgcggcgggagcgggagggcgtccaggttctcccccgacctgaccgctatcccggagagcgagtagtagatggagcctgccatgtgtctccggtggcgacggctcgctcggcgctcggtcggacggtgtggccgagctcgcgcgcgccggagatcgatggagcaggaagcgttgtagacgcagagctcggggatgagaaatgtgagtagtgtttttggcgccgttggtttaggaggcaataggatgagtgttgcgttattacgaacgtttaggttttagatgcaagtgtaaatacacgggatctccgtacggtgtgcccagtgagtcacagtttggaactcagcttctaatcagtgctcgtgttcaggctaaaaaattgaaatctctcgctgtttcgg

SEQ ID NO: 9949 - DNA, 1189 bp, Zea mays
ccatcactcgcattctcaccggcgagctcagggctcagcatccgcgcgcctcctctccaagcagaccaccaccgccggaagcatggccgcgccgctgcttcggcaatggcgcagcctcgccgtgctcggcgccctcctcgggctccacctcatcgccgccgtggcgcagtcgccgccaactacacccacgacccctgccgcaccaacgactccggccgcacccacgacccctgccgcacccacgactccggctacacccacgacccctgccgcaccaacgactccggccgcacccacgaccccggccgcacccacgactccggctgcaccgacgacacctatcgcacccacgactccggctgcaccgacgacccctgccgccaccccggtcgcgccagcaaacccgccgccggctccgacaacgccagcgcccaccgccaccccagtcgcgccagcgaagccgccgccggtcgcgcccgcggtcgcgccggccaaacccccgccggtgacgccgccaccagtgacgcctcctcccgcgacgcctccacccgcgacgccgcccgcggtgctcccacccgccgtgctgccgcccgccgcggcgcctccgccgacggcgacgcctccggccgaggcgcccgcgtcgctgcctcccgcgacgacgcccccgcccgtggccgaggcccccgcggagctgccgcccgccgaggcgccgtccaagggcaagaacaagcacaagaggaggaggaagcagcacggcaagaaggaggcgcccgcggaagcgccgcagccgctgagcccgccagctcccgccgcgccgtcgccggctgatctggaggacgtgtccggccctgcaccgtcagccgatgtgaatgcgagctgccggcagcaccagcactgggcctccgtcgtcgtgcagaccgccatggcggcgcttttgttatcgctagcgtggtaaactaataaatcccagagagaaacgaaagatccatatatcagcgtaccagctcagctcatggtttaattatttccgcccttcctgttcatgccgcaccatcatacataggccggtgagattatctgcgggatttgttataggaaccgttggattgtggcttgtggtatttgtttttgacacattctgtatccattttttcgttaatttttggaataaagacgcacacttgctcac

SEQ ID NO: 9950 - DNA, 1110 bp, Zea mays
  misc_feature (409)..(409): n is a, c, g, or t
  misc_feature (414)..(415): n is a, c, g, or t
  misc_feature (417)..(417): n is a, c, g, or t
  misc_feature (422)..(422): n is a, c, g, or t
  misc_feature (425)..(425): n is a, c, g, or t
  misc_feature (525)..(525): n is a, c, g, or t
tcctatatactctgctcgcgtgctacgctactcatcgccccgagatccatcactcgcattctcaccggcgagctcagggctcagcatccgcgcgcctcctctccaagcagaccaccaccgccggaagcatggccgcgccgctgcttcggcaatggcgcagcctcgccgtgctcggcgccctcctcgggctccacctcatcgccgccgtggctcagtcgccgccaactacacccacgacccctgccgcaccaacgactccggccgcacccacgacccctgccgcacccacgactccggctacacccacgacccctgccgcaccaacgactccggccgcacccacgaccccggccgcacccacgactccggctgcaccgacgacacctatcgcacccacgactccggctgnacgcnncnacccntgncgccgcccgcggtgctcccacccgccgtgctgccgcccgccgcggcgcctccgccgacggcgacgcctccggccgaggcgcccgcgtcgctgcctcccgngacgacgcccccgcccgtggccgaggcccccgcggagctgccgcccgccgaggcgccgtccaagggcaagaacaagcacaagaggaggaggaagcagcacggcaagaaggaggcgcccgcggaagcgccgcagccgctgagcccgccagctcccgccgcgccgtcgccggctgatctggaggacgtgtccggccctgcaccgtcagccgatgtgaatgcgagctgccggcagcaccagcactgggcctccgtcgtcgtgcagaccgccatggcggcgcttttgttatcgctagcgtggtaaactaataaatcccagagagagacgaaagatccatatatcagcgtaccagctcagctcatggtttaattatttccgccctttctgttcatgccgcaccatcatacataggccggtgagattatctgcgggatttgttataggaaccgttggattgtggcctgtggtatttgttttcggttttttaagatggtgcccatttgtttttgacacattctgtatccattttttcgttaatttttggaataaagacgcacacttgctcaaaaaaaaaaaaaaaagcggcc

SEQ ID NO: 9951 - DNA, 1441 bp, Zea mays
gcgactcagtggcacggggcgcggacgctgccgctcgcgatatttgcgagagagagagaagagagggcccgagagccgaggacgagtgcagtctggctggcgtgatgctgcttcggagcgcgtcctcgccgctgctcaactgcgggcgcgcgccggctgcggcggcgtcggtcgagcacctcgcggtggtttcgccgttgttgtcaccggcagtggcggcgcctaggcaggggccggtgctgtgccgcgccatgtccgagggggacctcgccgcgccgctcgtgcccaagaaggacgatggacacgggagggcgccgaggctgtcggcgtccttgtcctcgtccgcctccatcttcgtcgaggaggacggcgagggcgaggaggaggaggaggacctggtcgcggtcgcggtcgcgggggccggcgtggacgtgccgctgccgctgcgtcggctgctgacgaacacggggctggacgtgtccgccgccgcggcgctggcgttcgtggagcagggcgtcggcggcagcggcgggggcgggaaggcgtgcggcagcagcggcggcaagggtggggtcggggacggcgacggtggcagcaaccgcgccgccacggacgcccactaccggcagatgatcgaggcggacccgggcaactcgctgctcctggtcaactacgccaggttcctcaaggaggtggcgggggacgcagcaagggcgcaggagtactgcgagcgcgccatcctcgccagtcccggcgacgccgaggcgctgtcgctctacgcgggcctcgtttgggagaccagccgcgacgctggccgcgccgaggactactacagccgcgccgtccaggccgcacccgacgactgctacgtcctgggctcttacgccgggttcctgtgggacgccgaggaggacgaggaagagaactccgagcccttgccacctccttcgctgttccagggggcagctcagcgtccttccatcacagcggcctcttagatgatcgtgaactcgatctagatctcaccaccgcctgtgaacgaagctgaatctggaaccctggagagtggagagtgactgggagtgggagataaccgtgcagaaacccccgacgagtgactcgcatcgccggccggctcctcgccgcttgtgaactgaatcacggtacatgtaaaactgaatctggcagagcacacacgcgcctaagcctattagcgtctatagacttcgcagggctatgtatagtagatatgtagattgagaccctgctgagcatgtacgtgcagtatgttcctagtcacttgtgtatcattactagtaatgcagtatccctcgtgaaataaacgtcaaaaccccttcctgctgcttcatccgagcagagcatcttccaagaagagcagatatcgaactgcaagaactgatgcactgaatcacaaagcttt

SEQ ID NO: 9952 - DNA, 1447 bp, Zea mays
ccgggactcagtggcacgggcgcggacactgccgctcgcgatatttgcgagagagagagagagagggcccgagagccgaggacgagtgaagtctggctggcgtgatgctgcttcggagcgcgtcctcgccgctgctcaactgcgggcgcgcgccggctgcggcggcgtcggtcgagcacctcgcggtggtttcgccgttgttgtcaccggcagtggcggcgcctaggcatgggccggtgctgtgccgcgccatgtccgagggggacctcgccgcgccgctcgtgcccaagaaggacgatggacacgggagggcgccgaggctgtccctgtccgcgtccttgtcctcgtccgcctccatcttcgtcgaggaggaggacggcgagggcgaggaggaggaggacctggtcgcggtcgcgggggccggcgtggacgtgccgctgccgctgcgtcggctgctgacgaacacggggctggacgtgtccgccgccgcggcgctggcgttcgtggagcagggcgtcgggggcagcggcgggggcgggaaggcgtgcggcagcagcggcggcaagggtgggatcggggacggcgacggtggcagcaaccgcgccgccacggacgcccactaccggcagatgatcgaggcggacccgggcaactcgctgctcctggtcaactacgccaggttcctcaaggaggtggccggggacgcggcaagggcgcaggagtactgcgagcgcgccatcctcgccagccccggcgacgccgaggcgctgtcgctctacgcgggcctcgtttgggagaccagccgcgacgctggccgcgccgaggactactacagccgcgccgtccaggccgcgcccgacgactgctacgtcctgggctcttacgccgggttcctgtgggacgccgaggaggacgaggaagagaactccgagcccttgccaccgccttcgctgttccagggggcagctcagcgtccttccatcacagcggcctcttagatgatcgtgaactcgatctagatctcaccaccgcctgtgaacgaagctgaatctggaaccctggagagtggagagtgactgggtgataaccgtgcagaaacccccgacgagtgactcacatcgccggcaggctcctcgccgcttgtgaactgaatcacggcacatgtaaaactgaatctggcagagcacacacgcgcctaagcctattagcgtctatagactttgcagggctatgtatagtagatatgtagattgagaccctgctgagcttgtacgtgcagtatgttcctagtcacttgtgtatcattactagtaatgcagtatccctcgcgaaataaacgtcaaaaccccttcctgctgcttcataaaaaaaaaaaaaagaagagcagatatcgaactgcaagaactgatgcactgaatcacaaagctttacaaaaaaaaaaaaaaaa

SEQ ID NO: 9953 - DNA, 1065 bp, Zea mays
cccgcgcgtccgattattatgaacgatgggcagccaatcagtcgtcgaggcaaaaggcactgggggaccttcaaagcctacagaatgacaagcttgaaaggttaagtgacatacaaagtcaacctgagtcacagctgaagttcattgtagaggcatggttacagattgttgaatgcagaagggtattgaagtggacttatgcctatggattttacctgccagagcatgagcatgccaaaagacagttctttgaatatctgcaaggtgaggcagaatctggtttggagcggctacatcaatgtgcagagaaagaacttcaaatataccttgacgcagaatctccctcgaaagacttcaatgatttccgtacaaagttggctggattaactagtgtgactcgcaattattttgaaaatctcgtccgggctctggaaactggattaaatgatgtaggcccttccactagccatggcacatgcagcaaaagcgcaacttccaagagcctcggtggtaaaagtaagagtggcaagaacagggcatcaagcagcagttccaaatctggcggctcaacccgaggtgtggatgatagtaacatctggacatgcgatcagtgcacatatgcaaaccccaaatctgccagagcctgccaggcctgtgatcgccagcatcgatagcgatgtcagtcgttgctagagatttggaccccatttgtcgagaattttctggtgttgcgccgtgcgatacacaacatacatgaaaattgaatattagctgatctctgggggtagtgacgaggaatgctgtgtgcaggtaggttttcgtgtatcctggattgtttgtcgactgactgcgcatgtgaagcctcaactcagcatccactcccatttgtgtatataagtatatccatatctgtaacaatgttttgttcaatggaagtagcggagctaggaggcgtctgctgccaaaggaactcaactgttgtagtgctgttgtaatgtaagatgcattggtcaaatttaaagaaagttagtccccctgttaaaaaattccaagagaactcttgtt

SEQ ID NO: 9954 - DNA, 2482 bp, Zea mays
  misc_feature (1)..(1): n is a, c, g, or t
ngaaagggagtaatggagggagaaactagacaccactaaaaaggaaaaaaggtgaaagagagaggaaagctctcgttcctagcttccttctcttcaactaagcgggcgaccccaaccccgcccggatttttcttccttccctgttcacggattccaatccttcctccacacccccaccctcccttcgcctccacatccaccaccatccaatccgcgcgggtgcttcgccaccctatcccgattgctacctcctcgtggtgggcgccgctccgatccgcccgatccgcgctgctcctggggttccggcgcgcggcggcgagcggcggaggcggcgcaggaatggaatccgaggacgatatgcacgacgcaaacgactccgccgaagatgacttctacagcggcggggaggctggtctcgccgccagcgacgacggagacgcagactacgacttcgcggaccacgactccgacgactccgcggagctcctctcccacagacagcagcaaaattacagtatattgagtgaagttgatatcaagcggcgccaagaggatgacataaatagggtttcaactgttctttcaatttccaaaccagaggcatgtgttcttctccgcaactataactggagtgttagtaaggtgcatgacgaatggtttgctgatgaagagcgtgttcggaaggtggttggtttaccagagaagcatattgaaatgccaaatgacagagaagtaacatgtggaatatgtttcgaaagttgccctctcggatcgatgagtgctgctgcatgtggtcatcctttctgcggtacatgttggcgaggttacattagcactgctataagtgatggtccgggatgcttgatgctgaggtgtcctgatccgtcctgtgctgctgctgttggacaagatatgataaattcactggctgatgttgaggatacggaaaagtatgggcgatatcttcgcagatcttacattgaagataatagaaagacaaaatggtgtcctgcgcctggatgtgaatatgcagcggaattcgtcatgggcagtggcagctatgacgttaattgcaactgttcatatgggttttgttggaattgcaccgaggaagctcatcgtccagtagactgtgccactgtttcgaagtggatcctcaagaacagtgcggagtcggagaatatgaactggatactggctaattcaaagccttgtcccaaatgcaagcggcctattgaaaaaaatcagggatgcatgcacatcacatgcactccaccatgcaaatttgagttctgctggctatgtcttggtccatggtcagagcatggagagaggactggtggattttatgcttgtaaccgctatgagtcagcaaggcaagaaggagcgtatgatgaatctgaaaggagaagagaaatggcaaagaactcccttgagagatatacacattattatgaacgatgggcagccaatcagtcgtcgaggcaaaaggcactgggggaccttcaaagcctacagaacgacaagcttgaaaggttaagtgacatacaaagtcaacctgagtcacagctgaagttcattatagaggcatggttacagattgtcgaatgcagaagggtattgaagtggacttatgcctatggattttacctgccagagcatgagcatgccaaaagacagttctttgaatatctgcaaggtgaggcagaatcaggattggagcggctacatcaatgtgcagagaaagaacttcaaatataccttgatgcagaatctccctcgaaagacttcaatgatttccgtacaaagttggctggattaactagtgtgactcgcaattattttgaaaacctcgtccgggctctggaaactggattaaatgatgtaggtccttccactagccatggtacatgcagcaaaagcgcaacttcgaagagcctcggtggtaaaagtaagagtggcaagaaccgagcatcaagcaccagttccaagtcgggtggctcaagccgaggtgtggatgatagtaacatatggacgtgcgatcagtgcacatatgcaaaccccaaatctgccagagcctgccaggcttgtgatcaccagcatcgatagcgctgtcagtccttgctagagatttgaaccccatttgttgagaatcttctggtgctcccccgtgtaatacacaaacatacatgaaattgaatgctagctgatctctgggggtaattgcactaggaatgctgtaggttttcgtgtatctcggattgtttgtcgactgacatcgcctgagaagcctcaactcatcatccagttcgatttgtgtatataagtgtatcatctgtaacaatgttctttagatgagctaggaggcgtctgctgccaaaggaactgaactgttgtactgctgttgtaatataataatgcatttgtcaaatttaaagaaagttagccatcctgctacaaaaaaaaaaaaaaaaaagcggcc

SEQ ID NO: 9955 - DNA, 1091 bp, Zea mays
gcgcgactccatacaacaatacaaacaaagctgtaacgtactgtaaaagtaagatatggaggccgccggcggcggcggcgaggttcacaaggctagcaacgacaaggaggagcatttcgtgctcgtgcacggcgccggccacggcgcctggtgctggttcaagctggcgtgcctgctccggggctccggccgccaccgcgtctcctgcgtcgacctcgccggggccgccggcagcctcgtcgacccggacgacgtccgctcgttcgacgagtacgacgcgccgctcctcgacttgatggccgccttgccggacgacggccgcaaggtagctgtgccagctagctctgttgccttgccatacatgcatggtgcaagttcatgctgtgttttggcaggtggttctggtagggcatagcgcaggaggactgagcgtcacccacgcgatgcatctgttcagagacaagatcaagcaggccatcttcgtagcagcgaccatgctcccgttcgggtaccagtcggagcaagatatcaaagatggagcacctgatctatccgagttcggcgacgacgtttacgacctcaagttcagtctgggagacgaccgccctccgacgagcgtggcgctgagagaggagcaccagcgcgcgatcctgtaccagcaatgcacccacgaggactccacgctcgcatccattctgctgcgcccgtggccggcagctctgggcgccgccaggttcggccgcgccgacgacggcgccgtgaacactgtgcgtcgggtgtacgtgaagacggccaacgaccgcatgctgaagccggagcagcaggaggcgatggtccgccggtggccgccgagcgaggtggcggcgatggacaccgaccacagccctttcttctccgcgccagagcgcctcttcgagctgatcatcaagtcattgtgaatctctcatctgtattaatcgcttgtgttcttccagactccagtgcctggtgctgtcctgtatgccatgccaaccaataagttatcatttatttatcaataaattatctcaaccaagttatacatttaaaaaaaaaaaaaaaaaaaagggtta

SEQ ID NO: 9956 - DNA, 3399 bp, Zea mays
tgcatgcctgcaggatcctgtactttagaaggattatagaaaataatcataaattgaactcacaagatggacagttgatgaaatggtgaatatctgcaaaacagcaacatactgcaagttaatatccatttattatgatccagatataaaacatcttgtcagaaatcaagcctctaaatgcatcagaatgacctacagtgtagcttcttagcatctgacaaatcttcctactgatttgcactgctgaagaaacaggcatcagtgcaggctgagtcaaaacaagatcagattcactttttgtgtaatcagttgcatcagcaactgaaatcccaatatggctctctcctatggcatcatgatcaagaaattcatacccaaccattgcacaatgacaaccgaaatttcttagtcttcttactatatcgcttttgtcctctgtactaagatatgaagatagcaaaatggtaacaagaacttgcaaaaacaaaactttgcaggaggtacatagaagataaagatagacctggaaagagatcagaaatcccgttgatgtttgaatggacttctctgttattgcgagctaactcaaacactatatgtgcaggtaccacattggtacctagttttccaagctttccacaaacctgctttgtggtcgacaatggactttctgtagagaggacaaaacaatatacatatatgatgaagacatgtttatcatagaaaatgacaatagcaaaaatctcgacagcaggatatggcgatatgcacaacagaatgacctgtgaggactcttatatctaaacctagatcgataaggctatcgacaacatcagcactatcgcttctaaggtcatctgtgtaaggcagaagggcaataaagtcccaacaagagtctacctggaggaaggcaaaacaaactaaataaatatagatcgtaatttttgcaagttaaagcatgctaatgtgaaatccaattgcctacttgatgtcctacagctatggcctgatatccatcaagggcaagttcatccattatcatgcttattttctctttaacttctttgctgctgccacagtgatgagcaacctatagcacaaaagcagataatgagtaagagacaagctctgcatacaaaacatatgcaactgcatgcacgcacgtgtttatgtgcctcaagatgttggtggaacttgcatgcatgttcctatatgtgcctcgagatgtatgtttgaaatttcaacagcaacttgcctttgcaggatcacctttgaatacgcaacacttgaatctattgccttcgtcgatgtatgtagtctggaacatcagtttcagtgcaacaaagaaactggcatgatgctctaagacttgaacaccgagtcgtgcctacaaattcagtatgcatcttcatttaaaagaagcatacccattaaaattctccttagttagagaaagcaacctgctccggatcatcaaggaggcttagaatagctgcatcaattggttcaatgtacaactcatgttgagatcttgatgcccgggcagctaaaactatggcatggtctttattaacgctatctgcaaacatctcaatcttgtcccgtacaaaacagggctgattacacgttaaagtaccagccatgttgaagaggattacatccacacttgctagatcttcaagtgcaactgttccccggctagcaatccccagaaaacaaagccttacagatcccaatgccaatgccaggtaaaaaaaagtaggcattgccatcgggattccaccaatctttggctttttttgggcgtcgagtggcatgcctctgtaattttgtttttggaacaaaaatcttaagactatctcagcaaaagtgccaacaagtaccagggaagcacagaagcagccagtaagcatggctccttctttaagctgcccaggtcgagcataacgttgtgggtagagccgcaatgtacttctgggaatgccacgtccagttgcaatgacaacggcagttccttggccacaggaaacagtccaagcatagtataggaggaagccatgcgcacaatcaacagaccttttggcccagcaagtcattgtgtcgattttctgaaatcggagtatgcgagcattggctgggacaatgtccccaactttgagaaatatgatatcccctgggaccagatttgctgcatgtacatctctccacttcccatctctcagaaccttggcccttggtgcgtgggctttggcctccagcggagccttagcatactctaaaacaagcattgcagtaaagcatgctatgaggcatgtagctactacgaaaattatgatggccagctcgcatgatctttggccagctgaggtgatagcaagagacacaactatagtcagtactgtaacccacgacatggagttaagtatgacccggaccatgttattgtacttggggaagacatgatcccatccccagagcgagaagagcgccattaggaatccatgaagcatgctgccctcctgcagccgcgctttcatttagatgttaaaaacccaaataatgttgttaggaaccttttttttttgttatgaactagtatatgaatagttggttccagtttaatcatcgatgttcatgatccacaaacgagataatcaaagaggggttatggaaacagatcatccactgaaatttgtggtgatagaaattggcatcgtcttgttaacaaacattcagcagccgagctaagcattcgttgcctggttcttataagcattcagtaaaatagaaatgaatccattagtaaggagcatatggtagtgaaatcgataacgggcgcaggagttaagctaagttgtaggtttgacaattgaaaagcggcaaatggtggaggaatcaacatgcaggaggagggatctagagtggagacgtacgtggtgcgagaggacgacgacgttggggccgtggagacggaggcgtcgcgcggcctcgttgtcggtgaggcccgcctcctccgctgtgcctaaccggcgcagcacttcctcctcctccagcgtctcctacatgcattgccgttgcaaccacactgggcatcagtcacatcatcccgcagcgcgacaacgaaccggcggaggaggggactcaccaggtccgtcatggccttgtcatccagcgccgccatctcggcacgtgcgctggtccagttccgtccctctcgtcgtcgtcgtcctcgccgccgtcgtccccggcttgttttttcttctttttttttccgtaacagaaaacacaagagctgagacgacggcgggccgagcagacaggccaaccagccacaaccgttagaatggtggaccacaaaacaactactccctccgttcgcttaatttagtcgtcctgtcc

SEQ ID NO: 9957 - DNA, 2038 bp, Zea mays
  misc_feature (1847)..(1884): n is a, c, g, or t
atttctgaactcccccccctgctgccccgcgccgaagcaggtgtggcggcgctgcgagcctgcaaccatctccgcagactccgctgcgactcatctgggctacgacccacgtcaaggctgctagttgcgttcgttggagttgcggcttccgcgaatcccccaatccatcccagtcatggcgttctggggggtggaagtgaagcccgggaagccctacacccacatccatcacgctgaccatggccgcctccgcatttgccaggctacactgggcaactgtgatgctgctgcaaggacggtgctgcaatgcaatgttggcaacaagattcccatcaaactttgtagtctaaatccgaaattggccgagacatgccatctagaggttgagtttgaggaggttgatgatgttatcttctcagtaattggtcatagttcgatacatctctctggatactatgtctgtgcaagcaacaggtctaatgtgggggatgatgaatcagaatcttatggggaagatattgggcactccagcaccgatgaggagcatgataccagtgaggacagctatgaatctgacttcattgatgatcgtgaagttccattatctgagaagtatgggtctggttctatagatgacagtgatgatgagtgcacccaacgatgccacagacaaaaagctgaaaaaacgactcaaaatgctgaaagacggcggcgcttgaagaagcaccaagtaggtagcactgattacgatgatgatgatactccagtcatgaaacatgttgcgaagcgctgtgctcctaaaatatctgatagtggtgatgatgacactcctgtcacaaaacctgttgtcaaacgtagagcttcaatatttgatagtgacagtgatgaagatgataatgtacctatttctcttgcattgggtaagaaagacaatgctaaggttgctgaggaaactgaacatcaaaatggacaggcaaatggcatcaccaaaaaaaggattattgatgtcaagaaaagaaaacagtcttccatcagcgaggatcctgcatcgtcaatggatatgacagatgctaatgcaccatctgtttcaaaacaagttgatgaaataaaaaagaaatcaaagaaaaagatgagaaatcaatcaggggaaaataatgagaagcagtccaatataagaacattggatgacgggttggtggttgaatatttgtcaatgggaaacaatgatgcaaaagtggcttctgatggctgcaaggtctatatcaaatatgttggcatgttgaaggatgggaaaattgttgagtctaatgttagtgaaaagccttacaagttcaagcttggtgctggaaaagttatccgtggatgggatgttggtattcatggtatgcgtgttggcgagaaaagaaagcttacagttccaccttcaatgctctctggcggtaaatcagtgggagaagtacccgaaaattcttcagtcatatatgaaatcgagttagtgaaagtgaaataaagaaaaaatatgtcaggcttttgcatgtgccctatctcagcagctgcaacagttgcaggaattttgttgatatacagatgactcatgctcatgttttgcttccttctggaagaatttatatgtgccactcgtgccacaccataggacatcgagcagtgaactgcagcgggtgctttatccatgcatgccttgagtggatacttggttttgcactatctggctacattactttgtaaactgcatacgatggttgaagcactattgtggtctggtgatttgccatatgtttgtgactacttcgcggttcactgctttgaatcaggtttgttttcccaannnnnnnnnnnnnnnnnnnnnnnnnnnnnnnnnnnnnnacccaggggggggccccgaacccaattcccccataagggagccatattaattccccgggccccgctttttaaaaagcggggatgggaaaaacccctgggttaccccatttaaacgctttggaaaacctcccccttttccccagggggggaaaat

SEQ ID NO: 9958 - DNA, 1447 bp, Zea mays
tttgacttgttcatgagagccacatttccggtttctggtgctcgggtgaaggtttatttctcatccctgagatcctcttagtaaacattcgtgagtcatgctctgatgacctaaagcaattctgtaggctacagaaaggtttgaagtagcttatcgaacaatcaaggagttggctcttgccggttctcctggctctaaaactgtgaaacaagcatcacagcaacttttacctttgtgtgcaaaagcaatgcaagaaaacaatgcagagctcaccagggaggctgttgatgtgttcatttggtgcttaactcaaaatgcagagtcctacaagcagtgggaaagaatttatcctgaaaatactgaagccagtgttgctgtcctgagcaaagttgtgattgattggagggttgtgtctcctaagctcagttctgaagctctcaaggcaacagtgaagaacttgaaggctaagaatgaggctgcgctggagtccagcaacagatgctggaaagcaggcatctatcaaagaagcagacaagcactgcaaagtgatctttggaaagctgacccgtggcgccacctgcctgaagagcagcctggtggtcatcgcgctcgctgttgctgctagttacgtgctgtctcctggcatggacctcgagaaggtccaggcgatggtctcatcgcacctgtcgttctaaacatacctgtccagaatctccagacgtggatctaaattatacgagccatccaaaggggatggctcactcatcagtgaagagagctcagggggtgagaataagagggggataggcgctagaaccgaaagggtacagtttcctgagttgcctttttttatttttcccgcgtctcctcgagcagcagtgcgtgggaggagacgcagtcgactttgcagggagttggttaatcggtagactgatgggtgcgaagaaggtcaagtcaaacggctcaaccagaggattaacacctttgcttttctctttctgcatctgagatgattgcaaacagttttggtttaaaaattaagaatcttgaatcgtattcggtgctgtgtgcttgtcggctaaatgtatctgttgcgttgatatccgattaaattgcgtgtgatgctgtgctcgtgtcagtgtgctgttgtcgaagatctccctttttgcaggtgtgaatgtgatgcctgaaggccttttgaaacatgttccatttttttggacgccggaggtgtgatgtctgatgttggagcgtgaagatcttttgaaatatgttgcatttccagatggtttttggacgagggagatgctggttaatttctgggtttttttatttgaggattcgatctgaatctcaagggactgtatgttatctactgtctcttggtggtgtggatactgtggatgagaaggttttccttcatgcccgattaaaaaaaaaaaaaaaa

SEQ ID NO: 9959 - DNA, 1018 bp, Zea mays
gccggccgggccggccgcctcgtctctctccagctgctttcttccttcctgttcctgctcgtcgcctctcgaaagccaggaggagtctcgcctccccctcctcgcgcgcgtggcagctatggcgatggacgacctcgcgggcgcctcctcctcctcctccatggcggcggccgcctcctccgacccctcgcacggctggcagacggtgtcgtatcccaagcgcaaccgcaagcaggcgcagccgccccgcaccacggcgcccgatctggcgctgcagtccaacggcaagcctggcggcgtcttcgacgccgtcgagaagcgctcccaggagcgccaccgcgcgctgcagcagcagctcgcctccagggcggccgacctcgacgacgcgcggatcgccgctgccacgggcgccgcctactccgacgacgacgactccgacgaggccgctgccccgcgccaggagggagaggtcaagaagcctaagaagcccaaggtgaagaagccgaaggtgacggtcgccgaggccgccgtcctgatcgacgccgagaacctcgcagcgcacctcttcgagatctcggcatcgtacgagaatcaacaggacattcagctcatgaggtttgctgattactttggccgggcatttgcagctgtgagcgcatctcaatttccatgggcaaagatgttcaaagaatcaacagtgtccaagatggttgatatcccattgtgccatatatctgaggctgtgatcaagactgtgagtgattggatcagtcaaagatcttctgatgccctgggagactttgttttgtggtgtatagatagcatcatgtctgaattgtcaggtccatcagctggccctaagggttcaaagaaggttgcacaacagtctccaagggcccaggttgcaatctttgttgttcttgccatgactttaagaagaaagcctgatgtactggtaaatgttatgccaaaaataatgggaaacaatatatttctgggacaggaaaaagcttccatc

SEQ ID NO: 9960 - DNA, 1105 bp, Zea mays
  misc_feature (158)..(158): n is a, c, g, or t
  misc_feature (258)..(258): n is a, c, g, or t
tttgacttgttcatgagagccacatttccggtttctggtgctcgggtgaaggtttatttctcatccctgagatcctcttagtaaacattcgtgagtcatgctctgatgacctaaagcaattctgtaggctacagaaaggtttgaagtagcttatcgancaatcaaggagttggctcttgccggttctcctggctctaaaactgtgaaacaagcatcacagcaacttttacctttgtgtgcaaaagcaatgcaagaaancaatgcagagctcaccagggaggctgttgatgtgttcatttggtgcttgacacaaaatgcagagtcctacaagcagtgggaaagaatttatcctgaaaatactgaagccagtgttgctgtcctgagcaaaattgtgattgattggaaggatgtgtctcctaagctcagttctgaagctctcaaggcaacagtgaagaacttgaaggctaagaatgaggcagcgctggagtcagcaacagatgctggaaagcaggcatctatcaaagaagcagacaagcactgcaaggtgatccttggaaagctggcgcgtggttccacctgcctgaagagcagccttgtgggcatcgccctcgcagttgcagctagtctcgtgctatcatctcccgatatggaccttccgctcgagtgggagaagatccaggcgatggtctcatcgcacctgtcgttctgaacatacctgtccaggatctccagacgtgggtggatctaagtcatggatggctgactcagcagtgaagagagctcaacgggtggtgagaataagagggaggggggggataggtggtagaaccgaaagggtatagttttcatgagtcgccgtttttttcccgcgcttcctccagcagcagcggtgcatggtaggaaggacatgcagtagtcgactttgcagagagttggtttaatcggtagactggtgggtgcgaagaaggttgagtcaaatggctcgaccagaggattaacaccttttgcttttctctttgtgcatctgagatgatgttggcaaacagttttggttatctagaatcttgaatcgtattccgtgaaaaaaaaaaaaaaaaaagcggcc

SEQ ID NO: 9961 - DNA, 2261 bp, Zea mays
agttccttccttgcttctcgtctcgtcgcctctcggagatcagaaagagaacaccggacacctaccctgcgcccttgccttccctccgcgcgcgcgtgctatctatggcgatggaagacgtcgcgggtgcctcctcctcctcggtggcggccgccgcctccgaccccacgcacggctggcagacggtgtcgtaccccaagcgcaaccgcaagcaggcgcatcagccaccccgcgccttggcgcccgatctggcgctgcaggccaacggaaaaggctccggcgtctttgacgccgtcgagaagcgctcccaggagcgccaccgcgcgctgcagcagcagctcgcatccagggcggccgacctcgacgacgcgcggatcgccgcggtcacaggcagcgcttactccgacgactccgactccgacgaggccaccgccccgcgccaggtgggggaggtgaagaagcctaagaagcctaaaaagcctaaggtgacggtcgccgaggctgccgccctgatcgacgccgagaacctcgcagcgcacctcgtcgagatctcgtcatcatacgagaatcaacatgacattcaactcatgaggtttgctgattactttggccgggcatttgtagctgtaagcgcatcccaatttgcatgggcaaagatgttcaaggaatcaacagtgtctaagatggttgacatcccactgtgccatattcctgaggctgtcatcaagactgcgagtgattggatcattcaaagatcttatgatgccctgggagactttgttttgtggtgtatagatagcatcatgtctgaattgtcaggctcatcagctggatctaagggttcaaagaaggttgcccaacagtctccaagggcccaggttgcaatctttgttgttcttgccatgactttaagaagaaagcctgatgtacttgtaaatgttatgccaaagataatgggaaacaataaatatcttggacaggaaaagcttcccatcattgtctggtttattgctcaggcatctcaaggtgacctagtgactggcatgttttgctgggctcattttctatttcccacgttatgtgcgaagccaagtgggaatccccttgcaagagatttggttttgcagttgcttgaaagaattttatctgtcaccaaagctcgttctatcttattgaatggtgctgttagaaagggggaacgcctagttccccctgtttcatttgacttgttcatgagagccacatttccggtttctggtgctcgggtgaaggctacagaaaggtttgaagtagcttatcgaacaatcaaggagttggctcttgccggttctcctggctctaaaactgtgaaacaagcatcacagcaacttttacctttgtgtgcaaaagcaatgcaagaaaacaacacagagctcaccagggaggctgttgatgtgttcatttggtgcttgacacaaaatgcagagtccaacaagcagtgggaaagaatttatcctgaaaatactgaagccagtgttgctgtcctgagcaaaattgtgattgattggaaggacgtgtctcctaagctcaattctgaagctctcaaggcaacagtgaagaacttgaaggctaagaatgaggcagcgctggagtcagcaacagatgctggaaagcaggcatctatcaaagaagcagacaagcactgtaaggtgatccttggaaagctgacgcgcggttccacctgcctgaagagcacccttgtgggcatcgccctcgcagttgcagctagtctcgtgctatcatctcctgacatggaccttgcgctcgagtgggagaagatccaggcgatggtctcatcgcacctgtcgttctgaagatacctgtccggaatctccagacgtgggtggatctaagtcatacaagccatccaaaggggatggctgactcagcagtgaagagagctcaaggggtggtgagaataagagggaggggggggggataggtgctagaaccgaaaggttatagttttcatgagtcgccatttttttcccgcgcttcctccagcagcagcggtgccctgataggagggagatgcagtagtcgactttgcagagagttggtttaatcggggtgggtgcgaactgcgaagaaggtttgagtcaaatggctcgaccagaggattaacaccttttgcttttctctttgtgcatctgagatgatgttggcaaacagttttggttatctagaatcttgaatcgtattccgcaaaaaaaaaaaaaaaa

SEQ ID NO: 9962 - DNA, 1741 bp, Zea mays
  misc_feature (1741)..(1741): n is a, c, g, or t
aaaaaatctccatagtttttttttcctaagaaaagtcgtgctggtttacttggtttttgtctgtcaaactatgacagatttcagttcccgtgtaactataccctaacagctgatgtcataataacccttaggctggaacccgtcatcatcgagctagaacgccagcgtgcaccagtggttgtcatatctcatcaggtaaattgtcatagttgatgaaatattggaaagttggagcgcggacagcagaactagttagttttgaactatttgtcccattgctaggctgtactgcgagcactgtatgcatatttcgcggaccgtcctttgagagaagttccagagatagaggtgatgatacatttgactttcctcttcttgatcaaatgcgatatgtctgagctaatgttcggctcgtgctcatgtagatgccactacacaccataatcgagatacaaatgggcgtcacgggtgtggaagagaagaggtacaaactcatggactgaatgaatacataaaagcagctggttggctgtttcatacagcaagtacacataacacagaagccttttcccttctctctctctccacacggtgttcagtgtaatttctttggaaaaaagacatgttgaacattgtaaaggaaaaactaataaggaactgtaaaaatggcatgcttactgtaacgaataaggaatacagactgggggtctccaatgcttattcagaaacatattccgtcaaatcggttgatcccgtggctgatgggaccaatgaaccgtaatgcctttgccttggttgtactagtagatctgtacacgacctgtgccaaactatgaactgtcatgtcctcctgtgcccatgtgaggacacaaggcaggccgttttcgtgctccagaagctctgctgaaattatggcgtggccctggactgggtgccaaattcccctcgattccatgcggcatccatgaacgccctcacgatgcccctgtctgccttcaaatatatagctcagtcgccgcttggtccggtacggcttcatgtgtgcgtgcgtgattgaagacggaggcccggaggtgcgctgtcggcactggccatgtcgctggctcgttacgacgccaacgtcctgctggccgcggtgaccgcgctctcggcggctgtcgctttcgtcgcggcgcttcacctctacgcgcggtgcctcctgcagcggcgcgtcgccctcgcggaaggcagccctcgcgtggtcgcgctgcagcggcagcgcccgccggacggctacgtggtggaggtcgtccgcatcgtcgaagacgcaagcgtgtgcggccagcaggctgcggggctggacgccaaggcgctgcgcgcgctgccggtgttcacgttggagtccgagcaggccaaggaagaaggcggcgtcgctgccgagctgcacgggcagtgcgtggtgtgcctcggggagatggaggatggcgagctggggaggctgctcccggggtgccgccacgtgttccacgttgagtgcatcgacacgtggctcggggtgagctcgacctgcccggtgtgccggacggcagctacgcctgccgctccgtcggccgtcggcgtggaccacggtggcgaggaagagtccatagctgttgagtgctagtgtgatgtacaaaaaaaggaaggttaatcataaataaatggatgcaaggctgaaatcttttgtgcgaaaaaaaaaaaaaaaaagcccctagggccctcn

SEQ ID NO: 9963 - DNA, 1843 bp, Zea mays
ccggccgggccggggtcctcgtctctctcacagctgctttcttccttcctgttcctgctcgtcgcctctcgaaagccaggaggagtctcgcctccccctcctcgcgcgcgtggcagctatggcgatggacgacctcgcgggcgcctcctcctcctcctccatggcggcgcccgcctcctccgacccctcgcacggctggcagacggtgtcgtatcccaagcgcaaccgcaagcaggcgcagccgccccgcaccacggcgcccgatctggcgctgcagtccaacggcaagcctggcggcgtcttcgacgccgtcgagaagcgctcccaggagcgccaccgcgcgctgcagcagcagctcgcctccagggcggccgacctcgacgacgcgcggatcgccgctgccacgggcgccgcctactccgacgacgacgactccgacgaggccgctgccccgcgccaggagggagaggtcaagaagcctaagaagcccaaggtgaagaagccgaaggtgaccgtcgccgaggccgccgtcctgatcgacgccgagaacctcgcagcgcacctcttcgagatctcggcatcgtacgagaatcaacaggacattcagctcatgaggtttgctgattactttggccgggcatttgcagctgtgagcgcatctcaatttccacgggctgggtacctcggggccggcgcagcaacagtgtccaagatggttgatatcccattgtgccatatatctgaggctgtgatcaagactgtgagtgattggatcagtcaaagatcttctgatgccctgggagactttgttttgtggtgtatagatagcatcatgtctgaattgtcaggtccatcagctggccctaagggttcaaagaaggttgcacaacagtctccaagggcccaggttgcaatctttgttgttcttgccatgactttaagaagaaagcctgatgtactggtaaatgttatgccaaagataatgggaaacaataaatatctgggacaggaaaagcttcccatcattgtctgggttattgctcaggcctctcaaggtgacctagtgtctggcatgttttgctgggctcattctctatttcccacattatgtgcgaagtcaagtgggaatccccttgcaagagatttggttttgcagttgcttgaaagaattttgtctgtcaccaaagctcgttctatattattgaatggtgctgttagaaagggagaacgcttagttccccctgtttcatttgacttgttcatgagagccacatttcctgtttctaatgctcgagtgaaggctacagaaaggtttgaagcagcctacccaatgatcaaggagttggctcttgccggtcctcctggctcaaaaactgtgaaacaagcatcacaacagcttttacctttgtgtgcaaaagcaatgcaagaaaacaacgcagagctcaccagggaggctgttgatgttttcatttggtgcttaactcaaaatgcagagtcgtacaagcagtgggaaagaatttatcttgaaaatattgaagccagtgttgctgtcctgagcaaagttgtgattgattggaggggtgtgtctcctaagctcagttctgaagctctcaaggcaacagtgaagaactttaaggctaagaatgaggctgcgctggagtccacaacagatgctggaaagcaggcatctatcaaagaagcagacaagcactgcaaggtgtgatgccttggaaggccgtccgggccccgcccccctgttttggacgccggaggtgtgatgtctgatgttggagcgtgaagatcttttgaaatatgttgcattttcatatggtttttggacgag

SEQ ID NO: 9964 - DNA, 4400 bp, Zea mays
  misc_feature (2913)..(2925): n is a, c, g, or t
  misc_feature (3346)..(3350): n is a, c, g, or t
aattcggcacgaggggacgccgcgcagacgcggcggatccgccgccgcagcagttcgatcgccggcgttggcaggtgggacaccttcccttatcccctccggcgggccccgcacgctccgccccttgcggactccgaggcctgcggctccactcccatcgctctcccggttgcattcgccccaatccaaacgacaaacgccaacggttccctccattaaaagacctgccccccccgggcccgcccgggattccactcccacgtgctgctccacttgcgccgccacgttatacctctgggctgtagccatggggacgtcggggtccaagggcatcgacggcgtcggcgcagtttctggcgtcggcgctggcgcggcgggccttggcggcgtcggcgccggcggggacgggggcgagggcgccgccgcggaggcgtggcatggcggggcgcagctgtacgtgtcgctcaagatggagaacgcgttgatcagcggcgacctcgtcccgcacgtgtatggctccgagcccatcatcggcacctgggacccctcccgcgccctcgccatggaaagggagctcgcgtccatgtgggtgctcagcttcgtcgtgccgccggaccatgaaacactggacttcaagttcttgctgaagcccaaagacgctgaaaccccgtgcatcatcgaggaaggacccacacggctcctcaccggaggcatgctagagggtgatgtgagggttgcactgttcaagctcaatggagatgatgaggtgctcgagtttggggtggtcaacaaggcggaccttgtatcaccgctcgaacttgctgcaagctggagggtgtacaaggagaactttcagccttccaaagttcgggggatccctgatatcagtatcaatgtcacacccactaatggagctgaggaaggatcagcggctactttggaacttgacttggaacattatgttgttccgtccccgccaactgcaccaccaaatggatatgctgcaaaccttgctgcgactccagcatccgtgattcaaactgaggcattgttgacaaatgatatccttctaagtgatgggattcagagtccaagtagtgtttctgcaaaattagaagattgtactaaccacaagaatattgaggcctgggcaacagattcttctaagaaaattcagaattccggactcattgaatcaaaatcagttggcacctttacaccaatgcaaaagctagatggtcaaaaggggctgttcgttgacaggggtgttggctcttctatgcttccaaaatcagccagtgcatgctccttggcatctgggtttagttttggatcagcaaagacaatgccagaagcagcaggagctgttgcagctgcagctgtagctgatcgtttgcatgggtcaaaggaggaccggaagctggccattgttttggttggcctaccagctcgtggtaaaaccttcactgcagttaagcttacaaggtaccttcgttggttgggccatgaaactagacatttcaatgttgggaagtatcgccgtcttaagcttggagcaaatcagtctgcagattttttccgtgatgataatcctgaaggtattgaggcacgtaatgaggtggctgctttagcaatggaggacatgatagattggatgaatggtgggaggtcaggttggtatatttgacgcaacaaacagcacaagaaagcgaagatatatgctaatgaaaatggctgaaggtaactgtaagattatatttttggagacaatatgtaatgatccaaacataattgaaagaaacatacggctgaagatccaacaaagtccagactatgctgaacagctagattatgaagctggactggaggacttcaaggaacgtttgattaattatgaaaaggtctacgagccagtaggggaaggttcttacatcaaaatgattgacatggtaaaggggcaagatggtcagttacaggtaaataatatcagcggttatctccctgggaggattgtcttcttcttggtgaactctcatcttacaccacgacctattttgcttaccaggcatggtgagagtttacataatgttagaggaagagtcggtggtgatacagttctaagtgaaactggcgaactttatgcaaagaaactagccaactttatagaaaagcggctcaaatgtgagaaaacagcaactatatggaccagtacccttcagagaacaattttgacagcaagtccaattgttggattccccaagatacaatggcgtgctcttgatgagatcaattctggagtgtgtgatgggatgacttatgaagagataaagaaaatcatgcccgaggaatttgagtcacgaaagaaggacaagctaagataccgctacccccgtggagaatcttacctcgatgtgatacagaggctggaacccgtcatcatcgagctagaacgccagcgtgcaccagtggttgtcatatctcatcaggctgtactgcgagcactgtatgcatatttcgcggaccgtcctttgagagaagttccagagatagagatgccactacacaccataatcgagatacaaatgggcgtcacgggtgtggaagagaagaggtacaaactcatggactgaatgaatacataaaagcagctggttggctgtttcatacagcaagtacacataacacagaagccttttcccttctctctctctctccacacggtgttcagtgtaatttctttggaaaaaagacatgttgaacattgtaaagaaaaaactaataaggaactgtaaaaatggcatgcttactgtaacgaataaggaatacagactgggggtctccaatgcttattcagaaacatattccgtcaaatcggttgatcctgtggctgatgggaccaatgaaccgtgagannnnnnnnnnnnntgcatagatagcatcatgtctgaattgtcaggtccatcagctggccctaagggttcaaagaaggttgcacaacagtctccaagggcccaggttgcaatctttgttgttcttgccatgactttaagaagaaagcctgatgtactggtaaatgttatgccaaagataatgggaaacaataaatatctgggacaggaaaagcttcccatcattgtctgggttattgctcaggcctctcaaggtgacctagtgtctggcatgttttgctgggctcattctctatttcccacattatgtgcgaagtcaagtgggaatccccttgcaagagatttggttttgcagttgcttgaaagaattttgtctgtcaccaaagctcgttctatattattgaatggtgctgttagaaagggagaacgcttagttnnnnntgtttcatttgacttgttcatgagagccacatttcctgtttctaatgctcgagtgaaggctacagaaaggtttgaagcagcctacccaataatcaaggagttggctcttgccggtcctcctggctcaaaaactgtgaaacaagcatcacaacagcttttacctttgtgtgcaaaagcaatgcaagaaaacaacgcagagctcaccagggaggctgttgatgttttcatttggtgcttaactcaaaatgcagagtcgtacaagcagtgggaaagaatttatcttgaaaatattgaagccagtgttgctgtcctgagcaaagttgtgattgattggagggttgtgtcttctaagctcagttctgaagctctcaaggcaacagtgaagaactttaaggctaagaatgaggctgcgctggagtccacaacagatgctggaaagcaggcatctatcaaagaagcagacaagcactgcaaagtgatctttggaaagctgacccgtggcgccacctgcctgaagagcagcctggtggtcatcgcgctcgctgttgctgctagttacgtgctgtctcctggcatggacctcgagaaggtccaggcgatggtctcatcgcacctgtcgttctaaacatacctgtccagaatctccagacgtggatctaaattatacgagccatccaaaggggatggctcactcatcagtgaagagagctcagggggtgagaataagagggggataggcgctagaaccgaaagggtacagtttcctgagttgcctttttttatttttcccgcgtctcctcgagcagcagtgcgtgggaggagacgcagtcgactttgcagggagttggttaatcggtagactgatgggtgcgaagaaggtcaagtcaaacggctcaaccagaggattaacacctttgcttttctctttctgcatctgagatgattgcaaacagttttggtttaaaaattaagaatcttgaatcgtaaaaaaaaaaaaaaaagcggccgctaaatgtatctgttgcgttgatatccgattaaattgcgtgt

SEQ ID NO: 9965 - DNA, 2377 bp, Zea mays
tttatttggagaattgtccaggtcgcctttaatctgccctatactcttgctaatgctccgcacttatacggtgactggattctgtcttttaataagtcagttcgcaatctggtgatggtgggctgtggggcagttttttgggctatctggagaataaggaataatgcttgttttaatggcttgttggtttttgatcctattgaagtaatctttagttgctgcttttggctcgattcttggtctgttttgcagagtgagacaacaaaaaagatgttgttggaagggagtgtgcgaattcgaaggacgataaataagttctttgcgcacgcgaatggatgggcgcctatgtcgagaaggatcacgggatgaaaaaagtcttacatatctctggcttaacgttgtgaggtggcggtttagtggctttcgttgagtcaccgggcttctggattgtaatacgtcgctgtgcttgtttctctatggtctaagttcttctcgatcctgagtttcgctaagtcgagctcaataaaaaccctagggatttcgttctttagtaagtctggttagttgatgtctacctgctagggcgttgaagactatagcttcttaattaaaacttccccatgtaaaccgtactgtaaacgtatcctgtgatcatggagcttttgtgctcatatgaacactttaaatctggtacattcatttctcatccagtggcagtggcacacaaaagagatagacggcgtggcgcaaaaagggcggcacagaagaaattaggaaatatctattcacacttgaatgaaaaatgaagacactagatttaaagtactcatataagcacaagagctcaatgaatacaggatatgttaccgtatatgtttcctattttctaatgaaacaggggtaattccccttcctgtcaaaaaaaaaaagccaactggtctcctcctttcacctctcgcatcctcatggagagtcactgacacgtgggccgtcgtccctgtctgaccccacgcgtcggtgccacagcggcaggaagcttccatgcccgtgccgagcgccgccgtcgcttggtcacctactcacctccagctccaaagtcgcggcgacacgcttctagaaccgcgtcgcggcgtgtataacgaacgcatcatgcgtgaggccatggacgatttcatttccgaatcgatcccttccctttcggtcgccacctctagattacctcgcctcagctgtcaccgacggcgacgcgtttcttcgcgcagcgcgctgcgcctttaaaaactcccggagccggccagagaccacgagacagagcaggcacagagttcattcaccgccggctccttcatagttcattcccgaggcagagattttttttggggggtgaagcaccgcgcaactccttctcagttctcagcggcagacatgcagcggaacaactcgttcgggacgtcgtgggcggaccagtgggactacggcggcgacccgagcccgagggcgccgcgcgacggcggcgtgggggagaagaccaaggcggccgcggccaccggcatgaggaaggtgaaagagggcacgtcgcaggggttccagtggatcaaggacaagtgccagcggaagaacggcggcggcaacaagaagcagcagggctccgaggtccctgggtactgacccctcctgtcctcgtcacgtcagtgctgttgcttggcagacagcagaattttctaaattttttctcggttcttgctgttggtacgaatagtatactgcgtataggttgtgatctgatctcggtgctggttgcagttgtagagtagtttcatcgtacctgatatgtctccttgatactgaattggtcacttcgatatatataaaaggatatttttaaacttgtatgttcctgctcgtatttttcatctagacgtagacggagggcgataccttcatgaaaccaccacttttcgtgcctcgtgttggtataccttcagtaggctaataaattaataatttgtttcgaggttaattaagttttaaatatcatgttaggccggttgtttcaaatctctaaagctaaaatttaatggctgctcctacgcattcgatcatcatggactttcgtggtggcctcaagggtgagtccctaactccctatacgtgagagctttctctaaaatcacgcacacaaagacagaatgacctaaaacctacaaattaatgtttgaccatgtatgtctacatgcaacatgcggatattattcaatgcacatgcaacatggtttcatatttaaaatgtgaaagaaggtatttaacatttcttttttctaagcatgtactacctcagttttcgaatatttgccgttcactagttatttttgaactg

SEQ ID NO: 9966 - DNA, 2054 bp, Zea mays
atttccatatgttccagaatatttttagctcagtccctctgcagtctgcactcggaagggtactagagataatataactccacctccctatctccccccaccccggcgctcgagctctactcctctccccgagtcctctcctctccggggtattgaattcgaaccaaaaaatcaaaacaactcagcgattcgattcgcggcgagtcaagcgggatgccgccgcgcacggctccggcggcgacctcaaccccgccgcggaaggtgcccctccggaagctgctgcgtgcggcgtcggtcgcctgcggggtgcagttcggctgggcgctgcagctgtcgttgctgaccccgtacgtgcaggagctgggcatcccgcacgcctttgccagtctcgtctggctgtgcggtccgctgtccggcctcctcgtccagcccctcgtcggccacctctccgaccgcatcggccccgccgcttcgccgctcgggcgccgcaggcccttcatcgccgccggcgccgcgtgcatcgccgcagccgtgctcaccgtcggcttctccgctgacctcggccgactcttcggcgacgacgtcaccccgggctcaacgcgcctcggcgccatctgcgtctaccttgtaggattctggctgctcgacgtgggcaacaacggcacgcaggggccctgcagggcgttcctcgccgacctcacagagaatgacccaaggaggactcggatcgctaatgcatacttttcactcttcatggccctgggaaacatacttggatatgccaccggagcatacagtggatggtattcgatatttcctttcactgttacagagtcctgcggcatcagttgtgccaaccttaagtctgcctttcttcttgacattattgttctggtcatcacaacgtacactactgtaacatccgtgcaagaacctcaaacttttggaagtgatgaagcacaaaatccaggtgctgaacaggaagctttcctctgggaactttttgggtcattaagatacttcaccctaccaatttggatggtcttaattgtcactgcccttacttggatggcatggtttccttttaccctctttgatactgattggatgggccgagaaatctatcgaggaagcccagacaacccaggagagacccaaaggtaccatgatggtgtgagaatgggttcttttggtctaatgctcaactctgtcgtccttggattcacctctgttgtgctagaaaagttatgtaggaagtggggagctggacttgtatggggtgtctccaatattctaatgactttgtgcttcttggcaatgcttgtaataacatatgttgcaaagaacatggattatccatccagtggtgcacctccgactggcattgtcgttgcttctttggtggtttttacaattttaggggcacccctggcgatcacatacagtataccatatgcaatggctgctagtcgtgttgaaaatctcggtcttggccaaggcctagcaatgggtattctcaatttagctattgtcataccacaggttattgtgtcacttggcagtggcccatgggatcagctgtttggcggtggaaatgcacccgcttttgcggtggcagccggtgcatctttcatcggtgggctggtggctattctggggcttcctcgggcacgcattgcatcctcgtcctccaggaggagaggcgggacacaccgataagtctgctcatttaccattacaggcatcatcaagtctggaaactctttgtgggttggagaagagcacgctgggagctcttgaatgctgtgtgctctttggtggtttgccccgttgagctattttttgcgttgtctccaaatcttttgttgttcaattcaactcgaatgtatgtacgcacgtatgcatgtatgtatttgtatgtatgtggatcatttgtagagagcttaagcaatgaataaaagttacaggagttacgttcaatgagcttaaaaaaaaagctgcctatggcttcttctcgagactagtctctctctctctcctcgtgccgctcgtgc

SEQ ID NO: 9967 - DNA, 2551 bp, Zea mays
  misc_feature (874)..(874): n is a, c, g, or t
attgggaccctcgaggccggcctggatttcatggatagtctagatttcggcccataatttaacaatctccaccgagtgaaattcccctttgataaaaatgatgggccctcattaaataaccatgtgcatccaaggtcacaggaataatccacacgtgagatcatctttgtcttgtccaaaaggtaagacgaaaccaaatcgaggaaacaatgggcaggtctggtaccaatttgagatattgaagtatttgaacaattcacaatgcaaacgaagcctcaatgtgtgctactgacttctaattgaagtgaaagcaaacgattcataaacgatggcatggggccaagatattcctgagtcaatagtgaacacccatacttagcctattggtggaactgaaggtctaaaactctaaattcgaaccagcatatgttgaaatccaatcttcggtttagaaaagcgatcaggttttcactccccttgttacacaattccaccaagaaaattgaagactgagttgtgatggaaagtagctgaacaaaccgacggctatatagtgaatataagctagcagaaaaggctaggttcacaattagggtcagccttgcaaggcacagagattgtgtgtttgtactgtttgtattaaagaaacagtggcctgcattggtacaaatcaatccctgaaaaacttgtgtgtgtaaaaggaaagagtactcaagacgtaaattggtaaactgcagcgtgacaaaaggacagtggattggagtaagttgaactagagttaggatagatgatgatgatgatgatgcagctttttggggatatatatcactaactggcacctgctgtaggttattgtgtcacttggcagtggccncatgggatcagctgtttggcggtggaaatgcacccgcttttgcggtggcagccggtgcatctttcatcggtgggctggtggctattctggggcttcctcgggcacgcattgcatcctcgtcctccaggaggagaggcgggacacaccgataagtctgctcatttaccattacaggcatcatcaagtctggaaactctttgtgggttggagaagagcacgctgggagctcttgaatgctgtgtgctctttggtggtttgccccgttgagctattttttgccttgtccccaaatcttttgtttgttcaattcaactcgaatgtatgtacgcacgtatgcatgtatgtatttgtttgtgtgtggatcatttgtagagagcttaagcaatgaataaaagttacaggagttacgttcaatgagcttaatcactattctgggtgtggcttcttatatatatgtgtgcacttatataaactccgaaaatgctatgattgtggctggggatggatgcccccattgcccagtgcccaccatctatgaatctatgatgtccagtccagctgcagttggagcggcacgccgggcgtggggtggaggacctgcgcctcgggaagcgcctccgatagcagggcctggaaggactgcgtcgtcccctgtttggtgagcacggttgccaggagtccgccggcgtccacgtcgccgttgctcatgggtaccacgtacctggctcgcagcagcctggccaggtccaccgcgtcctcctggccggagacgagggtgaagttggccgggaggagctgcttcaccaccggcgtgatgacgatgtccgcccgcagctgcttctcctccaggaaggacctgtcgtacacgcagtgcggctcgtagtagaggaggccggggccgctctcctcacctgtggccatgaggatgtagccgttctcggggcgctgccacgggggccccaggacggggcctgcggtggccagcacccggacctgctggttgacggcggtggactggccgggctcgatgtaggtgacacggcggaagggcgtgggcagggattcgagcactggctgcgcgttgggggtggtcaccaccggcaggtcaggcgccctggccgacagctgcgtcagcgtccggacgtggcagtgatcgtccaggctctgcgtgatgagcagcacgtccggcctcgcctccggcgccagcagcaggtcgtccaccccgagggccttcaccttgggattcttcttggcgccgtcgaacagccagggcgcgccgaagtcgaggttgccgacaaggactgggtccaccaggatgcgcacgggggcttggccttgctgctgcacctcccacacccagctgttgatctccaggtacgtcagcttcagcgtcacctgctgctgcctgctctcgcggatggcggtgctggaggattgcggttgctggggccgtcgggacgaggatgatcttgggtgatctggacgccgtctcaaaatcagatgatctgatgagggacgacgacggcaaggagaagcagcagcgggtgggcggaagaccagctgcaggcggacggtcgtggccatcggtggtgcggtgcgccgggaactggagagtgggggtgggtttaggagcagaggtgtttttcgattaggatgttctaggtaatggtctcgtgc

SEQ ID NO: 9968 - DNA, 2834 bp, Zea mays
ccggccgggaaaaaacccggccgcctcgggatttttagctcagtccctctgcagtctgcactcggaagggtactagagataatataactccacctccatccactctaggtctctagctctactcctctccccgagtcctctcctctccggggtattgaattcgaaccaaaaaatcaaaacaactcagcgattcgattcgcggcgagtcaagcgggatgccgccgcgcacggctccggcggcgacctcaaccccgccgcggaaggtgcccctccggaagctgctgcgtgcggcgtcggtcgcctgcggggtgcagttcggctgggcgctgcagctgtcgttgctgaccccgtacgtgcaggagctgggcatcccgcacgcctttgccagtctcgtctggctgtgcggtccgctgtccggcctcctcgtccagcccctcgtcggccacctctccgaccgcatcggccccgccgcttcgccgctcgggcgccgcaggcccttcatcgccgccggcgccgcgtgcatcgccgcagccgtgctcaccgtcggcttctccgctgacctcggccgactcttcggcgacgacgtcaccccgggctcaacgcgcctcggcgccatctgcgtctaccttgtaggattctggctgctcgacgtgggcaacaacggcacgcaggggccctgcagggcgttcctcgccgacctcacagagaatgacccaaggaggactcggatcgctaatgcatacttttcactcttcatggccctgggaaacatacttggacatgccaccggagcaggagcttattttagaatgcgattgcaaattctcttgtgcaactgcctgctctagattgcttcgatccaggacgggacacttcctcggttcctgctggctcactcaattcacgcatccgatttcgcttgcgccgcacgcgatccttccttagattttttttctttagcgttataataattattaaaattaaaatctcgccaactcacacctgccttccttgcttgcttgcctgatgatgccatgcgtcgcgtagctaaaaaacaaagcaatttggcacatcacgaggggccaagcggaaaacggcctccgatatttgtttctctgcggcggtcgttccttcaccacatcacatcacacaagtatatgatgaatgtaccgagtcggagtgcgtatttgcaagagaacaagagcctcctctatcttcctgtcgttttcccctttagcaccagattctttgctccgatgcgaccttgctcgccgtgcctacctgctcattttacacgagtgccaaagctccaaattatgatgagtggcagttgccttgcgagctggcacggtattagcatcagattttttggagacctcggcaacaagcaaataacaatgtgtcaatcctttctcaggcaggtcaggggatcgctttcatgctgtgctagcggtaggcctacatactatacattaatacatagggagagagatattcaggggttactccattattattccaagttttgaatcataggaggacggtcggtcggccacttttgcaaacagacaggtatttaaagggccctcgttaataattgcaaggctcagattggcctgtggctgctatcagcttgtacgcaaagaggcaacctctgatgtgacattactatgtgttcttagtggtagcacagttttttctttgtaaaatataaatactcctagatgattgttttccacttaggtgaattttcagtttggcaattctgaccggagcttgcgcgtaccttaagggctagtgtaccttaagggctagtttgtaaactcaaatctttgggggattgagggagaaattagctagccctaaatttcttatggttttccgctgttgtttatcaaaaagggaaaacaagaactcagaaataaatgactcccttctgacccttcatgtggcagagaatgacccaaggaggactcggatcgctaatgcatacttttcactcttcatggccctgggaaacatacttggatatgccaccggagcatacagtggatggtattcgatatttcctttcactgttacagagtcctgcggcatcagttgtgccaaccttaagtctgcctttcttcttgacattattgttctggtcatcacaacgtacactactgtaacatccgtgcaagaacctcaaacttttggaagtgatgaagcacaaaatccaggtgctgaacaggaagctttcctctgggaactttttgggtcattaagatacttcaccctaccaatttggatggtcttaattgtcactgcccttacttggatggcatggtttccttttaccctctttgatactgattggatgggccgagaaatctatcgaggaagcccagacaacccaggagagacccaaaggtaccatgatggtgtgagaatgggttcttttggcctaatgctcaactctgtcgtccttggattcacctctgttgtgctagaaaagttatgtagggagtggggagctgcacttgtatggggtgtccccaatattctaatgactttgtgcttcctggcaatgcttgtaataacatatgttgcaaagaacatgcattatccatccagtggtgcacctccgactggcattgtcgttgcttctttggtggtttttacaattttaggggcacccctggcggtgagtaaaagactgtttttttctttttcatcataatgatttctgtccattttcaggtctgtcgtatattctccatgtagtatattcagttcatttccttatttgcagatcacatacagtataccatatgcaatggctgctagtcgtg

SEQ ID NO: 9969 - DNA, 1646 bp, Zea mays
  misc_feature (217)..(222): n is a, c, g, or t
  misc_feature (463)..(467): n is a, c, g, or t
  misc_feature (492)..(496): n is a, c, g, or t
tgggacaacattgtgtcaccaaaagtccgctaactgagcatcaattcagtgtcaatatattaattaggccctggaacctggatcaaagtctggtacaggtagtcttcagaacaaaagaaaatggaagttacagtagccgatgaatagaagaggcaatatcccaagagctaaacgtactaaccaatgctggcagtctgagccatagttctctaacacnnnnnntatatgtattctatccatcaatgccattaaacaaaatgcctcccacatgccaatttaatactacaggtattattggacttctacccttgatgtccaattgctgaggcggtacggcattggatttgttgtgatcgccaccggtgtagtttctcatcatatattagctctaggcgctggcaggacaaagaaatgatggccgtatttactgtcttctagggtggtcacggcttgttgctgcgcnnnnnggattcactgtaaagaatgacgccnnnnnctgtgagagtgtaaccgagcattcctgttatggacacaggattcctgaatatcatgattgagatgacgactgccacggcaccctttgcatttccgagaacctgtagagtcagtgcgctagtatgtttggtcaccaagaaattggtcaaattgacaaaatatgacaagcaagaattgaacagtagcaaccaaacaatcgtgaaatccttctttgcaagctgaattgtgatgccaacaacattatcctccataaagatagttgcaggaagcaagaaaataacagcaattggagccatgtacaataacagattcatagaattaagcttcctggtcgaattcttctcccctccggaagccagaagaattccttgcaatactgtcttcaacgccccttgctgcagttgctcctatgcacatgatgaatccaaacagatgaaagctaggctcgccgcccctggcgatgatgactccggtgacgacgggcacgagggtgaggtaggtgacccaggactcgcgcttgacggtcatgacgtaggcgaagacggcggtgaagaagggcgtggtggcgccgaccgcctggttgaaggagacggggaggtagcgcagcgagacgttgccggagacgacggagccgcagaagacgaggctgagcgcggcgatcttggcgagctggacgcgggagcgcacgagctgcatgggcacgacgcgcagccaggcgatggcggcgtaggagagcagggcgcaggcggacatgtggcacatggtgaggaagatggggtacttgaagccgtagttgctgaggaggtacttgttgagcaggagcacgccgatgttggaggagtaccaggcggtgaccagcccgacggtgaagaggcggccgttccccgccgcggggcccgcgccgccgggggacggcgtggcgccgcccttggccgtcatggcgtcgtcgcggccggagatctgggggaggagggtgcgggaatggggtgcggggcggtgggttgggtcgcggttgaattggtgctgtgctggtgggtttggtcttgggcgcttggcacgggagggaggcgtccgcgtgagcctgcgtttatggcagcgggaaggagacagacgcccctgtcggtggtgagaacggagaggagatggatatt

SEQ ID NO: 9970 - DNA, 1586 bp, Zea mays
ttgggggtttttttttttttttttttttttgagcttaaattcagtgtcaatatattaattaggccctggaacctggatcaaagtctggtacaggtagtcttcagaacaaaagaaaatggaagttacagtagccgatgaatagaagaggcaatatcccaagagctaaacgtactaaccaatgctggcagtctgagccacacttctctaacacaaaaaatatatatattctatccatcaatgccattaaaaaaaatgcctcgtacatgccaatttaatactacaggtattattggacttctacccttgatgtccaattgctgaggcggtacggcattgggtttgttgtgatcgccaccggtgtagtttctcatcatatattagctctaggcgctggcaggacaaagaaatgatggccgtatttactgtcttctagggtggtcacggcttgttgctgcgctttttggattcactgtaaagaatgacgccaaaaactgtgagagtgtaaccgagcattcctgttatggacacaggattcctgaatatcatgattgagatgacgactgccacggcaccctttgcatttccgagaacctgtagagtcagtgcgctagtatgtttggtcaccaagaaattggtcaaattgacaaaatatgacaagcaagaattgaacagtagcaaccaaacaatcgtgaaatccttctttgcaagctgaattgtgatgccaacaacattatcctccataaagatagttgcaggaagcaagaaaataacagcaattggagccatgtacaataacagattcatagaattaagcttctccccatcagaagacagaagaattccttgcagtactgtcttcaacgcccttgctgcagttgctcctatgcacatgatgaatccaaacagatgaaagctaggctcgccgccgctggcgatgatgactccagtaacgacgggcacgagggtgaggtaggtgatccacgactcgcgcttgacggtcatgatgtacgcgaagacggcggtaaagaagggcgtggtggcgccgacggcctggttgaaggagacggggaggtagcgcagcgagacgttcccggagacgacggagccgcagaagacgaggctgagcgcggcgatcttggcgagctggacgcgggagcgcacgagctgcatgggcacgacgcgcagccaggcgatggcggcgtaggagagcagggcgcaggcggacatgtggcacatggtgaggaagatggggtacttgaagccgtagttgctgaggaggtacttgttgagcaggagcacgccgatgttggaggagtaccaggccgtgactagccccaccgtgaagaggcggccgttccccgccgcgggccccgtgccgccgggggacggcgtggcgccgcccttggccgccatggctcctcggtcgtcgtcgccaacgccggcggccgcgcacgaacgagctcgcgcgcgggcgcgcggggagatctgagtgatgagggggggtgaggatgtgggaatggcgtgcggggcggtgggctgggtcgcggttgaattggtggtgggtttgggcctggctcgttggcacg

SEQ ID NO: 9971 - DNA, 1135 bp, Zea mays
gcacgaggagagatagttcgagtttttttttttttttttttcacagtcaaaacagctgggcagttgcatgcaaatctgaaccaacaatgtagctatgtagtcatgtagactttacattggcagtcttgatgggacatcattgtctcttttttttttttttttttgagcatcaattcagtgtcacaatatattaattaggtcccggaacctggatcaaagtgtggtataggtggtcttcacaacaaaacaaaatggaaactgcagcagcagaagatgaatacaagaggcaatttcccaagagctaaacgtatcaaccaatgctggcagtgtgagccatagttctctaacacacacaaaaaaatatttatattctatccatcaacgccataaaacaaaatgcctcccatatgccaaggtagttattggacttctatccttgatgtccaattgctgaggcagtatggcataggatttgttgtggtcgccaccgatgtgatttctcatcatatattagctctaggcgctgacaggacaaagaaatgatttcccatatttactgtctcctagggtgttcatggcttgttgctgcgctttttggattcgctgtaaagaatgacgccaaaaactgtgagagtataaccgagcattcctgttatggacacgggattcctgaatatcataatcgagacgacaactgccacggcaccctttgcatttccgagaacctgtagagtcagtgcactagtatgcttggtcaccaagaaattggtcaaattgacaaaatacgacaagcaagaattgaacaacagcaaccaaacaatcgtgaaatccttctttgcaagctcaattgtaacgccgacaacattatcctccataaagatagttgcaggaagcaagaagataacagcgattggagccatgtacaacaacagattcatagaattaagcttctccccatcggaagacagaagaaccccgtgcaatactgtcttcaacgcccttgctgcagttgctcctatgcacatgatgaatccaaacagatgaaagctaggctcgccgccactggcgatgatgactccggtgacgacgggccccggccggccgcggggtacccaatgccccggccaagcctcga

SEQ ID NO: 9972 - DNA, 1589 bp, Zea mays
acacgcaaacgcgcgcacacacaccgtacccctcagctcgcgccaccggccaccccacacagaacgcgtgctccgtccgtcctccctctgcctcgcgcgcgcagggttagcgtgagctgatcgagcaacgagagctagctagctagctagctagaggacacgacacaatggccttgcaggtcaccggcggcgtgggctgctgctgccctcaccctctcccaggcagtgcccggcggttgccgcaagcggcggcgctgtgtcgcccgccccgcgcggtaacgtccgcgggcgcaaccagggtggtggaggaggacgagggcaaggtgaggctgggcggctcaggcgtcgcggtcaccaagctcggcatcggcgcgtggtcctggggcgacaccacctactggaacgactccgagtgggatgataggagactgagggaagcacaggacgcgttcgatgcgagcatcgataacgggatgaccttcttcgatactgcagaagtttacggtacagcactgatgggagcagtcaattctgaaactttactaggaggattcatcaaggaaaggcaacagaaggaacagatcgaggtggccgttgcaacaaagttcgccgcccttccttggagatttggaaggggtagcgttctttcggcgctgaagaaatcgctagaccgtctaggcctagcgtccgtcgagctctatcaactccactggccagggatttgggggaacgaaggataccttgatggtctcgcagatgcttatgagcaaggcctagtcaaggctgttggagtctcaaactacaatgagaagcgccttcgggatgcacatgctcgcctgaagaagcggggggttccacttgctgcaaaccaggtgaactacagcctcatatatagaacccctgagttgaatggcgtgaaggcagcctgtgatgagctcggcatcaccttgattgcttattccccgatagcgcaaggtgttctgacaggtaagtacactccagaaaacccccctactggtcctcgagcaaacacatacacccctgagttcctcaccaagctccaaccacttatgaacaggattaaagagatcggagcaagctatggcaagagtccaacccaggtgtctctgaactggctgacctgccaggggaacgtggtgccaatccccggagccaagaatgccagccaggccaaggagttcgccggtgcactcggctggagcctgacgggggacgaggtggaagagctacggactctggcacgcgagatcaagggcataaagatgcccatcgaggagtcgtagatactctgtatttcaccaacccatgtcgtagcgggcgctcacggagaagacgacgcaaggatctagaaataaaccaggttgtgtaagtagaatagcttccaacgaatctcaggcctaagcattgtaagtatgcaatattcatttgccgaaaccagggctgtacctctgctgcttgttctctgctgaaaaaaaaagttaggatggaaagatagagactattgtgccgcaaaacaacacaaaggaaattactgaaaatgaaagaaaagttacaactaaaaaaaaaaa

SEQ ID NO: 9973 - DNA, 2152 bp, Zea mays
gtaagctcggaattcgtctcgagggaacatccaaaggacctgtgggtttacgacacatctctgtttcaaacaggggatgatttgataaggacaggggatgatcttgaatccacagcacacgatggttgtgctggtctgggtccttcattgccacctgatcctggacatgagtctccaaacaaagattgttccttatcggatgcctcctgacctcaagcctgtccagggattaggtgtttaccataagtttgatttccgggataacatcaatccctctatacctctctatgaaccaagtccagctcctcaggaaaatccattacagcttataaagcaaatgcctgttacagctgctgctgttgcaacagctgcagtggttgcatcttcaatggttgttgctgctgcgaaatctaacagcgatattaaactagatgtgccagttgcagcagctgccactgctgctgcagttgttgctactacagcttgctgttaaccaacaatatgaatacttggatccgggttggcaattgctttgcttgccaaggtcatcaaataaattaatccaaaaagggagacatgacttggtggatgatgatcagctggaaaccgatcatggacaggataatgcccttgagcgtgaaaagggtttgggtcaagcaccccaggaagctgagcgaatctctgatagggcaactgggacaagagagtgcaagatctgaaatttctcttgataaaatcgcagagtttgaaatccagtgggaagaacttacccttggagaacgagttgggctgggatctttcggagaagtgtatagaggtgaatggcatgaaacagaagtcgcagtcaagaaattcttgcaacaagatatttcaagtgatgctctggaagaatttagaactgaggtgggaataatgagaagactgcgtcatcctaatgttgttctttttatgggtgctgtcactcgtgttcctcatctttctatcgtgactgaatttctgccaaggggtagtttatttcggttaatccataggcccaataaccagttggatcaaaaaaggcgtttaaggatggcacttgatgtggcacgtggtatgaattatttacacaattgcaccccagtcatagttcaccgagacttgaaatctccaaatctacttgttgacaaaaattgggttgtgaaggtctgtgattttggtttatcacgtctgaaacatagtaccttcctttcgtcaagatccgcagctggaacagcggagtggatggcaccagaaatacttcgaaatgaaccatcagatgagaaatgtgacgtcttcagctatggggtcatattatgggagctctgtacattgctgcagccatgggaaggtatgaatcccatgcaggttgttggagctgttggttttcagcaacgacggcttgatattcctggtggtgtggatcctgctgtagcagagataataaggagatgctggcagactgatccaaggatgcggccatcattttcagagatcatggctactttgagaccattgttaaaaaacatgcctgccaaccaacctaccaggaagcgggcacaacaaacagatgattaagaatatattggtcagtatcagctgaagacacaggccaaagagagactgcattggtttgtcttgctcttgccttcccagcttcaagcaattggccatctgtaactattaccattgttttgtacagtacgccaaatgcgtatttgatgaagaacaggtgaattttggtccttttgccttcagcgtttggttctccattggagccagcggaatgctgtctatatctatctgatgaaagccgacccaaataacacagatccatgaagccaaagaaaagaaagggaaaagaaaatttgtgaaagttcgtgcatactatttttgcagacacaatggttactggagtcagaagttgacatgtcatgttgtaacaggatcttcgtcttttgttcagttaggccttatttttgctagtcctcgaacttaatggaaaattattccatctttaaggccccatcaaattgtaatgttttacttttgaaaaggttggctccccccttgtgtatatcacgtctccaaccaaatcttgcttttaattgaccagggtggatttaccaaaggaaaa

SEQ ID NO: 9974 - DNA, 3714 bp, Zea mays
  misc_feature (3621)..(3621): n is a, c, g, or t
tcagtacaaggtttgtttccatttttttttttgagaaaggtgtgattttcattactagttcagctaaacggtgtcgaagagccgcggcccatgttatgagttgggcagctcgagactagtgcggggctgcggcctgcgggccttcggggaacgcgcatgcaggtacgggccctttttgccgagagaaagcccgtcaagggccttgcatttgttggattggatttgaattgcagtatcattgtgctttgtacaaacgtgctgcaaggctttcagcggaaaaaaattggtgctgaacgtattatatagagagagaggaatagttttttaaatatagaaagctgtataaatacagtcaagatataacatgtatagatagctgtatagagacgcgaagagctcgtctcttgatttttccacttaacccctagagacccctcatttaattaggtacatgcccctgaaaaggcttaaatatagaagatggtcaaacattggcaaaaattctatgttactcaaatagaaaaaaacagagtttgaaacataggagaagctattacataattgatatacaagaaaatgaatccggagggagaccttttctcctccattactagtaccatgaaaagaaagcacacaaacaacaactagaggtgaaagcggaaacggtgattttcggataccaggaattgtttcgaaattttaccaaaatttagggctaaatgaaaatagaaacggttaccgaaaatacggaaacaaaattggtagaagaaaacggaaacgatttagatctctttcgactgtttccgaaaattgccgtttttattcagtattttaccgtcatcagtgaattcggtattttctagaaaaaatattaaatctaacccgatctttataaattcataataaattcaccttaacttagaaaaatatgaagctaattttattatatttctaaatcaagatctatctaatggtataaagtttggaattgtttggaacttttatggatcttatttatgttttcctaccaattattactcttgatacatatattcttacacgagaacctaagaaggaccagaaagataccaattatgttgactatgccaaacagtaggagtacaattagaatgcaaatgtcatgttattgtgcacatattaattctatagtcatatgctactagagttactgttgctttatttacatgcatgataataattttattattgtattacattgccttatatttattgtgacctctcctacctaccgattgtaatttttaaattccaatagtaaccggtgtatttcccgtactgaacttttgttttcaatattttcaaattatggatgttgttttcgtttccagaattatcgttttcgatttggtttcgagaaaaataaataagaaaccactattgaggtagactgccatgcaaactattcgaagccagtagcctaaaacagtgggaacccaaaaccaaagtagggtgctctagccaagaactgctcgtgtccactcactacgccgtggacgccgcgcggatctccggtgtcggtcttataacataatcctcgccgcgacgcctcttcctctcatttaaccgggtgccgtgatcgtcacccatggccaacaaggtcgccgtcgccagcgtcatcgccgcggtgggcatcgtggccgtgatcggcaccatcgccgcggtgaccagcgccaagaaagcgggcaacaaccacggcggcatgtccgccagcgtgaagctctccacggtgtgcgcctccacgctgtacccgcagaagtgcgagcagagcctcaagcccatcgtcaacgacacctccaatccggaggacgtcctccgggccgcgttcaaagtggcgctggacgaggtcgccgccgccttccagcggtcggtgcacatcggcaaggacgcccaggacaacctcaccaggaacgccatggacgagtgcaagaagctcctggacgacgccaccgaggacctgaggggcatggcgaggctcaagcccgcggacgtggtgcgccacgtcaaggacctccgggtctgggtctccggcgtcatgacctacgtctacacctgcgccgacgggttcgagaagcccgagctcaaggaggccatggacaagatgctgcagaactccaccgaactcagcagcaacgcgctcgccatcctcacacgcctcggcgagctcctgccgcaggaagccaaagctctgaacgccaccctgccgggtgcggggcacggccgccggcttcttggctggcagatgggcgaggccgaggaggtgaccagcggcggccgcgggcttccggccgtcaatgacaagcagttaggcgagatcgcggacgtagcgaacgcaaaccggaagctcctgtccgatcacgctgccctcagggggaggggggtactgaccacgggcctcgtcggcacgttcgacgagatccaatacgggcggagcggggtgccgcccagcgacttccccaagtggatgccggccagccagcggaggctcctgcagctgcccggctttcagaggcccaacaaggtggtcgcccaggacgggagcggcgacttcaagaccatcaccgaggccatcgccgccatgcccaagaccttcgaggggcgcttcgtcatctacgtgaaggccggcacgtacaaggagtacgtcaccgtgcccaaggacatggtcaacatcttcatgtacggcgacgggccgacgcggacggtggtcaccggcgacaagagcaacacaggcggcttcgccaccatcgccacacgcaccttctgtaagttggcatagatagcgactcgcgtcggactagatgcgggaagcaagaacgcgtccgccgccgtcgcccccgcccccgccgctgccgagggcaacgggttcatctgcaagtcgatggggttcgtgaacacggcggggccggaggggcaccaggcggtggcgatgcacgtgcagggcgacaagtcggtgttctacaactgccggttcgaggggtaccaggacacgctgtacgtgcacgccaaccggcagttcttccgcgactgcgaggtgctgggcaccgtggacttcatcttcggcaactcggcggcgctgttccagaactgcctcatgacggtgcgcaagcccggggacagccagtccaacatggtgacggcgcaagggcggacggaccccaacatgcccacgggcatcgtgctccagggctgccgcatcgtgccggagcaggcgctcttccccgaccgcctccagatcgccacctacctcggccggccgtggaaggagtacgcgaggacggtggtgatggagagcaccatcggcgacctcatcaggccggaagggtgggcggagtggatgggcgacctcggcctcaagacgctctactacgccgagtacgccaacaccggcccgggcgccggcaccagcaagagggtcaactggccaggctaccacgtcatcggacaggccgacgccacgccattcaccgccggcgccttcatcgacggcgcgtcatggctgcagagcaccggcacgcccaacgtcatgggattcaccaaagggtaatgatcggcggggttctttctgcagtgattttttgaggncagtagtgtgtcgcatgcatgcagcaagcttttaggttcgtcagagaacggctagccttttttttttgttatagctgtagggtgattaatcac

SEQ ID NO: 9975 - DNA, 3333 bp, Zea mays
catgaaagttgaagtgacataaaatttaagttcgaggacccaagtgacacgacatgccaagttggaggctccaagggctctgacgtggcatgccacgtcggtatctagttttacaaatctggctttggatagttttcatgggctgacaaaattcgaggacttgtttgcttggttttctaagttcggggtagatgacacaacatgacaaatttgtgaaccactagtgtactttactctttgttaatatattgagacgaatcgagttgagttggctcattatcaatcaaccttagttgactgtaaccttttgacaccggcaccatttttctacagtactatgccagttttctatcgttggttaattaatgtggaagagggtcgaacaatggtaaatttgtatgttgcaagaatttgaaatatagtaaaagtaataatataattcatccccaatgaaataaatcaggaggaagacctcttctcgtccattactagcagtaccataaaaagaaaacagtggcaacggccacgatgcagagagagtactgccatgcaatgcaaaccattcgaagccggtagcctaaaacagtcggaacccaacccaaagcagggagggtgctcctccagccaagaactgctcgtgtccacacgctacgccggggatgccggcctttgtaacatatataagcgtcgccgcgaggccgcccccgcccagataaccccgcatcgtcagccatggccaacagggtcaccgtcgcaagcgtcatcgccgcggtgggcatcgtcgccgtgatcggcaccatggccacggtgaccagcgccgacgacaacgatggcaacatgctctccagcgtgaaggtctccacggtgtgcgccttcacgcggtacccggagaagtgcgagcagagcctcaagcatgtcgtgagcgacacctccagcccggaggacgtcttccgggacgcgctcaacgtggcgctggacgaggtctccaccgccttccagcggtccgcgcacattggcaaggacgcccaggacaaactcagcaggaacgccatggacgtgtgcaagaagctcctggacgacgccaccgaggacctcagggccctggcacgggtcaagcccgcggacgtggtgcgccacgtcaaggacctccgggtctgggtctccggtatcatgacctacgtctacacctgcgccgacgggttcgagaagcccgagctcaaggaggccatggacaaggtgctgcagaactccaccgagctcagcagcaacgcgctcgctatcctcacccgcctcggcgatctcgggccggcgctagccgtcgacctgcaggccaccctggcgggtgctgtggggcacgaccgccggcttcttggctggcagataggcgatgccgaggaggtgaccagcggcggccgcgggcttctggacgagatcgtgggcgtggcaaacgcaaaccggaagctcctgtcggatacgctggacgagatcaccggcatgtcccacggcgcaaacggccggcgcttgcttagctccttggggtctcggatttccagcgcccagggagacgacgtcctcgcccgccaccagctgctggacgtgtcgcccgacgacgagaccgataacgctgcccggcgcaaccttttgtccaccgagctcgagagcatcgccagcacgtccgccgaggcaaaccgccagcttctcgcggcggaggagctccccgacgagctcgccggtaagcgagagctgctgtcccggacgctcatggggatcgacgaggcggccaccgaggccaagcgccagcttgatgaggcgacgacggagaacaccatgtccggcgaccacagggtactgaccacgggcctcatcggcacgttcgatgagatccaagacgggcgcagcggggtgccgcccagcgacttccccaagtggctgccggccacccagcggaggctcctgcagcagacccagaagcctaacacggtggtcgcccaggacgggagcggcgacttcaagaccatcaccgaggccatcaccgccgtgcccaacaccttcgaggggcgcttcgtcatctacgtgaaggccggcacgtataaggagtacgtcaccgttcccaagaacatggccaacatcttcatgtacggcgacgggccgacacagacggtggtcaccggcgacaagagcaacgcaggcggcttcgccaccttcgcctcagccaccttctgtaagtttgcatagatagtgatgacttggactagatgcggccgggaagaacgcgtctgatgaagatgaaagcgtgcatgtgcagctgctgagggcaacgggttcatctgcaagtcgatggggttcgtcaacacggcggggccggaggggcaccaggcggtggcgatgcacgtgcagggcgacaagtcggtgttctacaactgccggttcgaggggtaccaggacacgctgtacgtgcacgccaaccggcagttcttccgcgactgcgaggtgctgggcaccgtggacttcatcttcggcaactcggcggcgctgttccagaactgcctcatgacggtgcgcaagcccggggacagccagtccaacatggtgacggcgcaagggcggacggaccccaacatgcccacgggcatcgtgctccagggctgccgcatcgtgccggagcaggcgctcttccccgaccgcctccagatcgccacctacctcggccggccgtggaaggagtacgcgaggacggtggtgatggagagcaccatcggcgacctcatcaggccggaagggtgggcggagtggatgggcgacctcggcctcaagacgctctactacgccgagtacgccaacaccggcccgggcgccggcaccagcaagagggtcaactggccaggctaccacgtcatcggacaggccgacgccacgccattcaccgccggcgccttcatcgacggcgcgtcatggctgcagagcaccggcacgcccaacgtcatgggattcaccaaagggtaatgatcgggggattgcagtatgcgtgcgatgatgatacgcgcgcgtgtcttcatgcatgcaacatgcttttgggtttatctggaaactgctagcatttttgtgcgcatatatatatagctggaagctcctgtgcacgcatgcacggtgaataggatgacctgtctatatggttagtacgtggagctaacgcaagtgtgtgtttggcacggctccggctacttttaaattgactccggctccaacatttttacaagaggaatttttaataaattatttggcaaaacgacatctcttgtatttttatttgatatatataaggtgcatgtccat

SEQ ID NO: 9976 - DNA, 1495 bp, Zea mays
gcacgaggccagcttgatgaggcgacgacggagaacaccatgtccggcgaccacagggcacgcgccacgggcctcatcggcacgttcgatgagatccaagacgggcgcagcggggtgccgcccagcgacttccccaagtggctgccggccacccagcggaggctcctgcagcagacccagaagcctaacacggtggtcgcccaggacgggagcggcgacttcaagaccatcaccgaggccatcaccgccgtgcccaacaccttcgaggggcgcttcgtcatctacgtgaaggccggcacgtataaggagtacgtcaccgttcccaagaacatggccaacatcttcatgtacggcgacgggccgacacagacggtggtcaccggcgacaagagcaacgcaggcggcttcgccaccttcgcctcagccaccttctctgctgagggcaacgggttcatctgcaagtcgatggggttcgtcaacacggcggggccggaggggcaccaggcggtggcgatgcacgtgcagggcgacaagtcggtgttctacaactgccggttcgaggggtaccaggacacgctgtacgtgcacgccaaccggcagttcttccgcgactgcgaggtgctgggcaccgtggacttcatcttcggcaactcggcggcgctgttccagaactgcctcatgacggtgcgcaagcccggggacagccagtccaacatggtgacggcgcaagggcggacggaccccaacatgcccacgggcatcgtgctccagggctgccgcatcgtgccggagcaggcgctcttccccgaccgcctccagatcgccacctacctcggccggccgtggaaggagtacgcgaggacggtggtgatggagagcaccatcggcgacctcatcaggccggaagggtgggcggagtggatgggcgacctcggcctcaagacgctctactacgccgagtacgccaacaccggcccgggcgccggcaccagcaagagggtcaactggccaggctaccacgtcatcggacaggccgacgccacggcattcaccgccggcgccttcatcgacggcgcgtcatggctgcagagcaccggcacgcccaacgtcatgggattcaccaaagggtaatgatcatcgggggattgcagtatgcatgcgatgatgatacgcgcgcgtgtcttcatgcacgcaacatgcttttgggtttatccggaaactgctagcatttttgtgcgcatatatatatatagccggaagctcctgtgcacgcatgcaccgggtgaataggatgacctgtctatatggttagtacgtggagctaacgcaagtgtgtgtttggcacggctccggctacttttaaattgactccggctccaacatttttacaggaggaattaataaattatttggcaaaacggtcgacgcggccgcggtcgacgcggaaaaaaaaataaaaaaaacccgcgtaccctcaagctccaggtttttgctc

SEQ ID NO: 9977 - DNA, 1384 bp, Zea mays
ttttttttttttttttagcaatacaactattgggcacatgacatgtataaacatctggcattgctaagtaacaaaggggcaaaactgccagaactcagctgattcttcagagttcatatacaaacctagcttaggagcataagagcatcaatcagaaacaaatttgtctattccttttacagtgagcaccatttccatgccttttacagtggttataaccaacactagtgagaaatgtccttatgtcctgtgcactgctgttgccagcctgcagtaggtgttcatcttcttcatatataaggtagggatagggagcttcacctttaatccttgaaagcaaatttgatgcacctcccagtacgtggtattcccagccttgaacatcaacttagatcataagaactctctcagtatctggaacaacttcatccaaaggaattgtggaaacttcaacagcaatttctgcattagacttgaatgctaactttgtaccatctgcagatatagcactgttgtccagtcgaccaatcaccttgtgcatcgtaatagtcccaactcgatcagaagctgcagcgacgcagcgtgatacaccacaatgcggtcctgcacccggttgaggtacaccccgtcgcatctccgctgcagattctcgaacacgggctcgaatgccagcacccgaaactccgtcacggcggccagccggccacgaatgatgccatgccaacattggcacccacgtccaccaccaacccaccggatggttgccccctccccacctcgccgccgagcagctcctggatggtctcggagatatcgggcttgcggaagcgcttggccttgaggaggcgagcgatgttcttgtggggtggtcggggagggtacccatgtcggcgagcgagtagaagaaggggtacgacacgccctccacaaggttggcgaccatcgaggatgcctgtggcgaggcgtagcagccaaaggagtggaggccgcctggcaggcggcggtggcggaggaggccccggaggtggtgaaggttagatccggcgctttcgagagcacaaagagcaggacggttctgggagtcgaggataccgccgcgggagcggtggcgccggcggtgggaccggcagtgccggcattaatgaactgggctcgggcgtttgcttgagtagccagcggcggtgccggatagcgtggggtaaagccgtcgggctccgggctttgcgttgcctggtagtgtggaaagaagagatgcgtcgtcgagctgtcctgtccaccattcgtgggccgggactgcgtaatttcggcctgtgtccaccatttcggcctgcgtaattttagaataactgctggcaaagcaaactattttccatccagagacaaa

SEQ ID NO: 9978 - DNA, 867 bp, Zea mays
gcggcgccggccggccgggatcagcctgaaaaaagggccctgcggcgacgaagtgctccgttctccgtccaataatcgacatcccaattccctacctacgaatcccccgctccacaccgtcgccgccggcgaaatgtcggcgatgggatacgaccagggcctgtctacccacggcgcctcctggccgcagcgatccgactacgatccatactcctacgcctactcccaccacatcgtcgctgccgccgcctcctaccaccagccgcccccaccgggaacagagcatgctgctcccacatccgccgcctcgtcatggtcgtccgcagcaggagcatcgaacaacgtcgtagtgggcgggccaggcgcgaaccctctaaccgtttccgcactgtcacagccgaccatcttcgccgcctcgatcgggtggtccgggcacggtgtgggacaccttccgtactacgacccgcagtacccgccggcgcagcatcccacagcggtcgggggtgtaagcagaggtggtgagccttcgcatggtgggggcagaggtctaagccctatgtatcatcctcttacatggaatgcaggaattacatcaccatgtggtagaggacgagggcatggaaacaagagcagtgataggcagttagcccttggagcatccagtggatcatctgcatcagaggctcagcccggaacagtgtgtgcaccagcacatgtggtgcaagctacaaccatcaatttcacacggggtactgtagttccagctgcttggtgtgacctatgcccgagtggggtgtaatagcaaggaaatcctcgagcagcacaaaaatggaaagaggcataaacggactgtgcagagaatgcaaa

SEQ ID NO: 9979 - DNA, 1921 bp, Zea mays
attgggtaccgcgttccctgcccgggacccgcccgggctccccaactcggcaactccgcctcccaagtcacacccccactccctcgctcaccagaggaactagcggaccaggcaaagccgagccgcaaccgcgaagatcttgcgtggcctccttttcccagatcgtcactgtgccgctcgtgccctccactcccggtccgcccaaccaataatccatccatccatccaccaccaccaccccgctgcggcgatgtgcggcggcgccatcctctcgggtttcatcccgccgtccggggtggcggcggcggcggcggcggccaagaagaagcagcagcagcggtgccgtgtgactgcggacctgctatggccggggcccggcagtaaggaagctccccaggaccaggaggaggacttcgaggccgacttccgcgagttcgagcgcggcctcggcgaggatgacgtggacagcgccggcgaaggcggcgaccccgaggtccaggagcttcctccgccggagccgacgaggtttgccttcgccaccgcggccaaggcagcagttgatggcgtgatgacgacgactccaaaggatgtcaaaggagatagaccagtaaagcgcggccggaagaaccagtacaggggaatccggcagcgcccttggggcaaatgggcagctgagatcagggaccctaacaagggcgtccgcgtctggctcggaacctacaacaccgccgaggaggcagctagggcatacgacgccgaagctcgcaagatccgcggcaagaaagcgaaggtgaatttccccgatgacgacgcgccaggcactggtcacaggccagcgaacgcagcgcctaggctagtagctccacccccaccccccaaggcctgcgccgatgagatctttaacaacctgaagaacgacgacgacgacaacaacaacaacaacgatgatctgtttgcgatgtttgcgttcggtgacaataagaagaaggttcctgcagcgaagccagccgccgccgagggtggcagtggcagtggcagcttcctcgtccctgcgcctgcggtggcggtggtgcccggtaataagaggaggtcgtccgcgaccaacactatgctctccgtctccgacgaccagcgcagcaactcctacggctccggctcctccgacttggtggggtcgtggtcgtgggacgacgacgcggcggccgccgccatgacctcggactacacctcctcggtcttcgctcccgataacgccgtgctgccggcggcgtcttacacgcaaggcggagcgccgaagagaatgaggagcagctacggcggcgcgccgcccagcctcgcacatgacgcggccatgcctggctttggccttgataaagtgagctaccaccactaccaggcgttgcctccttattacgtcgggagcagcaacgcgtcggtgggcaacctcggtcttctgcagcaggctgatgatgctccagctccacaggatggggcgagcgccggggatatctggagcctcgacgagctgctcatgctggcagcagctggtgcttattgagaaccgcaagaaaaaaaaatgtgttggcgctgctagctggagacgagacgagggcgagaggcagttgcatcatccgccatccgctatcgttttgtctctcctatatctagtatatatatgcttctggcagtcgaactctatggcaatgcgtgtgtatagtgtgttgctgccgtctatgattggaagcgagctcgagactggttcaataattcacctttgcctaccgtcgtaccgccggcctgctggactgtagtgtgcgtactgcatatatatgccataattatgtatgcactcctcctatataaactatattattatgatgtgcttatacaaaaaaaaaaaaaaaaaaaaaaaaaaaaaaaa

SEQ ID NO: 9980 - DNA, 1932 bp, Zea mays
cattgggtacctcgaggccggccgggagctaccaatctaccacctccccaactccgcctcccaactcccaagtcccacccccactccctcgctcaccagaggaactagcggccaggcaaagccgagccgcaaccgcgaagatcttgcgtggcctccttttcccagctcgtcactgtgccgctcgtgtccttcactcccggtccgcccaaccaataatccatcgatccatccaccaccaccaccccgctgcggcgatgtgcggcggcgccatcctctcgggtttcatcccgccgtccggggtggcggcggcggcggcggcggcggccaagaagaagcagcagcagcggtgccgtgtgactgcggacctgctatggccggggcccggcagtaagggagctccccaggacaaggaggaggacttcgaggccgacttccgcgagttcgagcgcggcctcggcgaggatgacgtggacagcgccggcgaaggcggcgaccccgaggtccaggagcttcctccgccggagccgacgaggtttgccttcgccaccgcggccaaggcagcagttgatggcgtgatgacgacgactccaaaggatgtgcaaggagatagagcagtaaaaaagcgcggccggaagaaccagtacaggggaatcaggcagcgcccttggggcaaatgggcagctgagatcagggaccccaacaagggcgtccgcgtctggctcggaacctacaacaccgccgaggaggcagctagggcatacgacgccgaagctcgcaagatccgcggcaagaaagcgaaggtgaatttccccgatgacgacgcgacaggcactcgtcacaggccaacgaacgccgcgaacgcagcgaggctagtagctccacccccacccccgaaggcctgcgccgatgagatgtttaacaacctgaagaacgacgacggcgacaacaacaacaacgatgatctgtttgcgatgtttgcgttcggtgacaataagaagaaggttcctgcagcgaagccagccgccgacgaggttggcagtggcagtggcagcttcctcgtccctgcgcctgcggtggcggcggtgcccggtaacaagaggaggtcgtccgcgaccaacattatgctctccgtctccgacgaccagagcagcaactcctacggctccggctcctccgccgacttggtggggtcgtggtcgtgggacgacgacgacgccgccgccgccgccgccgccgccgccatgacctcggtcttcgctcccgataacgccgtgctgccggcggcgtcttactcttacatgcaaggcggagcgccgaagagaatgaggaggagctacggcggcgcgccgcccagcctcgcacatgacgcggccatgcctggctttggccttgataaagtgagctaccactaccaggcgttgcctccttattacgtcgggagcagcaacgcgtcggtgggcaacctcggtcttctgcagcaggctgatgatgctccagctccacaggatggggcgagcgccggggatatctggagcctcgacgagctgctcatgctggcagcagctggtgcttattgagaaccgcaagaaaaaaaaaatgtgttggcgctgctagctggagacgagacgagagggcgagaggcagttgcatccgccatccgctatcgttttgtctctcctatatctagtatatatatgcttctggcagtcgaactctatggcaatgcgtgtgtatagtgtgttgctgccgtctatgattggaagcgagctcgagactggttcaataattcacctttgcctaccgtcgtaccgccggcctgctggactgtagtgtgcgtactgcatatatatgccatagttatgtatgcactcctcctatatatactatatattattatgaaaaaaaaaaaaaaaaaaactcgagacctcgtgc

SEQ ID NO: 9981 - DNA, 968 bp, Zea mays
ccggccgcgttgggtccctcgaggccggccgggacaatctacacctccccactccgcctcccaactcccaagtcccacccccactccctcgctcaccagaggaactagcggccaggcaaagccgagccgcaaccgcgaagatcttgcgtggcctccttttcccagctcgtcactgtgccgctcgtgtccttcactcccggtccgcccaaccaataatccatcgatccatccaccaccaccaccccgctgcggcgatgtgcggcggcgccatcctctcgggtttcatcccgccgccgccatgacctcggactacacctcctcggtcttagctccggcgtcttactcttacatgcaaggcggagcgccgaagagaatgaggaggagctacggcggcgcgccgcccagcctcgcacatgacgcggccatgcctggttttggccttgataaagtgagctaccactaccagccgttgccgttgcctccttattacgtcgggagcagcagcggctcgtcagacgacgcgtcggtgggcagccttggtcttctgcaggctgatggtgctccacaggatggggcgagcgccggggatatctggagcctcgacgagctgctcatgctggcagcagctggtgcttattgagaaccgcaagaaaaaaaaatgtgttggcgctgctagctggagacgagacgagggcgagaggcagttgcatcatccgccatccgctatcgttttgtctctcctatatctagtagtatacatgcttctggcagtcgaactctatggcaatgtgtgtatagtgtgttgctgccgtctatgattggaagcgagctcgagactggttcaataattcacctttgcctaccgtcgtaccgccggcctgctggactgtagtgtgcgtactgcatatatatgccatagttatgtatgcactcctcctatatatactatatatttttatgatgtgcct

SEQ ID NO: 9982 - DNA, 1842 bp, Zea mays
  misc_feature (9)..(9): n is a, c, g, or t
gtaccctcngagcccggccgggctcccccaactccgcctcccaagtcccacccccactccctcgctcaccagaggaactagcggaccaggcaaagccgagccgcaccgcaaccgcgaagatcttgcgtggcctccttttcccagctcgtcactgtgccgctcgtgccctacactcccggtccgcccaaccaataatccatccatccatccatccaccaccaccccgctgcggcgatgtgcggcggcgccatcctctcgggtttcatcccgccgtccggggtggcggcggcggcggcggcggccaagaagcagcagcagcagcagcagcggtgccgtgtgactgcggacctgctatggccggggcccggcagtaagggagctccccaggacaaggaggaggacttcgaggccgacttccgcgagttcgagcgcggcctcggcgaggatgacgtggacagcgccggcgaaggcggcgaccccgaggtccaggagcttcctccgccggagccgacgaggtttgccttcgccaccgcggctctttttattatagatggcgtgatgactcctcctccaaaggatgtccaaggagatagagcagtaaaaaagcgcggtcggaagaaccagtacaggggaatcaggcagcggccttggggcaaatgggcagctgagatcagggaccctaacaagggcgtccgcgtctggctcggaacctacaacaccgccgaggaggcagctagggcatacgacgccgaagctcgcaagatccgcggcaagaaagcgaaggtgaattttcccgatgacgcgacaggcactcgtcacaggccaacgaccgatgagatctttaacaacctgaagaacgacgacaacaacaacaacgatgatctgtttgcgatgtttgcgttcggtgacaataagaagaaggttcctgcagcgaagccagccgccgccgagggtggcagtggcagtggcagcttcctcgtccctgcggcctgcggtgggcggtggtgcccggtaataagaggaggtcgtccgcgaccaacactatgctctccgtctccgacgaccagcgcagcaactcctacggctccggctcctccgacttggtggggtcgtggtcgtgggacgacgacgcggcggccgccgccatgacctcggactacacctcctcggtcttcgctcccgataacgccgtgctgccggcggcgtcttacacgcaaggcggagcgccgaagagaatgaggagcagctacggcggcgcgccgcccagcctcgcacatgacgcggccatgcctggctttggccttgataaagtgagctaccaccactaccaggcgttgcctccttattacgtcgggagcagcaacgcgtcggtgggcaacctcggtcttctgcagcaggctgatgatgctccagctccacaggatggggcgagcgccggggatatctggagcctcgacgagctgctcatgctggcagcagctggtgcttattgagaaccgcaagaaaaaaaaaatgtgttggcgctgctagctggagacgagacgagagggcgagaggcagttgcatccgccatccgctatcgttttgtctctcctatatctagtatatatatgcttctggcagtcgaactctatggcaatgcgtgtgtatagtgtgttgctgccgtctatgattggaagcgagctcgagactggttcaataattcacctttgcctaccgtcgtaccgccggcctgctggactgtagtgtgcgtactgcatatatatgccatagttatgtatgcactcctcctatatatactatatattattatgatgtgcttatactaaaatccccaccccc

SEQ ID NO: 9983 - DNA, 1479 bp, Zea mays
cattgggaccccccggccgccggcggatctcccaactccgcctcccaagtcccacccccactccctcgctcaccagaggaactagcggaccaggcaaagccgagccgcaccgcaaccgcgaagatcttgcgtggcctccttttcccagctcgtcactgtgccgctcgtgccctacactcccggtccgcccaaccaataatccatccatccatccatccaccaccaccccgctgcggcgatgtgcggcggcgccatcctctcgggtttcatcccgccgtccggggtggcggcggcggcggcggcggccaagaagcagcagcagcagcagcagcggtgccgtgtgactgcggacctgctatggccggggcccggcagtaagggagctccccaggacaaggaggaggacttcgaggccgacttccgcgagttcgagcgcggcctcggcgaggatgacgtggacagcgccggcgaaggcggcgaccccgaggtccaggagcttcctccgccggagccgacgaggtttgccttcgccaccgcggccaaggcggcagttgatggcgtgatgactcctcctccaaaggatgtccaaggagatagagcagtaaaaaagcgcggccggaagaaccagtacaggggaatcaggcagcggccttggggcaaatgggcagctgagatcagggaccctaacaagggcgtccgcgtctggctcggaacctacaacaccgccgaggaggcagctagggcatacgacgccgaagctcgcaagatccgcggcaagaaagcgaaggtgaattttcccgatgacgcgacaggcactcgtcacaggccaacgaccgatgagatctttaacaacctgaagaacgacgacaacaacaacaacgatgatctgtttgcgatgtttgcgttcggtgacaataagaagaaggttcctgcagcgaagccagccgccgccgagggtggcagtggcagtggcagcttcctcgtccctgcgcctgcggtggcggtggtgcccggtaataagaggaggtcgtccgcgaccaacactatgctctccgtctccgacgaccagcgcagcaactcctacggctccggctcctccgacttggtggggtcgtggtcgtgggacgacgacgcggcggccgccgccatggtctcggactacacctcctcggtcttcgctcccgataacgccgtgctgccggcggcgtcttacacgcaaggcggagcgtctaatagattgagccccccccacggcggcgcgccgcccagcctcgcacatgacgcggccatgcctggctttggccttgataaagtgagctaccaccactaccaggcgttgcctccttattacgccgggagcaccaacgcgtcggtgggcaaactcggtcttctgcagcaggctgatgatgctccagctccacaggatgcggcgagcgccggtgatatctggaccctcgacgagctgctcctgctggcagc

SEQ ID NO: 9984 - DNA, 2330 bp, Zea mays
cgcttctataaaagcattgggtacctgggcgcccggccgggcacagaacgagtgaggccaggcgacttcatactgctcgcctcgccgtctttcccccaatctgttgctcctccaagctgcgggcgatcgccgtaccccggccgccgcagggaaccccctcgccatggccttgcaggggaagaagctcatcaacaaccccgacgatgtggtgacggagttcatcgaagggttggtggagacttacccgggtctgcagtacctcgacgggttccctcagattaaggtcgttcttcgtgctgatgtccagcgcggttcctatgacaaagttgcagtcatctcgggtggtggaagtggccatgaaccttcccatgctggatttgttgggccagggatgttgacagctgctgtttctggagatgttttcgcctctccacctgttgattctattttagctgctattcgagctgtaactggtcccatggggtgccttctaatagtaaagaactacactggtgatagactcaattttggattagctgctgagcaggcaaaatctgaaggctataagatggagatggtcattgttggagatgattgtgcccttcctccacctagagggatagctggtagaagaggtttagctggaacaattcttgtgcataaggttgctggggccgcagcagatgctggtttatctcttgcagaggttgccgcagaagcaaaacatgcatctgaggttgttggtacgatgggagttgcactttctgtttgcacattgcctgggcaaataacttctgatcgtctaggtccaaggcaaatggagcttggccttggaattcatggagaacctggagttgctgttgttgaactccagccagttgacgtagtggtagaacatgtccttaaacagatattgtcacaggaaactcagtatcttcctgtcacaagaggttgcaatgctgttctcctagtgaatggattaggagccactcctatcatggaacttatgattgcagcgagaaaagcagttcctgagttgcaattggtgtatggcattgctgttgacagagtctacactggcacacttatgacatcacttgatatggcaggattatctattaccattatgaagtccggcgaaagcattttgaagagacttgatgctcccactaaagctccagcttggcctgttggttctgaaggaaaccgtccaccagcaaagtttcctgttcctctaccaccatcaccttcaatgaaggatgacgagattcttgctccatctcaggagctgagcaagcaagggtgtatcctggaggctgttattgaagcaagtgctactgaaattatcaatctcatggatagcctaaatgaatgggacagtaaagtgggcgatggtgactgtggaagcacaatgtatagaggtgcaacagctattcttgaagatatgaaaaagcgttaccctatgaatgatgcagcgggaacaataaatgaaattggggcaacaatccgaagggtgatgggtggaacaagtggaatcttgtatgccatactctgcaaggctgcgtatgcaagcttaaagcagagctcaactgtcactgcgaataaatgggctgatgctttagaggcctccattgctgctgttagcaaatatggtggtgccagcgcaggataccgcacaatgttggatgccctaattcctgcttctgctgttctgaaacagagacttgaggctggggatgatcccgtgactgctttcatcgcgtcttctgaagcagcatcagctggcgctgaatccaccaaacaaatgcaagcgaaggctggacggtcatcatacatcgctccagatctcctggcctcaatccctgatcctggtgcaatggctgcagctgcatggtacagagctgctgcccttgcagtgaagaacaaagtgcacggttcaaagagctagtagcatacgcaatgcttcattgctagacccaaaatagactgacaggaaaaatcactggggcattttctcactccccttagatttggtttccgcttgtgcttttgcatgggccgagaaaaaaaatgacttccatattgtctcacccttctcacatcatacaaagagatgttcaaagagttcgtcgtccgtacaagttaagggaagctatgcttttgcactgccgtgatatctcagcatgctgtcagtgttggaatgaccattgtttaatttgcccgagtttcgttttaatggctgagcccatgctggcaggggggggaaagatcgttggttattctgcccgaggtcccgtttcaattgtgcgcaattcggtaggatgtttaac

SEQ ID NO: 9985 - DNA, 2243 bp, Zea mays
ttacgtttaatttttttattataagtttgatcaactgatcttattcaaaagaattataattattaatttttattgtgatattgtttagcatataatattgactttatttttaaaaaaattatgaaaaaattgaataaaataagtcagttaaactttataaaaagtaaatgaattataaattaagacagagaaaatatgtatttttaatgcatatcgtctacctgtgctaacccgcgcgcgcaacaaaaccacactgccgtgctgcaaccgtcgctggccactagcccacgttcccagcagccctccctttcctttccaatcccgttcgggccgaagcaatccctctctgcattaacagcaaggagcgctgcaactcgccacttgcagtttcgacttttcgagatctgcgccgctgttgctgtccccactcggcctcccctctctctccccttcttccagacccttcccttcttccgctcacccacgcggacgccggctgcccccttccctgactgaccccctcgaggcccctcgatacgatacttcgggtgtaggggagcatgcggaagaaagggcgggcggtgccggagtggctcaacagcccaatttggtccgctaccccgcccgcgcccgcccagccggacccctacggcgccgacctcgctccgccgccacccccaaagccgccgccgccgccagctactgcctctcccgtaccgccgccgccgtcgtacgagcaggccgtaggggtgggtggtggccggagggaggaggaggacgacgagggcgccggggcggtgatacgggcacacctgctctcggacttcaaggccgcgctatcgaagaaggtggtgaacatgggagagctgcggcgcttagcctgcctcggcgtccccgacggcggtactggtgtccgacccgtcgtctggaagtcagaaaaactacgaatgattgaggaaacaaagctgtcaagaaagaaagacacaagtattgagaggattggctttctttcgagattcgaagttactaatgaagagcatcctttaagctctggtaaatctagcctgtggaaccaatattttcagagttactagaacagatagaccgagatgtaaagcgaacacatcctgatatttcatttttctcatcaaagtctaaccaggaatccctgaggagaattttaattatattttcaaaattgaaccccagtataagatatgtgcaagggatgaatgaagttttggcacctttattttatgtattcaagaatgaccctgacccaagcaactcagcgtcagctgaagcagacgcatacttttgctttgtcgaattgttgagtggctttagagacaactattgcaagcatcttgacaatagcagcgtgggtattcgatctacactttcaaaattatcacaactcttgaagcgacatgatgaggaactatggcgtcacatggaggtcaccacaaaggtttacccacaatattatgcctttagatggatcacactgttgttgacgatggagttcagctttaacgtgtgtatacatatctgggatgctatcttgggtgatccagaaggcccatcggtacattaccccccctggaataaatttgtggacatcttacagtgctaaaccgttgcatattctaatgcaggacccattgatgaggatatgctgtgccatgctcatcctagtccgaaagcgtctcttagctggagacttccccgccaatgtccagctgctgcaacattacccagcccccaacatcgatcccctcctccacatcgccaaccggttgagaggaactgtagccggctagtgttttgttgcctttcctgcatacctgtacttcagttttgcccatgtgaccttcgtctggttaagtcgctaaatgcaatgttggtagcttgaaatatcactctgctccttgtgttctgttttgcctgtttcggtgtggccggagccggacgatgaatatcggagacacttcatgtgtcacagctctgagtagcgcttctgttttcattcacatggaaacacactattggagctccttccagcttgtagtacctgggaaagggaagaatggatgcattcctgaattgtgaaaactgaatatgggttctgctggatacgctcctctgtacccaaagtcatatcctttgtagtgtactcttttaatgctttatgaattagagtatgtagaatgacttttgcaagaaaaaaaaaaaaaaaaaaa

SEQ ID NO: 9986 - DNA, 7657 bp, Zea mays
tgttgacctttatgagatcagattggccagcagagtggttggtgtgactgatgtagatatagagcttgtttgttttgacttttgggcagattttagtcgttagaatagtcttctagtagttaaacgtttagcttgtcattgcgcttctgttaaagaatgcttaaatcaatgtgaatacagaatccactgagacgttataatagaagaaatccgtcgctccctaaaccgtaaaatgtgtagacttctccatcttcctcacaaacaagctacacgatatctagattctcgtaacagctagattatctaaaaaatctatattctcagaaaagttcttaaaaaattgtctcaaacaaaccctatatactggctcattacatattatattacgttacattacgagctcgtaaccttcaatgatataattttcatgcctggaaccgatatatgcaaattagtagtcgcaaagttagttaatataataacacgtctccacaaagtttgacattgtagttatcaccgaaacttatgagcatcacaaataatcagctatatagcggagaacaacacggcgggtctggtgacatcagaaaataaatcaacaattcacggtctcctgctagattggattggatatcgaccgttatcttttgattcagcttggagccaaatgtgttttccacgtctccagatcgacaatctgagcctagaaaattctagatcggtgggggaaggaaactatccccacgcgcagactcatcaaacaggccaatgacatcataaaagttatgagcctcgaacacaaaaaaaaaatagcgcgtccgtgaagccccagcgcctagccatctcatcggaccccaaaataggcgccgcccgcccaggccatgggaccccaccgcccccgtctctcaattcaatcaatcccgggccgcccgtccgccgcggctaccactcgcccctcctcgtcaccagcggcggcaccatctgctccgccaccgcgttcacgcgctcccgtcgctgtcggccccgctcctctatttatataccgccccatcccagctccacgctttccctaggcaggcgcgcatccagctcctgccttgcttcctctcctcccggttcccgaataaaatttcctggacccggagcgcgcagcgcgctcccccgcctcccaaggaaacttatctagcattccggcggtcgatccatcttcccgtccagggagagcaaggaataatcaatcaaccggccagtgaaacgttaggaggaggagagccggagtccgtccagcgcggcgcgggttgatcccttgcgtctccgcccctgccccgcgccggcgacacctttttgcggtgcttgcgttgcgtcgaggagggacaggcgcgctgcgtccttcgcacggcaacggcaagacggcggcgttgaagatgcgggtgttggaggaggacctcttcccctccaccccaggcaaggtgaagatcgagcgggcgggcgccatgaaccggcagctccaccgctgcttcgcgtccaccagcaccatgttcctgtgggcgctgttcctcgtcgccatgacggcgtcctacctcagcttccagtccttcgtcgacacctcctccaagtacttggccgcctcctggggcggcctgcactgggagcggcagatccgtgcgtccgccgcgccgaggcggccccccgggtccgccgccggggccgggatgtcggtgctggtcacgggcgccgcgggcttcgtcggcacccactgctccctcgcgctccgcaagcgtggcgacggcgtcgtcggcgtcgacaacttcaacgcctactacgacccgtcgctcaagaaggcgcgcagggcgctgctggcctcccacggggtgttcgtcgtcgagggcgacatcaacgacggccgcctcctggccaagctcttcgacgtcgtgccattcacccacgtgctccacctcgccgctcaggccggcgtgcgctacgccatgcagaacccggcgtcgtacgtgcactccaacatcgcggggctcgtcacgctcctcgaggcctgcaaggacgccgacccgcaaccggccatcgtctgggcctcctcctcctccgtctacggcctcaacgacaaggtccccttctccgagcgcgaccgcaccgaccagccggcctcgctctacgcggccaccaagaaggccggcgaggagatcacgcacacgtacaaccatatctacggcctatccatcaccggcctccgcttcttcaccgtgtacgggccctggggccgccccgacatggcctacttctccttcacccgcaacatcctgcaggggaaacccatcacggtgtaccgcggcaaggaccgcgtcgacctggcccgcgacttcacctacatcgacgacattgtcaagggctgcctcggctccctggacacggccggcaagagcaccggcaccggcggcaagaagcgcgggccggcgccctacaggatcttcaacctcggcaacaccgcgcccgtcacggtgcctaacctggtgtccatcctggagaagcacctccgcgtcaaggccaagaagaacgtggtcgagatgcccggcaatggcgacgtgcccttcacccacgccaacatcaccctcgccaggcagcagctcgggtacaagcccaccaccaacctcgatgtcggcctcaagaagttcgtcaagtggtaccagtcctactacggctacaccaggggatccaagaactcgcgacaatgatccatgctaattcttccttcttcctttctcgctttggcccggccgcggccacccactctcggatcaaacattgacattcttatcaggatttttttggtggaaatatgttatgttagggtgttcctttattaagtagagaaataccggggacaaattctttgcttggtgaggagatgggaggagagtgctggaggaagaaaagcaatcgagggctggaggaagaaaagcaatggggagcaacctttactttttctcttttctcctcctgtgtctttcttctctctgtaaattggtcggcgctctacaggatcttaatccttttccgctccatcaatccttttccggattccgatgtgctgaccctaatcaaactgtggtagtcaagtcagattatccccagttcaaattgaattccagagtaacagccggactgccggagacgagagagaagaaatcggctggccggtcgtggcagtcctgtaaatagaccgcgggaacgttatcgcggagataaaaagcggccagcggacgtgggtgccagaggtgcctcgaagcgcgcgaagtggtcgccagctggcttggtccctcccccactgctggtgggccatctgcagctttattgctgcgtgggaccatgtgtctgtgagcctgggtggagatgggtcggtggggtggggttcttgccccacgttgtagtagatcacatgggtgggcccggaagatgcggtggcgttcgtctctgatgagctgccgttgaggattgaactccaattttttggttattttcttgggacaagcagtatctctgccgccgtgccgcagatgcgaatgtgttctgttcgtagcgtgggttataattggaactagtaactgactcgcgcaagcgcgagcctttggtcaatactccctccgttccttaatatatgtcgtccgttagtacaaatttaaactactcgacgacaaataaaaagaaacggatggagtacataacaacaatgtatatatatatgcacacacttaaagtatatatatatatatgcaccaaagcaataaaatattagtctcagtctcaatgaaaaaaataacgcgttgcaaaaaaaaaacaatgagtgaacatatcagcttgccctagggtatatgaatttctaagtttaagtctcggtaacatgcttgaaacagttattaaaagtacaccttatcttcatctgtaacagtagttggttccaattaataaacaaataaatacatggtgttaatttcaatagtgttttttaagaagtacacacatatgttaaatatttatttctaatcttttgtaggtatgtgaaattctgaagtcgacatatataagtttgaaagcaaccgtgagcataatatcttttccattcctaaagtgcatcagtacttactatccttgccaaaaaaaccggtaccttcgtcaagcgatgcatggctgaatgatagataatggttctttaccttctcagagcgctttgatcttgtgcgatgctggattgcttcagaaaattgtaaatgccagagacaacaaactcgttgaagaatgaactgaaaaataataattatgtagaatagatacctactgcagcccgcctggtcctgaaagcagactggccaaaagaaattatcaaaggcccgatatctcacactgtaacaacatggaagatgaccataaggtcactgtagtgtagttcttcaaaagctatccccagccttgtgtttttggatccttagaactgcatgtcatgcactaaactttcttcatttggcctcctgagtcaactcggttggtccctacaaatctcaaattcagacatcattggttcagaattcattgggaccactgtattttaaccagctacttaggttccaaagcttattgaaaaaatcctgagaacattttctaagagaaatttcaacaaacagtaagagggtaaagggctagtgcactatgtttgtgagcgtatgctggtgggcggtcgacgaacatgtacctaggcacatgaatagagttggagtgagatatctgaagcacctgggtgccataggatctgtggtggcacgagcatgaaagtatgaccgcagttcatccagagatgctacttagtgccggaggagctcgacgatgtgaattgtgctttctccaagacatgggtggcagtgaggcgatatgcgaggcgagcactgaaccccaaggcaaaggtgcgcgcggggagagaggcggatggagggagccagggaggaccgtacccgcagaccacagtcgctttggtcgagcttagtctgacgacgaagacaaagcagttctgttattctttctctgcctttttcgtgcggcatctagaagactccgtcgattggaggagctgcctcatatgcgtccctgaccgttgaagcatgatcgtgtggctacaatacaatacgctggtgtggcctcaccagattgcagatttacgccctgctttaatatatagaaagaaacaagcatatctagtagggagtagttttgcagaaccatttgttaaacaaattattacatcaagttattaaaaaaataactagcgacttttattaagctagagcaaatcaaaggagtatatagttgtcttgcaggtgcatatgtttaggattgcaacagacacaatttacccgcgtatgcgtgggtaaaaaccttatagagtgcgggtttttgtatgagtttatacccgcggttactgatgcgggtttgattcttaacctgatagggtttttttctcgcgcgtaagaaaatgttatacccgttttaaacctgcgcacctgcaatagatatatatatatatatatatgtacgcatatatctgtgttatatatgtgtgcgcatatatatatatatatatatatatatatatatatatatattatatacatatctgtatatgtattatatgtgtgtataaatatatgtatatatagataatatatataaacatatgtgtctgcaggtatatctatgggtttgtgccacccgcagtaagcttgtgcgtattggtacaggcgtgggtttaaaaattctctgcccgcagattttaaactcattgccatcctttactatatgcttgtatcacgaagtttgtatttgaatagaggtttgaattgaatctacattacttgatttacttaacaatattatctgatcttttacaggatatattatttatataatgaagtttaaatatgagtacgaatatgggtaaagtgttgaaaatagtcttaatccccacgatgaactgatgatagctcaacgtgatctctgcgccctggcaccggcagataggagtaataaaaattgtgatatcagtctccggcaacgaggacgactagccatcacggccgacgcgtggaatctcgagataggacgcgtgatttttctattttctcggagaacacgaacggtccatgcaatttgtcacgagtccccggaccatttggacggcacggtggccacatctgaactggagtcacgcacgcgcagaggcggcgtgttgagataggtggtgacacctccgcgttgaaattgaaaacaataaacttggctctgtttggaggtctggaatgtttaaaactcccaggttctaccgtattttctcgttcccacacaggtttgacaagatctcactgactcggagcatctcgaaatgacatttttttcgctctctgtttgacactctttttatctctatataaatattaccaacaaactttatttataacatgtgacttcaacggattctctatttagtttgactagtacaagtggtagctaaatttagctacacgtaggatcaatttaaagagccaaataagttagcgagttagatgactaatctgctagaaagtaataatgttattgaatagtcaaaatttaacttaatgagtcattcaactattcctttggagatgctcccccactcacgtggcaaaaaaaaatctattttttcggacgatgcactccttccatgccaaatttcaggagatgttaccgcttcatttcctcactgcgtaacgtggtgaaataggagtttaaagttacgatcaagtgagacttccgtaattttagtaaaatttatactccatcatctataatttgtttgaattttatttatcaaatttgatcggctcgttttattcaaaaaaaattgcaaaaaatcaaagctgtacttaaggtatactcaccaaaataactatgaattcacagctatacttaagaagtattacatgctaaatgatatcacaataacaattaataatagttatgatttttttaagaagacaagccgattaaatttagactaaaaagtcaaatgaattataaattgagacggagagattatacgatactattaaaatttgactctaaatagttatattataaaaatattttcataactatgctaatgatattaagccaatagttttaatgctagtgtttttttaaataagtcttataaaaaattaaaaaaatgtgattattgattacacgatgtaatcctaacggccccgatgcaatcgcgcgaacgggtatcccaacttctaatctagaccgcccaggacacatcggacggtccgcacctttcttccctcacttaccaaagaagcacgacgacgtagagcatcggcgcggcggcgccatgaaccgtcgcccagatcacggaattaatgcgctaaattttgaattggtaagcgctacatgataccctactctagacgaacacgagtaatggatacttacccctccaggcagtgcggacagacgtggcgacgacgggtggcaattttgtagctccgatgaggttgatgaaagggaaatgtgcccttgggccattctaagtgttttagtgatttagtgtccaacacga

SEQ ID NO: 9987 - DNA, 3008 bp, Zea mays
cattgggtacctcgaagccggccgggagcgcgtccggccgttcgcccagcgcccatccatctcatcccagcgcgtccgaccaccaaaataggcgccgcccgccgcccggacccgatcgcctcccaatcccgggccgccgtgcgcccgtccgccgcggccacctccctggcctcctcgtcacctgcggcggcaccctctgcgccgccaccgcgttcacgcgctcccgtcgctgtcggccccgctcccctatttatatccccgccccgtcgctgtcggcaggcgcgcatcaagctcctgcccccctttcctcttcatcctctcctccctcgcggcgcgcacgctctccgccctcccaagtcccaaggaaacctatccaccattccggcggtcgatacatccatccgtccagggagagcaaggaataatcaatcaatcggccagcgaatcagtcgaagggaggaggagagccggagtccgaccagcgcggcgcgggttggtggtcccttgcgtctccggctctgccccgcggcgccgtcttttgtggttcttgcgttgcgtcgaggaagcagaatccgcgacgaggagaaggagggagaggcgttcatcgggttgcgctgcgtctgtcgcacggcaagacggcggcgttgaagatgcgggtgctggaggaggacctcttcccctccaccccgggcaaggtgaagatcgagcgggcgggcgccatgaaccggcagctccaccgctgcttcgcgtccaccagcaccatgttcctgtgggcgctgttcctcgtcgccatgacggcgtcctacctcagcttccagtccttcgtcgacacctcctccaagtacttcgccgcctcctggggcggcctgcactgggagcggcagatccgcgcgtccgccgtgccgaggcggccccccgggtccgccgccggggccgggatgtcggtgctcgtcacgggcgccgcgggcttcgtgggcacccactgctccctcgccctccgcaggcgcggcgacggcgtggtcggcgtcgacaacttcaacgcctactacgacccgtcgctgaagaaggcgcgcagggcgctgctcgcctcccacggggtgttcgtcgtcgagggcgacatcaacgacggccgcctcctggccaagctcttcgatgtcgtgcccttcacccacgtgctccacctcgccgcgcaggccggcgtgcgctacgccatggagaacccggcgtcgtacgtgcactccaacgtcgccggcctcgtcacgctcctcgaggcctgcaaggacgccgacccgcagccggccatcgtctgggcctcctcctcctccgtctacggcctcaacgacaaggtccccttctcggagcgcgaccgcaccgaccagccggcctcactctacgcggccaccaagaaggccggcgaggagatcacgcacacgtacaaccacatctacggactctccatcaccggcctccgcttcttcaccgtgtacgggccctggggccgccccgacatggcctacttctccttcacccgcaacatccttcaggggaagcccatcacggtttaccgcggcaaggaccacgtggacctggcccgcgacttcacctacatcgacgatattgtcaagggctgcctcgcctccctggaaacggccggcaagagcaccggcaccggcggcaagaagcgcgggccggcgccctacaggatcttcaacctcggcaacacctctcccgttacggtgcccaacctggtgtccatcctggagaagcacctccgcgtcaaggccaagaagaacgtggtcgagatgcccggcaacggcgacgtgcccttcacgcacgccaacatctccctagccagggagcagctcgggtacaaacccaccaccaacctggacgtcggcctcaagaagtttgtcaagtggtacctgtcctattacggctacaccaggggaggatccaagaactcgcgacattgatccgtgctaattctttctccttttcctgctttggcccggccgtggccaccatgctaggtcggacattgacattggattttgttggttggtggaaatatgttatgttaggatgttcgtcgaagaaaaatccttcgcttggtgtggagaggtctggaggaagaaagcaatggagagcagtcttttttttttcctttttccttcctccgtcttctttctctctgtgtaaattggccgttctccattaatcaaactgcaattctaaagtcgcgctgttcattgcgccgtcagactgtcagagtaaccgccggagacgagggagaagaaatcggcggtccggtccggtccggtcgtggcagtcctcgtgcaaatagcccgcggcaacgtgggcctcgccgtcgtggataagataagcggcctgcgactgccagcgtggtggcgtgaggtacctcgaaccgcgcgaagtggtcgccagctggctcccgcctcgctcggtccctctgcactgccggtgggccatctgcagctttgttgctccgtgggacccatatgtctgttgagtctgaatggagatgggtcatgttcatgcctgtggggttcataccccacgtaatggtagctcacatgggtggggccgtcagacgcggttgcgtgggccttcgtctctgagctgccatagaggatagtacgaactgcaattcttttatatatcaaactggatgcgaatgtgcattgtgcttgatcaggattctattcctagcgtggctccagatgccgccactgcgtgcatagtacgaagtagttttacatttcgtcttttattttaaaattcacaccgtaaacagtgtgtttaactatacgagtaaactgatggatatgtctacactgttgacaatattgttttagagcgtatttgattctaggactaagattgagctcatgtgcattaaatatttgaatctctattacgagtattagaaatatggtataattataaaattaattacaaacggctagacaaaaaaagtaaacataatt

SEQ ID NO: 9988 - DNA, 2198 bp, Zea mays
ccttcagatatatttgggatggagtaaacaataacatcagttatccaaataaaaaaaatattatacggagagcagaaacaatcaataaaaaatcttaagatttttttggtggatagtttacatggatattgttgtaagccgttgcaatgcacgggcaaccgactagtgttttattatagagtcgatagatagacgatgcatgggaagtgtttccaatacgataatcccattttctaaaagatgaatgagaggctagaattgtctataggtgggacttaggtcagtgacagatagaactgccatcttcgcaaatggatcctagccctctgttggggtagcgtgccccgcgtccatcgcacgcggagccggaaagataacggcagctggacagatggagccgctggctgatccacacgacgcggccagatcccatctcggccgtccgtccaacggcggcccggctattcgagcgcccgcccggccgcgcacgcgcgggcacttgttcggaaccctgcctggtccaagcgagtagcgattagcctgtcgttttctgcttcttgatatttcttcttttcttcaattttttctatggttgcgttccgttgttgctgcagttttttgagattcctggtatagtaatgagattcctgatatggtaatgcgattattttacattttctggttaggatcttgctgacgtgagaattgagatcgatctgaaaggcttgattgtgccttccctacatcaatccatcttgaagtctcttggaaattccccaaaagctaaaaagaacctgtttggtggttgcattgtttgctttggtaattcaactttgcttttgcttgtttcttctttattccgtgccaatgatgattcactttcaaggtgaattctttgatggttgcattgttggctttggtaattcaactttgcttttgcttgtttcttctttattccgtgccaatgatgattcactttcaaggtgaattctttgattgttttgtgatgttcttgaggcgttcaactgaggcacgaccgaatcgaaatttaattactgctttgtagttcatcaaaatcttggctttaattcagtagtagaaaattgaactttgaaactttgtattcgtgtcaaatctttttttatgttactcatctcaagtgtacttcggacgcgacctcgcggatgactttatttgctggttcacagctacggtgatatgcatttgaggtgtacacctgaggcacgtcgcacgcttgaagaagcctatgcacttgttctttctgatccttaagtttgaaggttcattcgtttggtctttcgaatggttcttattgcatcagcagctaatttcttgcatgaaaatagcgatttgcttaggttaccctgcacctactttcaacaaatatgtcatgttttttctcattcatttgtgatttgcctccaacgtcctcatgagtttgatcagtacaatatcatgcattttcttaatcaagtgtatggtttggaaaaaaagatgcgttgaagtatcaatgccaattagaataaactagtgctaacttagtcatgctaaaataactagcatgaaccacggaaggaggaaataactggattcgtgtggctgcatgtatgtatgttaatttggactttagacataatatagcattagtttgtatggggtgtgggttttatctatctcgatctggtcttaataaattaagattttctctcagttcggattccatctctgtttgtatcctttgtaaataaagtaccttaattttgtagtgaaaacttttataagaaaactacagcggtggttaccttggcgaagtgaagggtggtggttggaactttggtgaccaaaaaatatgtaaagtggtggacagagatataaagtggtggaaagcattggaatatgatactttggtttgttttgcaaaatttcattgttaagagaattttggtttgtttttctattgataaatggcttgccttttacatcgtagttccatgtttttagctctatttttaagctacataagtgtagctctataagttctattctagaaaaaagagtttttagagcatttaaaaggatgttatgtaacaagagcccaggatcgtattttgaaatatatgataacaaaatcctattataaaatatatatgactaacaaaaaccgtttcaacatgggc

SEQ ID NO: 9989 - DNA, 3991 bp, Zea mays
cgaagctgtctgtgcagtgtgcacatccgtctcacgtcacttgaagagtcgtgggagctcctgccccttccagaagcttccgcactcgtcgccagaccgggctcgtcgcctccaggcctcctctatccagacgcttctcacttccccttttgtctcctcccgtctcctcccccgtaccaaacaaacctcaccgagtcgcaactcgcaaggacagtgaaaacgcccaaacgagcgcgggcacgccaaccaaagcggcgaagcgcgaaggaaggaaggaaggaagcaagcaaagcagcagccatggggcttgactactacaagatcctgggcgtcgacaagggcgccaccgacgacgacctcaagaaggcctaccgcaagctcgccatgaagtggcaccccgacaagaaccccaataacaagaaggaggccgagaacaagttcaagcagatctcggaggcatacgatgtaagtgtgcgtgcgtccggagaaatccatgccggactcactgcccaatcgagcgaatgtcgtgacccgctcttgctctatgttgtcgccgtgcaggtcctcagcgacccgcagaagcgcgcggtgtacgaccagtacggcgaggaggggctcaaggggcaggtgccgccgccgggcgccggcggggcgggctcaaccttcttctccaccggcggcgacgggccgacggtgttccggtttaacccgcgcaacgcggatgacatcttcgccgagttcttcggcggctccagccccttcggcggcatgggcgggagtgggatgcccggcatgcgggccggcgggtcgaggttctcctcgtccattttcggggacgatatgttcggctctgcgttcggcggcggcggcccggacgggcacggcatgcacaccggcggacgtgccgtgaaggcgccggccatcgagcggaagctgccgtgcagcctggaggagctgtacaagggcaccaccaagaagatgaagatttccagggaaattgctgacgccagtgggtaagtgcctgctctctcttctcatctcggtcccagcatcgtttatttactgttcttagttaatagtatttgaaattgaaccggcgacgccttaaaattgcttgagctaactggatgaagtgatccctgccagatttatgcttggttaatttctgctgttgaattcaagctgaacttgcatcaatgtgtagctcactcgcctcgaggctcggccgggtatttggcactttgggtgcgccaacttgtttggctcgtgagctagctccagaacccattaaaaaaagagagctgagctccatttgcagcttgtgtactgaccactgctaccctgtgtgtgtgcaggaagacgatgccagtggaagagatcctaacgatcgacgtgaagcccgggtggaagaagggcaccaagatcacgttcccggagaagggcaatgagacgccccacacgatcccggcggacctcgtcttcatcatcgacgagaagccgcacccggtgttcacccgcgacggcaacgacctggtggtgacccagaaggtcccgctggcggaggctctgacggggcacaccgcgcgcctgacgacgttggacgggcgcatcctgacggtgcccatcagctccgtgatccacccggggtacgaggaggtggtgcgcggcgagggcatgcccgtccccaaggacccgtccaggaagggcaacctccggataaagttcgacatcaagttcccggcgaggctctcggcggaccagaagtccggcgtcaagaggctgctcgggcagtagagcgcctcgtgttctggtgtgctgtgtgtcagacattttcgtgttggttgatcttgaactgggggatgctgccatttgcagcgtccgtgacgacgacgacgaggaggcaggccaccgagcgctgagtacagaacaagctagtggtggtatatggttgagaccttgagatgcacagcataggattccttgtgcaatcttccagacgggtggtgcttgtctgttcaccggtccatgtcgttccagccttgcaaaggtcggatggaataattattgagcacatacacgtacgttctttgtatttagtgtgagaaatagttattgcaatagcaattgtactccctccataaaaaaaaactctccttcccctaaaatatacttctttcgaggtcactgtttttatttccacattcaaataataatgaatatagtttatttccacatttatttaaatgataatgtaaactaccggcctacagtttacattcatacgttacttcgttcgttacttcatatgttacttcatgaacgtgcaattagttacttaataaatgtataattagttttaaacgagttatatttagaattatatttttataacttatgaaaagctatactgaaaagaaaatctagaccggatcttaggttctcttgctcttgcagatcatcgtgtaaaacactgtcctgcaggtgatcgtgcactgttagactacactggtggatttgaacatcgttcgttcatgtgcgccagaccgccatcaccttgatctgaaggtttatgcagctgtgctgcgcttggaccaaggaactgctggaacccgagagatctcaccatcccaaaaatgttgactcataataacatccgcacatccatctttttctcacagctcagattatcctatatgagtaatttatgtgaaaattcaggtcccatttggaacatatagatttcaccggaatcagttcatttttacaggaaactttccgacattccaaagggagccgtctacaggcgtctgagcagttgaccaagcaagaaagtagtagcaaccaacaaattatcgtatcgttttatattccaatcatgcgtgtgcaagtccacgagaaaattacaagcatgtgtccattaaaaggcaggacatatgccaggatcactttaactaatctaaacagacttatttcatctcgatcctccaactggtaaaaataagctggtggatatgcaatcctggctgataaaaaaagacgccagaggaaatacctgaagatttccgacgataataaagcacataccgagatatatcacacaaacacctcatgagtaataagtaagcgtgacggctgcatttgtcgttcttacctatccagaccatgcatgaggagctacaccatggctaacagagctcaacctatcatgcagggggttatggtctgcaggctggcctgcagccaccatacggagtgcaagaccctcaacctgatccttcgagtaacccatccgagtaaccttttcagcaatgtctatcggatggttcagcactgactggggtcccaagtgatgaagcaccatgggagaactgccatgtgcttgttgattaaggacagcaacaatagtagcaggattgctggaagggcttccataagcagggctataggtctgtgcattcccttgtaccgtatatgacgctagaccgcatggactaactttgcttggcggaggtacaaatgagccattgccgagtgaatgaagctgctgatgctgctccgccagtggaacagaaactgtgttgctttgtacataaacaggagcagcttcatgatgcttccggtgggatgaagaaattgtagagtatgaaggtggcacaactatgcccccactgcgtgcctcagcattaccacaggcagactgatgaggcccgtatggaggatatactactgtgacctgtggtgtactatgagcatgtggagaggacgtttgcagctgaaccatctgtgctggaccttgctggatgttgctgtactgctgctgtagtacatgtggttgtggttgccttgcctgtgagaaaacctgctggccgggctgatgtggccattggtgctgcggatgagggtagaactctggtgcctgactggttacctgagatacctcaactactgtcggtggctgagttttccgagtgtgtgtctgcaggcatgcaag

SEQ ID NO: 9990 - DNA, 1726 bp, Zea mays
gtttcctgcgccttccagaagcttccacacccgtctccagaccggtctcgtcggctcggcgcttcgtctatccagacgcttctctcatccccttttctctcccctcctctcctcccgtctcctaccccgaaccaaccaaacctcaccgaatcgcaacgacagcgagaacgtccaaacgagcgcgagtctccggcgataaccaagagcgcgggcacgcaaagcggcgaagcgggaaggaagcagtaacgatggggcttgactattacaagatcctaggcgtcgacaagggcgccaccgatgacgacctcaagaaggcctaccgcaagctcgccatgaaatggcaccccgacaagaaccccaacaacaagaaggaggccgagaacaagttcaagcagatctcggaggcgtacgaggtgctgagcgacccgcagaagcgcgcggtgtacgaccagtacggcgaggagggtctcaaggggcaggtgccgccgccgggcgccggcggggcgggccccggcggcgcaaccttcttctccaccggcggcgacgggccgacggtgttccggttcaacccgcgcaacgcggaggacatcttcgccgagttcttcggcggctccagccccttcggcggtatgggcggcggtggcatgggcggcagcggcatggggggtgggatgcccggcatgcggagcggcgggacgaggttctcctcctccatcttcggggacgacatattcggctctgcgttcggcagcggcccggacgggcacggcatgcacgccggcgggcgggccgtgaaggcgccggccatagagcggaagctgccgtgcagcctcgaggagctgtacaagggcaccaccaagaagatgaagatctccagggaaatctctgacgccagtgggaagacgatcccagtggaagagatcctaacgatcgacgtgaagccggggtggaagaagggcaccaagatcacgttcccggagaagggcaacgagacgcccaacacgatcccggcggacctcgtcttcatcatcgacgagaagccgcacccggtgttcacccgcgacggcaacgacctggtggtgacccagaagatcccgctggcggaggccctgacggggtacaccgcgcacgtgacgacgctggacgggcgcagcctgacggtgcccatcagctccgtgatccacccgggctacgaggaggtggtgcgaggggagggcatgccgatacccaaggacccgtccaggaagggcaacctccggatcaagttcgacatcaagttcccggcgaggctcacggcggaccagaagtccggcgtcaagaggctgctcgggcagtagaacgcgcttgtgttgttttggagtattgtgtatcagacattttcgtgttggttcatcttgaactggggtggagggagctgccatttgcagcctccgcaacgacgacgatgacgaggccaccaagtgttgagtacagaacagctactattgtacggtgtatggttgagaaacttgagatgtgtagcggaggattccttgtgcgaacttccagatcgtggtggttgtctgttcactggtccacgtcgttgcatttgcaacttgcaaggatcgcggatggagtaactgttggccacgaacaaaaaaaaaaaaagtattcgttattgtaacaaatagtcattgcaaacgatagttgtactccgtaaaaaagaataaagctcaaggtttaagag

SEQ ID NO: 9991 - DNA, 2417 bp, Zea mays
ctgcagcgtgccgcgatccaagccgaaggacatcgcttatgagcgaggtggaaggagaattggtcggcaatcgattatcacgactccacaattatcaaacaagaatcccagtccatagaaactgctggaacccgagagatatctcagccatcccaaattcccaactcataatatcacccgcataaagaagcaagagaaactgattggcagctattctttaggagatggtttcaactttcatggggccaacagggaaagatgggaggacattggcagacattgtgaaaactttgactttaaagactaccgtgatgtagtgctttggaaatgcggcgaacaacaatctgtcatatgggaagctaggccctgactggaagctcatttggaaacgcaaaatttctccaaaaactgaagtgtttatgtggttagtgagcaataaggccattttaactaaagataatttgctcaagaaaaactggacagggagggattcctcctgtagtttctgtccccaagtcgaaacagttgatcaccttttctttacatgctctgttgctaaagtgatatggggagtggtggccaagtgcctcgacacaccttatgtgcctggggaacttagatcattgtattgtgtggttacagagatatctcaaaattgacaagtctactcgtgtagttctaattgccgttacttgttgggccatatggaagaccagaaacaaaatgagcttcgaaaaaatcttaatcaaatcacctaatgtgattatttgccatgctggtgctttgattttgtgttgggcaggactcagcaaaaagatttgcaggatctttaggagggtgctaaacttcttgtccgggctgcaagtggaaggcagatcacgggcaccaatgataaagttgatgatgcggagtaatcctggcttccagctgcgacaacgtcgtctctctgttttgtgtgctactgctttctggtgttatctctctgggtttcagcccctttgtgactgtagtatgtagacttcatcgcccagtctaggtggatgcttgattgatgtgttgtcgcacttgttgtggtctgatggttgtgatgcctcaatcaggtactccaccatgatgtaataatgggttctgaacttggccaccatgctgttatgcgctgaaaacctttctgtaaacatgttgtatttctattatgcaagtaatagagttgggggtatccctctcataaaaaatataatatcatccgctcaaactcgcaatccaattgaatttatttcaaaaacaagtcaacttaacttcgcatccatctttctcccacacttcaactggcgccggagcagatggaacgagctcaacacttcaccacagcaaagtagcagcaaccaacaaatcatcgtatctttttatattgcaagcatgcgtgtgcaagtcacaaacaggttacaatcacatatgtccattaaaaggcaggacatatgccagcatcatttcaactaatctaatcagtcttatttcatcttgaccatccagctgcaaaaaataagctggtggatatgtagtcctggcagataagaagacggcagaggaaatacctgaagatttccaacgataatgaggtacattatcacacgagcatctcatgactaattcattcttaactatccagaccatgcctgaggagccaccgcatgggtgacagagctcaacctatcgtgcagggtgttacattctgcaggctggcctgcatccaccatacggagcgcaaggccatcaactacttgatcctttgggtaacccattcgagcaaccttatcagcaatgcctatcggatggttctgcactgactgagatggtcccaggtgatgaagcaccatgggagcactgcaatgtgcttgttgattaaggacagcaacaatagtagcaggattgctggaagggcttccgtaagcagggctgtaggcctgtgcattcccttgtaccgtatatgatgctacaccgcatggactaactttgcttggctgaggtacaaatgagccattgccaagtgaatgaagctgctggtgctgctccgtcaatggaacagaaactgtgttgctttgtacgtaaataggagcagcttcatgatgcttccgctgggatgaggaccttgtagagtatgaaggtggcaagacaatgctcccagtgcgtgcctcagcgcccccgcgtccgcgctcgcgtgcgccgtatggaggatatactagtgtgatctgtggcgtgctatgagcatgtggagaggatgtttgcggctggaccatctgtgatggaccttgctggatattgctgtactgctgctgttgttgaaccacctgtggttgtggttgccttgcctgggactgaagctgctgaccagtttgatgttgccattgatgctgcggttg

SEQ ID NO: 9992 - DNA, 1330 bp, Zea mays
cagtccgggctcgtcgcctccaggcctcctctatccagacgctcctcgctgccccttttgtctcctcccgtctcctcccccgtaccaaacaaacctcaccgagtcgcaactcgcaaggacagtgaaaacgcccaaacgagcgcgggcacgccaaccaaagcggcgaagcgcgaaggaaggaaggaaggaagcaagcaaagcagcagccatggggcttgactactacaagatcctgggcgtcgacaagggcgccaccgacgacgacctcaagaaggcctaccgcaagctcgccatgaagtggcaccccgacaagaaccccaataacaagaaggaggccgagaacaagttcaagcagatctcggaggcatacgatgtcctcagcgacccgcagaagcgcgcggtgtacgaccagtacggcgaggaggggctcaaggggcaggtgccgccgccgggcgccggcggggcgggctcaaccttcttctccaccggcggcgacgggccgacggtgttccggtttaacccgcgcaacgcggatgacatcttcgccgagttcttcggcggctccagccccttcggcggcatgggcgggagtgggatgcccggcatgcgggccggcgggtcgaggttctcctcgtccattttcggggacgatatgttcggctctgcgttcggcggcggcggcccggacgggcacggcatgcacaccggcggacgtgccgtgaaggcgccggccatcgagcggaagctgccgtgcagcctggaggagctgtacaagggcaccaccaagaagatgaagatttccagggaaattgctgacgccagtgggaagacgatgccagtggaagagatcctaacgatcgacgtgaagcccgggtggaagaagggcaccaagatcacgttcccggagaagggcaatgagacgccccacacgatcccggcggacctcgtcttcatcatcgacgagaagccgcacccggtgttcacccgcgacggcaacgacctggtggtgacccagaaggtcccgctggcggaggctctgacggggcacaccgcgcgcctgacgacgttggacgggcgcatcctgacggtgcccatcagctccgtgatccacccggggtacgaggaggtggtgcgcggcgagggcatgcccgtccccaaggacccgtccaggaagggcaacctccggataaagttcgacatcaagttcccggcgaggctctcggcggaccagaagtccggcgtcaagaggctgctcgggcagtagagcgcctcgtgttctggtgtgctgtgtgtcagacattttcgtgttggttgatcttgaactggggga

SEQ ID NO: 9993 - DNA, 3026 bp, Zea mays
gcacgagaccattacctagatcctaatcgaaaaattccccccttatgcttctcacccgtcacccctcgccgtctccggcgagacccggaaatggatgtcgctgccaccccctcaaggtcaaaatctaagcccagatcctcgctggtgaatcccgtcgcagcccccgccgagtccaggatggacctctgcaccccatcgaagcccacgcccaggcggaactccaaatcgacggcctcgccggcgccaatgtctccgtcgacgccctacaccgtccggcgctcgcgccgcctcctcgaaacccccaccaaagccgccctggaggtgcaggtgaaggctacgctgacccctacctccaagggcaagcgcgccgcgccgtcacctaaaacccctgctcagcacgagcccaagaggcagaaacgacacccgaggaagagggcatactaccggaaggtggtgtatgacggcggggagttcgaggtcggtgatgacgtgtacgtgaagcggcgggaggcggcggagtctgacgcggaggaccccgaggaggaagagtgccgcgtatgcttccgcaccggtggcggggttatggtggagtgcgacgcgtgcctcggcggatttcacctgcgttgcgtgcgaccgccgcttcggagggtgcctgaaggtgactgggcatgtccatactgcgaggccgagcgcgccggaaaggtggtcgagcggcccaggccgcctgagggcaagcgcatcgtgaggactgccaaggagaaactcctttccagcgatctgtgggctgcacgcatcgagagtttatggagggagcctgatggcaccttctgggcaaaggtcaggtggtacattatccccgaagagactgcagcaggaaggcagctgcataacttgagaagagagctgtatcgtaccaatgatcttgcagacattgagatggaaacaatccttagacattgttctataatgtgccccaaagactttagggatgctaacgatggaggagatgatgtattttactgtgaatatgagtatgatattcattggcataattttaagcgtttggcagatattggtgatgaacccgagacaaaggaagatcccagtgacgagccttacaatgccagtgatgattataacagtgacactgatgaagattcagagtatgacgaggtggaagaacctacatcatctttctctgccagagggaatcaatcacatgaattggcagcgaattcaaggaagggtagaatatatggcctacaaaaaattggaatacgaaaaattcctgagcatgttcggtgccaccaaaagactgagctggagaaggctaaagcaaccctgttattggcaactctccctaagtcattaccttgcagggataaagaaatggaggagatatcgatatttgtaaaggatgcaatctgcaatgaccagtgcctaggacggtgcctttatatacatggtgtacctggtactggcaagactatgagtgtacttgctgttatgaggaggctgagatctgaatttgattctggaacactgaggccatattgttttattgaaattaatggtcttaaattagcatccccagagaatatctacaaggttgtatatgagcagttgagtgggcatagggttgggtggaaaaaggctcttcactatttaacagaacatttttcaggtggcactaaaattggaaagcaagcaaaccagccaattattttgctgatcgatgagctcgatcttcttttgacaagaaaccagtcggtgctgtataacatccttgattggcccaccaaaccatattcaaatctagttgtcataggtatagcaaacacaatggatctccagaaaaattattgcctcgtatatcaagtcggatgggcattcaacgactgtgttttggtccatacaattatcggcaactacaggaaattataacaagccgtttaaaggggattgatgcctttgaagaacaagctattgaatttgcttctagaaaggtagctgctatgtcaggtgatgctaggcgagctttagagatttgtagacgagcagcagagtttgcagactaccgtgttaaacagtctcgacagtctgcacagaatactgtttctgcaaataaaggtgatggtgttgtttccatgggtgacatagaagctgctattcaggaagtcttccaggcaccgcatattcaagtgatgaagaattgtccaaagtttggaaaagttatcttggttgccatagttcatgagctgtacaaaagtggactaggtgaaataatgtttgataagttagcaacaacagttttctcctggtgccgtgcccacagagaactattgcctggatacgacactctcttgaaaatttgctgcaagcttggtgaaagcaagatcatcctctgtgaagagggtaccaagcacaagttgcagaaggtgcagctcaactatccaagtgatgatgtgacatttgccctcaaggaatctccagatcttccttggctatctaagtacttgtgaggctcttattgcattaaccattgattcctggcactctgttgcctttctgttctctttggaggctagacaattctacttcacccgcaaacctttcaaacacacatatcccatggtcgatctcctggtcactctagcctcgtatctgcaaaggaaccggcgaaggatgacggcatgtcgctgcacccaacggaacgcgtcacactaggaacgtaaaacgttagaaacatgtacgtctggaatttcgtccccttcatgactggatacgtatgtatccacttcaacccatgtagtttggagtggtttggtatgtattttaaactaaactctatattaaaccactctaatccatatcgattgaggtgaatatgcatgcgtccatatgttgtaactgaactgccgcgtagtgagatttagtaactatatatgaatggtttgttacaataacattgcgagttttgaataagaaacattgagatatcaatttgcaaaaaaaaaaaaaaaaaa

SEQ ID NO: 9994 - DNA, 1520 bp, Zea mays
caatatttgtaaaggatgcaatctgcaacaaccaatgcctaggacgctgcctttatatacatggtgtacctggcactggcaagactatgagtgtacttgctgttatgaggaggctgagatctgaatttgattctggaactctgaggccatattgttttatcgaaattaatggtcttaaattagcatctccagagaatatctacaaggttgtatatgaacagttgagtgggcatagggttgggtggaaaaaggctcttcactatttaacagaacatttttcaggtggtactaaaattggaaagcaagcaaaccagccaattgttttgctgatcgatgaacttgatcttcttatgacaagaaaccaatcggtgttgtataacattcttgactggcctaccaaaccaaattcaaatctagttgttataggtatagcaaacacaatggatcttccagaaaagttattgcctcgtatatcaagtcggatgggtatccaacgactgtgttttggtccatacaattatagacaactgcaggaaattataacaagccgtttaaagggtattgatgcctttgaggaacaggctattgaatttgcttctagaaaggtagctgctatgtcaggtgatgctaggcgagctttagagatttgtagacgggcagcagagtttgcagactaccgtgtcaaacagtctcgacagtctgcacagactactgtttctgcaaagaaaggtgatgctgttgtttccatgggtgacatagaagctgctattcaggaagtcttccaggcacctcatattcaagtgatgaagaattgtccaaagtttggaaaagttatactggttgccatggttcatgagctgtacaaaagtggactaggtgaaataatgtttgataagttagcaacaacagttttctcctggtgccatgccaacagagaactattgcctggatacgacactctcttgaaaatttgttgcaagcttggtgaaagcaagatcatcctctgtgaagagggtagtaagcacaagttgcagaaggttcagcttaactatccgagtgacgatgtgacatttgccctcaaggaatccccagatcttccttggctatccaagtacttgtgaggttcatattacattaaccattaattcctggcgttctgttgcatttctgttctctttggaagcaacgattcactttacctgcaaaccttgcatacacacatgtcccatggtcgatctgcaaaggaaccatcgaaggatgtcggcatggcgctgcacccaagggatcacgcatatttaatcgcacaacaggaacataaaacgttaagaaatatgtacgtctgcaatttcgtctccttcaaactatggtgttgtttgtgttgtattgaactgccgcgtgtgagctgatccaattgttttctattgccatctttcagtaactatatacgaattgttcgttaaacattgacagttttgaataagaaacattgagatatcaaatttgcaaaaaaaaaaaaaaaa

SEQ ID NO: 9995 - DNA, 2155 bp, Zea mays
gagaagcggggggctcgcagaggcgtagctcgcgatccgggcgccgagctggtgcgtacttggtttggtcgcgcggctcggtcgggaggctagctagctagggctcgcggcgggcgggatggcgaagggcggtgcggtcgtggggacggctgtggtggtgtgcgcggctgctgccgcggcggtgggggtagcggtggtgctgtcgcgcaggaggagtcggcggcgggaggcggaggacgagaggaagaggaaggcggccgcggtaatcgaggaggtggagcagcggctctccacgcccaccgcgctgctccggggcatcgcggacgccatggtcgaggagatggagcgcggccttcgcgctgagccccacgcgccgctcaagatgctcatcagctacgtcgacaacctcccaaccggggatgaacatggtctgttttatgcactggaccttggcgggaccaactttcgtgtcatccgggtccaacttggcggaagggacagacgtgtcgtgaagcaacagtatgaagaggtctccattccgcctcatcttatggttggaacttctacggaactatttgatttcattgctgctgagttggaaaaatttgtgcggactgaaggagaagatttccacctaccagatggcaagcagagggaactgggtttcaccttttctttcccagtgcaccaaacatctatatcatcggggactctaattaagtggaccaaaggattttgcatcaatggcacggttggagaagatgttgtggctgaattgagtagggccatggaaaggcagggtcttgatatgaaagttgcagctctggttaatgatactgtaggcacattggctggtgggagatatgctgataatgatgttgttgctgctgtaatattgggcactggcacaaatgcagcttatgtggaacatgcaaatgtgattcctaaatggaccgggctgctacctagatcagggaacatggtaatcaacatggagtggggaaacttcagatcagataaacttccaaggtcggagtatgataaatccttagacttcgaaagtttgaaccctggtgagcagatatatgaaaagatgatttctggaatgtatcttggagaaattgtccggaggatcctgctgaaactggctcatgatgcttcattgtttggggatgttgttcctccgaaactggaacagctatttatactgaggacgccagatatgtcagccatgcaccatgacacctcacatgatctcaaacacctgggagctaagctgaaggacattcttggggttcctgatacttctctggaagcaagatacatcactcttcatgtgtgcgaccttgtcgcagagagaggtgcacgcctggctgctgctggtatatatggtattctgaagaagctgggcaaagacaaattgctaggtgactttagccaacaaaggactgtagttgctattgacggtggcctatacgagcactacaagaagttcagtgcctgcctagaggcgacgctcacagacctgctcggcgaggaggttgcctcatcggttgttgtcaagttggccaacgacggctcaggaattggagctgcacttcttgctgcctcgcactcccagtatgctgaagctgcatagttctaggagctcgggggtcctagtgtaacctttttttttgtttcccaccatttcccccttcaatcgagaagcccccctcgtgcgattcgcatctctctattttctttcctcagcagcgggatatagctaggatggtgccattgagcttggagtacattatcactagcaacaagcattagcagcggcaggaaagaagtggaagcggaggcctgaataagccgttccattcctgccgattctttttcttcccaatcccttgaagtttgtattatgaggcgatatcacaaaacagccagttcttatctgtgtgatctcgtctttcaaaataaggagagaggtgggggaccaaatcatacagtctttactcattttttattgaatcgtgcagtgcttctgcctttatttcagaaacaactgcaatggcaatatttgcttgttcttaaaaaaaaaaaaaaaaaaaaaaaaaaaaaaaaaaaaataaaaaaactcgagggggggcccggtacctaattcgcc

SEQ ID NO: 9996 - DNA, 1773 bp, Zea mays
  misc_feature (1773)..(1773): n is a, c, g, or t
aaccgtaccgggagtccgggaaaaaaacgaaaaatattgccattcacacctccactccatcccaagtgcagaggggaccgagggacgaagaagggccagaaggagaaggcgcgatgcccgacgcgataccggcctgcttccgccgcgtcgcggcagcacccggcgggcgggcgtcggcgtcggcgtcgccggggtcggggcccggctccggggtggggacgagcctggccacgtccgtctacaccacgcggctcggcctggccgcgctgacctggtcgcgcgccgcgctcgggctcagcctccgcgcggtgctccgcgtgtccgcggggcccgcgccgtctccctcggcgtccgactacggcgacggcgaggtggagtacgggggcgccgagaagggcgacggcgagggggagcaggacgcgacggtggccgttgcgcgtgcggccgtggctgctgtggcggcggcgcgggtccaagcgcttccgcgcgcggggccgccgcgtggacctggcctgggacctgtcgcgcgcgcgcttcgcggcctcgggctccccggagcccgtgtcggggtacttcgtcgccgtcgtggtggacggcgagatggcggtcgccgccggggacatggcggaggaggcctacaggaagaccagggcgcgccgcccgcccggccccggctccggccctggtcccgccctcgtctcgcgccgcgagcacgtgtccatgcgcgacggggccggcggcggacaccggacctgcgtcgtcgtgcgcgttttttttttttttttggttttttttctcgtctcgcgcgcgcagggccagggccaggggcgggagcgggacagggccgaggtcggcatgtcggtctccgtcgacggcgatcgcgtgctccacgtccgccgcctgcgctggaagttccgcggcaccgagaagctggacctcggcgccggcgaccgcgtcctcgtctcctgggaccttcacgactggctcttccccgcgcgcgacgcctcgccacccgccgccacggctccgcccgcgcgcgccgtcttcgtcttccgcttcgagctcgccggccgcgacggcgaggagcgtgacccggccgacgccagggagaaggaggtggtccaagtcggaggcggcttggcggggtacgtcgacggtaggaggtgggggagaggggactggagcgagagcagcagcagcggtgagaagcggaggacgaggggccaggcgagcaggctggcaaaggcgagctcctcctcgtcggcgtcagtggcttcctcctccgcgtcgtgggcgagcggctccaccgtcatggactggggcagccccgaggaggccgagctgcagagcggcgacggcttctccctcctcgtctacgcctggaagaactagcgtgcttgggccttgggctagcggcggccaaaggggcttgcccggcattgtttcgattgatgattggttcacagttcagtgaggatttctcttcccattgttgttgtaagttgcagttgttcagcgagcaatgttcttgtgcagctttgagtgctccactgaccaaagccatttctacccaattccttccattgacgactagtactcaattactcattggtctgcaaacagtaggtggcaaatcgctaactgatttggagctaaacaagtgatcgagtaactagatctcttgacttagaaagaaaaaaaaaaccagcttctgcgccttgtttcccatgcctcccgtgacggaaaatagctgaaaagattgggtttttttgn

SEQ ID NO: 9997 - DNA, 1412 bp, Zea mays
ctgcaatcgggaaagcgtcgaaaacccaaatccaaacgtcgccgcaaaccgcgcgatccccaggcccaaagcgccgccgttcatgagcttcctcgccggccgcctcgccgccaaggagggcgcgtacttcctccaggagtcaaagactgccgtcggccgcctcgcggagaagctcccgccctccgcttcggcgcccgggggtgcgtcggcgcagccctcccccgacgtgctaccggagatcctccgccactccgtgcccatcaaggggacgccgcccccggccgaagcctccctctccgcgtcctcccgctgggccctcccgccgggcggcggcgaggctgcgggcttgcaccccgacgcgctcaacccgctccgctcctacgtctcgctgccgcaggccaccttcggccccaaaagatggcagcttccgaacgaacaacctaactacttggcgtcaacagcaaatgaaaggcggcgagatcgggccccacctcccttggaccctgagaatttgaaagccgtaattgctggttactcacagattgggaaggcattcattactgcaacttttatggtgtttggaggagcaacagctgtgctgttgtacacagcagataagctacagttgcattcagtagatgatgttaaaactaaaggaaaagatgcactgcagccacgagctgatatgattaaagaacaaatagctccattaagaagttgggctgaagaaatgtcccgaaaatggcatttcgaaggtggtaaagaagctaaggagaagtctggcatcgttagagaactttcaagaattttgggctccaggactccccctggttgatcaacaatgacatacggctgttgtaaatccaccgtccactttgttgtatgcgtccttatcgtttccatatgtttgtgtataggaaacaaaacatcctgacatctagtttggatgtatatattggagtatagaattggaattggaatcagcttttctaaaaattttgttgtttgggtgcccttggaatttagatttggaatcataggcctaattcactgaaattgggctatgactagaacccccactttcaatacaaagcttcacccatcggtattgtgtagaattagaccgcacaaattataaactttaattcagtgacgtttaaacaatataattagaattacatctcatttcatacataatttagtattcaatttaattttatcctctccaatatcgacatccaaacggagcttgagatatgtataatatctagtctcatacctctgtttgggctttccgatagaggagattgggatggtacatgctttcaagtttgaatcagcatttgaccgcatggacttgtctgaactgcctgtttcgtggcataatattttaaagttcgatgccataattg

SEQ ID NO: 9998 - DNA, 1084 bp, Zea mays
gtcacgcagctgaccgcggcccgcatccgctacgccaacgctgcgacgggcacgggcacgggcacgggcagcgcgataaaatccgccgcggcgcctccacccactcgacgctcgcttctccaaatccccccttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaggcgtgggagcgccggcgcaggggcatgcgccgcgggggcacggcgctgcgccgcgcccgcagcgtcacggacgacgacctcgacgagctccgcggctgcatcgacctgggcttcggcttcgagccggcgcccgccgccgcgtgcgcctgcacctgcgcctgcgccgggaggaaccgcctcctggagacgctgccggcgctcgacctctactacgccgtccacggcgggccggcggaggggccgccgtgctcgtgcggcgccgcgtcggaggcgtcctcgtccgaggagtcgccgctcggcagccccatgtccatactctctccaggcgacacgccggagacggtgaagatgcggctgaagcagtgggcgcaggtggttgcgctgtccatgctgagccgccactgagctctccgggccacggccgccgctaccttgtcgcattgggaggagagagaaaaaaccattcgagatgcacacaacagcagaaggaaggaatctccggcggtcgcctcaagcagaaaaaagagcgaagagaaaaaaaaatctgttagggtttggtcatttggtgggccgccgccgccttccaccttgctcgtcctatcttggactgctagctaatcatctttcttccaccatgattgtatgattccgttggagacaaaacatcatgcctaattactttgcttgcttatcaaaaaaaaaaggcgatattccagactcacgaaaacttggaacatctggctatgatggagagggttcttggacctttgccataccata

SEQ ID NO: 9999 - DNA, 4871 bp, Zea mays
ctttccggtttttcattttgtagtaaaccgatcgatttttaatgcaggtaagacgattgttttgcctgttgcagctataatccatagagataaaacattgtattagcagtagaaactaatacggattaaagccaaacgaacacgaaccgatatttttttttaaaaaaagaatgcacataccatagtccggcgatacaatctctccatatatatagaagcatgcaactaaacagtcggaatgtgtgcttgcatggctgaccgacgaaggtttcagtttgcgcacacacgaaattttcgaactgatcattcaaaaatgccattagtaagagaataacggaaaattccttaccctccccccgtgagtccgtgaccgaaatcaatgcctgataattctccttttacagttgcagccttcttctggtccaaaagatccaccgttggagtccatctcatacccggtgtaccaggaagatacgatctatatatacgttcgttttacatcggcagacgtcacgcagctgaccaagcccgcatccaccacagcgacggaggataaaatccgccgcggccgcctccagccacctcgaatctctcgcttctccaaaaaccccagtcgcaagggggtggagccgtggagggaagggaagggtgtacagcagtgccgtggccatggacaaggcgtggcagcgcaatcttcatcttatcggcggcggcggcggcggcggggagaagaaggcgtgtcctgccgcgccgcccgcgttggggctgcagaagcataagtcgtggtcaccggacatcgagcgcgacgaggcgtgggagcgccggcgccgggacatgcgccgcggaggcacggcgctgcggcgcgcgcggagcgtcacggacgacgacctcgcggagctccgcgggtgcatcgatctggggttcggcttcgagcccgcggagtcggtgtgcgcggcgtgcggctgcgccgtgaggaaccgcctcctggacacgctgcccgcgctcgacctctactacgccgtccacggcgggggcggggcatgcgaagcggaggggccgaagtgctcgtgcggcgccgcgtcggaggcgtcctctgacgagtcgccgctcggcagccccatgtccatactatctccaggtaatctcccatatatactatagtacagtactttcccccccgcgaggctccgttctaggcaatcacacccctcttgatctgtcgatccgattattgttctgatctctgacccgttcgttcgtgcaggcgacccgccggagacggtgaagatgcggctgaagcagtgggcgcaggtggttgcgatgtccttgctgagccgccgatgagctctcgaggacgtacggccgagccatggccgccgccgccaccaccttgcatttgtggcgtggggtgcggggagagaatcaatcattcgagatgcagaacagcagaaggaaggaatccccggtcgcttcgagatggaaaaaaaaggaggaggaggatttctgttagggtttggtgtcccccgcctgccaccttgcattgcggccccgctagctaatcaaagacggaaacaccatgcctaatcactttggttaataattgttaaaatcctcttgcttcccctagttcatattagtttctcatgtccatattagtttctcacctcctttcaagaggtagattaatttgattcctttcaaaaaaaaaaaagaatgcttcatagatccttcagagttccttaacactggttttgcagatcaaagaaatttcatgaaaaccggcaaaagaaatcgagaattgtttagtgaggcgggccacaggctgtctggacgaatgggaaaagagaggactcgggcgtgtctggagtccggctgtccgtttctgtcgtttcggcgcagcgaagccgtcttctagctgctacggcgctcgctgcccatgtcacgttgagctactgccgagtgcaacagggcaggggccaggggtgtggaggtgcggtgcgcacggacgcatcacgtgcccgtcctcttggttgaactgcactgttgtccgtccctggtccagcagcacagcacctgcctaataatcaactacgtactatactaatcaagggcagacaacgacgtggttacagcgctaactaatgcggcctcgtcttgcataactcagagcaacctcgggccagcgctaatggactggaggaggagcgacggttcctctgcagtccgtacccgaggcgtacggcgtctttcagccagtgatgtctgcgccgtaccgggatgcagtgcagcagggagcaggcgtcttgaggaccgggaccggttccatgagcaccgtcagatgccttccgttccgtccatggttcttccatgcgccacacggggcccactggatggccaaccgttctgacaggtgcctccgacactgcacgtgccgagagggcgagtcctgttaattgcgattaggacggccaggccacccgaaccaccgcacgacctcccggtcccggccaagcagcccacacgaggtcgcaggggccatgcgcataggttttgtagcgtcgtatgattgaaggcactcttctcgctgtttcccttccaatcaagcacaacaaataggctgctctttcccttgaccggcgacggcgagcatcactgacgacgcccccagaatggactcgcccaaaacagcttcaatagtaagtaattatacaacaacaacgacaacgacaacttaatactcctttcttaagcaatgtctataagcttgggcagcggacgtcagctgttctaaagtctacatcacaattaaattggttttacaaagcacaaggaatgatgatacacatatagtcacatggtatcacaccaaaccagaaagcctaaataagcaaaatggagcataagtactctacctcagtcaacaaactgaccgggctgaatctacatacaaatttctctattcgcgtgaactctctttctttttctttttttttttttttgatgtaaagggcaaaagcttataaagtgacaatcacagacaatctatctgcgcctataaggctttggattaatggcggtgtgaacaagggcgactctggccaccgtgtgtccatcttccccctactatacacactcctccttcacgagcgatactgctaggtacaggtccacgagcttaccacagacctgccaacgtcctccgcagacaaattctctttatcgtgggtccgacttgccgtctcattctctccaggacctgcagccaacaaccaccaaagcattgttgacttcccttttttcatttgtttttgcaaccgtcagaacatgaaattctgtacaaaacaaataaatactccatagatttgaagattatactgatcagtcaatggggatagaacaaccaacaacaaaataaggtaaaataaaactggccacgaatctaatggaatgtcgtatagagaaacaacttgtttgctttgcgcaacatccaatgatttttccccatgcaagtaaaaatttaactgtgaaactttactatgcagaaggaagctgcaattgtccatcaatctttttatcctacacaaacatttttttagcttctgatggtaaaacagagctacatattttcttggtcgtcctcagttttctcagatcaacataggatcacagacagacactgcagctattcaaatagcgggaagagcttgagaaaaaaaaacattgacaaaaacataggtaacctgtagtggacaccacacaagttgcatacagaaaagcacagactgcatggcgacaccagttgtggaagttggccaatccattcagagaattttgaaatcatttaaccagcttaaaaatgctaccacacgtagccccagttgtaggaaaatacaatcaatcacatccacatccgtcctggacttaatcatttatcaatttctctacaactttacttcacatacaaggtattgcttaagtcaaatatatgggcatgatagactgatagtttgaacgcagaactctctggacatcagtagctgccaaccagacaataatattgtatcatgccaacaagtcacatgaccacaagtttagagatctttcattttcttcaataataattgttgaggtttcaaaccgcccccgccctggcggcccccctttggtggttttttgttttgcatgatcatagggctatagtatattcatgatgtgatgctgttagggttgactgtaatatacttcatgacaagggaatctacacattatagaattccttttgtagaaaacaacttcctacacatcaacaaagttcgctgctagtactaaattgaaagagtctagtctatagcttgtaaccagagcaaaagtatcttcttcaaaatgggaagcaattacctcattcttttgcttctccagcatttcgacctgcatatttgagaagaaatcggttagcaataaatagcagcagttatgaagaatgtgatctaacaacacatagaaaatagtcagacgagaggctgagtagaaaatgcgatcgaacaacacatagaacatagtcagacaagagtcagacataaggttctctagtatcccaaatggtctcaaatccaagtaaaggtattaattaaactatttgaattccacaatcgtgaaccaaaaaaataaaaaaaatgcaaacatcatatgagcatacctgtttttttgcaactcatcgttcaactctttaagttttgccacctcagcttccaactccatcatatacgcctgccgaacattacaaagtacaaatatgtctacttaaaatcgctagcagtttagaagcgttagagaaaggagactagattcattcagaaataggtttcacctgg

SEQ ID NO: 10000 - DNA, 1563 bp, Zea mays
tttttttttttttttttttgatgtaaagggcaaaagcttataaagtgacaatcacagacaatctatctgcgcctataaggctttggattaatggcggtgtgaacaagggcgactctggccaccgtgtgtccatcttccccctactatacacactcctccttcacgagcgatactgctaggtacaggtccacgagcttaccacagacctgccaacgtcctccgcagacaaattctctttatcgtgggtccgacttgccgtctcattctctccaggacctcattcttttgcttctccagcatttcgacctgtttttttgcaactcatcgttcaactctttaagttttgccacctcagcttccaactccatcatatacgcctgtttcctcccacgcgacctcgcggccaactcccggttcttgatcatccggcgttgcctcctctcaaccaccttctccacagctggtggcttccttcccctcaaaccagcacaaaaaaacgtacgacaccggtgatggcgacagatgcgacaagtcgtctccttccatcttcccgaacccgcttgccgtaaccggccgcggcgataccgccggggcctcaagaacacctccctgctgctgactgagagcccccgacacaaacccattcccgaattggagcggaggcactaagggagcaaacacattgccatgtggaaacagcattggcggttgcagatgaggtggtgggcaacccggcgctggtggtacgggcgccgccgccatcatgtcctccctcaccacgccggcgcggacgaggaactcctccagcatgatctccccgagcgtcggctgccgttgggccggtggggcggcgccacagcctcgtcggagggtcctccaccgttgcacacgaggtcacgctagacctcgtcgacggtcttctggctgagcgtgcaggggagggtgagcgagccctggcactggacgtacggcgcccgcgcggcatggtccgcagctgtgacgctgtgtgtctcctccgccgaccagatgttgcggaggagctcgtccatgttcatggatccgaagtccttggtggccccaccgagcgagctctggaactcgtcgaacgtgagcgagtagaccgacccctaccgcgccagcgggagcggcgtcatcggcgacaggtgctccggccccggatgctgctgccgcctcccgcttccagccgggaaattcatccatgcttcacgtagcccaccaaactcgacccaattgacatttcgaaagagccctcggtagtcggtacacccaggcccagaggccgaacggagccgccaatcaggtgagctcagagcaggggttagactgaatatggtggcttagcgacaggaggtagcagaattagcaaaagaaattcggcgtatcaagaggaatttggtggggtgacctgaggcgcgaggtgcacgacgagcgttgttggtgtatgcctgacttgcctgtatggtcgcgggtgtgcgggagggaaagtcaggccgtggcggcttggcgaggggaatggatggatattcccggccggcttcgagg

SEQ ID NO: 10001 - DNA, 2031 bp, Zea mays
ctgtggaccggtagcagttaccgccttttttttcccactcgcgaacggctcatgcatcaaagcgtgccggccgcccgggcctagtaactagttagggtacatcgccaagaaaagaaggaaacgaaatttgttgcgaagcgtaattttggtactactggagctcaaaatggaacgttacaatgaggtggtggttgaaccatactgtgtgctggcaaaaaaggtttcccgtttgtatacacaggcaaaaaggaaagaaaaaaaaacaaactccaacagctcattcaaaaatatcgtttataaccggaaataagtgtcagcgcaaaaaattcttgccgtcctttttttcgtgtcgccgcaccctctcccgtgaccgaaatcaatgcctaataattaccttacccgtccctgggtggctgccttcttccagttcaaaaatccaccgttggatttgcataccctactgtacaaggaaggtacgttatatacttatatacgctaggctagttacatcggcagacgtcacgcagctgaccgcggcccgcatccgctacgccaacgctgcgacgggcacgggcacgggcacgggcacgggcagcgcgataaaatccgccgcggccgcctccacccacctcgacgctcgcttctccaaatccccccttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaggcgtgggagcgccggcgcaggggcatgcgccgcgggggcacggcgctgcgccgcgcccgcagcgtcacggacgacgacctcgacgagctccgcggctgcatcgacctgggcttcggcttcgagccggcgcccgccgccgcgtgcgcctgcgcctgcgcctgcgccgggaggaaccgcctcctggagacgctgccggcgctcgacctctactacgccgtccacggcgggccggcggaggggccgccgtgctcgtgcggcgccgcgtcggaggcgtcctcgtccgaggagtcgccgctcggcagccccatgtccatactctctccaggtagtctccggctgtccaggcaatctccgcccgtgattctagtttcgatctctgatccctttccgttcgttcgtgcaggcgacacgccggagacggtgaagatgcggctgaagcagtgggcgcaggtggttgcgctgtccatgctgagccgccactgagctctccgggccacggccgccgctaccttgtcgcattgggaggagagagaaaaaaccattcgagatgcacacaacagcagaaggaaggaatctccggcggtcgcctcaagcagaaaaaagaggaagagaaaaaaaatctgttagggtttggtcatttggtgggccgccgccgccttccaccttgctcgtcctatcttggactgctagctaatcatctttcttccaccatgattgtatgattccgttggagacaaaacatcatgcctaattactttgcttgcttattaatcctcttgcttcccccctaatccatattagtttctcatcttcgtgtatgtacatggttcctttcaagaggcagattaatttccatcatctcaaatgattagcggggctccgccttctcgatctactactatacctatacttgagatgacgacgattgttgaatacgcacggatgtctctctctctctctctctctctctctctctctctctctctctctctctctctctctcttagatcctttttcagttcatcaactctgttgaaacctgtgctcaatcaagagttgagacttaatacatgtcgtcaatccagagtcttgcagatcaagggcaaggagacgaatttttcaacaaaaccaacagcggtggaaataaattccgtgtggttggatcggttgggagagagctgtcttggttctgcttctgcag

SEQ ID NO: 10002 - DNA, 3134 bp, Zea mays
  misc_feature (107)..(107): n is a, c, g, or t
  misc_feature (242)..(242): n is a, c, g, or t
agtacttaaaaaataaagtactttatctttattttaggattctacaacgaaatcctttattttctagcaattctactactacgaaacaaaaaagacccttcaaattntttttgaaaaagaaactaagcctgctattctaaatcgaactaaagtcaaactttctagtgcttataaattcttatggctttatccctttcatacatgtaattacaatttttttttctgataatacaaaatattgntagcatttacttgtacgaatcctatagtagttagcaatcaggaaaacaaataattttatataatttgaggcttgattattctgcagagcagatggtagtagttcatctaagagcatatgcgtatcttggtccgccaatgccaggcctattacccaccattagaaaaaaaaaatcgttaattattgaaacgtgacgctgtcgtcctcatcatgttgcgctcgatctttttccctcgatgagttgctagctacttgcctactagagccaatgaaacgatgatccagtaaaagacgtacgcgttgcttatataataattattgtactccgtactcaaatgtggctcacaagtatatgtttactcttgttttaatatattagttgccgttgccgttgccgcaagcccatgatgtagtggagttggagagacagtcttccgcgaaattgtagtagactcgcactaatcaaatcacagatggagaacctgagaccaggtctagttggtagttgcttctagaaataactggttctgaccatatcatcagagtctgaagcatttctcttgctctttcttgccaatcgccggttgctaaggctgggaagctcaagcgacgcaaggcatgccgtgcagtttctggcagcatgccaccgtccacggcaccctacagatacagagatccgattcgccgatctacttgcgggggcaaagcaagcgtcaggtttggcttaaaataaaacattgcaccgggacgtggcttggtccttcgcttctagatatggttcgtgattcgtagtactggtactgactctgccctgcccatgccaaaagaagctctttttttttcacaacgtcggagcaagtacatatctctacaaaagatcttggaaattaacagatgtatcatcttcaggctagcgcaaatcacgaaccgcatcagtcacagtccgtgcatgaatccgggcaaacatgggtcgacacataaattgtgtggtctgaatctccttcttcttctccagtggagatacttgcatgcaggtgatcgacccgcagatatttttcttcgatcttgtctcgagggatcgcgactgatggcgaggcgcaatgttaattacacgtacgtaatcattcgagactcgattggccgatcgatccatcaatccatccattcttcctccgcaagcgactctcggaggaggaggacgacgacgacgcctctcatgatctcgcgcactgtcacgctgtggaccggtagcagttaccgccttttttttcccactcgcgaacggctcatgcatcaaagcgtgccggccgcccgggcctagtaactagttagggtacatcgccaagaaaagaaggaaacgaaatttgttgcgaagcgtaattttggtactactggagctcaaaatggaacgttacaatgaggtggttgaaccatactgtgtgctggcaaaaaaggtttcccgtttgtatacacaggcaaaaaggaaagaaaaaaaaatctaactccaacagctcattcaaaaatatcgtttataaccggaaataagtgtcagcgcaaaaaattcttgccgtcctttttttcgtgtcgccgcaccctctcccgtgaccgaaatcaatgcctaataattaccttacccgtccctgggtggctgccttcttccagttcaaaaatccaccgttggatttgcataccctactgtacaaggaaggtacgttatatacttatatacgctaggctagttacatcggcagacgtcacgcagctgaccgcggcccgcatccgctacgccaacgctgcgacgggcacgggcagcgcgataaaatccggcgcggccgcgtccacccacctcgacgctcgcttctccaaatccccccttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaggcgtgggagcgccggcgcaggggcatgcgccgcgggggcacggcgctgcgccgcgcccgcagcgtcacggacgacgacctcgacgagctccgcggctgcatcgacctgggcttcggcttcgagccggcgcccgccgccgcgtgcgcctgcgcctgcgccgggaggaaccgcctcctggagacgctgcccgcgctcgacctctactacgccgtccacggcggggcggcggaggcgccgccgtgctcgtgcggcgccgcgtcggaggcgtcctcgtccgaggagtcgccgctcggcagccccatgtccatactctctccaggcgacacgccggagacggtgaagatgcggctgaagcagtgggcgcaggtggttgcgctgtccatgctgagccgccactgagctctccgggccacggccgccgctaccttgtcgcattgggagtagagagaaaaaaccattcgagatgcacacaacagcagaaggaaggaatctccggcggtcgcctcaagcagaaaaaagagaagagaaaaaaaatctgttagggtttggtcatttggtgggccgccgccgccttccaccttgctcgtcctatcttggactgctagctaatcatctttcttccaccatgattgtatgattccgttggagacaaaacatcatgcctaattactttgcttgcttattaatcctcttgcttcccccctaatccatattagtttctcatcttcgtgtatgtacatggttcctttcaagaggcagattaatttccatcatctcaaatgattagcggggcaaaaaccgccataaaaaaaaacctattttgacactaaaataaccaaacaaaaa

SEQ ID NO: 10003 - DNA, 3463 bp, Zea mays
accctgccccgtcccgtccgtctccgtcccaatcggatccacccgcccgtcgtcgcctataaactctcattggctcccccggcgggcggggcccggcttcctcccaactgccaccgatttgtttgttcggcttcggccccatctccagtcacccgttcccacttcattggtcgctgctccctccctccacggccgatcccgtgccggcgagagggaccatggcggggaaagggaaggaggtgtacgtggccgccatcgaccagggcaccacaagcacccggttcatcgtctacgaccgccacgccaaacccgtcgcatcgcaccagctcgagttcaagcaacactacccggaggcagggtgggttgagcatgatcctatggagattatagagactgttaaggtgtgtatgaaagaggcagttggcaaagccaaagctggtaaacacaatgtggttgctggtttgaaggccattgggatcacaaatcagagggaaaccactgttatgtggagtaaatccactggccgtccactgtataatgctattgtgtggatggatgctcgcacaagccctgtttgcaggagattggaaaatgagctgtcaggcggtagaacccacttcgtggagacatgtgggttgccaatcagtacctatttcagtgctctgaaattattgtggttgatggaaaatgtggatgctgtcaaggatgcagtccggactggtgacgccttattcggcacaatcgacacctggttgatttggaaccttacgggaggtgttgctggtgggcagcatgtcacggattgctcaaatgcatctcgtacaatgcttatgaatctaaagacacttgactgggataagccaacacttgctgtgttaggagttcctgttgagattttgccaaagattatcagtaattcagagaaaatcggtgtggtcgccaaagagttcccgtttgcaggagttcccatctcggggtgtcttggagatcagcatgctgctatgcttgggcagctgtgccagaagggtgaagcgaaaagcacctatggaactggtgccttcatccttcttaacacaggggaagagcctacccaatcctcccatggccttcttagtaccattgcttacaagcttggtccagctgcacccactaactatgctcttgaagggtccattgcaattgcaggcgcagcagttcagtggctgagggacagccttggaatcattcagtcagcagctgagatcgaaaagttggctgaaacagtgccagattcaggtggagtgtactttgtgccagcatttaatgggttgtttgcaccatggtggagagatgatgcgaggggaatttgcatcggaatcacaaggttcacaaataaggggcacattgctcgagcagtgctcgagagtatgtgttttcaggtgaatgatgtcctcagctccatgcacaaggatgctggagaggcaggagaagtaaagagcgcagaaggagagttcttattgcgtgttgatggtggtgctactgttaataatcttctaatgcagatccaggctgatttattaggcagccctgttgtcagaccagctgacatagagaccacagccctcggagctgcatatgctgctgggttggctgcaggagtttggaccaaggagaaggtttttgcaggtttgcacaaggagaacacgacagtcttccgcccgaaactggatgaggcgcacaggaaaaagagggcggattcatggtacaaggcggtttcaagatcattcgatctggctgatctttctctgtaaatttatcctgccagcgctcctctatctggttttggaagctgcaaatgaataaattggtcttcgctgggactaatcttaactgcttgttatttatatataacatcacgatgtttataaaagtgagtacatgaatatcctcagattttcagcaggaagtgtttttctagaatatttatgtgtgcttccatagacccggatggttgactgtttgcttcaaattaaagccgactatttggactgctacaaccataatttatagagataaaaatattgtagaagcagtaaaagctggtacgggataaagccaagcgaacaaccaatattgaacaaaggaggcgggaaatgatagaagaaatacattatgcataagatcgtgcttctgctggctgtttcatcaaatccagcatcctgcaaaagaaactactcaaactagcatgtccttggtctagctgcaagctcatggtctcctccaagacagaagcgacgtgtctcgcggtttcagctccctgttctctgagcgcagtaaaatttacggcggcatctgaatgcgctagcgagttccatgacccatgaaacttcacttagtactggtcgttgggtaaggtcactggcgatggggaaaattcatttgtcatcaacaagtccagcagcactttcgcatggtcgacgagttatgagttatcttacgagccttgcgtgttatcaatgcagcgcatatcaccacggggcgccaaacctgcagatcatgcagaaagagaaatggaaatatttagactatcttctcagaataagttgcgataaaaagtttgctggattgcctaggcctagcaaagccagaaaggagcagctattccgataagtagggccgggctcagaatgaaatgagagtgaggatatacttacaacaacaagcgccaaatgtcaaagccaaagcataataattgagttgaacagaggaggatatacgctgaaaatctagtcttttatacttacaacacaaaaatgagtgagggcctatgctctcattccattacacgtagatccgcctctgccgataagaccaatatgctcgaagaagagtgccgattgatgttttttttgtcctctttgtggaaccaaaaaatgtttagcatgcaatggactaaaacagaccttctttggaatattggcctacactaacccaccaggtaaagcttggcaaaagtggcctagacctctatctttgagcaagcagtttcttgttgcaagcaaatagcctttcatataactggactgttgattttggtgatagatccggaagacctgctgatcatccttcttctcacgacatgacctttgttgttgtataaacatttcgttttaagtcttaacacaagttttgtgcccatctgcaacttattcgtgggacacatcctagaccatgtttgtttcctttgtagattatatagtagattatataatccagctgaaataagtttacaaattattagaccatgtttgtttcctttgtagattatataatccagctaaaataagttcataaattattaggtggattatataatctagatatatagattatgataattcataagcagatcattaactacttatataattcataagctagattatatataattttagaggtaaacaaacagtgccttagagcg

SEQ ID NO: 10004 - DNA, 6071 bp, Zea mays
  misc_feature (666)..(666): n is a, c, g, or t
  misc_feature (1799)..(1799): n is a, c, g, or t
ttgccgggccgaaccttgacactataaaattagtcgtacctcgaggcagcccgctaggcataaaacatttggtcatctacagtccagtacctcctccctcaccgtccttgatctctagagcatggaaaaaagcgagagaatgaacttgatcttgtcttactccaaaccacatacctcgacatttgcattaacctaatctacgagtttggatcatgtttgaaaaactatcccattgaagcaaagtctatctataatatagaaaccgtagtgatgctcgtacaactaactattggtttctgagttctgaatttgttgtgagctaaaaccgaaggagactacgaacatggtggggcgagggagaggagttgggggtactgcaaggcaaaagtggggatgggagagttgcagagaatgagcgtagtggtttgagtggagattgtggtgagtgtctttagagcccattcgtccctagctttagtcattcctcataacttatgctttcttggctttacctttgggtcaacattgaggttatgttcaattatgcttttgttgacgagatcatttataaactaggcaaatacatctttgttatttgaacaagaatcttttcatttgatcttcttgttctttggacaacttagtgccaaagaagactttctaatnatttaggttatcagaaatgattactttctttagttatctaaaggtgcggccttctccttgattttggttccttttggtgcttaatctgtcccatgtcatcaatgttgtgcactgttcttcttccaattgtccagtttctctcagccctttttacgccttcttggtttttgaatactaagatgaccttagtaggtctaagcattttcatatagagatagcctgaatgcattatagctttaaaggcgttcaatttgcctattcccattattacattgtatgggtagtccatccccacgattttacctttttcgagtttgactttaggatgatgaaactgtcaaagtaggctacaccgaatttgcatctagaccagacccgatttgtatttttgcgcttcaggtgtccatttttcgatccacttcttccgagagttctctgatatgctaagaaagtttgtcgagtcatcaaaccacctattgttgtttttttattgtggtgaatgtcccgctgtgttctttgatcattctggcgggcatctagttattagttggttcgagagtattttttggagtttttaagagttatttaggacggtgaccattccaaagaaattctgcccagctgtcgtcgccttacacttgttattaaaccagaagaggtcacaaggcatctagttattagctggttcaagggtattttactcgtaagacttggagttttaaagagttactagtattttaggacggtgaccattccaacgaaattttgaccggctgtcctcgccttgcacttgtcaataaaccaggagaggtcaccggatgcgctgtcagcctgtctccgtcacgagctgcgctaactctgcatccttgcaggattcggtgggatttggccgtatcgtaagcctatccgtggtgtttccgtctagttttctctctcatatattccagggcggattcgtcctgcttcttgtcacgtagtactcggcagcaatgcctcctctgaacgtatgtagaaactgcatcaaaaaagattgaaactggaggtcacggagctttggcgtgagaaccgaggatcatcgccggtgctggcgcggtgacgccgacgggcgacggctgcaggttgacttgtagcanctaaccgtgtactgaactactgatatgtaaagccaaagactgactgcttgttattaaaccgatggcagtgacagtgaagaacattacgcaattgtattctcttgtggaaaattgatggtatcgtcgtcacaattaataactcggacccaaaaaaaaatacgccaattgcaggttgcggcaagcaaagtccatggaggcacgcatccactctctcgtgctcgtgcacccacctacccgtaccgctgtcctgcagcagcaatcggcacgggcatgaatacttcaggggtgtttggttacaccccgctaaaatttagcccatgtcccatcgaaggtttgaacctcagttccgagtaaatatagtcgaattataaaactaatttgtcagccgaagattgaaagacgagacgaatctagtccagttggttgtgtctatatttcatactcctatttaaaagtcaaacgcttgatgtgacccgagctaaactttagcaggagcaaccaaacacccccttcttggctgcggctttaatccattggcttgtatattttctatagtattttatctttataaatcataactataatagttcgaattatcgaatagctagcttaaaaaccacagccaacaagctgttggttgtcactgcactttgccggcatgcagctgcactcaaatatatatatgcgatctcggctcgtctctatccggataagattcgccaggactcaagagcccgtcggcgaaccgatcacagtcggcgagggccgaggggaggccttttttttttttttgacgcggtcgccagaaatcccgtcatgtcaggtcccgccgtcccggcgcagaggagagcgcgagccccgagaagcgcggagcggaattgcaagagcagacgagcagtgtagacaacgggacagccattgacttccccgcctaccctgccccgtcccgtccgtctccgtcccaatcggatccacccgcccgtcgtcgcctataaactctccctcccatccgcctctcgaggggcccggcttcctcccaactgccaccgatttgtttgttcggcttcggccccatctccagtcacccgttcccacttcattggtcgctgctccctccctccacggccgatcccgtgccggcgagagggaccatggcggggaaagggaaggaggtgtacgtggccgccatcgaccagggcaccacaagcacccggttcatcgtctacgaccgccacgccaaacccgtcgcatcgcaccagctcgagttcaagcaacactacccggaggcagggtgagtgcgggcgggtttcatgttcttctcgggccagagatcggttgggtagcgggtctgtttgcttttggattgcgcgaattctggacccggtggttgtattggagggaatcaagggaatggctaatttaaagatgttgtttttttttgttttgatactgtgactgaactgtgaaaaggtttagaagagtaactgttagatctgaatgagttagccgctttatccagttgtcttactcttaactttttgagagaacaggagggggtagcgcctactgaaaattttatttaaactagaaagaaaacattgttttgaacaaacaagtagacgtattacagaaggttagggagagttcctactgccattgctgaagccatgctaggatggcagaatcgaagcactggtttttcccatgtacaactaggattacatgtttttcttttatgaatagaaacttaattggcgaagcactggactttcccatgtacaactaggattacatgtttttcttttatgaatagaaacttagatgatcagtgaatcagatttacctctacatacgaaaatgagtattattctaggggaaaatatagcaccacaaagtaccgaaaggatcactatgaggcgtgaactctttctctgctagaccaattcggtgcctcatcaattggcaacttttgcttcgccttttggtttcctttccctatgttcattaagcatgtctacataattaatttgctttaagcatggtagtgctgtaatgctgtttcacaagctatcatgatgaactttcaggagcgctgatcatctgactctgacctttgatatattgtttgcacctgtgacttccaagctttgttagaaatctcacatgttttctttatttcagtatttccatttatatgtggatatgaagctagatatctactataccttagtcacgctgtttcatgctatttgctcgagtcactgtagctggtaatcttagtcccatcttcctgtttaaagcgatgacagttgtcatggtctctgattttgtcctttctatgtttgtgtgaactaaaaggtgggttgagcatgatcctatggagattatagagactgttaaggtgtgtatgaaagaggcagttggcaaagccaaagatggtaaacacaatgtggttgctggtttgaaggccattgggatcacaaatcagagggaaaccactgttatgtggagtaaatccactggccgtccactgtataatgctattgtgtggatggatgctcgcacaagccctgtttgcaggtcgccttctttttatcattcactcgttttattaacattcgatatcatcaaatcttctcatcatgcttcaacaacacaggagattggaaaatgagctgtcaggcggtaggacccacttcgtggagacatgcgggttgccaatcagtacctatttcagtgctctgaaattattatggttgatggaaaatgtggatgctgtcaaggatgcagtccggactggtgacgctttattcggcacgatcgacacctggttgatttggaaccttacaggaggtgttgctggtgggcagcatgtcacggattgctcaaatgcatctcgtacaatgcttatgaatctaaagacacttgactgggataagccaacacttgatgtgttaggagttcctgttgagattttgccaaagattatcagtaattcagagaaaatcggtgtggtcgccaaagagttcccgtttgcaggagttcccatctcggggtgtcttggagatcagcatgctgctatgcttgggcagctgtgccagaagggtgaagcgaaaagcacctatggaactggtgccttcatccttcttaacacaggggaagagcctacccaatcctcccatggccttcttagtaccattgcttacaagcttggtccagctgcacccactaactatgctcttgaagggtccattgcaattgcaggcgcagcagttcagtggctgagggacagccttggaatcattcagtcagcagctgagatcgaaaagttggctgaaacagtgccagattcaggtggagtgtactttgtgccagcatttaatgggttgtttgcaccatggtggagagatgatgcgagagggatttgcatcggaatcacaaggttcacaaataaggggcacattgctcgagcagtgctcgagagtatgtgttttcaggtgaatgatgtcctcagctccatgcacaaggatgctggagaggcaggagaagtaaagagcgcagaaggagagttcttattgcgtgttgatggtggtgctactgttaataatcttctaatgcagatccaggtaaagaaaatgacctcttctctctattcacatacaagcacttatgacttatccatgtatcttaggaattgaatttgtggtcaattatactaacatgttttcagtacatgttatttttgctccaaaaggccatgctttcagttagtgcttttggctcgttggaaatggacgaagttgatgctaactctccgtacttctctcctattaagatcaactcagaaccccgttaatctgacgtggcaaattatgcatgctaacagcagtagactgtcagtttcaagtagtacattttttttacaatgtatgaagtccaaactatgttttcatccttggatatctggttcatctgcaaattgatgcacaagtttacttgcatcctcctcccagtcccagtaatatcacccaatcagcaggacgcaagtatggactatcgcgaaaaaaaaatctaaaaggaggttgcgatctgcaatgcatcaattcatcatatccacgtttgcttggtgatatgtgttcttaacttgtgtgatcttacctggcacagatcttattcatttattttcttcgcaattgcattggatgactgaggatagcttggttacataatgcctgcaggttgatttattaggcagccctgttgtcagaccag

SEQ ID NO: 10005 - DNA, 1911 bp, Zea mays
ttggctgaaggcgattcggcccattgtagccccgagacagcgtccgcctacggcctatccgcgtcagcccgccggcgagtcgcgcacgagacctgcgaggcgcgatggcaggccgcggcggcgccggccgccggcctcgcgccgtcttcatggccttcggcactcagggcgacgtcttccccatagcacttttgcgtgtgaccaacaggagtatgctgtggtgttcatcactcattcagcgcaccggagtttgtcaacacatctagcggccagcagtgttagatacatgcctgtgtcaagcccgcctgtcctcgccgccgaacagttagagaatatctcaagtgattctattcaatcaaaccatgagcgcgagtccttttcaatgcggaaaaaagccattcaggcggagcacaggaaagaatgcttgtcttttgtggaagaagtttttggaaacgacccaagcatcagtggggattttattgtgatcaatttcttcgctttggaaggttggcaccttgcagaactattccaagtaaagtgcgtcattgctgctccctattttgttccatatagtgctcctacatcattcaaacgccaatttaaacaaacttttccgctactgtacaagtactttcaagaagctcctgcaaatacggtctgctggactgacattatccattggatgtgggcactcttcatggaaagttggggatcatggagaaatgattgtctgaatcttagccccattcctttcacagatccagtaaccaatcttcctttgtggcatgtgcgagaggagtcacctttattactgtatggtttcagcaaagaaattgtggagtgcccaggatattggccgttcaatgctcatgcttgtggcttttggtttctacctatggattggcaattttcttgtgacaaatgcatggtgttgtctggaaatatcaattcttcatttggtggtatgttgtgtgcaaaccattcttccctggaacacttcctcacaaggaatgcttattcatcaagacctatatttgtaggattaagttccattggtagaatgggctttcttagaaatcctaaagcatttttaatggtgcttaaggctgccatagagtcaacggattatatgttcatccttttctcatctggatacaagccattggattctgcaatccaatctattgcttcatcagtaaatgaatcaagaggggtggattcaccttctcttggtggtgacagcgctctcctttttaatggccgccttttctgttttttaggatcaataccgtacagttggctttttcctaggtgtgcagccgctattcaccatgctggtagtggatcaacagctgcagcactacttgctggtatccctcaggtaacatgtcctttcctgatggaccaattttactggtcagagaggctacagtggttgggagtggcgcctgaacccctacaaagacaaaatctagtcccagataatgatgacgccttgagcatccacaatgctgcagatgtgctagttggagctatcaggtcagctttatcaccggaaaccaaagctcaggcggccagaattgctgataggctttcttctgaggatgggattggagaagccctcaggatattgaaggcgagagtgttgactcagaacaaaatcatcagcccattcatctcaagtaaataattagtactgatatgatatgaggaatggatttaaaccactaaatttaagaaatggacttctaatgcaccgccccatgtaatgtaagatagagtaattcctcataccaatcacctttagtttatttgagagaataaaggtgtaatacagtttttttgagagaccgattttacagcggtctttgaaaaaaataaataagcaaaaatgcaaaaaaaaaaaaaaaa

SEQ ID NO: 10006 - DNA, 1941 bp, Zea mays
ggacccccgggtcggccggggtattagtgccatatggccattgccatcccatctgcccatcgtcgtccagccgtccagggatccaggctgaggcttaataataaagcactctttccgctcctttgatcccaccactctgcagaaccatggccggcgaggaacaccagcagcacagcagccactacggccaccacttcctggtggtggcctacggcatgcagggccacgtcaacccagcgcgcgctctggctcaccgcctcgccaagctcagcgacgtcgtaggcggctgccccatcctcgccacgctctccgtgcacgtcgccgcccaccgccgcatgttcccggcacagctggacccggacgccgccggcgaggaggatgaggaggaggccagcgacggcgtcatctcctacgtgccccactcggacagcttcgacgacggctccttgcccagaacccccgaggactgggcccgcagacgccgcgcgagccgcgagagcctctccgccatgctcgcccgcttcgccggcggcgggcggcccgtcacctgcgtggtgtgcacgctgctggtgcccgcggcggtggacgccgcgacgcgccacggcgtccccttcgccgtgtactggatccagccggccaccgtcctcgccgccgcgtaccactacttccacggctacggcgagaccgtcgccgccgccgacccggcgcacgaggtgagcctgcctgggctacgccgccctctccgggtccgggacttcccgtcctacctggtggacacgacgggcagcccgctggccaggtccgtcgtcgggatgttccgagagctgttcgagagcgtggaccggtggcggcctaaagtcctcgtgaacacgttcgacgagctggaggcgggcgtgctctcggagatgaagcgacacctcgacgtgttcgccgtcggtcccatggtcgccggcgccggtggtggctcgggctcctctggcgcgtcaaacgacgaaggacggatccatctgtacaggcacgacgacgccgacaggaagaggtacatggagtggctcggagcgcagccggagagctcggtggtgtacgtgtcgttcgggagcatagcgacgcacaccttgcagcagatggaggaggttgtccaagggctgctgcaggctggacggccgtacttgctggccgcgcgcagctggcacgggctcgaggacgacggtgcgcgccgcgtcctggacaacgccgcccagagcagcggcggccgtgggacggtcgtggactggtgcgaccagccggaggtcctggcgcacccggccgtcgggtgcttcgtctcgcactgcggctggaactcgacgttggaggccgtggcggccggcgtgccgctcgtcggcgtgcccagcctgtttgaccagccaacgaacacgtacttggtggtggaggagtggggggtcggcgtcagaggggagcgtgacggtgagggcgtgttagctgcgacggagctggcgagatgcgttgagctggtcatgggtcaaggtacaaaagcaacggcgataagggagagagtaaaggctttgagagagatggcgcagcaggcggcacgagcaggtgggccggcggagagaaaccttgaggactttgttaactctgtcggtgatagcttccgtcctgtcggaatttcagttgcggaaaaaactgatgaatctcgtacatgttcatcagaatgacttccgtacagatattatttttatctacattctacaaggagtacctgatataccatgtaatggatggaatgaggttccagcttctacgtactccaaattccaaaagggagtggactgcggttcactacttcacgagcacataggatcaatctccaacaaactagtctccactgtgagagtggtgtttgatttgagcaatgactaaaatgagatagtacatcataag

SEQ ID NO: 10007 - DNA, 2244 bp, Zea mays
  misc_feature (2071)..(2071): n is a, c, g, or t
  misc_feature (2073)..(2074): n is a, c, g, or t
  misc_feature (2077)..(2080): n is a, c, g, or t
ttgggaccctcgccgcgggtccggccgggctgcccactgctcagtccactgcccagcacggatctcatctcaccagctgcccgcgcatccaattcctctcgctggacggctgcagcacatcatcaggtgagaccgtgagagggaatgggatcaacaacaatgtcccctccatcttttcccgtcgtcctcctgctcctcctcctcgccaccatagccgcagccgccggaagcaacatggatgaggaggtggtggacgacctccagtatcttattgacaactccgacgacatccccaccaacgatcccgacgggtggcctgagggagactacgacgacgacgaccttctcttccaagatcaggaccaggacctcacaggccaccagccggagatcgacgagacccacgtcgtggtcctcgccgccgcaaacttttcctccttcctcgcctccagccaccatgttatggttgagttctacgcaccttggtgtggccactgccaggagctcgccccggattacgccgccgccgccgcgcatctcgccgctcaccaccaccaggcccacctcgcccttgccaaggtcgacgccaccgaggaaaccgacctcgcccagaagtacgacgtccagggcttccccaccatcctcttcttcatcgatggcgtccccagaggctataacggagccaggaccaaggaagccatcgtcgactggatcaacaagaagctcggcccagccgtgcaaaatgtcaccagcgtcgacgaggcccagagcatactcaccggagatgacaaagccgtccttgccttcctcgacacactatccggtgctcacagtgatgagcttgctgctgcttcgaggctggaagatagcatcaacttttatcagacttcgactcctgatgttgctaagcttttccatatcgatgcagcagcgaagcgtccatccgtagtgctgctgaagaaagaggaggagaagttgaccttctatgatggggagtttaaagcatcagccattgctggttttgtgtctgctaacaagcttcctttggtgaccacactaactcaagaaacttccccttctatttttggcaatccaatcaagaagcagattttactatttgctgttgcaagcgagtccaccaaatttctgcccatctttaaggaagcagcaaaaccatttaagggaaagttattatttgtctttgtggaacgagacagtgaggaagttggtgaaccagttgccgactactttggtattactggacaagagaccacagttcttgcttacactggtaatgaagatgctaggaaattttttcttgatggtgaggtgtcacttgaagctataaaggacttcgctgaaggtttcttggaagacaagcttacaccattctacaaatcggaaccagtgcctgaatctaatgatggggatgtgaaaattgttgttgggaagaatctggatctaatagtttttgatgaaacaaaagatgtacttcttgagatatatgcaccatggtgtggtcattgtcaatcgctggaacctacttacaacaatctagccaagcatctacgtagtgttgactcccttgtggtagccaaaatggatggtactaccaatgagcatccacgtgcaaagtctgacggatacccgacgattctcttctatccagctgggaagaaaagctttgagccaatcacttttgagggggagcggacagtggtagatctgtacaagttcatcaagaaacatgctagcatccctttcaagttgaagcgccaggagtcgagaaccgagagcactcgggcggagggtgtgaagagctctggtacgaactcaaaggacgaactgtaaagagctcagggttggatgtgtgttggagtggatcagggtgaaagtttccatctcaatacaagtagatcgatcttggtggatgcgagtgcagtgttggcctgagggaggagcagcagagatgagtgcttactgcttagagagaggaatgaaatcagcaactaatcaaataaaatcaaattccattattccttttaaaaaaaaaaaaaaaaaggcccggccnannaannnnaaaaaaaaaaaaaaaaaaaaaaaaaaaaaaaaaaaaaaaagggaaaaaaaaaaaaaaaaaggtttttcgatcccgtcaaaccccgggggggggcccggaacccatttccccctatggggagccgaattacccccgctccctgggcgtcgttttacaccgtcggg

SEQ ID NO: 10008 - DNA, 2125 bp, Zea mays
tgcatgcctgcagtgttgttcagttaaactgtgtccaaaagtttacatatagttactaaaaacactgttttacatcgtggattgtactgttctcagtggattaatagaattggacgctggagatagacccgccggagaagatggcctgcccactgctcacagtagtctagtccctgcccaccaagtacggatctcatctcaccagctgcctgtgcagcagtccaattcctcttgctggagcataccagaagcagaatcgggtgagaggaaatgggatcaacaagaacgtctcatccatctttcccggtcctcctgctcttcctcctcgctaccgccgccgccgccggaagcaacaaggctgaggaggtggacgacctccagtaccttattgacaactccgaagacatcccacccaacgaccctgacgggtggcctgagggcggcggcggcggcgactacgacgacgaccttctcttccaagatcaggaccaggacctcccagactacgagccgcagatcgacgagacccacgtcgtggtcctcaccgccgccaacttctcctccttcctcgccgccacccgccatgtcatggttgagttctacgccccctggtgtggccactgccgcgagctcgcccctgaatacgccgccgccgccgcgcatctcgccgtccaccacaaccagaccgatctcgctcttgccaaggccgacgccaccgaggaaaccgacctagcccagaggtacgacgtccagggcttccccactatcatcctcttcatcgacggcgtccccaaggactacaacggcgcgaggaccaaggacgccatcgtcgactggatcaacaagaagctcggcccggccgtgcaagatgtcaccagcgtccacgaggccgagaggatactcaccggggatgacaaagccgtcattgccttcctcgacactctaaccggtgctcacagtgacgagcttgctgctgcttcaaggctggaagatagcatcaacttttatcaaacttcgattcctgatgttgctaagcttttccatatcgacccagcagcaaagcgtccatccatagtattactgaagaaagaggaggagaagttgaccttctatgatggaaagtttaaagcatcagccattgctgattttgtgtctgctaacaagcttcctttggttaccacactaactcaagaaacttccccttctatttttggcaatgcaatcaagaagcagattttactatttgctgttgcaagtgaatcctcaaaatttctgtccatctttaaggaagcagcaaagccatttaagggaaagctattatttgtctttgtggagcgagacaatgatgaagttggtgaaccagttgccaactactttggtcttactggacaagagaccacagttcttgcttacactggtaatgaagatgctaggaaatttttccttgatggcgaggtgtcacttgaagccattaaggacttcgctgaaggtttcttggaagacaaacttacaccattctacaagtctgaaccagtacctgaatctaatgatggggatgtcaaaattgttgttggaaagagtctggatgtaatagttttggatgaatcaaaagatgtacttctggagatatatgcaccgtggtgtgggcattgtcaatcactggagcctacttacaacaaactagccaagcatctaagtggagttgactcccttgtgatagccaaaatggatggtactaccaatgagcatccacgtgcaaagtctgacggatacccaacaattctcttctatccagctgggaagaaaagctttgagcctgtcacttttgagggggagcggacagtggtagatatgtacaggttcatcaagaaacatgctagcatccctttcaagttgaagcgccaggagtcaagaagggagagcatccagacggatggtgtcaaggacgaactgtagggcaggtcatgcattgatagatagctgagttttgaattttggttttataaaattaggtccgccaccgaatttcgcgttttcagcttaaacatcacctaaatctgtttctttatattatactatattaaagcaccagtttcaaccgtgaaaaaaaaaaaaaaaagcggcc

SEQ ID NO: 10009 - DNA, 1870 bp, Zea mays
cggcccgaagcccaaaccgcatgggcgcgggggcgagctgaccgagccggacccagacccactcgctcctccgcccccgccgcaatggaggagccggcggcggcctctgccctggaggcgcgcggcgacctgcgctcggcgcttcccttcctccccgtcgtcctccgcggcggcgcactcttctggccgccggccgcgcaggagtcgctccgggcgctcgcgctcggccccgacgtcagccgcgtcgcctcgggggacgttctcgccgacgcgctcactgacctccgcctcgcgctcgccctgcccgcgctgcccccgcgcgctgccgacggcctggcgctcttcttcgacgacctcctttcacgcgcccaggcgcggggctggttctccgaggtcgtccccaacctcgcacgcctcctcctccgcctccccaccctgctcgaggaccactacgccaaggctggccacggcgcctccgggctccgcgtcatggcgtcgcaggacgcgggcgtcgtgctcctcagccaggagctcgtcgccgcgctgctcacctgcgcgctcttctgcctcttccccacggccggtagggcccaggcgtgccttcccaccataaatttcgatggcctgttcgcgccgctgattcacaatgcgaggcaaagccaggagcagaaagtgaggtgccttgttcactatttcgagagggtgactgattctatgcctactggtttagtttcgtttgaacgcaaagttcttccccgccgagcgctctctgatggcgttccctatcctgacatccatgcgtgggtggcatctagtgcaccactctgccaattcacgtaggtattttcatcaggtttcatagaagatgaagaacaagaagcccttcaagttgactttgcaaataaatatttggggggaggtgccctttcctggggttgtgtgcaggaagagatccgcttcatgataaaccccgaattgattgtgggtatgctattcttgtcttgtatggaagataacgaggctatagaaatctttggtgcagaacggttctcacagtatatgggttatggttcctcctttcgctttgtcggtgactatttagataccaaaccctttgattcgatgggcagacggagaactaggattgtggctatcgatgctttggactgtccagctaggttacactacgaatctggctgtctcctaagggaagtgaacaaggcattttgtggatttttcgatcaatcgaaacaccatctctatgcgaagcttttccaggatttgcacaacaaggatgacttttcaagcatcaattccagtgagtacgtaggagtttcaacaggaaactggggttgtggtgcttttggtggaaaccctgaaatcaagagcatgattcagtggattgctgcatcacaggctcttcgcccttttgttaattactacacttttgaggacgtgtctctgcaaagattagaggaggtgatccagtggatacgacttcatggctggacggtcggcgagttgtggcatatgctcatggagtactcatctcagaggctgggaggagaaacgcacaagggctttttggtttggttgcttcccagcgacaggcccaagaatcaagtgcattacatgtccgaatagcaatagacccggtttttgtgagacgcgcagctctcctagggctgatttgatgattagggatccacaggggaggaattcccttgcaattcaatttttaatagcaagaggatttcttcccctcgggatcccggtcaccaaatcagctcttaggagtgtgtgcatgaacgaagttattgctgacaaaaaaaatgaaataaagataaaatcgccaaaaaaaaaaaaaaaa

SEQ ID NO: 10010 - DNA, 790 bp, Zea mays
  misc_feature (10)..(10): n is a, c, g, or t
tttggggaantgtttgtttgtttgatcttttattataaaagacgacgaagagagaagaagaaaacgcctgcaccatttgtaatctcgatccccgccgcacaagcttgatcggacggtcggacaccagacagtctgtcagagacaccaacgcccgggtccgctgccacggtgccaccgctgtttcccatgccggtcggcggtcgccgctccagttgaatttgaaggagcctgacggatcgatggcggccgcggcggaggtgtaccggcgggtgctgaaggcggtgcagaagcacgtcggtaggggcgccaccaagcagcgcttcctcgacttcggggcggccgagttccgtgcccccgtcggcacggaggccgacgctagggcgaggctgcggctcgccggggactatgcctacctcctcaccagcgtccaccaccacaaggatctgctgctctcgtacaatatagctgtggatcgatctgatgaaacgaagaagatactgaacaaatctgccgccagtgtaggcctccagcttcctgatgtctacaagccatgagtgcttcatttctgcatctatgtgtggtccatgatactgccatttagctatgcaacttcaccatttaccttgtttccaatgctactgttctctcaactctcaataacgagagatgacatttgtttattaatgatgtcattcatcgatgtatgaattccttctacaaaaatcaattgccagtgtgctatagtctgcacaaaatctaaattgtattaaaaaaaaaaaaaaaagcccct

SEQ ID NO: 10011 - DNA, 887 bp, Zea mays
gcacgagggttaaaagagacactgtgtttgcacctcaaaccaagaaggaaatcagtgaaatttcatggcacagaattgatgacctcttaccagctagtgatgatgcagtatctcgtgcagtgaatggaatgaagctgtacatggttgcaccatttttgacgggtcttaaggcttggattgccacacatcctccaccactgcatcagaaaccagagacatctgctagaggtactgtgtggagggcgaagggttcgtcgagcggcacaaccccagtggagaatcctgttgctaaagcaggatctgacgtgcagcacgctgtcgaccgccctggttgcagcttcagaaacttcaggtttgacaccgcaagcatcctgcaggccatggaggcttccttcctacgcacctaggatcctgacgaagcatccacacctgcacccttgatgtgtatagaccgcggaccagcgctatctgtgttgtcaatctgtctttgtttcatctttctcgccttgtatctgtactcttcacagcagtcctgtcagacgcttgaacctgattttgctgctgccccgtttggtggtggttgtccataaagttctaacgatggtgctgcaaagtctggaaagggccggatggggctgatggctcggatggggccaattcattgggccgttggagccactgccctgctgcgttgttctacaagagttgtcctcgcggttgacacagaaaggataaaattgcaagttgtgtctcagtttggcactcgaagggagttaggtgtgggtgtcgttttttttgtcatggctgcgtcgtctctaactcgaaaggataccgcagtttctccaggtattgtgtttaatagcgttatgtaaaaaaaaaaaaaaaaa

SEQ ID NO: 10012 - DNA, 1837 bp, Zea mays
cctcgaggccctcatacatattttggttccaaatcgaataacccaatgccgccgtagccgtctgcctcctcgctttcctttcgtccgtacgccgccggctcgcaccgccgacagtcctcagtccagaactccagatcgagcctccctcttcccagatcgggtcctaggctacagcagccgccgcatccgtcaccttcacaccgcgtgcgtgctctctctccccctccccctctccgtgcgacgactgggtgggctaccgccgccctacgcaaggtgccgagaacttcgccgatatctgcgccggagaagagcgcccaccagatcaggcgcttagaaggcgcgctggccggtggatgacgatggcgggtggcgggggactgaaccggtcttcatcgagggggcagctgccgccgcaagagctgcttgacgatctctgcagccggttccttctgaatgtgcccaaggaggagctggagtcgttcgagcggatcctgttcctgctggagcaggcgcactggttctatgaggacaactccgttgagcacaaccccaacctcaagtccctctccttcaaggacttcacttccctcatgttcaagagctgcactgctctccggccctacatcgcgcacctggatgatatctacaaggacttcaacaactacaagtttcgtgtgcctgtgtccggcgccatcatcctagacgacacttatgagaggtgcttgcttgttaaaggatggaaggctggggccagctggagctttcctcgtggaaagaggaataaagatgaggaagaccacacatgtgctgttagagaagttctagaggaaactgggtgtgatgtttctagactattaaatctggatgattacattgaagtttcaattggacaacaaagggttcggctctacatcataacaggggttaaaagagacactgtgtttgcacctcaaaccaagaaggaaattagtgaaatttcatggcacagaattgatgacctcttaccagctagtgatgatgcagtatctcgtgcagtgaatggaatgaagctgtacatggttgcgccatttttgacgggtcttaaggcttggattgccacacatcctccaccactgcatcagaaaccagagacatctgctagaggtactgtgtggagggcgaagggttcgtcgagcggcacaaccccagtggagaatcctgttgctaaagcaggatctgacgtgcagcacgctgccgaccgccctggttgcagcttcagaaacttcaggtttgacaccgcaagcatcctgcaggccatggaggcttccttcctacgcacctagaatcctgacgaagcatcaacacctgcacccttgatgtgtatagaccgcggaccagcgctatctgtgttgtcaatctgtctttgtttcgtctttctcgccttgtatctgtactcttcacagcaatcctgtcagacgcttgaacctgattttgctgctgccccgtttggtggtggttgtccataaagttctaacgatggtgctgcaaagtctggaaagggccgacttgcgatcttcgtgctgatggctcggatggggccaatccattgggccgctggagccactgcccgcgttgttctacaagagttagttatcctcgcggttgacacagaaaggataaaattgcaagttgtgtctcagtttggcactcgaagggagcttgtgtgggtgttgttgttttttttttgtcatggcagcgtcgtctctaactctaaaggataccgcagtttctccaggtatttctgtttaatagcgttatgtacctactcagttgctgtgccatgatagtgtagcctctc

SEQ ID NO: 10013 - DNA, 839 bp, Zea mays
aaaaaacgaaccgccgggccggccgggaccttcacttcacccacaaactagccggacaagcgaacaaaaggtgtaagagcttacgaccgacgcggccaaatcgagataagagcaagatgacgtcgtcgacggcgttcagccaactgttcccttccgccgctgcggtatcccccgtccctcgctgcgtctccctgcagctcttctgcgccagcggtggagttgtccctggatggaggagaagatgccgccgcatggccatggtgcgcgcggccaccgcggatgctgcggcgcccgcctacacctccgattccctcatcctctacttcaaggcggagggcaccatggaggagagggccattcccaagatcacagaatctcttgagggtatggagggagtcaaggacctggaggtgctcattgaagaaggcatcggaagtgttgtgttaacaaaggagacaactgtgcaagctactggagtagcctcgaacctggtggaagctatccagggagctgggttcaagctgcaaactctaagcttgagcttcgatgatttcgacgagccagcagcaggagcgggaggcactgtccaatccagcgagtgagctaatttgtggtgccgtgcgtggtgccaaatgcatataattcggtctcctgattttgtttaccctgctccttacctttgatttcccaagcacgatcttgttttttttttggcaaatggtcgagaaatcaatgaatatttttaaggaaaaacatttgttttttttggctaaaaaaaaaaaaaaaagaggccttaagtaaatccagttggcaacaaaaaaaaaaaaaaaaaagcggcc

SEQ ID NO: 10014 - DNA, 804 bp, Zea mays
  misc_feature (766)..(767): n is a, c, g, or t
ccgacccacaaactagccggacaagcgaacaaaaggtgtaagagcttacgaccgacgcggccaaatcgagataagagcaagatgacgtcgtcgacggcgttcagccaactgttcccttccgccgctgcggtatcccccgtccctcgctgcgtctccctgcagctcttctgcgccagcggtggagttgtccctggatggaggagaagatgccgccgcatggccatggtgcgcgcggccaccgtggatgctgcggcgcccgcctacacctccgattccctcatcctctacttcaaggcggagggcaccatggaggagagggccattcccaagatcacagaatctcttgagggtatggagggagtcaaggacctggaggtgctcattgaagaaggcatcgggagcgttgtggtacgtcaggttttcttgctgccactcgctcgattagtgctcccactgggcactagttagtgcgcttcatctgtgcagattggttttctgctgcacattgcagcagttcgtctgaaactgtacctgcaaccatgtcgagatacagttttaatctatctcctcgttttgttagaaagagtttaatccgtagttagaggtggagcacagttttccagaaacttgaatatatggtagaaacattcggctgtaaagaagatgcttcaattgaagccgccagggttaagtgaaagaagaaacaaatagacactagaatcttagagtttcagcattgccagctgttgaaagcctaattttaggnntcaatattttaaacaagatctctgaaccagatttcgg

SEQ ID NO: 10015 - DNA, 845 bp, Zea mays
attgggacctcgaggcggcgggcgggcgtcaccggtacctcgccgccgccggagccggacagctgcacaaaaggtgtaagagcttacgaccgacgcggccaaatcgagataagagcaagatgacgtcgtcgacggcgttcagccaactgttcccttccgccgctgcggtatcccccgtccctcgctgcgtctccctgcagctcttctgcgctagcggtggagttgtccctggatggaggataagatgccgccgcatggccatggtgcgcgcggccaccgcggatgctgcggcgcccgcctacacctccgattccctcatcctctacttcaaggcggagggcaccatggaggagagggccattcccaagatcacagaatctcttgagggtatggagggagtcaaggacctggaggtgctcattgaagaaggcatcggaagtgttgtgttaacaaaggagacaactgtgcaagctactggagtagcctcgaacctggtggaagctatccagggagctgggttcaagctgcaaactctaagcttgagcttcgatgatttcgacgagccagcagcaggagcgggaggcactgtccaatccagcgagtgagctaatttgtggtgccgtgcgtggtgccaaatgcatataattcggtctcctgattttgtttaccctgctccttacctttgatttcccaagcacgatcttgtttttttttttggcaaatggtcgagaaatcaatgaatatttttaaggaaaaacatttgttttttttggctgattcgtgaagttagtgatggcttaagtaaattcatttggcagcgctcccagaaaaaaaaaaaaaaaaaa

SEQ ID NO: 10016 - DNA, 1511 bp, Zea mays
  misc_feature (1345)..(1345): n is a, c, g, or t
aactcctttcccccctcccgttccaactttattgtcggggccccactccaccggccgcccgggagggagaaagttagatccgtgttccgtgtccgcgtccagtgtgtccgctccccctcagtcctagcggtagcgtgcgcgcgggagacgtagatggcggcttcggcggcggcggcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtcgatgaaatgaagaccattgctgagcaattcagcgtagaggccatgccaacattcctgttcatgagggagggcgacgtcaaggacagggtcgttggcgcagcaaaggaagagctagcaaggaagcttgaactacacatggcctcgtagatcagtgatgccgtaatgtagtattcgcctaaataagaggacgcctcgcctcaactctgagaaaactagtgcttctgtgatggtaattcgtatgagagagtgccccctttggtggtacttcttcgtatgtagtattaactcctgtcttaatatgttgccctgcttgtgcttttcaaaaaaaaaaaaaaaaaaactgcttgtgcttttcataccatgtttgctctttcagctgaggtgttatacggtaaatcggagtcaatatctttgaaattgattaactgtagtcacctagcttttttccctaacagccagcttgtttagccgcgatgcgtgggttatttcggacagccatgtcttctcaggccagtatgctttctcttcctgaacactcaagtttccagaattacggtcttgtctggtattgagaaccgatatttgcgtgttcatttccaaatcaatgttgaatgggacatttttttctcatctggtattctggtggcatttttgcaagaaatgctactgttaatttcaattccgttatttgtacccctataaaaaccacaacttcaaacattgctagagtcatccaaccaaatgtccatcacaatctacagttcttctaaatgaaccaaacaaactacgcttagattcatctcaaatcgatcatacttttgaaatcaagaaatgagatcagtttaaacttctcctttctcttatctaacgaccaatcttatttgaatcattctacctcatcattaatcatcaaccatgtatatctatatttatatcactataaatctttatnaaacccaccacttcaaacattgctagagccacccaaccaaatatccatcacagtttacacctctactaaatgcaccaaataaactgcacctagattcatctcacctctcatttctcttactcaaatctaaaaatcaatcttaattggatcattcaacctcatcatc

SEQ ID NO: 10017 - DNA, 822 bp, Zea mays
ggcgggtgccgctcgcgcgcccggcagctaccggagcgcgtcgcgggggggggagagaaagtcagatccgtgttccgtgtccgcgtccagtgtgtccgctactccgctccccctcagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtggatgaaatgaagaccattgctgagcaattcagcgtagaggccatgccaacattcctgttcatgagggagggcgacgtcaaggacagggtcgttggcgcagcaaaggaagagctagcaaggaagcttgaactacacatggcctcgtagatcagtgatgccgtaatgtagtattcgcctaaataagaggacgcctcgcctcaactctgagaaaactagtgcttctgtgatggtaattcgtatgagagagtgccccctttggtggtacttcttcgtatgtagtattaactcctgtcttaatatgttgccctgcttgtgcttttcataccaaaaaaaaaaaaacagctgaggtgttatacggtaaatcggagtcaatatctttgaaattgattaactgtagtcaaaaaaaagcggccgccccta

SEQ ID NO: 10018 - DNA, 1665 bp, Zea mays
aaaagccgctcggttcgctcacctgcctgtgttgcgtacttgcgttgcgacttgcgagtgggcggcggagtgcccgagtcggtgcggccgtgcaggagcgtttgctgtctccgtttccgtcccgttccctttcgtggactgttttggaaggcgttgcgatgagacgctgcggcggcggcggcgaggagtgcatccctcggcgatgagcagaatcaccaccggatcttaatctcccttgcctcgtttgcggcgagcctgcgctgtcggcggcggcgcaccccctccccttcccccggcgcttccgtctgctggctggactcagttcttccaactcggcccttaacaagagaacgacgaccatgccgatgcgtggcgtcgatttcaagtggtatgatgggttcttcctctccatgctcgccactagcgtaattatcgtttccattaattggaagaggtatcgcctgtgtgcccacccgctccacatttggatagtggtggactacaccactgtcttcatcttccgcctcctaatgtttgttgataatggtctcgctgcaggaatgggattagatctcggatggcaacagagatatgctcgtttttgtggaagaataattgtcctctcagttcttgtgctacttctctacccctttctctgggtttggactgtgattggaacattgtggtttagcactgcaagaggctgcttgccagaggaaggacaaaagtggggcttcttgatatggctgcttttcagttactgtgggctcgcctgtattgcttgtgtagctattgggaagtggttacaccgaagacatgcacttcaacagagagcacaacaaggaattccagtctctgaacatggggttttagttgatatgatccgtgttcctgactgggcatttgaggctgttggcctggaaatgagagtgggtcaagatactgcatatcatcctggtctttatttaactgatgctcagagagaagcagttgaggcactgattcaagagcttccaaaattcaggctgaaagctgttccaacggactgcagtgaatgccccatctgccttgaagaatttcatgttggcaatgaggtccgtgggctcccatgcgcgcacaatttccatgtggagtgcatcgaccagtggcttcggctgaatgtcaagtgcccacggtgccggtgctccgtcttccccaacctggacctgagtgcgttgaacaatcttcggtcgaccagcgagccggaccatccatccgccagcgccagcaatgtaacgacggcaactgcagcgacgagatacgtgaggtcgcagccggcaggtcaaagctatttggtgcggttgcaggggctgctgctccgccctgtccggcacgatagcgtggagagtgacggtgagccggcggtgggcaacagtcgcttggttggcaccgaagagctgcctagcatacttgtagacgatggccatcagctgccagatcgctgactgatttgatgacctgatggatccagcatacttgtcagcataatttaggatacttgtcagcttttcttttacagttttcttttgcaaatgaaatgcgagttttgttgaaagaattttttttaactgaacactgaaataagcaaataaaattatttagctcaaacgaaaaaaaaaaaaaaaa

SEQ ID NO: 10019 - DNA, 914 bp, Zea mays
gttttctgaagtggtggctggaaagcctctggatcgggcatatcccacccgtccggtggcccttgttgaagctggatgtattaatcttgctaaacatatatcaaacacgaggagttatggagttaatgttgtagttgcaatcaacaaatttgcatcagatactgaggcagaaatgaaggcagtgcacagtgcagctatggctgctggtgcttttgacgctgttgtctgcacacaccatgcccatggtggtaaaggagcggttgagcttggacttgctgttcaacgagcatgcgaaagccaggcagaacctctgaagtttttgtatcccttggaatctagcataaaggagaagattgagtcaattgctaagttctatggtgctagtggcgttgaatattccgagcaggctgagaagcagattgagatgtacaccaagcaagggttctccagcctccccatttgcatggcgaagacccagtactcattctcacatgtcccgtccatgaagggcgccccgaccggctttgttctgccgataagagacgtgagggccagcatcggcgctgggttcatctacccgctcgtgggcaccatgagcacgatgcctggccttcccaccagaccctgcttctaccagatcgacgtcgacactgccaccgggaaggtcatggggctgtcatgaattgaagtccctgatggtatcattcagagaacgtaaattcggggcattcctggatcgagttaaataagagccgttcctggcatcctgcaagttcagtggcgcttcctttttttacttgattttgtaaaccggagactgtaaatgtgcttgaaccgtgcttttagacccatgcctcaaatcctgcatccaataagtgtctttgaagtgcctgaggctgctgagactgttgacc

SEQ ID NO: 10020 - DNA, 1366 bp, Zea mays
gggtacctcgaggccggccgggataactctccaacggactagctataaagcaaagcaaagcaaaagcaaaagcgagagagaaacaaaatagaaagcgaagagacgacgaccatgttcccgtcgccagggagggcggtgatggcgctgggccacggtggccagcacatgaccgcgtcgtccaccgccggcggcatggcggcctcctcgtcgtccacccccaccataacgttcgcgttccagcagccgtcccctccccctcctccgacggcgacgagctccctcgccctcgcccacccccaccaccatggcgtgctaggttacggctccgcctgccttctcctggaccaccaccacccaaccaccgccacctcctcggcctctccctcgcacgcggctccgtccagcgtcgtcccggcccccaccctccaccaccacttccatggccatgcagcaggagcgccgcacgtttccctttcccctcccacgagggcgtcgcctcctcctcctcatccatggtcgacggcggcggcctgcgaagaagagccggagccgcatcacgatcatcgccaacaagcaggccaaggcggcagaccgccgagggggaagggagcggcggtgagcgaggggtcggcggcggcgctgggggtgggcgccgtgcggatgaagaaggcgggcggaggaggaggaggcaaggcgcggcggaaggtgcgcgagccgcggttctgcttcaagacgatgagcgacgtcgacgtgctcgacgacggctacaagtggcgcaagtacggccagaaggtcgtcaagaacacgcagcacccaaggagctactaccggtgcacgcaggacaactgccgggtgaagaagcgggtggagcggctcgccgaggacccccgcatggtcatcaccacctacgagggccgccacgtccactccccgtcccgcgacgaagacgacgacgccgctcgcgccaacgccgagatgagcttcatctggtagcctgcagatccggctccgaccggcggctatctttcagtgcatgcaacgtcgtctactcggccgcctccggtctaagtttcgccagccaccagcagcagctgaatatcctgaatttagctattatatccatccatgcatcgaagaactctctcatcgatcgtgtgtgcatgtggcatgtctaggcattatatgtattgctatgtcgatcgatctttatatatatacgcgaatgatgtccgtcgcaaaaaaaaaaaaaaaaaactgcatggtcctcctagctactgtcgtagttaattagctaataatatagtagtgcatccaggttatggactaaataatacttatatacatagcagctacctgacactacagt

SEQ ID NO: 10021 - DNA, 1450 bp, Zea mays
aaacagcgcctaagaaagttacaataactttaatttgagttggagtgagtaataatctgataagaatggcatcatgaatagtggtcggacgtgaccgtgatgactgataacactgatgaagtgctctgggttccagttttggcggcactgttcataggtccggccatgtcactcgctccttctctcccccagctgctccaccgctttcacaaaactatttgattttgtccctaatagctctcactccaagcagtttatatcactagtcctgactcctgaaggaaaagaaagcaaagcaaaagcaagagagagagagagaaacaaaatagaaagcgaagagacgacgaccatgttcccgtcgccagggagagcggtgatggcgctgggccacggtggccagcacatgaccgcgtcgtccaccgccggcggcatggcggcctcctcgtcgtccacccccaccataacgttcgcgttccagcagccgtcccctccccctcctccgacggcgacgagctccctcgccctcgcccacccccaccaccatggcgtgctaggttacggctctgcctgccttctcctggaccaccaccacccaaccaccgccacctcctcggcctctccctcgcacgcggctccgtccagcgtcgtcccggcccccaccctccaccaccacttccatggccatgcagcaggagcgccgcacgtttccctttcccctcccacgagggcgtcgcctccttcctcctcctcatccatggtcgagccgctctcgctcgctcatgtccctctctctccctccccccttcaagaaagctagtttctcgtacatacacgtgtagcgtgcgtgaccgtgaccgtgatcctatcctccgtgtcaattaggtcgacggcggcggcctgcgaagaagagccggagccgcatcacgatcatcgccaacaagcaggccaaggcggcagaccgccgagggggaagggagcggcggtgagcgaggggtcggcggcggcgctgggagtgggcgccgtgcggatgaagaaagcgggcggcggaggaggaggcaaggcgcggcggaaggtgcgcgagccgcggttctgcttcaagacgatgagcgacgtcgacgtgctcgacgacggctacaagtggcgcaagtacggccagaaggtcgtcaagaacacgcagcacccaaggtactcgctcgctcgcatcaccatacgcgtgcgtctgcatgctgggccgtgcacggacgtcgagtattacgcacttgctagctagctagagcctagattcatgggctagctcatggccgcagtccagcacatcactacacatttgctcggttaactcccgagtcccgatcacgtgcgatccatgccatggcttaccaacgattatatataactgcactgcaatttagtttcaaatctgtcgagcatgctttgcttccatgagatc

SEQ ID NO: 10022 - DNA, 1086 bp, Zea mays
ggccctaggggcctttttttttttttttgttattagccgtctgccgtcgatgatatgtaattatgtatggcttgaacgccttattccaaacttatatgtcaatcgggttaacaaaaccagatgatggcctgcatcttgacatgttgcaaacttgcgacaagctagcagagcactgtgtgagatcagtcaaaaaagcagtccctgtgcgagatcagacaaaaagcaactacgcaggcactgctcaaataccaacagtaatgaccctggcccgttccgtttttccagtacgtttccgtcgtacgtttcccttcagttcaccgacgatgatgtcccggacaaaggctcgtgcacgacgacgtcggtagagacgaagacggggctgtcgttcagcctcagcatgatggccctaaggatttctgtgagcgacttcttgaactccgcttcatccactgcctttccttcttcgacgcccgctgtcttgatcgactcttccacgacagcatccacctctttcacagcaccgtaatatggcaggcttgcagcatcggccatcttgtcaagcgcggctatgaggcactccttggacgccttgttcttatcttctgctgccaaacctttccaaacagaatccagcagcttgtccaactcgaatttgttggccagcagcctcttgacgccactcccgtcatagtggttctcggtgtgcgcgacgatcacaggctgctcctgcagtcgatcagcgacggcgcccagcagcttcttcagctgctggaacaggtcatcgcgggaggccggctgctgcccaggctgatcggcaggaagaagctgctgcaacgccggctccacgatgtgcttcgcgacccaggcatctgaagccgggggcactccgtggtcgacggacagcttctgtagagcggccaacacgcattggcgcggtgacgcgacttcggaaccgagatcgacgacctgcgagaaaacggcggcagctgtgggctcgtatctgctgccggcggcgaagtccctgcccgccccgccgcccgggccccgttgcacgagggggtccctcttgagccccgccgccggcca

SEQ ID NO: 10023 - DNA, 1092 bp, Zea mays
gtaggcttctcctaaatgcagtggggcaaaaaagagtggaagttctccaagagtagtgaaacaaagagcggattggaatccaggccttgagaggtctcttgttgacattctccatgaatttaaagaaagtggataaagaggtgacaatggttggaactccgaagggtggaatagaatggtcaaggagtttcatgtgaggaacaagtatgtctcctttacaaagtctcaaattcaggataaagaaggtcagctgaagagagactacaagatgctcaaagcagcaaagcaacagagtgggtccacctggaatgagaaaaggaatatggttgaaggaccaccagctttgtgggagaatcttatggtgacatttcctaaaatcaagaagtttaacaacaacaaggcaaccttcccgctctttgatgctttgggagagctttatgatggacacttggctgaagggacttggaattgcacttctcttgaggcaccgcaagaggaagaaccgaatgagcaacttcaggatgcagaagatggaccacaaggctttgatctgaatgttgttcatgatgtagatgatgaagttgatgatgcactcactgaaaggaatgaagatatgcttcaaggaagggctaatactctgtcacgagatgaagaaagtggacagcgaagacctgctgcgtcaagaaacaagcaagaaaaggaaccaaagaagcctagaaagactgacaacatagaaaatatgatgaacaaatacctagaaatgaggagcaagcaagtagaagatgaagctgcaagagaaaaggaagcaagagaaaaggagacaagagaaaaggaggcagctcaaagtgaagatttctccatcaaaaggtgcatatcagttctgaacacaatggaagaagtgaccaaactggagaaggcaaaagcatattcagtcttcaccaagagcaaagagaatagagagactttcatatgtgcatgtgaagcggatcaagaatcagctttgatttggctaagaaatgagatggcttagtaggtatgatatttgtgtctttaccttccactcaaccatattcacttgggcctttatattcc

SEQ ID NO: 10024 - DNA, 1618 bp, Zea mays
agggagcgccatcgccacgtcgacatcaaaacccatccacctcccttcttcctctccagtccccgcgtccgcaaccccacccatctcctccttcacgaaccttctagaaccccgtccagaaccctacccaaccatggcggcctccctcctctcccgcgccgccgctgccgccgcggcgctgcgcggcgcggcccggccgaaccacctcctcgctcgggcctccctccccaagggtcgggtcgggtgggcggcgcgcgcggcggagggcgccggtgggccccggtgcggcccgtcgccactgctgggcgcgttcgggatcgcggcgcggtgcaacgccacgtcgtcttcgtccgcggtgtccgaggccaccggcgtccacacagtgcccccgacggagcccgtggtgtcggccgagtggctccacgccaacctcaaggaccccgacgtcaaggtacttgatgcctcttggtatatgcctgcagaacaaaggaatccattacaagagtaccaggtggcccatatccctggtgctttgttctttgatgttgatggaatatccgacagaacatctagtttaccacacatgctgccatctgaaaaggcattttcagctgctgtatctgctcttggcatctacaacaaagacgggatagtagtttatgatggaaaggggctgttcagtgctgctcgtgtttggtggatgttccgtgtatttggacatgataaagtttgggtgttggatggaggtttgccccaatggcgcgcttctgggtatgatgttgaatcaagtgcctctagtgatgccatcctaaaggccagtgcagctggtgaagcaattgagaaagtttaccagggtcaattggttggtccaaccacatttgaagcaaagttgcagcctcatcttctttggagtcttgatcaggtgaaagagaacatcaacacccagacacatcaacttatagatgctcgatcaaaacctagatttgatggtgcagttcccgagccacgaaaggggattagaagtgggcatgtgcctgggagcaaatgtgttccgtttcctcaggttcttgacagctcacaaaagctattgccttcagatgagctccgtaaacggtttgagcaagaaggaatatcacttgatcagcctcttgttacctcttgtggcactggtgtgacagcatgtgtattagccttgggccttcatcgacttggcaaaaccgatgtcgcaatttatgacggatcgtggaccgaatggggcgcccatcctgacactccagttgcaactgctgtttagtctcttcataataggacgcccgtgctcttcatagaggacctcttgattgtatttgccccgtgctgtgattctatggaggttggttggatgcttggatgtaaggctggggaagcgaagccttttggccttcactgtaaaagctgcaacagaaaaactgtcacatgcactgaattataagataactccccttgatctctcgtcttggttgattaataatgctaaagtttgtctgctgtatgtgagctaactatacttatatgcacataaatgtacatatctacagacattcaaaatcctcgggtgcagaagcaccgatctgtggtc

SEQ ID NO: 10025 - DNA, 1596 bp, Zea mays
ttgtacagcagcccatccgttgttttcacggccgccgcggcggcagccctgctccttgttccttgcatgccggcagctaaccaagggcgtacacgtacgtgaggtgccctgccggagttgtttgcagccagcacgccacggaagcgggtaggggtagcgctgagcctctcgctcgcgttttttgcaaggaacaaacatgtttgccactggtctaaaagagagaaaaaaaaggactacatattatgccggcgtccgcgtgtcaccgcgcgatgagcgagcctatggcgccggcgatgagcgcggtgggatcgccgagcaccgcggagatgacgacctgcgcggcgaacccggcgatctcgcagcagcgcttggccttgcccttgtgcttgccccagtacgagtacctccctcccccgctggcgtggctgctcttcgccgcgcccctgatcatcgccggcacccagtacccgccgctgccgggcaccaccacgtggcccgccatcccctggtcgcccttttggcgcccgacggagtgccagctctcgacgagcatgtccatgacgcacgccacgtggaggctgtagcacctgcactggctccggtagctccagccgcggccgcggtgcccgcagcggtggcacgcggcgccagagccggtgtccgggtgcaggtgcagcctgaccccggcgccggcgtccagcgcgtgcggcagcgcggcgcagcacgggtgcaggtcgaagccgcaggcgcggcagtggtagacgtagccggccacgtcgcggccgcacgcgttgcagtagcgcgcccccgcgccccccggcgcgcgcgccaggaacacgaacgcgcagcgcgggtagaacgggtgccgcagcggcgccggcgccggcagcgcgcactgccggtgcaggtcgtggtcgcagcccgggtgcgggcagcggaaacgcgccccgatgcccacctcgccgcacccatcgcaccggaacggcgtctccgcgtgctccagccggagacggtgctgcgggtggctcaggtgcgccagctcgccgtacctcatttctggctgcgggggtggctgtgggcgagagagagagagagaggcaaatgtttgtattggagttggaggccagctagctggtaatcccgcacgacattcccttctatacgtaggcagccagttgaggagcatctggtcctggatttcggtgaggtgatcttgcgtgccttcatgatggatggaggccgagcagaggatgataagagcgcacaaattccatgctgcgtaagattggaatgtcccccagcacgttcaacatagctgtcacctgtgtagctgtgtttatctaggccatttgtgatggagagctggagacccggcgcatcggtcttcccctggatgctctactgtcgtgttgagttatggagcacagtacctagggcacttatggattgaatttgtcctgattctcatttctttccgaaaagcaaggcccgacccaatgaccaacctgagaatgagttcttttgcagggaagggaccaaggttgaggatagggccggaaaataagctcgaggctcgcgagccgactcgagctagag

SEQ ID NO: 10026 - DNA, 1757 bp, Zea mays
ctgcaggaaacagaaaaagaacttgtcacaggaaaatcccgtctgaagctgactcttgcttgaaatgcttagctaacctgtggtgaagcatgcttgcggtgtctaaaacactcactcgatggtgcaggaaataattcgggaggatgatgagaagctgcaagctttgaaggctgaactgggtgtgcaggcgcacgatgtggtcgtcaaggccctccttgagatgaacgagtacaatccaagcggcaggtaccccataccggagctgtggaacttcaaggaggaccggagagcaccgatgggcgaggcagtagcctacatagtgaagcagtggaaggtgagcaagaggaagcattaggcgggcctgatgcctgatggcccttgtgccattggttcctgggtcgatgtccctgacagtgagagctgagaccctgatcccctgactttttctgctgatggaagacctagtaccagtagcactactaaaaatttgtccgatctcttggagggttagattggctatgggctatggcacctagtgcaatgatctatacgtataaaaaaatatctgtagtgtttaatgattttaccagaactagataaagattatagaatatttattattatacatgttgtgttggaaagtgaacatagagagaacgttacggcttccggagagatcatcgtagtttctttgcacgtctcgaattccgccaatatctcacccgaggcccaaagccttgttgagctcctgaagcgaggagtccaaaagtaggcccaaaataacattttctccagcaaggcccaaacaggcaaatccagtctggtctgctgctggcgtcaccgaccgcaggcaaatattcccaaccgcaacgccagccgcacgggagagaacccgggagccgccgccctgccttccgctgccgcgcccgcagtttccaaattcgtcttgctccgctcaatcacgcgaatacctgacctcctccgttccttgttccttcgtcgtcgctcccggtcgcagtcgacctagcgaaggagcagcgcaacatgcaaacagtacggagtgcggtgctgcagcacctccggctccgcgcggcggctcctattgctgcacgtggaggcagcggcgggttcgctcggaggatgagcgcgccggcgggccaggaggacagtaacggcagcagctccgaacccgagagggacatcaggacgcgcgtcgttaacctggtcaagaagttcgacaagatcgacgccgacaaggtgaccgagactgcagacttccaaaaggacctgagcttggacagcttagaccgggtggaacttgttatggcctttgaacaagagttctccgttgagatccctgatgacaaggctgacaagctgacctgttgtgcggatgttgccaagtacatcatatctgaatctcaaacgagtgatacaaatgccggtggatcctgagggacagatgaaaccgagtgcaatgtttcttttgtgtgtgtgtgtttatcataatgagtctgggttacaaaggacgatctgtgcgcatgatttccttttagtttttccagtatggaaaaaaatatctctacctcggttaattgttacaaagtgaaggttttttttatatgtcgatcatggtcatggatcatgttcatgattttccaatgctagtatgttttcttaactagtatttatcataactagtatgtgtgtgtgtgtttatcataactagtatgttttctccaaaaaaaaaaaaaaaa

SEQ ID NO: 10027 - DNA, 1403 bp, Zea mays
tctactacgactacgccaggtgtctaggtcgctgccgccctacgcctacgccaggtgcccagctcttgttcggcccgtacgccggcgaggagcaccaccagggatactaaatatgcagaaagatgctcgtcgaaattcttggaaaataattaacgacaatattagattgcataaagaactggaaaccaagaaaaaagaaattggcaggagacacgaggaacttgagaagttggttatgaacagtactaacagagaaaagcttgaagcggcaaaagaagagattgcaaaggagaacaggcttctctatttagcaaccctaaagaagaaggaagaagatgagaagttcttaaaacttgtaaaggaacaagagcaagagaaagaaaatgtcaggaagatggtatatgatttagaaatgcagttggcttccaaacaaaaacttgaactggaaagagaactgttgagggggaatcttgaggtatggaagtatatgggagaggaagatgcaaaatcgaaggaaatgctcgataagttgcatgaagcactgaaagagaaagatgaagaaatggagcatattgattctatgaaccagacccttattattaagcaacgaagaaccaatgatgagctggaagaagccaagaaagaactgactactgacctagttaatatgtcatcagctcgatccattgttggtgtcaaaaaaatgggtgagcttgacaataaagctttccttgcctcttgcaaagagaaaacagcagacgagttgtcattgtcaattctgtgctcgaaatgggaagatgagatcaggcaaccagaatggcatcctttcaaagttatagatgttggtggacaggcaaaggaaataattcgggaggatgatgagaagctgcaagctttgaaggctgaactgggtgtgcaggcgcacgatgtggtcgtcaaggccctccttgagatgaacgagtacaatccaagcggcaggtaccccataccggagctgtggaacttcaaggaggaccggagagcaccgatgggcgaggcagtagcctacatagtgaagcagtggaaggtgagcaagaggaagcattaggcgggcctgatgcctgatggcccttgtgccattggttcctgggtcgatgtccctgacagtgagagctgagaccctgatcccctgactttttctgctgatggaagacctagtaccagtagcactactaaaaatttgtccgatctcttggagggttagattggctatgggctatggcacctagtgcaatgatctatacgtataaaaaaatatctgtagtgtttaatgattttaccagaactagataaagattatagaatatttattattataaaaaaaaaaaaaaaaaaaaaaaaagaagataaaaaaaaaaaaaaaa

SEQ ID NO: 10028 - DNA, 1129 bp, Zea mays
ccccgcgcccggttcccaaaggaaagccccacaaaacctcggttgctccccttggcccttgccatcctcgttcctatcgccagttcgccacctcctttgctctcgcctcgcgcgcgctcccccccgcgcatcgtgccgttcgccaccgcaccgcgccgatggaggtcgccgccgtgcccagatccgccgcggcctgccgtgcggcgcccctgctcccggccgtccgagccgctgcgtgccacctggccctgccccggcgcgcgttctccgcatccgtcgcggcggcaccggcgccgcgccgcctcgccgctcgtcgcgctgcggatggtgacagcgtggagacggcgccggaggcggtccccattgagaaaaggttccctcccttcccgagcgtcatggacatcaaccagatccgcgagatcctcccccacaggttcccattccttttggttgatagagtaattgaatacaaggctggagaatatgcagtggggatcaagaatgttacaataaatgataatttcttcccaggacattttcctgaacgccccataatgcccggtgtcctcatggtcgaggctatggcccaggttgggggtctggtgatgctgcaacctgaagttggtggatctcgagacaacttctttttcgccgggattgacaaagttaggttcaggaagccagtgattgctggcgatacactgatcatgaggatgacactgactaagtatcagaagaggtttggactcgccaagatggaaggaaaagcttatgttggtggtgacctagtttgtgaaggggagttcctcctagtcagcgcaaccgagtagtgcaaagacacttcatgattctctgggaagaatcattggttggaatcagatctggttggatgtttgaaagaaccgagttttgaactaattatacaatcggcagttgaggcgatcctttacctgttcttaagcatgttgttgagtccatgtggtgatttctatcggttaccaagggcccaaggctgaatccacgccatgttatgttgcaattgaggattacaatatattgggtaattgtttgatggaataaacgataatgcttttgtaaaaaaaaaaaaaaaaatgccaaaaaagggtta

SEQ ID NO: 10029 - DNA, 1481 bp, Zea mays
aataacaactgcgagggaaacatcagaacccgctcccgcctctccgttctactactactcctttccggcggaccggcgcccggcggcggcggaaccgcctaagcaaaacggatggccccgagaggcggccgcgaggaggctagttctggctccgaggatgaggaagaggaggccgggttctccaggagctacttcctggccaaggagaaggagccgtcatccgtgaagaagcgcgcccgcgccgccgcaggcaagctctccgacctcaacctcgtcgacgagcaggtgttgcgtgcatcccttgcacagatccccccgaagcacaaggaagaggtggagtccctaacgagaagctacaaggaccagtaccgcaactggctgttcgaactaagatgcggttttggtctcctgatgtatgggtttggatctaagaagcagttactcgaggattttgcctccaccaccttgactaatttcactgtcgttgtaatcaatggctaccttccggccgtcaatttgaaacaggtcatagcaacaatagctgaaatgttctgggatcaaacaaaagctaaacgcaggaaacgtgcaggaacaaggtcccagttgtcacagcagtttccgtcacaatcaacagagggtatcatctcattcctaatgagacagacatctgacgatgtggatgatcacgtgtgccttcttattcataatattgacgggcctgctttgcgtgatactgaatcacaacaatgtctagcacaaatttcttgctgcccacaaatccgtgtcgttgcatcaatagaccatgttaatgcccctttattgtgggacaagaagatggtgcacaaacagttcaagtggagctggtaccatgtcccgacatttgcaccttacaaagtcgaaggcgtgttctacccattgatccttgctagtggtggtcacgcccaaaccacaaaaactgctcttgttgttctgcagagtctgacaccgaatgcacaaagcgttttcagagtccttgctgagtatcagttggcaaatgagaaggaggaaggtatgccagtcagcagtttgtatacaaaatgccgtgagcgctttctggtaagcagccaagtgacattgaatgcacacctgacggagtttaaagatcacgatctggttaaggtcaggaagcactctgacgggcaagattgcctccgcattcctcttgtttctgacgcgctggagaagttgctgcaagaattggcttgacattttgcattagcgcatttatttttcatggatgatgggttcactgaagtattgtagttttctctgcccacgtgcaactgaaggatcttgtccttattgaaggaaagtgtattaccatggaaagaactcagatgagcatgccattgcatggattatttataactcggattccggaactgaaagcatgttgcatgaaccgctctgctttgttggcttaaaaaaaaaaaaaaaaaaaa

SEQ ID NO: 10030 - DNA, 1180 bp, Zea mays
cttgcatgcctgcagaagagatggtgctttcagaaaacctgttgcatgctgctgtacggaggaagtctgttaacatggttagatttctgctgagatacaaaccaaataaaaactcgaagggaactgcacaggcatacttatttagacctgatgctctgggcccttcaaagattacccccctccatatagcagctgccactagtgatgcagaggatgtgttggacgcgcttacccatgatcctggactggtattctcttttctagttcttggaattttgtccctcttttttcccaccacctcaagctgagctatattaatttacaacagtagatcatgggaaacttagtaaattatcattcttttgatgttttattctttcattaaatcacgcacttacacgtacattgaactgtgaaatgatgaatacatgagtttccagatgtcagatgcattgcatagattcaaaatttgactaacagagttgaatggtattagttatatctgacattccatgtcccgtgcagattggaattagtgcgtggagcaatgcacgggacgaaacaggttttaccccagaagactacgctcggcagagaggcaatgacgcttacctgaatctggtccaaaagaagattggcaagcatcttggcgaaggccatgttgtcctcggtgtcccgagcagtatatgccctgtaataaccgatggcgttaagcctggcgatgttagcctcgagatctgcagggcaatgtctgcatcagtgccgggttgcctcctctgcagccgtcaggcacggatgtatccaaattctacggcgaggaccttcctttataggccagcaatgttaactgtgatgggagtcgctgtggtttgtgtctgcgtgggcatactcctccacacctttcccagggtttatgccgcgcccacattcagatgggagctgctggagcgtggacccatgtaaattttaggatgaaataaacctagcagttttgtaacttgagagctctagcgcaaaggaacataattaccgtgtgaagaagttcctttgcatttgcagcaagatccggttgctgttgtaagcttatatatcgtcaatatcaactatatttacagcctaacatgcttcgattccattaatcatttttattgtagaatttgtttcaaaaaaaaaaaaaaaa

SEQ ID NO: 10031 - DNA, 2972 bp, Zea mays
gaggaaaagggccgtggtcgttgatgatgatgatgatgatgaaacggaggatcaggacagggtcgtgaatggtggtgggtcgctcagcttgataatagggggtacggctgctggtgctggagcgatggagaacggcgatgtaaatgaggatgagagaaatggaaagaagatcagggtgcaaggaggcggctcaagtgggccggcatgccaggttgagggctgcggagcagatctgactgcagcaaaggattatcaccgtcggcacaaggtctgcgagatgcatgctaaggccaccaccgccgtggtcggaaacactgtccagaggttctgccagcaatgcagtagatttcaccttcttcaagaatttgatgaagggaagcgaagttgccggcgacgcttagcaggccacaataaacggaggaggaaaacccgccctgatactgcaagttgtgggactgcttcaattgaggacaaaatcagcaattatctactgttgagccttattggaatctgtgctaatttgaactctgataatgttcagcattcaaatggccaggagttgctatccactcttttgaagaacctagggtctgttgccaaatcactggagccaaaagaactatgtaaactcctggaggcataccaaagcctgcaaaatggatcaaatgctggaacctctggaacagctaatgccacagaagaggctgcagggccatctaactctaagttgcctttcgtgaatggtagtcattgtggacatgcatcatcatctgttgtgccagtacagtcgaaggctaccatagtggtaactccagagcccgcatcatgcaagcttaaggattttgatctgaatgacacttgtaatgatatggaaggctttgaggatcgacaagaaggttcacctacacctgcctttaagacagctgactctcctaattgtgcatcatggatgcaacaagattctactcaaagtccaccgcagactagtggcaactcagattcaacatcaacacaatcattgtcaagctcaaatggagacgctcagtgccgaactgataagattgtcttcaagctttttgacaaagttcccagtgatttacccccagttttgcggtcacagattcttggttggttgtcaagtagccctactgatatagagagccatattagacctgggtgtattattctaacaatatatctacggttagttgagtctgcatggcaagagctttctgagaatatgagcctgcacctggataagcttttgagtagctccactgacaacttttgggcatctggcttggtatttgtgatggttcggcgtcgcttagcttttatgctcaatggtcaaattatgttggacagacccctggcacccagttctcatcattactgcaagattttatgtgtcaaacctgttgctgcaccttattctgcaacaataaatttcagagtcgaaggatctaatctactcagtacttcctcaaggctaatttgttcatttgaaggacgttgtatattccaggaagacacagactctgtagcagaaaatgatgagtatgaggatagggccatcgaatgcctcagtttttgttgttccgttcctggtccaagaggaagaggatttatagaggttgaagatagtggttttagcaatggcttcttccccttcataattgctgagaaagacatatgctttgaggtttctgagctggagagcatatttgagtcctccagtatcgaacatgcagatgctaacgataatgccagggaacaagctctggagtttctaaatgagctgggttggcttcttcacagagcgaacagaatgtctaaagagaatgtaactgatacatctgtagctacctttagcatgtggagattcaggaatcttggtgtatttgccatggagcgggagtggtgtgctgtgatcaaaatgctattagatttcttatttattggccttgtcgatgtgggatcccgatctccagaagaggtggtgctttcagaaaatttgttgcatgctgctgtacggaggaagtctgttaacatggttagatttctgctgagatacagaccaaacaaaaactccaaggggactgcacagacatacttatttagacctgatgctctgggcccgtcaatgattacccccctccatatagcagctgccactagtgatgcagaggatgtgttggatgtgctgaccgatgatcctggactgattggaattagtgcttggagcaatgcacgggacggaacaggttttaccccagaagactatgctcggcagagaggcaatgatgcttacctgaatctggtccaaaagaagattgataagcatcttggcaaaggccgtgttgtcctcggtgttccgagcagtatatgctctgtaataactgatggtgttaagcctggcgatgttagcctcgagatctgcatgccaatgtctgcatcagtgccaggttgcctcctctgcagccgtcaggcacgggtgtatccgaattctacatcgaggaccttcctttacaggccagcaatgttgactgtgatgggagttgctgtggtctgtgtctgcgtgggcatactcctccacacctttcccagggtttatgccgcgcccacattcagatgggagttgctggagcgtggacccatgtaagttttaggatgagccttagctgttgtttgtaacttgtaagttgagagttttagcgttgtggctaagatcaaaggaacatgattaccgtgtgaagaagttcatctgtgtttaacgcaagatgctgttgcggctgtaagctttatatacatcgtcgatttcaactatatttacagcctatcatgctcccattccattcatccattttgttgtagaattcattccttgcggagaatttgtgaaccctcagaataaaaaacaggttcttgtatggaaaatcgtttagacataatatttcttggaatgatgctgg

SEQ ID NO: 10032 - DNA, 2901 bp, Zea mays
ctgcagcaaaggattatcaccgtcggcacaaggtctgcgagatgcatgctaaggccaccaccgccgtggtcggaaacactgtccagaggttctgccagcaatgcagtaggttagttttatggttctgcctgcttctattacctttcaatcatatgcagttatttgttcataaaagaatgaatgggtaaaataccttatgcaagttatatttagcgcagctacacacagacttgagaaacgtgcaaaactctgaccatcatgatgatttccaacctttgatctttgacactcgctatatctgtgacacctggagaaggaaatagatgaaatgcacatttattatatttagaccaaaatattaccatttaagtgaatattgtttgcaaagaaattttagtttagtttagacaccagaatattcactgtgctcacacaagaactaaggatgatgcttggggaagtggttaaatagcttcatgcttagaactttagaagttgttaagtaatgtgttcatgctactgtatacttagaagatcccccgccctgcgctctgtaattatgttgtacatattcttgtgcagatttcaccttcttcaagaatttgatgaagggaagcgaagttgccggcgacgcttagcaggccacaataaacggaggaggaaaacccgccctgatactgcaagttgtgggactgcttcaattgaggacaaaatcagcaattatctactgttgagccttattggaatctgtgctaatttgaactgtaagtttgctaacttgctagaccaaattttctattctaagatacttgtataacttattttcccttcaatgttatgaaattggtagtaatgttttgactaaattttcttggtataggcttagatcaagataagcgaccgtaatctgttttacaagagtatatgaggtcttaattactcattttgacatgttgggacataaggatgttccacggcatttggtgtgctgtaagtttcatgaattggtttattagacaactctaggattgcgcacagtcacgggatgttcctccatgagctgcatgtgaggatatcatattgagatttagcatctttcactgacagagtgctgcaatgactagctgcgtgaccttaaattatctgtttattacctagtcttgttgcatccctttcttttatcggggttcttgcaatgggatatccttctccaaataactgaaatgcagtttggtgatctgcatctttaattgttggaaacttctcaagtttttgtaccaagccttgatttatgaatcaacaaaaataccttgaaatagatttgaaaaatccgggtattgtggacattccgtcatttccattccggagcattcgaatcttaagtttcttaattatcaaagaaaaatttcattatcttctcaatcttcattaatccatatggatctggatcaatctagcaataattgaatctctattctgcctaccaaatcacatgaactccacatatgtatttcatatatataattatgtgtcctgcagaactacttgtatattcaggaaggcacatgactcttagaattctccttgcagctgacaatgctcagaatgcaaacggccaggagtcgctatccactcttttgaagaacctaggatctgttgccaaatcactggagccaaaagaactatgtaaattcctggaggcataccaaagcctgcaaaatggattgaatgctggaacctctggaatagctaatggtgcagaagaggctgcaggaccatctaactctaagctgccttctgtgaatgatagtcattatggacaggcatcatcatctgttgtgccagtacaatcgaaggctaccatggtggtaactccagagcctgcatcatgcaagcttaaagattttgatctgaatgacacttgcattaatatggaaggctttgaggatggtcaagaaggttcacctacacctgcctttaagacagctgactctcctaattgtgcatcggggaccccgcggccggccgcgcaaagcccaccacagactagtggcaactcagattcaacatcaacacaatcattgtcaagctcaaatggagacactcagtgccgaactgataagattgtcttcaagcttttcgataaagttcccagcgacttacctccagttttgcggtcgcagattcttggttggttgtcgagtagcccatctgatatagaaagccatattaggcctggctgtattattctaactgtatatgttcggttagttgagtctgcatggcaagagctttctgagaatatgagcctgctcctgggtaagcttttgaatagctctactgacgacttttgggcatctggcttggtatttgtgatggttcggcaccacttagcttttatgctcaatggtcaaattatgttggacaggcccctgacacccatttctcatcattactgcaagattttatgtgtcagacctgttgctgcaccttattctgcaacaataaatttcagagtagaaggttttaacctactcagtacttcctcaaggctaatttgttcttttgaaggacactgcatattccatgaagacacggattctggagcagagaatgttgagtacaaggatagggacatcgaatgcctcagtttttgttgttctgttcctggtccaagaggaagaggatttatagaggtcgaagatagtggttttagcaatggcttcttccccttcataattgctgagaaggatgtatgcgctgaggtttctgagctggagagcatatttgagtcatccagtaatgaacatgcaaatgccagggaccaagctctggagtttctaaatgagctgggttggcttcttcaatagagcgaacagaatgtctaaagaggagaaactg

SEQ ID NO: 10033 - DNA, 2654 bp, Zea mays
cggcagatgtgcataatttatatgtagctatggtcatttatgctatgctttcatattgatactatagctttgttctaagaaaataaatatgtatatatcatataacgatatatatttttatcaatgttgagcattgtataccaaattattatactagatatttctaatattagtagattgttagggtttctattttatagtatgtctttttttagttgttggcttatagctagtaacctttttagatattggctagctaatctataccactatataatctatcagttaaaattttacaaaactcatccaactaaatcactttacccatagccttgctaaatcaaccaaacaaattgcacctagacttaacacacaatcacaaccaacggttcatatcgctagataaacctctctcccttacacacttaggtgttgtttggttccatgcgaggagcggtaatgtcaatgggagccgttgtcgatgctatgcattgcatattaacaactaacacgctttgtttggtggtcggttgggaacaaaggttacaatgagagatgggacgggatcgaataacttcgggtgggtcgcggtaacaagattgtactactctgtatctgatagcgccgcgttccgctgcaggctcggtcaaccaaacgatatgtaaccggaccgggtcacaccgtaaatcgatcgcgggggtaaataacgcaaacccaacatcaccttaaatccaatgaataatattatttagatcattcatcctcctcctccacccacgaccacgacgtcccctcccctcactcgtttcgtcgccgttgtcaactcatcctcttctttccttgggatcatagcattaacatgagctatatatattagttagcagtaattgttgatccaaaagtagaggctccactaaaagccctctgctcagtaaaatattacttcattcattttgaactataataagaatatttaaattttctgtggtgtaagtcactacaggttcaggttcgtcggattcattttgatgaatgtcatgaattcactttcactatgtgtcaagtcacctctcactaccttccacgaacgcgtggtcggcgtgttggcaagcccgctcgggaggagcctctgcccctgcattcaaggcctgctcgacgcaggtccctatcgggttttgcttgtctgtcctagcttgtatttgcatacgtggtgtaggagtatgagttgtttgtggttaagttcgaatagatacgcggctagcaactcagttgctgcagtagctgtagcctgtagcgccatagacacgtcacacaagcggtcaaaagacccaggacacgtcaggctcagtccctccacgtcctcactcctacgtggaagccacccaggggcccaccccgtggatcacgcacctgatcccgcgtgccctggcccacgcggtgggcggacggccccggccccgccagcgtggcggaaacggacggcatcggtggatgccggctggcccccagacttatcgacaaacaaacggccggggccgcgacacgtcgccccctggatgcgttcttatccccacgatgcatccgacgaccgctgccccattctccactccgccccctctcagtctcaaactccccgctctcccccgcccgtccagctcgtgctccgcctccgctgctctgtcctcttccctcctctgcgtttctcctcagagctgtttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtccgagttcatctccttcatcaccggcgaggcctccgacaagtgccagcgcgagaagcgcaagaccatcaacggcgacgacctgctctgggccatgaccacgctcggcttcgaggactacgtcgagccgctcaagctctacctgcacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggcatggctcagtcccgccgccggcttcttgcttggtgtcggtaattagcgctggttaagttaaccttcggtttttccccccttttcttttcgtggtaagtaatgttgtgctgaatggagacagtgatatggttaagatagctccataacctctcggtaattaatcctgtgatttgtactcctaaaaaaaaaaaaaaaaaaaaaaaaaaaaaaaaaaaa

SEQ ID NO: 10034 - DNA, 2013 bp, Zea mays
attgggtacctcgaggccggccgggatagcattgaaccggcccctccccgcgggcccccacacccaacccaacccaaccgcgctccgcgcctcctctcacctggaaagggaaggcaagtcgagattcgagaaggcaaatcgaattcgccatgggcatggctgctccgcgcgcgccgctgcctctcccccaactgctgctcctcctcgttgccgcgctcctcgccgccgctcccctccctagggcggccagggcggacgagttcgacgtccgccgccacctctccaccgtcaccaggtatgatgtggccagggagtccagtagtgtcatctccatgccgtcaatcccagacgggtgccgtgtcattcacctcaatttagtggcaagacatgggactcgcgctcctaccaagaagcgcatcaaggagctggatagattggcagttcgactggaagcccttctgaaagaggcaaatcaggtccttgatagtgattctctgaagaaaattccatcctggattaaaggctgggaatcacgctggaagggtaggactaaaggtggtgagctgattagtgaaggggaagaggagctttacaatttagctaccagaatgagggagaggtttcaagatctatttgatgacgaatatcaccctgatgtatattcaataagagcaacccaggttcctcgagcatcagctagtgcagtggcatttgggttgggactactttctgggaaaggaaagcttggacaagggaagaaccgagccttttctgttctgagtgagagtcgtgcaagtgatatttgtctgagattctttgacagctgtgagacatacaaggcatacaggaaaaggaaggagcctgatgtagacaagcaaaaggaaccaattctagagcatgtcacagctgcacttgtcaatcgttatcacctaaaatttacaactcgcgatgtttcttccctctggtttctttgtaagcaggaagcatctttgttgaatacaacaaatcaagcttgtgggctttttaatgaagctgaggttcgttttctggagtggacagatgatttggagggttttgttctaaaaggctatggtgagtcaattaactacaggatgggactgccattgctcaaggatgttgtccagtcaatggaagaagcaatcatagctagagaagaaaaccgtgctgatggtacgtttgaaaaggcaaggctccgatttgcacatgcagaaactgttgttccttttagctgccttcttggtctttttcttgaaggtccagaaattgagaagatacagagagaggaagcattggacctaccccctttgccgccacagggaagaaactggaagggcagtgttgttgcgccttttgctggtaacaatatgctggttttatatcaatgtccaagcaaaatttcggatggcagcacaatctctggaggccgaaacaactcttacttagttcaagttctacacaacgaagtcccagtttcaatgcctgggtgcggcaacaaagatttctgtccgttcgaggagttcaaggagaaaattgtgaaaccgcacctgaagcacgactacaacatgatatgcaaggtcaaatccccagcggcaagcgaggagcctgcctcgttcgcctccagggtgtccagtttcttcctaggactcctctcgcagaaagggtaccgcggtgtgggcgccgagggcgtcaagaccgagctgtaggcgtcaagacctagcttagcacggtgccgtctcctctcaccgtctgcgagcacgatcaggaaccagactaacccatgcactaacccgcagtgtttttgtacggggcgagtcgaatgtgtaggacaccaccacaggaggcgccagttcggttgtctccagggccagacgcctctgatactgtagtagcaataacataaataataaatgtgtttcgattcggactccaaaaaaaaaaaaaaaaaaaaaaaaaaaaaaaaaaaaaaaaaaaaaaaaaaaaaaaaaaaaaaaa

SEQ ID NO: 10035 - DNA, 901 bp, Zea mays
ccggggtgagtgtgagtcagcctctcgatctgggttgggttttggtctataaaaccccccggccggcccctcttgctccggctgggggttgtggcctcctatccttgcacgcacacgcaaacgcatcccatcctgtcctcgcgttactactagttagttagagagagacagagaggatcgatctgctggcggcgtctaagctggagaaaggcggcgccaccgccgagggcgacgagataggcatcgacccagcggcggagactccggagcagcgcaacaagttcctggtcctccgcctgtacgaggcgctcaacgcccgggaccacgccgccgtgcagtcgctgctggcgcccgacctggagtggtggttccatggcccgcccaagcaccagcagcacatgatgcgcctcctgacaaccaccaccaccaccaccggcagcttccgcttcgtgccccgctccgtggacgccctcgccgcctcgtccggcaccgtgatcgccgagggccacgagaggggttgctactgggtgcacgcctggaccgtgggacccgatggggtgatcacccagctccgtgagtacttcaacaccgacctcaccgtcacccgcctcgccgccgccgtcgccgccaagtgcgtctggcagagccgccgccccgacagcgccaccaactccctgccgggactcctgctcgccctctgaatctcagggataaataccatctctatctatatacgtatcatccttgtcgtcgtcgtcgtcagtcagtgcaaaccgcgtgtgtatgtatgtatctacgtacgtattgtatttgcatcccatccatggccgtatgtcactattatatatatacagtatatctcatcaactttgaccaaaaaaggcccctaaaaaggccccta

SEQ ID NO: 10036 - DNA, 778 bp, Zea mays
ggggtggtggttgtggcctcctatccttgcacgcacacgcatcccatcctgtcctcgcgttactattatagttagagagacagagaggatcgatctgctggcggcgtctaagctggagaaaggcggcgccaccgccgagggcgacgagataggcatcgacccagcggcggagactccggagcagcgcaacaagttcctggtcctccgcctgtacgaggcgctcaacgcccgggaccacgccgccgtgcagtcgctgctggcgcccgacctggagtggtggttccatggcccgcccaagcaccagcagcacatgatgcgcctcctgaccaccaccaccggcagcttccgcttcgtgccccgctccgtggacgccctcgccgcctcgtccggcaccgtgatcgccgagggccacgagaggggttgctactgggtgcacgcctggaccgtgggacccgatggggtgatcacccagctccgtgagtacttcaacaccgacctcaccgtcacccgcctcgccgccgccgtcgccgccaagtgcgtctggcagagccgccgccccgacagcgccaccaactccctgccgggactcctgctcgccctctgactctgagggataaataccatctctatctatatacgtatcatccttgtcgtcgtcgtcgtcagtcagtgcaaaccgcgtgtgtatgtatgtatctacgtacgtattgtatttgtatcccatccatggccgtatgtcactattatatatatacagtatttctcatcagcttggccc

SEQ ID NO: 10037 - DNA, 1783 bp, Zea mays
ctaaaatttattggcttttattattagcaataaatttcatggttctaaatgcgacagtttttttacttgaatagagacatttattttaaccaaagaaaaatcatatatatataataaaaacaaattagtggcatccatacatatggatgcccaaacaattatcggttgaggaagtcaacaggaaagtatcttaaaggttggaaacgtggcaaatcgaggagcatgagctggtagggcactcgcagtgggtggagccggtttgctgacgcggaaggaaccgaccattcatgactcgcttggcacgcggtgaggtgagtgtgagtgtgagtcagcctctcgatctgggttgggttttggtctataaacattgggtacctcgaggcccccgggcggagggttgtggcctcctatccttgcacgcacacgcaaacgcatcccatcctgtcctcgcgttactactagttagttagagagacagagaggatcgatctgctggcggcgtctaagctggagaaaggcggcgccaccgccgagggcgacgagataggcatcgacccagcggcggagactccggagcagcgcaacaagttcctggtcctccgcctgtacgaggcgctcaacgcccgggaccacgccgccgtgcagtcgctgctggcgcccgacctggagtggtggttccatggcccgcccaagcaccagcagcacatgatgcgcctcctgaccaccaccaccaccaccaccaccaccggcagcttccgcttcgtgccccgctccgtggacgccctcgccgcctcgtccggcaccgtgatcgccgagggccacgagaggggttgctactgggtgcacgcctggaccgtgggacccgatggggtgatcacccagctccgtgagtacttcaacaccgacctcaccgtcacccgcctcgccgccgccgtcgccgccaagtgcgtctggcagagccgccgccccgacagcgccaccaactccctgccgggactcctgctcgccctctgatcactctgagggataaattaaataccatctctatctatatactacgtatcatccttgtcgtcgtcagtcagtcagtgcaaccgtgtgtatgtatgtatctacgtacgtattgtatttgtatcccatccatggccgtatgtcactattatatatatacagtatatctcatcaactttgaccaaaaaaatgcgacttataccttgcaagcaaattctaatttgatttatatttaaaaaaacataaatatctcccggttactggctaccacaaacaagcaagcactggctaaactgtccttgtcatttgacaagcgagcaacgatatgattttctctcccttccctgctacctacacctacctactgctaccaggcatcttgaatcctgagggtggtttcagatgccaaccacgctattattatctgtcacaaactcttatctaccactcctaaactcttatctaccgcacctcttgtgtatagcctttatcacagcctatacacatcagcttttttagacttttatttaaaataaaacaccgcgttttattaaataaaatttcattcgtacacataattaaacaaaaaaatacataatttaaagaacaaaataaaatataaaaccttcaaaacaattactccctccattcttttttatttatcgttgtttaattaaaaaataaactagcagactacaaatattcgagaatgaaggtcgtacatgactgtcatatttgatatttctcatccacctttttcatatcttttcat

SEQ ID NO: 10038 - DNA, 887 bp, Zea mays
gtgagtcatgcctctacgatctgggttgggtgttttggtctataaaataccccggcctcccgcccttctctggtgggttgtggcctcctatccttgcacgcacacgcaaacgcatcccatcctgtcctcgcgttactactagttagttagagagacagagaggatcgatctgctggcggcgtctaagctggagaaaggcggcgccaccgccgagggcgacgagataggcatcgacccagcggcggagactccggagcagcgcaacaagttcctggtcctccgcctgtacgaggcgctcaacgcccgggaccacgccgccgtgcagtcgctgctggcgcccgacctggagtggtggttccatggcccgcccaagcaccagcagcacatgatgcgcctcctgacaaccaccaccaccaccaccaccggcagcttccgcttcgtgccccgctccgtggacgccctcgccgcctcgtccggcaccgtgatcgccgagggccacgagaggggttgctactgggtgcacgcctggaccgtgggacccgatggggtgatcacccagctccgtgagtacttcaacaccgacctcaccgtcacccgcctcgccgccgccgtcgccgccaagtgcgtctggcagagccgccgccccgacagcgccaccaactccctgccgggactcctgctcgccctctgatcactctgagggataaattaaataccatctctatctatatactacgtatcatccttgtcgtcgtcagtcagtcagtgcaaccgtgtgcatgtatctatctatgtatctacgtattgtatttgtatcccatccatggccgtatgccactattatatatatacagtattacagtatatctcatcgactttcaccggcc

SEQ ID NO: 10039 - DNA, 1159 bp, Zea mays
ccggccggggagcagaccgaggaagccactccaggtcggcgcgcggctgacaccaggtagccgcccctcctctatccaccccttcacttgcttggtcttccactcacccctctctcgttattcacccggtctcctctcctgcaaagaggaagatgagctcgctacacgccacacgagcggagcttggcctggttgtcctgtacctgaacaaagccgaggcccgggacaagatctgcagggcgatccagtacggctccaagttcgtaagcaacgggcagcctggcactgcgcaggaggtcgacagatcgaccaccttggctcgcaaagtcttccggctcctcaagtgggtcaatgatctgcatgctcttatcagcccgccggccaaagggactccgctcaccctcgttctgcttggcaaatccaaaaacgcgctgctttcgacgttcttgttcttggatcagtttgtgtggctcggacgaacggggatcgtcaagaacaaggaggcgacggaccgcgttgccaggttatccctgtactgctggatggcttcttctgcctgtgcaggtctagttgagcttggagagcttaaaaggctatcgagatcgatgaggaagcttgcaagagagctgagggacacagataaatatgagtgtttatcacatggccattctcagaacgagcagtaccaggacaaaatgaggcagtcagatgaacggctcctggccctggtcaaggcggccatggacgtggtcgtggccgtcgggcttcttcagctggcgcccaagaaggtcactccgagagtgacaggagcctttgggttcgtcacctcgcttatctcctgctatcagcaacttccttcccgcgctcctgttgccaaagtcaaagtttgagaggtgtcgccgtcctagtaaaaaaaaaagaggcgacgctggaaatcgatctctgcttcaacaatggatcgtaatataattttattatgcgaatataaggcaggctagctatgtattttttttattaaaaaaatagtacaacaaaatagaacaccagtgattgcacgtatgggcttatcactatcttctctttttgcctagcaatggacaagtaatgttcacgtgattatgtctttggatatgctttgctagcaaaaaaaaaaaaaaaa

SEQ ID NO: 10040 - DNA, 1310 bp, Zea mays
ccgggactttgctcggctgacaccaggtagccgcccctcctctatccaccccttcacttgcttggtcttccactcacccctctctcgttattcacccggtctcctctcctgcaaagagtattcttgggttcatggctgtctgcagattgtcgcccttgctctgcctgctctattcggcctcagttcattctgtcgtaaacctcacctcgtaactgaaataagccatatgcgccgcgcgtcgaagcttagtgtctgatcgatacgctatccctacaattttctgagctgttgaactcctgcgcccgtctcctcgtcgaggacaggaagatgagctcgctacacgccacacgagcggagcttggcctggttgtcctgtacctgaacaaagccgaggcccgggacaagatctgcagggcgatccagtacggctccaagttcgtaagcaacgggcagcctggcactgcgcaggaggtcgacagatcgaccaccttggctcgcaaagtcttccggctcctcaagtgggtcaatgatctgcatgctcttatcagcccgccggccaaagggactccgctcaccctcgttctgcttggcaaatccaaaaacgcgctgctttcgacgttcttgttcttggatcagtttgtgtggctcggacgaacggggatcgtcaagaacaaggaggcgacggaccgcgttgccaggttatccctgtactgctggatggcttcttctgcctgtgcaggtctagttgagcttggagagcttaaaaggctatcgagatcgatgaggaagcttgcaagagagctgagggacacagataaatatgagaacgagcagtaccaggacaaaatgaggcagtcagatgaacggctcctggccctggtcaaggcggccatggacgtggtcgtggccgtcgggcttcttcagctggcgcccaagaaggtcactccgagagtgacaggagcctttgggttcgtcacctcgcttatctcctgctatcagcaacttccttcccgcgctcctgttgccaaagtcaaagtttgagaggtgtcgccgtcctagtaaaaaaaaaagaggcgacgctggaaatcgatctctgcttcaacaatggatcgtaatataattttattatgcgaatataaggcaggctagctatgtattttttttattaaaaaaatagtacaacaaaatagaacaccagtgattgcacgtatgggcttatcactatcttctctttttgcctagcaatggacaagtaatgttcacgtgattatgtctttggatatgctttgctcgaaaaaaaaaaaaaaaaa

SEQ ID NO: 10041 - DNA, 962 bp, Zea mays
cgttagccgcccctcctctatccattgggtacctcgaggccggcccggcgggccccccctcacttgcttggtcttccactcacccctctctcgttattcacccggtctcctctcctgcaaagaggaagatgagctcgctacacgccacacgagcggagcttggcctggttgtcctgtacctgaacaaagccgaggcccgggacaagatctgcagggcgatccagtacggctccaagttcgtaagcaacgggcagcctggcactgcgcaggaggtcgacagatcgaccaccttggctcgcaaagtcttccggctcctcaagtgggtcaatgatctgcatgctcttatcagcccgccggccaaagggactccgctcaccctcgttctgcttggcaaatccaaaaacgcgctgctttcgacgttcttgttcttggatcagtttgtgtggctcggacgaacggggatcgtcaagaacaaggaggcgacggaccgcgttgccaggttatccctgtactgctggatggcttcttctgcctgtgcaggtctagttgagcttggagagcttaaacggctatcgagatcgatgaggaagcttgcaagagagctgagggacacagataaatatgagaacgagcagtaccaggacaaaatgaggcagtcagatgaacggctcctggccctggtcaaggcggccatggacgtggtcgtggccgtcgggcttcttcagctggcgcccaagaaggtcactccgagagtgacaggagcctttgggttcgtcacctcgcttatctcctgctatcagcaacttccttcccgcgctcctgttgccaaagtcaaagtttgaggaggtgtcgccgtcctagtaaaaaaaaaaaaggcgccgccgctggtcgtcctccgctgcttcaacaatggatcgtaatataattctatatgcgaatataaggcaggctagctatgtata

SEQ ID NO: 10042 - DNA, 661 bp, Zea mays
agcttacactatcaaatgcttttgaaaagtcaagttttagaacaacagtgggagttcgcctcttgtgccaacattgccccaacccagttgcatatacaaaattttcagagatgggccgccctttcagcaaccctgtttgatccataccaacctgtttgagtgtttatcacgtggccattctcagaacgagcagtaccaggcacaaaatgaggcagtcagatgaacggctcctggccctggtcaaggcggccatggacgtggtcgtggccgtcgggcttcttcagctggcgcccaagaaggtccctccgagagtgacaggagcctttgggtttgtcacctcgctcatctcctgctatcagcaacttccttcccgcgctcctgttgccaaagtcaaagtttgagaggtgtccccgtcctagtaaaaaaaaaagggcgacgctggaaatcgatctctgcttcaacaatggatcgtaatataattttattatgcgaatataaggcaggctagctatttaaaaaaagaatagtccagcaaaatagaaccccagtgattgcacgtatgggcttatccctctatcttctctttttgcctagcaatggacaagtaatgttcccgtgatttaaaaaaaaaaaaaaaaaaaaaaaaaaaaaaaaaagaaaa

SEQ ID NO: 10043 - DNA, 1220 bp, Zea mays
acctgtcaggttgttagtggggattaactttagaagaagggattaacttcctctggcccacacgtcggccaccacgtgcatcgtccggccggtgagggaccaccgcggcagctatcctcggcgccgcgctcacgattccggaatcactccccacgcgattcgatcctctcgccggcccaggcatcgtagaatccccccaccgaaaaaatcaagcgggcatacaaagagcgcgtgcgcactgcgcagtgcttggaataggtgggtcgaacttcgaaggggttcgaggacttcagctatggcatctgtgggacgtgcaggacgaggagggaaaggagatggagggaagggagaagggtcgctggctcgcagggcgtggaggcagtacctgctccagctccagcaacatcctctccgcacaaagatgatcacggcggggtgcctcgccggcgtcagtgactccgtggcgcagaagctctctgggttccagaagattgagaaacgcagactcctgctcaagatgctctttggttttgcatatggtggcccatttggacatttcttgcacaaaattttggattacatcttccaagggaagaaggataccaaaaccatagcaaagaaggtgttattggagcaagtgacatcttctccctggaataacatattgttcttgttctattatggatatgttgttgagaggaggcctttgaaggaggtgacgaccagggtgaagaaacaatacccttctgtgcaactcagcgcttggatgttttggccgatagttggttggataaaccaccagtacatgcctttacaattccgagtgatcttccacagctttgtcgcatgttgttgggggattttcctgaaccttcgtgcaagggctatgtctctgaagcaggcctagatggtttagaaggaacgtatagcagcaaagctcctgcccggtgctaactaaagcagccgaagaaggaggatgctggaagctgtatcctgcacggttacaaaaaccgttgtttatttcctggtagtagtcggtttatttgaatgtcaacgcatgcgaagacagattatgctttttgtaaaaaaaaattgtgatgggagcaaagtatggtgaattcggttagctttgaggaccagttcgtattcgttcattcattgttcagctaaatggtcatgggactgttccagcgtccaccgttcttgctttgctggtaatc

SEQ ID NO: 10044 - DNA, 3502 bp, Zea mays
  misc_feature (2776)..(2776): n is a, c, g, or t
tacatgggatgagtatcagaagcatgatgtaactcaaacaaagtcgcccttatctgtggagctcaatatctaattgcggccacacttttaatatgactttaccgacaagtgttgcacaatgatttcatagtcaaacatggcacatgatcaagtaaagtttacacctttttgtagaaccaaaaaacaataataagctgtttatttcctttttaaaagggtgtctcgatctaatttagatgtgaaagaatggaacacggccgggaagaaacgcttcagccgatctgaatcacgcttacactcttctttagttcttacctcttcaaaccctagcctccctgatccatccgcacctcgaaatttcggcagccgatgcctccgccatcgccgccgtggtcgcctagcacctcttctatctaggtttcgtcggtccctcttcttcctgcgccctcaagatctgcgcgacgacctgagctctccgtgctgtttagggcggccatgaacagcgcgttcagcgaggacatactcgctggcaagctcgccaagctcaacaacacgcagcaatgcatcgagacgttgtcgcattggtgcatttaccatagaaagaacgcagagcaaattgttcagacttgggacaagcagttccacagctttggcaaggagcagaagatccctttcctttatcttgctaatgacatcttacagaacagcaagcgcaacgggacagagtttgtagaagaattttggaaggttctccctggggcgcttaaagatgtaagtgagaacggtgatgaccgtgggaagaaggtggcatctaggctggttgacatatggcaagaaaggagagtttttggctcacgcgctgggggcatcaaggatgtgatgcttggggcagccccccttcctgttttagatatgaccaaaaaacggtctcgcagttcagcaataaggattgttaaaagagattctcgttctgtgaaactgagactaggcattggaggaactgcagagaggatcatatctgcactgcacactgttctcagtgaacaagcagatgaggatgatgacctggaaaaatgcaagacttctatgcgtcatgttggaaagatggagaaggacgttgacagtgcttgtagcaaagccgaagatcctcgtcgcgaggttctttgcacagaactaaaagatgaggaagctaacatgaaaaaatgcatcgaaaagctaaaagctgttgagaaaaatagagcagctattgtgtttgaactgaaggaggcactgcaggaacaggaatctgaactggagaaagtccgcactcagttacagctgaagcaatggtacatgaagcctcgcccacgctccggagactcaggaatgagccaaccattccgctgcccagatcagcatcgttagtagagccaggaaaggtggtctccaatgggcaagtaaaggagcagcacaagacggctgctgctatccttgcagacaagattgcagcatcatcaaactctcagcagattctgcagtctgcactttcgaagtttgctgccgaagaagcaaagaattcatctgaaacacgctcagataagaggcaaaaggctgaacaactatcgcaggtaccaagcgtcgcaaatgccgctgcttttgttccaatgccacaagtggttgccacaacagctcagcagcagccccaggcaatcttagtgcaacaagcacctatgcagagccaagccactgcatctcagccccagtacaatatctaccaggccccgccccagcagtttgtccctcagcctggaggtgtaatgatgggcatgccttacaacatgagctccatgaccccaccgcctccaccgccgccccagatgatgagcctaggaaggccctcaccttcagctccacagccccagatggctgtcatgccgcagactcagcctccagcgccaccgatgcttcagcagcagatgccaatgaacctaggtcctcagatgcagttcacccttcaaccgcctggcgtgccgcctttcaggcccatgcagccacctcctgggatgcagtacttccatccccaatctcagtgacagttttggtagcccagccctgttaaacttttgacaggttctcaatttagcgttgactagtaagcaggatctgactgctgtagggtatactgtttgtgtggttcgtttcgacatatgttgttgtactgtacatgtaatgcgaggagaggtaaagagcgaggagagaaatgaagattaaagatttcacataggcctgcttcgttctcgtgccgtggtttggtgggttgaatctgcggctgcaagtgaggtgagttctcttttctcatttttgtgcatgcaggtaaagcttctgggtttcctaaaggggcagagtttatgggcctgattacatcagccgtttttttttggtaccataggcaacgaaatacagaaatattatttttgcatattacaatagcctggagcaaggtggagcttgctcctagtcacctagtgcctcaattagacaacttgccagcatcgcagttccaacctccaagggcagcaagttctgtatgaaaattgaggcagagatgtgctgctgtcttaccccatgcatctgggatgctcttatctaactcaaaacatgatgtaatctctctctagtatgcatgatcccaaccccaagaacatccttatatggaggaggaaacaaagtgtgatcttgcaggcaatagatagcctgcgggaacatgcattgactggatgttgcgaatttacctggnaaatatttatataggttacatctaattcagtactacttgacatgaggtactccagagaacaactgcgaatttatctatgggatttacatgtttatcacatagtcgctccagagtactagacgatccagaattgaattatagccgctgcattgaacttgtaccggctacttgttttctgaacaagtttgattagaagctctttagcgagcagacctttaagcagctctgcgtttatatactcaagttcaattgtttgattttagactcctttacaacataatgcataatgttaatgtatttaacatcaacaattgatttgttgttatagaagtaatataccgctggtttattattgtagtagattctgtagttttgtctatcacttttaaatcaagtataaatttctttagccatataatctttctcgttgtctcatagcaagtaacaagttcagcatacattgtcaagggtgtagtgatgagtttttttttcatgatatagctcctcctgtgagtgaatatgtaatctaacatcaacatggacttcctattttcttcacacctcgcataatttgattttgagtataatataatttcaaatactttttaaatggatttttagtgttatatttctagttttttttaaaaaaaaaatctgccaaatatcgcagttgtgaataccaaatgagaacgaatacatatttgaatatgcattatatttcgacac

SEQ ID NO: 10045 - DNA, 3832 bp, Zea mays
  misc_feature (834)..(834): n is a, c, g, or t
  misc_feature (3085)..(3085): n is a, c, g, or t
cttaaaattcaggtaggtgaaatataaaataaaagaagtgtacatatatacacctgatcgatcagcgtataattaagggcgattgggaatttgtattataatatatagtccgtcctaattattttccgatcttggagagaagtctttctagaaaatgttgtagccttttccgcgcatgattcacaaatcacgagtcacgcgacaaccttttccgctcggagagaaggtgcaaaagggcacgatggggtgagagaaattaaaggagatcactcgagctgaaaaaatgaaggcggtggtcgagaggaggaagacagagaggggtggattgagttgagccagagtacagtgatgagtgatcacactcgcagacttgcacctacttgagagcgacccgccgcccgcccgcgcggccagccctctcttttatacccctaccttcttggatccccatcctctccctctcctcgctgtcgtcttccttcccagggccagcgagagcttcgttgttccggcgggcagttgcaagcaaacaactgccgcgcgcataacgcgccattgaggtaactggctagtgctagtctcccaccctttgcacggcagcttgctagctagcaagctacatacctcgggcgcgcgcggcatggcgaggcggacgagcggccccaagaagaagctgaggaggggcctctggtcgccggaggaggacgataagctcgtcaaccacattgccaagtatggccacggctgctggagttccgtccccaagctagcaggtagtagtggtattgggctactagcagagctaagctactagtatatatattttccatgtanacaccttattagaatatgttaattcgatctgctccgatccgcctctcataaagcaattaataatgcctactgtcaaagtttcttggattgtacccaagtttttatataaattaaggagagaaaaaagctgcgaagatgcattgcattggttgctagcagtcgcagagttgaattgatggcaattcgttaatcgttatggtgatgatgctgtttatttttgcatgcttgcgtgtgcattaggtctagagaggtgtgggaagagctgcaggctgaggtggatcaactacctcaggccggacctcaagaggggagcgttctcgcaggaagaggaggacctcatcatccatctccattccatgatgggcaacaagtaggtggtgccacagtggcaggccatgcatacagcagatccccggcccggccagtttcttttatttattagctgtgtgcgatgatgatgatgaatgatccatccaatcggggatgtaattctgttcgttttgcacgtacgaatgacacaggtggtctcagattgcttcgcagctgccggggcggacggacaacgaggtgaagaacttctggaactcgtacgtcaagaagaagctccggcagcgcgggatcgacccggccacgcacaagccgctcccgctggccgccgagggcatcagcagccgcacggcggtgttcagcgacgccgagctcatcctgtcgtcgtcggcggcggcggcggcggcggggcggcacatgccgccaccgccagtggcggcatcggcggcggagagctacgtgtacagctacagccacagcagtggcggcgcgagcgacggctctctgcagtcgctgtcggggtacaacagcaacagcaacagcaagcaaacagctgcggatcacttgggtgccgcagccgcagcggggtacctgcagcaggagcaggacccagcagcagcagcagcagcagccgacgcgctgcactgcggaccctccggtgccccggcggtcgttctcccgtcggtgtccagctccagcacgctgaactcgatggctggcctaagccccgcggccaccaccaccgacgaacagtgcaccaacaactgtagcagctgcagcttccacagcgggttggagccgtggctggagctgggcagcacgagcggctactacggcgccgccgccgtggaccactacggcgcggcgctggacgagctcaagtggtccgactacgtgttcgacggcggctacggtggccagccgggacagggcatctacggcgacagcaaggacgccgtgcagttcgtggacgccaacgcgctcagcagcagcagttggtgcttgaattgatccccgtcggtcgatcccaacgcgctcggcggcgagcaattaactaatcggccggccgccaattccaactccatctccagcacagcagagacacacactgatacacgtgtgcatgtgttcctacgtgcctacctacgaggctacgactacgattgattggttgattggtgatacataaagtagctcatacatgtttgcattggtgagcttcttgtttgtaaattcaattttcgtcttctttcggattggattacagggcttgttaattttccggcgcggtcggtcgacatgtagagagtgcatatggtgacggtgattggggagtgacgagacatacatgtaatggaacatatatatagagagagagattacatatataataataatacatattccctcctattatatttatccgaggtgttggattaactaaattccgtggttgattaagtaagaaatatgtgcggttggtcagtattatctctgctagtatatttattctgacgtcgcccgtgcttcaatttggttatgattgtatactacagaaaaagttttttttgcatgcaaaaacttttatcgtgtagctaataatgaaaatacccccggtcacattataagtggatatataccccatgaattatagaaggtgacttgtaaaagctgaattgttagaagttaggttatagaagccgagttaaatgagaatgttcggatccatagattgtaaaaacaaattaagctagacagttttacacagtaaattaatacaatgtcctcactctttgttttttatgatgttgctatgaaagaatgagagacgtatgattgtcttttaatgtctagaagctagctagaagaagtttgattccttgtgcttacgagagtctacacctcatggtttcggttaagtttngggctcccaagccaggagaccaaatcagagagccttcctatatatcctctagggtcctttagaccaggggacttattatgtgaccctcaaggcctctaggaccctctcgatctctaggttgcggaccaaccccctgcccagccaagtctgggacccaaataggttagagctcataattcaaccccatatattttctcgaaaagcttataaggtgggatttgacgactctagggaaagacgtcccaagggcacgatggcctttggcacttggaagtaaggtcatggtgccatgtgcgcctctgctcggaacaacctccctgatgtaatgcgatcaatataaggcttctatccaacatattatatgtggtggttgacattgcgatcaagaaagtacaatgaagtcatatcaagtaccatatttgtatccgaggtcactatgaaagtgtgacatcatccatgtagacacacctaaacatgcttgttgatgtacctgcaaacattataaattacaagcaactaaccatttaccaactacgtcatactcggtaacgtagagtctagtacctatcactatgataggatatatacgccactacgtagcaagacatgctttacactggcactactaagccgtgtactgtgtacggctccacgtctgcgtctgcaacaagatatgagtagatgaacatctgctcagcagggccaaaaatctagcaggtatgtaactctcacatttcttgtgctata

SEQ ID NO: 10046 - DNA, 1423 bp, Zea mays
acaataacgttctttcgtgcgcgcctgtcatcgtccggctcagagccgccacagcctcgccgtcgattctctcccctccccttcgtcctcacgagcgacgaacgtcacgaacccctcctccacctcctgctactatcggcgccggagccctcctctggtctcaccgtgcaaatccccaaccccgaggcagacgcaggccagcccctgtgatggcacagaccaacggcaacgaccccttcagtccccctgtttcccaagaaagggttgtgataacaaacaagcatggtgagaggcttgtggggctgctgcatcacaccgcttcaaacaagattgtggtcttgtgccatggttttatagctaccaagaatgacagcctcattcttgacctggcggaagcgttgacaaaggaagggatcagtgtcttccgcttcgatttcagtggaaatggagaaagtgaaggccagtttgagtatggcaactacaggaaggaggctgacgatttgcattctgttgtattgtatctgtgtcaaaaaagttatgatatagcagctgttgttggtcatagcaaaggaggagatgtggtgattctatatgcttctgtccatgatgatgtgggcacaattgttaatttatcgggccggtttgatttaagaaaaggcattgaagaacggataggggaagggtctatcgataaaataaacaaagaaggctaccttgatgtcaaggacaaatctgaaaatgccagctacagggtaaccaaagaaagtttgatggaacggcttaatactgatatgcgcgctgcaagtgtttccataagcaagggatgcaggttcttaacagtccatggctcagctgataagaccatacccgtagaagatgcccatgagtttgcgaagcatatacccaaccatgaactgcgtgtcatagaaggagcaaatcataactacacctcacatcgcaaagaagttgctgatgcagtagtagatttcatcacgtccaatgtaaccgtataataaggctgggggatgaatgtcattccagaccacttggtcatgcacctatcgatcccctccatcatggggcaatactggtactaggtgtctattatcttctgaaccgaaaaccccatgtcatgcaggtttgatatgatgatgttgctcgtatgtgctcttaagaattactgtaaatattgaactcctggtagacttgtatgccgcagctcgcagtttatataggctcatatctctatagtttttttttctttcttctttgttcgagggctctattcccttgctcttttttgcatggttcatgtaagttttcttccttgtaccctatagttatttaatttatttaaatttggcactgtggactattttgtacaagaagtcttagtgcaaacgtacaagcaggcccaaaaaaa

SEQ ID NO: 10047 - DNA, 2005 bp, Zea mays
ttgggtacctcgaggccggccgggagaatctctccgtatctccctccccggcggcccgcgagccgaccttaacctccccaccacaagcccgcacacaccatcccgctccgctcaagtcgcctccgcattcctgccccctctacccgcccgccgccgcgcggacgacgggagacgccggcaccatgctctgcctctcgctgtgcgcaccgcaccttcacctccacctcccccgcagcccgaccgcacgacccgccgccgccacgtgcaggaacgcgcgctgcatcggcgtcacgctatgcctccggatgccgacgacaccggaggaacggcggcagaagcgcgggctggcccagttcctggacttatcggccgcgccgacactcacgccacccgcgcccacgcccgtgcatctcacgcccgcggccaaacggcgcggggcgctgcgggagatgcgccgggtgtggtgggtgtgcggggtcgggtactgggtgcaggggttccgctgcttcccgtggctggcactcaacttccacctcacgcgcggcatggggctcagccccgccggcctgcaactcctgcagaacgctgggagcctcccgctcgtcgccaagccgctcttcggggtcctctccgatgccgtctacatcggccgcgcccaccgcataccctacatctcccttggagtgtggctgcagctcattgcttggggagtacttgcaaccattccagttacaggggatgcgtttccaactctaatggcatgcattctcattggaaatctaggagcatctgtcacagaagtcgtaagtgatgctgttgtcacggagttcagtaggacacagaaggctggtgtactacagtcatatgcattcgtagccctggctgcaggatccttgctggggaacttgtctggtggttacattctgcttaaaacacaggaaccaaagatcatgttcacagcattctcagtccttcttggcttccagctagcactgtccctaagtacaaaagagacattgccaagctctcgaggaaactccagaaatcgtcttgtcaaaagctctttggcagctaacttccgcaagcaattctcaaacttgatgacagcgatcagagaggaaaggatcttataccctcttgcatggatcatgacatcctttgctgttgtgcctgttctttctggaaccatgttctgctttcaaacacagtatttgaatctcgatccatcggttattggtctatcgaaagttgtgggacaggtcatggtcttatcactaactgtactctacaatcgatatcttaaaaggataccactgaggtgccttaccacaggacttcagatactatatgctctggcagttttgtcagatttgatccttgtgaaacaagtaaaccttgtgctagggataccgaacgagattcatgttctttgcttctcagctctagctgaagctctagctcagttcaaggtattgccattctcggttttgttgtcaagtctctgcccaccaggctgtgaaggttctttgttcgccttcttcacatctggactggtgctttcagcaatacttagtggagtattcggagttggattgtccaccctgatcggtgtgtcttctgtggactactccagcttgcctttgggtattttgctgcaaagtttggctgcattgctaccgttgggatggatatcctttgtgcctgagaaatggactgccgatgacacggttgtaataaaaagatgaagtgttttcaccatacaaatttccaggcaagatcctgttaggcaatgacacaatgtagataaatgtagcccacccagtcaacactggtgaggttacatgtataggtatccagattctcttcaattagaatagttcttattattactgtactatatgcaatacaggatagcccttatgctcctgctgaatatagcacacaaattgcattgaattagttgtctcgtgaaacgagattggactataaaatttgcttcacatgc

SEQ ID NO: 10048 - DNA, 1900 bp, Zea mays
attttgttttttaattaaaaaagggttccccacagcaccaagcgcgacgtgagcgaggaggcaggcgcgcacggcgtgtcggcgtcgcaccgaacccgacacggctcggcctacggcccccacacatccggctgggccgttccgttccgtttcgttcccttcccattcttctcgtacgcggccgattgcgaccctcgctcgccctcgcttccccaccacagcaccgaaactgccccgcctccgcagccgccgcccgcgcccgctcgtcctccccgcgccgcctcggggacgccccggtcggcgatgtggcgggagcatgctaggcccgctcctcaggctcctctcggcgtgcggcggggtctggcccacctcgccggcccccggcgccgcggcctcctcttccgcctcctccggggacgactctgagggccgcgacggccttctctggtggcgcgacctcgcgcgctgccacgccggcgacgtctccgtcgccgtcgcccaggccaaccaggtgctcgaggaccagtgccgcctcgactccgccccgtccatcggcaccgtcgtcggcgtcttcgacggccacggcggccccgacgccgcccgcttcgcctgcgaccaccttgtccccaacctccgagaggcgtcctccggcccgcggggcgtcaccgcagacgccatcagggaggccttcctggccacggaggaaggattcctcgcgctcgtgtcaagcctctgggaggcccagccggacatcgccacggccgggacatgctgccttgtcggcgtcgtgcacaacaggacccttttcgtcgccaacctcggcgactcccgggccgtcctcgggaagaaggcgggccgcgctggccagatcgccgcggagcagttgtccagcgagcacaatgccaaccaggaggctgtcaggcaggagctcatggcgcaacacccagatgatgctcagattgttgcgctcaagcatggggtctggagagtgaggggcctcatacaggtgtctagatcaatcggtgatgtatacctgaaacatgcaaagtataacacagaccagatcaaacccaagttcaggcttcccgaatcattcagcaagccactattgagtgccgatccatctatcatctcccgcgatcttgaaccaaatgactgtttcatcatattcgcatcagatggattgtgggagcacctcagcaatcaagaagccgttgagattgttcacagccatcaacgtgctggaagcgcaagaagactcattaaagccgctctacaagaagcagcgcggaagcgtgagatgcgttactcggatcttacaaagatcgataagaaagttcgcaggcatttccatgatgacattactgtcatcgtcttatttataaactatgacctattattgaaaggtgctccgcagggacaacccctctccatcagatgtgccctagattattgacagtgagctagttcacccactggtattcaagctcctgcgggcagccatatccagagtcagctgacatggtcaaccggttgtgaaaagcgcacaacctccggcaccagtttccttttcgtttccccttttttgcacataaaattgacaagtcgctgaaattgccagttttcccctcttggattatgtcggataaaatgcgtatactcttcggttttggagatatatgtctagactctagagcgtgagggaaggttataaagtcttgtatgtctttgttctcttgcagtcttgcttacagttacagctagctctttttgtatgtaacaattgtcagcaatcagcatgtttaaccacctccgtgacgttttacaagaaaaaaaaaaaaaaaatccacgccgtcatgagcataaattctttacgacttcaaggcttgaaagcaaacag

SEQ ID NO: 10049 - DNA, 2011 bp, Zea mays
cattgggtacctcgaggccggccgggctccactttcctaccctactctcccccctccctctctcttccccgcctctcctctctcttcccgcagcggcagtcgacggcaaaaccctagatccctctccctcttaaaccctctacgaggtaacgtttcttgcccggagattagagctttggctctagatctctcttctccccgtttcctcgattggttcgggaccttccatacgaccaatttcgtggtgtatattggctgctgcctgtgttacagtgcgggaggatgtcggagccttccaaggtaatccacatccgcaacgtcgggcacgagattgccgagtctgatctccttcagctgctgcagccgttcggcgtggtctccaagatcgtcatgttgcgtgccaagaaccaagctcttctgcagatggaagacatacatgcttccgtgagtgcgctgcaatattacacttccgttcaacctagcataaggggaaggaatgtttacatgcagttctcatctcaccaagagcttaccacagaccagagctcgcatggaaggaattctgatcaggagtctgaacccaaccgaatcctcttagttactatccaccacatgatctatcctataacggtggaggttctacatcaagtattcaaagcttatggatttgtggagaagattgtcacatttcaaaagtcagctggttttcaagctcttattcagtttcactcgcgccaagaagctgtggaagcatttggttctttgcatggaaggaacatatatgatggttgctgccagctagatattcaatattcaaatctcagtgaactgcaagtccattacaacaacgaccgatctagagatttcacaaatccatcattacctacagaacaacgccctagggcctctcagcaagcttatcctgatccagctaatctctatgccttccaacaagctggagcttcatatgcacagatggggagggctgcaatgattgctgccgcatttggtggaactttacctcatggagtgactggtaccaatgaacggtgcacactcatagtcagtaatctgaataatgataaaattgatgaggataagctcttcaatctgttttccttgtacggaaacatagttcgtatcaaggtactgcgtaataaaccagatcatgctcttgttgagatggctgacgggttgcaggctgagctagctgtgcattatttgaagggggctatactatttgggaagaagctggaagttaactactcaaagtaccctaacattacacctgccccagatgcccacgactacttgaactcgagcctaaaccgattcaacagcaacatggtaaaaaactaccgacattgctgctctccaacaaagatgatccacatctctgccctcccccaagagatctctgaggaagcaatcctgaaccatttgtctgagcacggtactgttgtcaacaccaagctatttgaggtgaatggcaagaggcaggctctcgttttatttgagactgaagaggcagcgaccgaggccctcgtgtcaaagcatgccagcacacttgagggtaacacgatccggatctctttctcccagatgcagagtatataagccacctcaagggaaagctcatgccgccctcgcttaccacccggcgagcactatttaggaagcatttcagactaagatgtgaatcctctgcgccattctccaagacatgctgtctgagctgtacctccccctgaccttcgggttttcttttcactctacactggccttgcaccaaaaggtttctgtgtttctttccaaatcctgttggctaggttatcaaaggacatttaccccttgtcgtgatattctgagttggaaggcctgttaattgtgtgaatcgtattatccttttgcctggacgctatttgccttgttttatatttttttcggtgtaattgttgcactggacttacttgcagctgcgacctttctgaacacaaaaaaaaaaaaaaaa

SEQ ID NO: 10050 - DNA, 1884 bp, Zea mays
cattgggtacctcgaggccggccgggctgctctagcgccggccgagacacactactgccgtgcccccctcccttctctctctcttcgccgcagcgtcagccgacggcaaaaccctagatctctctccctcttaaaccctctcaacaagtgcgggaggatgtcagagccgtccaaggtaatccacatccgcaacgtcgggcacgagattgccgagtctgatctccttcagctgctgcagccgttcggcatggtctccaagatcgtcatgttgcgtgccaagaaccaagctcttctgcagatggaagacctccatgcttccgtgagcgcgctgcaatattacacttctgttcaacctagcataaggggaaggaatgtatacatgcagttctcatctcaccaagagcttaccactgaccagagctctcatggaaggaattctgatcaggggtccgaacccaaccgaatacttttagttactatccaccatatgatctatcctataacagtggagattctacatcaagtattcaaagcttatggatttgtggagaagattgtcacatttcaaaagtcagctggttttcaagctcttattcagtatcactcgcgccaagaagctgtggaagcatttggttctttgcatggaaggaacatatacgatggctgctgccaactagatattcaatattcaaatctcagtgaactgcaagtccactacaacaacgaccgatctagagatttcacaaatccatcgttgcctacagaacaacgtcctagggcctctcagcaaggttatcttgacccagctaatctctatgccttccaacaagctggagcttcatatgcacagatggggagggttgcaatgattgcggctgcatttggtggaactttacctcatggagtgactggtaccaatgaacggtgcacactcatcgtcagtaatctgaatactgataaaattgatgaggataagcttttcaatctgttttccttgtatggaaacatagtacgaatcaagatactgcgtaacaaaccagatcatgcacttgttgagatggctgatgggttgcaggcagagctagctgtgcattatttgaaggggtctatactatttggtaagaaactggaagttaactactcaaagtatcctaacatcacacctgctcctgacgcccacgactacttaaactcaagcataaaccggttcaacagcaacgtggtcaagaactaccgacattgctgctctccaacgaagatgatccacatttctgccctccctcaagatatctctgaggaagcaatcctgaaccatgtgtctgagcacggcactgttctcaacacgaagctattcgaggtgaatggcaagaggcaggctctcattttgttcgagagcgaagaggaggctaccgaggccctcgtgtcaaagcatgccagcacgctcgagggtaacacgatccggatctctttctcccagatgcagagtatataagccacctcaagggaaagcccctgccgcccccactcgccccacttcgagctctatttaggaagcatttcagactaagatgtgaatcctgcgcatcattctccaagactgatgctgtctgagctgtacctcccctgaccttgttttttttttcacgcaacactggactttcaccaaaaggtttgtgtttctttccaaatcctgttggttaggatatcatttactccttaatcttcatgtcctgacattctaagttggaaggcctgttaattgcgtgtgaattatattatccttttgcctgtttggcatgtttaatgtaccctctagtgcagctgaaaaaaaaaaaaaaaaaaaaaaaaaaaaaaaaaaaatcgagtgggggaaaccggtaccca

SEQ ID NO: 10051 - DNA, 1559 bp, Zea mays
tttggtgctccacccctattgatttagattctagatatttacccgccaatttgattttaaaagttgaatcaaccacactctcaataaaggaagagatggaaacgatgcgtcttgccaacacaaaaccgctagtttttcctcctcttgttttgctgatagactcggtttctaagtaagaaatagttttcttctttatttttctcattgatttgtcttacacgtcaacgtcatcaaaatgctgatactcttagttcttcacggctcagttaaaagaagtgaatacttgggttgacactgaagcatcagtatagccggcatttatattttgccgtgccctcagtttgaccctctggttgccaagaaaacccccgcccagtcagccagtccacgcgaatcgctgcggcctcgctcgttgcaaaccttccagcctgtcttgcctccgctcgaggctacaggacacttcaccctctgccgccccgcctcgtcgccatcctccacccgctatatatagccgccctcctcgagtcttcctcctccatcggccatcgccgtctccagcagagaggaagcgacacagctcaaggacagcgcagcacgcaagcgggaccgcaccgaagcagcacacaagatcacacatcctactgctgcgccgcacaatgggcatctgcgtgtcgtgcgacgcggcggacgagggcgccgcgacggcgagggtggtgctccccagcggcgagctccgggagtacgccccgccggccacggccgggacggcgctgcaggcggccggcggcgagggcccctggctcctctgcgacgccgacgggatggcgttcgagggccccgtcgccgtcgcggcggtcgcccccggcgaggagctccaggccgggcagatctacttcgtgctccccgccgagatgcggcgccgccgcctcacccgcgaggaggtcgccgcgctcgccgtcagggccagctcggcgctcgtcaaggccgcggcggccgcgcaaccgtcctcgccctgccgccggctccggcgcggcgcggtggcgccgctcgtgttcccggtccccgaggaggagtacgcggcggcggacgcggtctcgcccgtcgcggcgaagccgcaccagaagcggagggtggcgtgccggggcgggagggcgtccaggttctcccccgacctgaccgcgatcccggagaccgagagcgagtagatcgagcctccgctcggcatgtgatatgtctctggtggtcagtggtgacgggtcgctcgccggcgcttggtcggacggtgtggccgcgccggagatcgacggtgcgggaagtgttgtagatgcagagctcagaaatgagaaatgtgagtaggcaacaggatgcgcgtgtagagtgtacgttacgtgtaggtttaggtgcatgcaagtgtaaatacacgggatctccgtgcggtgtgcccagtcacagtttggaactcagcttttattagtgctcgtgttcaggctcaaaaaaaaaaaaataaaaaataaaaaaaataaaaaaaaaatatttaaaaataatataaaatataattt

SEQ ID NO: 10052 - DNA, 1820 bp, Zea mays
gagggatggaaaacgatgcgtttcttcccaacacaaaaccgctagtttttcatcctcttgttttgttcatagactcggtttctaagtaagaaatagtttccttctttatttttctcattgatttgtcttacacgtcaacgtcatcaaaatgctgatactcttagttcttcacggctcagttaaaataagtgaatacttgggttgacacttaagcatcagtatagccggcatttatattttgccgtgccctcagtttgaccctctggttgccaagaaaacccccgcccagtcagccagtccacgcgaatcgctgcggcctcgctcgttgcaaaccttccagcctgtcttgcctccgctcaaggctacaggacacttcaccctctgccgccccgcctcgtcgccatcctccacccgctatatatagccgccctcctcgagtcttcctcctcctgcggttggcgccggctccagcggagaagaagaagcgacacagctcaactgctcaaggacagcgcagcacgcaagcgggacctcaccgaagcagcacacagcacacaagatcgcacatcctactgctgcgccgcacaatgggcatctgcgtgtcgtgcgacgcggcggacgagggcgccgcgacggcgagggtggtgctccccagcggcgagctccgggagtacgccccgccggccacggccgggacggcgctgcaggcggccggcggcgagggcccctggctcctctgcgacgccgacgggatggcgttcgagggccccgtcgccgtcgcggcggtcgcccccggcgaggagctccaggcggggcagatctacttcgtgctccccgccgagatgcggcgccgccgcctcacccgcgaggaggtcgccgcgctcgccgtcagggccagctcggcgctcgtcaaggccgcggcggccgcgcagccgtcctcgccctgccgccggctccggcgcggcgcggtggcgccgctcgtgttcccggtccccgaggaggagtacgcggcggcggacgcggtctcgcccgtcgcggcgaagccgcaccagaagcggagggtggcgtgccggggcgggagggcgtccaggttctcccccgacctgaccgcgatcccggagagcgagtagatcgagcctccgctcggcatgtgatatgtctctggtggtcagtggtgacgggtcgctcgccggcgcttggtcggacggtgtggccgcgccggagcggagatcgacggtgcgggaagtgttgtagatgcagagcccagaaatgagaaatgtgagtaggtgtttttggcgcggcggcaacaggatgcgcgtgtagagtgtacgttacgtgtaggtccaggtgcatgcaagtgtaaatacacgggatctccgtgcggtgtgcccagtcacagtttggaactcagcttttattagtgctcgtgttcaggctctgtgtcgtgcatcatggaataaatctctccttgtttgtgaaaaaggaaatctctccttgtgacccaacacaatagtatgaccagtatgattcaagcactcctggtacccatccttttcagctgatagatgaagatgagaacccaacgtttgccgtgcttctaccattattgatatctcaccatcgcaactaatcctttagggctgatttggtgaatagggatcatggggttggatgagattgagagggaaatcaatcttcccgtgatatctttgtcaccaaatcaacacttatgaagtgtttgatataaactgttcattaaactccaccctagagtagtttctaaggccctgtttagcagagctctactaccggattctgca

SEQ ID NO: 10053 - DNA, 951 bp, Zea mays
  misc_feature (590)..(590): n is a, c, g, or t
  misc_feature (669)..(669): n is a, c, g, or t
atcggccatcgccgtctccagcagagaggaagcgacacagctcaaggacagcgcagcacgcaagcgggaccgcaccgaagcagcacacaagatcacacatcctactgctgcgccgcacaatgggcatctgcgtgtcgtgcgacgcggcggacgagggcgccgcgacggcgagggtggtgctccccagcggcgagctccgggagtacgccccgccggccacggccgggacggcgctgcaggcggccggcggcgagggcccctggctcctctgcgacgccgacgggatggcgttcgagggccccgtcgccgtcgcggcggtcgcccccggcgaggagctccaggccgggcagatctacttcgtgctccccgccgagatgcggcgccgccgcctcacccgcgaggaggtcgccgcgctcgccgtcagggccagctcggcgctcgtcaaggccgcgcagccgtcctcgccctgccgccggctccggcgcggcgcggtggcgccgctcgtgttcccggtcccagaggaggagtacgcggcggcggacgcggtctcgccccgtcgcgcggcgaagccgcaccagaagcggagggtngcgtgccggggcgggagggcgtccaggttctcccccgacctgaccgcgatcccggagagcgagtagatcgagcctccgntcggcatgtgatatgtctctggtggtcagtggtgacgggtcgctcgccggcgcttggtcggacggtgtggccgcgccggagcggagatcgacggtgcgggaagtgttgtagatgcagagcccagaaatgagaaatgtgagtaggtgtttttggcgcggcggcaacaggatgcgcgtgtagagtgtacgttacgtgtaggtccaggtgcatgcaagtgtaaatacacgggatctccgtgcggtgtgcccagtcacagtttggaactcagcttttattagtgcc

SEQ ID NO: 10054 - DNA, 2987 bp, Zea mays
  misc_feature (686)..(686): n is a, c, g, or t
cgacgtcggttccagagaaggagaggttgctcgtggctatcgtgggaggacgggagcgcagccgatggatcgcgagcggctaccgtgccacggacggtccggatcaattaaaggcagaacgacagactactcttaccttcttaataagtagtatagattaatctaccatatggtattgcagccaagagttgggagggacttgcttctattgttcttgtgatttcttggacctacgaaagagatctatgagatcccttagttcatgctatagactcttgagtcttttgcgtctatcagttctagtttatggttttgcaattgttcggaaaatgagtcgagatcatcatggtttcagtgtctctccatcgcttggtcacattcaaccttggccggtataaaaccatttaggctactatttgtaatatctacctcgtttttgcttacctactttcatgaagatcgaccaccctcgagtccccctccccctccattaggccttgttcgtttacatcagattgtacccggaatcattccggctaatcaaagtttatataaattagagaagcaatctggctcggaatcgttccgacccaccaatccgacacaaacgaacaaggccttagtcgggttctatccacgtgccctaattagaggcgcaacaatccatggtagagctgctagagcangtgaagttagaatgtttagaagaaaaggttgaacgtaaatcaatatttaatgaatttgtagatgatgtatctccaccaaacagagcctcgtgatgggcagcccaatctgttgacatcccaaaacggcccatgttgaagtaccatgtaggcctcataaccataccgcaccaaactcactctcggtcccccgaccccgcccggcacgaacgaccacgacggagggcagcgatctcggtttttacccaaagacgaagccgacgacaaggagaacagagactccggcgagccccagccacggtgaagccgcgcgaattgcaggagcgaagcaaaggagatgcttctcgaggagctgctccggtgccaaatccacgagtggtacccggccttccgtcgccactccatccccaccgtcatcatcccgctccccgccgccttcctccgctacctcgccggccagcgggcctaccccaacgccgacgccgacgctgaagatggcgctgatgaggagccactaccgttcctccttccggcgataacttccggccgccagcccttcgcgcccatccacgcgcaccaccccgaccccgactctctcctcaactccgacttgttcttcggctccagcagcgaagacgtcttcgaccccgacgccgaccacccgctccggccggaattcccggagctggaggtggccatcgactccgccatcgccgagctaggcggcgccgcgctccccaagctcaactggagcgcgcccaaggatgccaccttcatgtctgccgatggcacgagtcggtgcacgtgcttcgccgaggttgccatgctgctccgctcctccgactgtgtagcccacgaccttgcctccgcgcgacaatcatgcaaggatttcgtgcgcccggagggtgctcgacggaatgcccaaaaagttagtgccggttctgaggaaggtgctcgaccaaatgccgatgggattcgtggctgcgaaggcaccaatggagcaccaagtaattcaagcaagacaggtgaggagggaggcaagacaaatgatggggactgtgatgttgaagatgcaaccgaagaagaacataacgagaatacttgggtggacgatgggttccaatactaccttgccctccgcaagtggtacccaggcctacgccctgagtcagagttccgatgcttcgttcgggagcagaagctggttgctgtgtcccagagagacccatcagcttactacccatcactgcctggatggagttccgaggtgcaaccgaaaattgaggctttcttcaacgaagtgattgagccacagtttgcttcaaacaattatacgtttgatgtgtatgtgaggacagatgggcgagtcaagctcatagatttcaatccatggggtggttataccttgccgctgctgtttacttgggaggagcttgaggagaaggggagagggtctgagctggagtttcgggtggtcatgcagcagggtgcagtgaggccaggattgatgacagctgtgccatatgatatgctggattggggtgaggggagtggctgggatgtttttctgaagaaggctgacgaggagcttgacagacagatatgaactccctggatggtgattcatgattgtggttcgaaaaaaaagtcttaattatgctgtaggcacacaatttaaagtgatgactgctgttttttttacctgctactgtgctacatactagcagtcacctcctttcttaaaattgctatgcagtctcttgccatttatacttttctctttttttttgttactattatggtgctacttagctgtcaatgcagatcacctcttaaggcctcgtttggaacctctaaaactaataattaactactaaaaattagttgttgggtttcaaacaccatcaactaatactacagctaattgttagctacctcacagctaacaattagttcattagcgggctcaatccagctaataatttattagctagctaactattagctctagagttccaaacaggaccttagtctgattgcgtcatgtgttagttggaacctcccagataattcgtatgtggtttttagtggagctgatgttaagtaaaaatctgcagaaatgcatttgcagtgaaacttgtagcccttttgcccagcgctgttgtatatcccttatctttcatggttgattatcattgctctttatatctacccattcatgtgagaactttagttaaggactgagataacaattcatcgtgttagctaagtttagtttcttcttgctaacttacactagaacaa

SEQ ID NO: 10055 - DNA, 1076 bp, Zea mays
ggtaccctcgggcccggcccggacggcgagctgctcccgttcctcctccccgcgatgacctccggtctcctcaactccgacttcttcttcggctccagcgacgaagacgtcttcgaccccgatgccggccacccgctccggccggagtttccggagctgaaggcggccatcgacgccgccatcgccgagctaggcggcgccgcgctccccaagcgcaactggagcgcgcccaaggatgccacattcatgtctgccgatggcacaactcagtgcagtgcacgtgcttcgccgaggttgccttgctgctccgctatttcgactgtgtggctcactgaccttgcctacgcgaggcaatcatgcgaggattttgtgcgcccggcgggtgctcgacggaatgtccaaaaactggatctaacactgccttgtatgcagcatttacaaatgcagtgtctgccaagataccaactggatcacctggtgtcacagaacttgatacatttgtcgagtcaaattgtacaattgagttgctgcacgaagttctcatggttccgtcatagcatactgtgacatctcggagcattgccatcatgttcttaaaaagattgccaggttcagccagtcctttagatgatgagcgctctatcttttcccttactgatattgagtggagtaattcctcgtatggatttaaaccattgtaaaatgaactcgtaacaaaatcatgtccttttgaaggatcataacaattggtgcttccgctgcacctttccagaaagttgtagcagtcctccactaagttgctagagtataacctaccagtcctttgcagttgttgtcccaagaaaccaatctgctcaactaatttcttcagagttgaatctttttttgggtcaaccagcagaccaagggcagaggaattaacaatggagtccacagttaacttgttgaacttatcggtctcaagcgaactactttgatttgccttctgcattgcacaccggccatcaagacctttcaagcttatgctgaaaccatccataagcagtgattccattaggaggggctgcaggccggca

SEQ ID NO: 10056 - DNA, 1189 bp, Zea mays
aagtagcgctgctccacgacgacgtagctgggcagcctgccctccccggcagtggcgcgcgaagtggaggtcgaaggcgtggaagctggcggcgtacttgagctggcggaggctccggtagaagagcgtggacggcgggtactggtagtagacgccgaaggagaggccctcgtcgtggagcgcgtcgaagatggtccgctgcgggaggccagccaccagcgccctgctgtcgttgctgacgaggccgtgggaggtggcggagtgcacgaacagcccggttgggctgcgtggacgccgggttggacgcgaaccagcggtcgcacacggcgaactcccgcaccaggtcccggtacacgggcacggcgtcggggcggaagccgctcatgacggtggcggacatgccgggcctctccttctcggcctgctgcgcgaagccggacatggagggggcgacgcccggcggggtggcgggcgtcgtggcggcgtcgacgaagggcgtcccgtagacctgctcgtagatggcctgcatggagtggcccgggtccgggtccacgtactcggcgccgtcgctgaagcggacggcgtgggaggccgggtcggaggcgtccacgtggttggtctcggcccccgtcacgccgtcgatgtccgggttcagcgacttcatccaccccagcatgtggtcgaaggagcggttctcctgcaccagcaccaccaccgtcttgatcttattgttggtcccggcagctgccgccggtactggtactggtaccggttccgccgccgccattgttgctggactgatggtgtggtagctgcttggtttcttcgttctccgtccccggtcgaccgatacgaaatatatagagagatagccgcccgcccgcgaggggccccagctcggacgcttgtctgccaagcatgtcttaattagcttaaactgcagcatgcgtggacgtacacgcatggcgcatcggaggggaagacgccaacgacagagagaagaagcgtccgtccagagtccagactctccaggcacatcatgcattcatgatctggctttaattaatttgcttgccactcactccaaggcatgcattcgatcgaggcaaccgaaaggtgagagcccaccacaagcagcaagttcaacaagcaaaaacagatgatagatccgcgcggctctaaagagtcg

SEQ ID NO: 10057 - DNA, 1363 bp, Zea mays
gccggccgggtcgggaacctgcagcgaccgcacttcaaacctcctcggccctagcctccccttgggctttcccaggccacaccccgactcaccaatggccggctccggcgccagcgacgatgaggtcatcttcgagatggcgcagttcatccgcgtctacaagagcggccgcgtggagcgctacttcggctccgaccccgtcccggcctccacagacgccgccacgggcgtcgcctctaaggaccgcgccgtctccccagacgtcgccgtccgcctctacctcccgccgcccgccaaggataccgaagacaacggcggaagcagtaagaagcttccaatcctcgtgtacttccacggcggcggcttctgcctccacaccgccttcaacttcgtcttccacgcctacctgacctccctcgccgcgcgtgcccgcgccatcgtcgtctccgtcgagtaccgcctcgcgccggagcacccgctccccgccgcgtacgacgactcctggcgggcgctcctctgggtcgcatcccacgccactggatccggtgaggaaccctggctcaccgaccacggcgacttctcccgcttgtgcgtcggcggcgatagcgcgggcgccaacatcgcgcaccacatggcgatgcgcgccagcgccgagcccctgccgcacggcgcccgcatcagcggcgccgcaatcgtgcatccctacttcctcggagccgaccgggtggcctccgaggagacggaccccgcgctggccgagaacgtggtgaccatgtggcgtgtggtgtgccccggtaccacaggcttggacgacccctggatcaacccgctcgcggccggcgcgcctgggctggaggggctcgcgtgcgcgcgcgtcctcgtgtgcctcgccgagaaggacgtggcccgcgaccggggacgcgcgtacgccgcggagcttagggccagcggatgggctggggaggtgggggtgggcgaggtgaacgggcagggtcactgcttccacctcgtcgacttcgcgtgctccgatgctgtcgcgcaggacgacgccattgcgagatttgttaacctgtactaggatcctgcgatctcgtgggcgtcgtactttgcatatggtctacgcctgcctgatatgtctgtaaacctaccggcgaattcatactcttttacgtttctgcggtccgaaaattattgtcgttgatatacatccggctgcggtcggtggaggattttggatcgccacttgatcaatccaaacttgatttaaaacttttctgtgttctaatcaaaacgaggcacacaaatctaatgccatggcttcgactcttctgatcataacactattttgacgctgatactgcag

SEQ ID NO: 10058 - DNA, 3133 bp, Zea mays
ctcgaagccggccgggccgggacaaaccctctatggctctgtccagtagtagcaatttggatagagatatatgccaattggcaattgccaaagaaaagaaaagaaaaatctctctctcgaccggcctggcatcagcacacgtccacacctaacggcgccaattctaccatccattccaataatccaaggtaaccgaaagcagcagcggaggtcgcaagaacacttccctcctctccggatcaatcatcgatcagccaagcccctacaaaaaaaccatcgccacatgttggctaatcccacgacgcactgatatttttcttccttgattgtcttgctgctatttataatcgatctccagcttacagcgacgtccaggtccaggtctgagctcgaggcacaggactccctttataatttatccatccatggcttcctccaattccaacagcagcagcaacccgctggaagccatgggcgccttcttctcgaagcaggtggaccggcggaagctggtgaccaccgagaagcgggcgctggccacgcggctgtcctcctccggcgacacgttcccggggtcggagcaccggccggcggaccggaagcggtggatggcggagctgggcgccgacaagctgcgcgtgcaccaggtggtgtggcccggcacgcacgactcggccaccaacaagatcggcgtgccgctggtgacccgccccttcgcgcagtgccagtccatgtccgtgtacgagcagctggccatgggcacgcgcgtcgtcgacgtgcgcgtgcaggaggagcgccgggtctgccacggcatcctggcgacgtaccccgtggacgtggtgctggacgacgtgagccggttcctgagcgagaccgagtccgagctggtcatcttggagatccgcaccgagttcgggcacgaggacccgccggggttcgacaggttcctggccgacaagctgggcgagcacctgatcccgcaggacgaggcggtgttccacaggaccgtcgcggagctgctcccgcggcgggtcatctgcgtctggaagccccgcaagtcgccgccgcccaggcccggggacccgctgtggagcgccggctacctcaaggacaactggatcgacacggacctgccggagaccaagttcgagagcaacctcaagttcctggggcagcagccgccggtggccggccggaggttcttctaccgggtggagaacacggtgacgcccaaggccgacaacccggtgctgtgcgtgtggcccgtcacgaagcggatccacggctacgcgcggctcttcatcgccgaggccttcgccaagggcctcggcgacaagctgcaggtcttctccaccgacttcatcgacggcgacttcgtcgacgcctgcgccggagtcaccaaggcgcgcgtcgatggcaccgcgtgacgtgacggcttcgatcgacgagcccgtacgtacgtacgtgtgccagtgttgcggccgtactgccattgcagtgtatgtactgtgtagtgtacactccagtcgtgcagtatatttgcatacaggaacaggtaaatgcgatgtgtatatacgtattcattcatgtgtaacgtgtgcgtcccgtacgtgtatgcagtgcactgtgtctagtgatgaattgctcgtgggacgagcaaaggaataaacatatgcagttacggaattttcaaaaaaaaaaaaaaaaaaacgaaggctattctcgttaagagtttcattgtgttatttgcaataataatgctgccacgttatctgctagacgagatgagataaaagaataaaacatacactctcaaaacaaagttccacttcgcgatttcatagcctataccctgtcaaatgttacatctaaacggccaataatagaaattgagtttaacatggtttcaatttcacggtgataaaaccacttacatctattttataatgaatatggtgtcattttataaaaaaaacgatgtggcgccctaattaacgtatggaactatactgcggagttcggagtgatgagaagagaggaattttagcggtagagtatactccccaaaaggaagtacttttggacataatctcacataattaacaggggagtgtttaattatggtgtctatttcctgttttgcctacattaaatatgttgttgttgctcttactcgtaaaaaaaaaaggctcccgtgagtttgactccgacgtggaggggagtaaaagagatttctacatttttagtgggccaattcatcaagctattaaattgatttttaagcacaagagataactaacagacaataatataaccatgtgtctataaaatcagtcacattataaatataattaaaaatatgtatgaagagttacgtagagacactcttcgtaaggagactgtcttttatttgtttatatatatttaagtctctagagacccattaaaagaccttatattaaatgaggttgagcatcatacttatgtaaaaacgttatgcacaatcattttatgacggcttaattaacaacatgattgtcttgacactgaataatgtttatgacctggcaacgcgacaagttgccgcgcgttgaaattattcgtggccccttggctcaacggccccactactaataaatgtatcacgaggaacctttagggaacccacaattggcaaaacacagaccacatggctttccacttgattcagagagcccccatcaatcaacaccactgcctctcttttcttttttcatcaaaaaatgtggttatctttcttctcagtggttatccacggtgagcgacacatgccaactcgaaattgtgatggacggccgctcagaatgttgtgctggcctgcaactaggcccaaatgtctcagcccagttgtgccccaaggcctaggcctgttctgcgtacagccctctaggctttctaggtgctacttggttttgagtctagttacagtttcagttgggctttacacgtcggtgcgccgcccgtagcctgtttgagacacctccggttgttatcattcaacaaaaatagatttacttcatgaggaaatagccaaataatctagatctaaccaatccagattcaggggtgtttggtttctagggactaactttag

SEQ ID NO: 10059 - DNA, 1777 bp, Zea mays
ttgggtacctcgaggccggccgggagcgaacaaaccctctgtggctctgtccagtagtagcaatttggatagatatatgccaatcggcaatcgccaaagaaaagaagaagaaaaaaatctctctctctctctctctcgaccggcctggcatcagcacacgtccacacctaacgacgccaattgtaccatccattccaatccaaggtaaccgaaagcagcagcggaggtcgcaagaacactaggactcatccctcctccggatcaatcatcgatcagccaagcccctacaaaaaaaccatcgccacatgttggctaatcccacgacgcactgatatttttcttccttgattgtcttgctgctatttataatcgatctccagcttacagcgacgtccaggtccaggtctgagctcgaggcacaggactccctttataatttatccatccatggcttcctccaattccaatagcagcagcaacccgctggaagccatgggcgccttcttctcgaagcaggtggaccggcggaagctggtgaccaccgagaagcgggcgctggccacgcgtctgtcctcctccggcgacacgttcccggggtcggagcaccggccggcggaccggaagcggtggatggcggagctgggcgccgacaagctgcgcgtgcaccaggtggtgtggcccggcacgcacgactcggccaccaacaagatcggcgtgccgctggtgacccgccccttcgcgcagtgccagtccatgtctgtgtacgagcagctggccatgggcacgcgccgtcatcgacgtgcgcgtgcaggaggagcgccgggtctgccacggcatcctggcgacgtaccccgtggagcgtcccgcggggccgcccgggccgggtcctgggcgagaccgagtccgagctgctcatcctggagatccgcaccgagttcgggcacgaggacccgccggggttcgacaggttcctggccgacaagctgggcgagcacctgatcccgcaggacgaggcggtgttccacaggaccgtcgcggagctgctcccgcggcgggtcatctgcgtctggaagccccgcaagtcgccgccgcctaggcccggggacccgctgtggagcgccggctacctcaaggacaactggatcgacacggacctgccggagaccaagttcgagagcaacctcaagttcctggggcagcagccgccggtggccgaccggaggttcttctaccgggtggagaacacggtgacgcccaaggccgacaacccggtgctgtgcgtgtggcccgtcacgaagcggatccacggctacgcgcgcctcttcatcgccgaggccttcgccaagggcctcggcgacaagctgcaggtcttctccaccgacttcatcgacggcgacttcgtcgacgcctgcgccggagtcaccaaggcgcgcgtcgatggcaccgcgtgacgtgacggcggcgatcgacgagcccgtactagtacgtactgccattgcagtgtatgtactgtgtagtgtacactccagtcgtgcagtattatatttgcatacaggaacaggtaaatgcgatgtgtatatacgtattcattcatgtgtatgcagtgcactgtgtctagtgatgaattgctcgtgggacgagcaaaggaataaacatatgcagtgacggaattttcacaggctgttgtactagtaatcaggctattctcgttaagagtttcattgtgttatttgcaataatgctgccgccccgtctgctagacgagatgagataaaag

SEQ ID NO: 10060 - DNA, 1612 bp, Zea mays
cgccccgccggcccggccgggacaatcggagtagatcacacaatagctctccttgttttttttttcaaataaaaaagcacgagctcagcgccatggcgcccgccaaagcgcagcacacaagcactaaccagcagacattgctggatgcgcagctccagctctggcatcacgccttcggctacgtcaagtccatggcgctcaaggccgccctagacctcggcatccccgacgccatccaccagcacggcggctcagccaccctcccacagatagtcaccgagctggccacactccacccgtccaagacaccgtgtctgcgacgcctcatgcgcgtgctcactctcaccggcgtcttcggcgtcgtcgttcagcactcgacgaccgacggcggcagcgatcttgtctacgagctcacgccggcgtctcgcctcctggtcggctcggcgccgtcgaacggcccgaacgtgagtccgtttctgaacatgatcctcggcaccgccttcgtgtcctccttcctcgacctcggcgagtggttccagcacgagctgccggacccgtccccgttcaagctggcgcacgggcggcacgtgtgggacatggcccgccacgacgcgagcttcgccaagctctgcgacagcggcatggtcgcggacagccggttcatcatggacgtcatggtcgaggagtgcgccgacgatgttttccgagggatcagctccctggtcgacgtcgccggcgggctcggcggcgctgcccaggccatcgcgaaggcgttcccgcacatcgactgcagcgtgctggacctcccgaacgtcgtcgccgctgcgcccactagcaccgacgtgaagtacatcgccggcgacatgtttcagagcatcccagccgcagacgttgtcttcctcaagtgggttctgcatgactggggcgatgccgaatgcgtcaagatattgcagaactgcaagaaggccataccatccgaaggagggaaggtgataataatggatatcgtggttggagcggggtcgtccgaccggaagcatgtagagacgcaggtcttgttcgatctctttatcatggctatcaatggagccgaacgagaagaggaagagtggaagaagatcattttcgaagccggatttagctcttacaatatcatacccgttctaggtgttcgatccatcatagaggtctacccgtagtccatacaagttaatgtaacaaagtgctgttttgggcgacccagatgcagtttcgttgaaagcgtccctgaatgatgctagaatcaacagccacacacaataattaataattcgcatcacgtggacaactttccatgtgtttggttgctctcgcatatgaagagccacactctgcacatgcattgaccacagcttgacctgtgtttggttcgctgcatctagctatactggcacgcacgtaccgatgcaatctaaacttatttggctgcatccacagatacgtagaattgattgtacccagtgaaacaggctcatgcgagcttggctacgcacgtccacgcatccaatcacacagaaaattgtgaatcgtgacgaacaatcattgatgttaaaccatattgtgagtggtgact

SEQ ID NO: 10061 - DNA, 8022 bp, Zea mays
gccctgtgggcgtgggggctcccctgtaggctgtagccgccaatgcaagaggaagtagctggcacgcggagacaggtgcgtccagccttagttatcctgcttcttctccttgacatcaggtcagctcagctagtaaaaaaggagcgtccattttatatttataataataggagcatagcaaaaacaaactcatcattacagtaccgttctgtccccgccgattttagtgcctagtttttttatttactcaaggaagtatatatatacttttttattagagcgccgcaaaattttaataatcaggcggagggtacagtcctaggcaggggagggagagggcacatggggttatgcggaagcagcctggtaggtaaggtgccggtgccggtgccggtgccatatgggcctgtgtgcgcttgcaaatgcctgcctgccacctacatattcatatacagctcaccttcatccttcgttccttgcttcatcatcaccaccatctctctagacgcacacagacagaaagagtcggtacaaatcgtcgagggaggccgggcgcgcgtaggaacagaaagacacgcagccagattgacagagctgagtgtgagtacgtactacgtagatacctacagctatactgtactgtacagagtgggaggaaaagggagggagagagagggacgtgtacacacacgcgcgtacaaaaatacagaggaagcttagcttgcctccaaccccgaccgacactcgggctcgtgaaccccgtcccgtaatttctctatatatcccgtccctccccccccggccgtcactcggcctcatctccccacgcaccccggcgcccgcgccgcgccaccttctctcccccctcctcctcctcctctctctctctctctctctctgccacacagcacaccagaagggcagcaggggaggtagagagaggtagcttcgcattctcggtttccctccgcgcgtgtcctcccagcctcgacagagagaagggccaccatcgtccctgcctgattgcgcgccaggcaggcaggcattatggcgccgggcggccggcgcagcaacggcgagacgccgacaggacagcagcagcagcagcagcaggctgacggcaggcgcgggtgcgcatgcggcgggttccccgtgtgcgcgtgcgccggcgcggcggcggtggcgtccgccgcctcctccgccgacatggaccgcgtggcggtggccgccaccgagggccagatcggcgccgtcaacgacgagagctgggtggcggtcgacctcagcgacgacggcctctcctccgccgccgacccgggggccgtcgcgctcgaggaacgccccgtcttccgcaccgagaagatcaagggtgtcctcctccacccctacagggtgctcatcttcgtgcgcctgatcgcgttcacgctgttcgtgatctggcgcctcccccgcccccccccggacgccgctgggtccgcgccgaacaacaacactatatcagccagtagtctcccactccaagcaagcactctactactagactgaagcagtgaattaacaactaaaccaaaccaaaccaaaccaaacgaggcagttaaatttcagtctcgtcaatccgggctcggccattagacaggtgcacgttacagttaggcaggggaccccaggcaggcggccccgcttctcccgttgggctgtcggcagcaccaccgctgcagggtgggacccctcctgcctgcccatggcggctcataaaaaaaaggtgaaggcatctctgtgattggtgctgctaattacccgcaacgggaatccgaggtggggtgcagtgcagtgctggtgggaatcaatgaatgccttttctgcttcagcttgcccgcgtggggtgctgtgctgtgctgcacagagagagaggcgacagtaggcgtggcttgcatgtgagtccaaagccagcctccaagttccggtatagtaaaggatgtttagcggaaaactctgcatcataactagtacaaagcgccttgtgtgttgtgtgtccaaaactaaaaatgtctttttttttctttctttctttcttttccctccatacacttttgggcatgggatgggagagtgaaagtgctggtgagtgactgagtggtgacatagttttttttgggaaggtgataaaaaaagagagagaagaaagtaggactggtggtggtgttgggggcattccagttgcaccctctaatttgggaaggtgggttcttctagactctagagggctcaaccgtttttttttttttggaaggggtttgcatctaaatcctagctttcatgagctcgggcaagcacaaagctttaggtagacgaagaaaaagattgggagaatggtgacagctcgaggcggaagggactagatttgggcccgtttacagctcagaccgtcggcgttgtagcggcactaggctgtacatcgagcgtaggattcgcttccacaggtccacgctgtacagcgaatccctctcagggcttgttcggttctaccccaatccatatggattgagggggattgagagggtttcaatccctagcaagtcaaaatccctcacaatccgtatcaatccccttcaatccatatggattgaaaataaccgaacatagcctcacatggtactgaagcatgcatacacgcgggacaggagtggcgagggaattattcggttattccccgcggtcccgggacggaaagcattggtgtagcagtagatatatctaaattcgttttcaaacgcttattctctatatccaatttcaaatccatattcgacaatgtttggtagcgtctgtatccgcagagcaaaaacaagatatcataaacctatttaaaaactaatctcgcaaaatccacaccctcctcgagcggcgcggccttgcttggctggccaggcgctggcgctttcacgccgcgggccctggacgcaatggatttcggcggcgtgccagctcacgcgcattgactgccactcgcatcgcaccgcgccagcgcttccgtttcctcgctctctccacatgattggttggtgggttcctcctgccgtgccgtgtgccgcgccgcgggtggacggacggacgcctggacgcggcagcacaggacgcacccgcatccagcagtctccgccccaaaataaacgccgtctctagcggatcggtgggagtactttttaagcatttaaaatttcaactagatttatataagatattaaagctatttatttatattctaaacgaattcataataaaagtatatttatcgaattatctactgatgttataatttaataaaaaaagttaacatctgaactgtatgtatggtatgctaggtggaaaacaggatttggcagtgtgattttaactaacgaatcgtggtgaatctgtgcagggtgctcatcttcgtgcgcctgatcgcgttcacgctgttcgtgatctggcgcatctcgcaccgcaacccggacgcgctgtggctgtgggtgacgtcgatcgcgggcgagttctggttcggcttctcgtggctgctggaccagctgccgaagctgaacccgatcaaccgcgtgccggacctgggggcgctgcggcagcggttcgaccgcgccgacgggacgtcgcggctgccggggctggacatcttcgtgaccacggcggacccgttcaaggagccgatcctgagcacggccaactccatcctctccatcctggccgccgactaccccgtggagcgcaacacgtgctacctctccgacgactcgggcatgctgctcacgtacgaggccatggcggaggccgccaagttcgccaccgtctgggtgcccttctgccgcaagcacggcatcgagccgcgcggccccgagagctacttcgagctcaagtcccacccctacatgggccgctcccaggaggacttcgtcaacgaccgccgccgcgtgcgcagggactacgacgagttcaaggcgcgcatcaacgggctggagaacgacatcaggcagcgctccgacgcctacaacgccgccagggggctcaaggacggcgagcccagggctacgtggatggccgacggcacacagtgggagggcacctgggttgagccgtccgagaaccaccgcaagggcgaccatgccggcatcgtcctggttagtcgtcgttttcttcttctcagagcatcttccactgacacacatgtggccgaatgaaatcggttaggagacagatgaggggtgtttttccatggggattttggcggattggacgcggctgatggtggagagcgcaaccgccgcacactgattcctcagctctaatccaccgccattgaattgaatggacgacgccacgacggatgatgcgatgcgtccatgggcagacacagacagagccatccagctagcccacccattttcccattgaattgaacccctagcgtgacgaggtggttggggtggtcctttccccccgacaccaccacagcatcgcctttaaatccaaaatcaattagccactggtgggttcctgattagggctgtgctgtgtgctgcctttcttcagtcgccctcaatcatttgattccccggctaagttactactctgctctatccacctcctgtagtaattaacttaaggaatcaccacttgattgaccgccagttttttttaattaaccgacagtttcactttcactttcaccaaattacacattcacatttaccatgacaaagttaacccggtcggtaattagtagtaattaccccattggagccactgtaaaaaaaaaaatctcacttctaacggttgtgcgaaaatttgcaggtgcttctgaaccacccgagccacagccgtcagctcgggccgccggcgagcgcggacaacccgctggacttgagcatggtggacgtgcggctccccatgctggtgtacgtctcccgcgagaagcggcccgggcacaaccaccagaagaaggccggcgccatgaacgcgctgacccggtgctccgccgtgctctccaactcgcccttcatcctgaacctggactgcgaccactacatcaacaactcgcaggcgctgcgcgcgggcatctgcttcatgctcgggcgggacagcgacacggtggcgttcgtccagttcccgcagcgcttcgagggcgtggaccccacggacctgtacgccaaccacaaccgcatcttcttcgacggcacgctccgggcgctggacggcatgcagggccccatctacgtcggcacgggctgcctgttccgccgcatcacgctctacggcttcgacccgccgcggatcaacgtgggcgggccgtgcttcccgtcgctgggcggcatgttcgccaagaccaagtacgagaagcctgggctggagctcaccaccaaggccgccgtggccaagggcaagcacggcttcctgcccatgcccaagaagtcgtacggcaagtcggacgcgttcgcggacaccatcccgatggcgtcgcacccgtcgccgttcgcggccgcggccgccgtcgtggcggaagaggcgaccatcgccgaggcagtggcggtgtgcgcggcggcgtacgagaagaagaccgggtggggcagcgacatcgggtgggtgtacggcacggtgacggaggacgtggtgacggggtaccggatgcacatcaaggggtggcgctcccgctactgctccatctacccgcacgccttcatcggcaccgcccccatcaacctgacggagcggctgttccaggtgctccgctggtccacgggctccctggagatcttcttctcccggaacaacccgctgttcgggagcacgttcctgcacccgctgcagcgcgtggcgtacatcaacatcaccacgtacccgttcacggcgatcttcctcatcttctacaccacggtgccggcgctgtcgttcgtgacggggcacttcatcgtgcagcggcccaccaccatgttctacgtgtacctggccatcgtgctgggcacgctgctgatcctggccgtcctggaggtgaagtgggcgggcgtgaccgtgttcgagtggttccggaacgggcagttctggatgacggccagctgctccgcgtacctggccgccgtgtgccaggtgctggtgaaggtggtgttccggcgggacatctcgttcaagctgacgtcgaagcagcccgcgggggacgagaagaaggacccctacgccgacctgtacgtggtgcgctggacctggctcatggtgacgcccatcatcatcatcctcgtcaacatcatcggctccgccgtggccttcgccaaggtgctggacggcgagtggacgcactggctaaaggtggccggcggcgtcttcttcaacttctgggtgctgttccacctctaccccttcgccaagggcatcctggggaggcacggcaagacccccgtggtggtgctcgtctggtgggccttcaccttcgtcattaccgccgtgctgtacatcaacatcccccacatccacggccccggcggcaagcacggcggcgcgatcggaaagcacggcgccgcccaccatggcaagaagttcgacggctactacctctggccgtgaaggatcgatcgattggagcagccaacccagcatcgtcatgcatgcacatacctgccctgatgatgatatggtgagccgcgaaggtgaagagagtacgttcccgttcatccatcgtccttagtgatgcccggtgattagttgatgatgaagagtgaagaagactacacaccaacccacacacatttgatcgacccagcgacgtacccgccaattttttttcttcttctttcctttttgcccgcccccttttcttcattctttttcttctagttttgtccagaaattgaaagatgtgttaagatgtgttgatttgatttagttttttaattaccgtacccgtggtaattaaattatgtacctacttatatatacattacgccgaagaggaaggatcactttgtataagaaaagagagaaatgggggatgtaggagggggggctaggggcccggctttggggtggtattcttttagcatatggaacacaataaatttaatttcattcttggaaaaaaagaatgtgtgcaccccctctgttgatctaattaatgttggctatccctcgcctccgctctactagagcagtgcgtgttgtcggttgcgtgcgaatcggaatttcctgtaatctactctactctactacagtagtgctcggtgggtttttgacttgtgtgcggttgatgccctcctagggccacgtgatggcatggccgtgcttgttaagctgtacgtactctgcttgagcacggcgcggcgtcgtgcagagtagcggtggctttgccgacatgtgggcgtgagtgactgatgaggcaggtggcgggaatcttgcgctgccagtactgacttgaacgtggatgcgttgatgagggactgagggagagagagagagacggtcatgtggtggacaagcatgttgccgcgttcggcaaacgcgcgcggcgcttctgtccatgacccccatgccatgcttgagtgcgcaacatggcgcttactgggagatatctcttgtatttctaaatcatgtttgttcaaactatattgatttagtatactcatctcttagtactagtttggtcttaggactagtttgggagacataaaaccgtagtagattggagtggttagaatctctttcttattcaaatttgaataaaaagaagtcgattttagccactccaatcacattcgtttttgtggctctcaaactgtcccttatcatggtagatttccgcggggataaactccccgacaaatacggagatggaagaaaaagctctcccacagacttttgtggggacatggaattatccgttgatcgtattagactaccccagtatcatcctgtatatgctcctctacgctagatttagagattgatgacgttatgtacatgtctaacaataccctgtaaacgagtattaaa

SEQ ID NO: 10062 - DNA, 3208 bp, Zea mays
gggtgacgtcgatcgcgggcgagttctggttcggcttctcgtggctgctggaccagctgccgaagctgatcccgatcaaccgcgtgccggacctggcggcgctgcggcagcggttcgaccgcgcgggcgggggcgccggcggagggacgtcgctgctgccggggctggacgtgttcgtgacgacggcggacccgttcaaggagccgatcctgagcacggccaactccgtgctgtccatcctggccgccgactaccccgtggagcgcaacacgtgctacctctccgacgactccgggatgctgctcacctacgaggccatggcggaggccgccaagttcgccaccgtctgggtgcccttctgccgcaagcacggcatcgagccgcgcggcccagagagctacttcgacctcaagtcccacccttacatgggccgctcccaggaggacttcgtcaacgaccgccgccgcgtgcgcaaggactacgacgagttcaaggcgcgcatcaacggcctcgaccacgacatcaagcagaggtccgacgcgtacaacgccgccagggggctcaaggacggcgagcccagggcaacctggatggccgacggcacccagtgggagggcacctgggtcgagccctccgagtcccaccgcaagggagaccacgccggcatcgtactggtgcttctgaaccacccgagccacagccgtcagctcggcccgccggcgagcgctgacaacccgctggacttgagcatggtggacgtgcggctcccgatgctggtgtacgtgtcccgcgagaagcggcccggtcacaaccaccagaagaaggccggcgccatgaacgcgctgacccggtgctccgcggtgctgtccaactcgcccttcatcctcaacctggactgcgaccactacatcaacaactcgcaggcgctgcgcgcgggcatctgcttcatgctcggccgcgacagcgacacggtggccttcgtgcagttcccgcagcgcttcgagggcgtggaccccacggacctgtacgccaaccacaaccgcatcttcttcgacggcacgctcagggcgctggacggcatgcagggccccatctacgtgggcacgggctgcctgttccgccgcatcacgctctacggcttcgacccgccgcggatcaacgtgggcgggccgtgcttcccggcgctgggcggcatgttcgccaaggccaagtacgagaagcccgggctggagctcaccaccaaaggccgccgtggccaagggcaagcacggcttcctgcccatgcctaagaagtcgtacggcaagtcggacgcgttcgcggacaccatcccgatggcgtcgcacccgtcgccgttcgcggccgcctcggccgcctccgtcgtggcggacgaggcgaccatcgccgaggccgtggcggtgtgcgcggcggcgtacgagaagaagaccgggtggggcagcgacatcgggtgggtgtacggcacggtgacggaggacgtggtgacggggtaccggatgcacatcaaggggtggcggtcccgctactgctccatctacccgcacgccttcatcggcaccgcccccatcaacctgacggagcggctgttccaggtgctccgctggtccacgggctccctggagatcttcttctcccggaacaacccgctgttcgggagcacgttcctgcacccgctgcagcgcgtggcgtacatcaacatcacgacgtacccgttcacggccatcttcctcatcttctacacgacggtgccggcgctgtcgttcgtgacggggcacttcatcgtgcagcggcccaccaccatgttctacgtgtacctggccatcgtgctgggcacgctgctgatcctggccgtcctggaggtgaagtgggcgggcgtgacggtgttcgagtggttcaggaacgggcagttctggatgacggccagctgctccgcgtacctggccgcggtgtgccaggtgctggtgaaggtggtgttcaggcgggacatctcgttcaagctgacgtcgaagcagcccgcgggggacgagaagaaggacccctacgcagacctgtacgtggtgcgctggacctggctcatggtgacgcccatcatcatcatcctcgtcaacatcatcggctccgccgtggccttcgccaaggtgctggacggcgagtggacgcactggctcaaggtggccggcggcgtcttcttcaacttctgggtgctcttccacctctaccctttcgccaagggcatcctggggaggcacggcaagacccccgtggtggtgctcgtctggtgggccttcaccttcgtcatcaccgccgtgctgtacatcaacatcccccacatccacgggccaggcggcaagcacggcggcgcgatcggaaggcacggcggcgacgcacaccaccatggcaagaagttcgacggctactacctctggccgtgaagcgccgagcagccagcatcgtcatgcatgcacatataccgcctgccctgatggtgacgatggtgagccgccaaggtgaagactgaagagtacgttcccgttcatccatccatcgtctccttagtactgctgcccggtgattagtcgatgaagagtgaaggtgaaggctacccacacacacacatttggtcgacgtacccgccaaaatttgaattttttttcttcccccttcttccttctcattcttttttcttttagttttgtccagaaatcgaaaggtgtgttgatttgatttagtttttttaattaccgtgccccgtggtaattaattatgtacgtacttatatatatatacattacgccgaagaggaaggagcactttgtataagagaggaatggggaacgtacttatgggtggggggccggggtgtcagcgtctgcctgtctgtactgtacatggcttagaggagtcacatgcagagagggagggccctggctttggggtggtattcttttggtacatggatcaagaataaattgaatttcattcttgttgtttggaaaaaaaaaaaaaaaactcctccctcctggactctggttcctgtggagagtatgtatctttattattactgatgtaccacctgtgtgttgtcggtactgtaattggatagtaagtactacactgatctgctggtctaatcaatgttgttgttttatatggataataataatgattagtaagtcaatggtgaacaaaaaa

SEQ ID NO: 10063 - DNA, 1426 bp, Zea mays
cacggtgacggaggacgtggtgacggggtaccggatgcacatcaaggggtggcggtcccgctactgctccatctacccgcacgccttcatcggcaccgcccccatcaacctgacggagcggctgttccaggtgctccgctggtccacgggttccctggagatcttcttctcccggaacaacccgctgttcgggagcacgttcctgcacccgctgcagcgcgtggcgtacatcaacatcacgacgtacccgttcacggccatcttcctcatcttctacacgacggtgccggcgctgtcgttcgtgacggggcacttcatcgtgcagcggcccaccaccatgttctacgtgtacctggccatcgtgctgggcacgctgctgatcctggccgtcctggaggtgaagtgggcgggcgtgacggtgttcgagtggttcaggaacgggcagttctggatgacggccagctgctccgcgtacctggccgcggtgtgccaggtgctggtgaaggtggtgttcaggcgggacatctcgttcaagctgacgtcgaagcagcccgcgggggacgagaagaaggacccctacgcagacctgtacgtggtgcgctggacctggctcatggtgacgcccatcatcatcatcctcgtcaacatcatcggccccgccgtggccttcgccaaggtgctggacggcgagtggacgcactggctcaaggtggccggcggcgtcttcttcaacttctgggtgctcttccacctctaccctttcgccaaggggcatcctggggaggcacggcaagacccccgtggtggtgctcgtctggtgggccttcaccttcgtcatcaccgccgtgctgtacatcaacatcccacacatccacgggcccggcggcaagcacggcggcgcgatcggaaggcacggcggcgacgcacaccaccatggcaagaagttcgacggctactacctctggccgtgaagcgccgagcagccagcatcgtcatgcatgcacatataccgcctgccctgatggtgacgatggtgagccgccaaggtgaagagtgtacacgttcccgttcatccatccatcgtctccttagtactgctgcccggtgattagtcgatgaagagtgaaggtgaaggctacccacacacacacatttggtcgacgtacccgccaaaatttgaattttttttcttcccccttctcccccctccctctcccttctcattcttttttcttttagttttgtccagaaatcgaaaggtgtgttgatttgatttagtttttttaattaccgtgccccgtggtaattaattatgtacgtacttatatatatatatacattacgccgaagaggaaggagcactttgtatcgagaaaaaaaaaaaagaccccaaaaagaaaaaaaaaaaaaaaaatccgggcggccg

SEQ ID NO: 10064 - DNA, 2645 bp, Zea mays
cgcaacacgtgctacctctccgacgactcgggcatgctgctcacgtacgaggccatggcggaggccgccaagttcgccaccgtctgggtgcccttctgccgcaagcacggcatcgagccgcgcggccccgagagctacttcgagctcaagtcccacccctacatgggccgctcccaggaggacttcgtcaacgaccgccgccgcgtgcgcagggactacgacgagttcaaggcgcgcatcgcccggctgccgttgctgtcgaggcagcgctccgacgcctacaacgccgccagggggctcaaggacggcgagcccagggccacgtggatggccgacggcacacagtgggagggcacctgggttgagccgtccgagaaccaccgcaagggcgaccatgccggcatcgtactggtgcttctgaaccacccgagccacagccgtcagctcggcccgccggcgagcgcggacaacccgctggacttgagcatggtggacgtgcggctccccatgctggtgtacgtctcccgcgagaagcggcccgggcacaaccaccagaagaaggccggcgccatgaacgcgctgacccggtgctccgccgtgctctccaactcgcccttcatcctgaacctggactgcgaccactacatcaacaactcgcaggcgctgcgcgcgggcatctgcttcatgctcgggcgggacagcgacacggtggcgttcgtccagttcccgcagcgcttcgagggcgtggaccccacggacctgtacgccaaccacaaccgcatcttcttcgacggcacgctccgggcgctggacggcatgcagggccccatctacgtcggcacgggctgcctgttccgccgcatcacgctctacggcttcgacccgccgcggatcaacgtgggcgggccgtgcttcccgtcgctgggcggcatgttcgccaagaccaagtacgagaagcctgggctggagctcaccaccaaggccgccgtggccaagggcaagcacggcttcctgcccatgcccaagaagtcgtacggcaagtcggacgcgttcgcggacaccatcccgatggcgtcgcacccgtcgccgttcgcggccgcggccgccgtcgtggcggaagaggcgaccatcgccgaggcagtggcggtgtgcgcggcggcgtacgagaagaagaccgggtggggcagcgacatcgggtgggtgtacggcacggtgacggcggacgtggtgacggggtaccggatgcacatcaaggggtggcgctcccgctactgctccatctacccgcacgccttcatcggcaccgcccccatcaacctgacggagcggctgttccaggtgctccgctggtccacgggctccctggagatcttcttctcccggaacaacccgctgttcgggagcacgttcctgcacccgctgcagcgcgtggcgtacatcaacatcaccacgtacccgttcacggcgatcttcctcatcttctacaccacggtgccggcgctgtcgttcgtgacggggcacttcatcgtgcagcggcccaccaccatgttctacgtgtacctggccatcgtgctgggcacgctgctgatcctggccgtcctggaggtgaagtgggcgggcgtgaccgtgttcgagtggttccggaacgggcagttctggatgacggccagctgctccgcgtacctggccgccgtgtgccaggtgctggtgaaggtggtgttccggcgggacatctcgttcaagctgacgtcgaagcagcccgcgggggacgagaagaaggacccctacgccgacctgtacgtggtgcgctggacctggctcatggtgacgcccatcatcatcatcctcgtcaacatcatcggctccgccgtggccttcgccaaggtgctggacggcgagtggacgcactggctaaaggtggccggcggcgtcttcttcaacttctgggtgctgttccacctctaccccttcgccaagggcatcctggggaggcacggcaagacccccgtggtggtgctcgtctggtgggccttcaccttcgtcatcaccgccgtgctgtacatcaacataccccacatccacggccccggcggcaagcacggcggcgcgatcggaaagcacggcgccgcccaccatggcaagaagttcgacggctactacctctggccgtgaaggatcgatcgatcggagcagccaacccagcatcgtcatgcatgcacatacctgccctgatgatgatatggtgagccgcgaaggtgaagagagtacgttcccgttcatccatcgtccttagtgatgcccggtgattagttgatgatgaagagtgaagaagactacacaccaacccacacacatttgatcgacccagcgacgtacccgccaattttttttcttcttctttcctttttgcccgcccccttttcttcattctttttcttctagttttgtccagaaattgaaagatgtgttaagatgtgttgatttgatttagttttttaattaccgtacccgtggtaattaaattatgtacctacttatatatacattacgccgaagaggaaggatcactttgtataagaaaagagagaaaggggggtggtggggggggggctaggcccccggctttggggtggtattcttttagc

SEQ ID NO: 10065 - DNA, 900 bp, Zea mays
  misc_feature (8)..(8): n is a, c, g, or t
  misc_feature (54)..(54): n is a, c, g, or t
ggtacccntcggggccggccgggaagtacatcaatcatcccacacatccacggngcccggcggcaagcacggcggcgcgatcggaaggcacggcggcgacgcacaccaccatggcaagaagttcgacggctactacctctggccgtgaagcgccgagcagccagcatcgtcatgcatgcacatataccgcctgccctgatggtgacgatggtgagccgccaaggtgaagagtgtacacgttcccgttcatccatccatcgtctccttagtactgctgcccggtgattagtcgatgaagagtgaaggtgaaggctacccacacacacacatttggtcgacgtacccgccaaaatttgaattttttttcttcccccttctcccccctccctctcccttctcattcttttttcttttagttttgtccagaaatcgaaaggtgtgttgatttgatttagtttttttaattaccgtgccccgtggtaattaattatgtacgtacttatatatatatatacattacgccgaagaggaaggagcactttgtataagagaggaatggggaacgtacttacgggtgggggccggggtgtaagtgtctgcctgtctgtactgtacatggcttggaggagtcacatgcagagagggggtactaggggggcccccttggctttggggtggtattcttttggtacatggatgaacaataaattcaatttcattattgttgtttggaaaagaggtgtacaccctcctccctcctgtactctggctctttgtgttgttggtactgtaattgacacgactacactgatctgctggtctaatcaatgttgttgttttatatggataaaaaacaaaaaaaaaaaaaaaaaaaaagggcggctgctcgcgatctagaac

SEQ ID NO: 10066 - DNA, 3755 bp, Zea mays
tggcctaggggagctttaatgagccacatcaacaacttctccaccatatcctgtcacgtaggctgctggattgcgcgcactctatccaagagagtttgactcacgtatagatgagcgatcgattgtcacctttgtgggaagccgaaaaaataaagaaaagatggagtttcgacgcaaaaaatgctcaaattggtatacaacatctctcggaattgctcttagactaaggccaaccgatctgatccaatctgctaatttttttttactcggcggccagtgtaacgaataggtacaaaccattttttgatccacaataatccatagcctaggcacaaactatgcatgtaacctaaaatctgatctaacctaaaaaaatcgaccataaactaaaaaaacctgattcaattcgaaaaaaactgattgacatatccatgggaggcatgtcccaacccaattcaatccgatactaaacacgggtcgtgcaaaaaaaaaaacgtacaaaccgttcttgatacgatccaaaccctactcaacccgacgtctagagcaagggagtggagtgctggacgtcgccaacgtgtgggcccactttttcatttttggcgtggcacgaaccttgacgcgctccctctcgtactgggaagcggtccctaccaactggcggcggcggttcataccctcgcgaagaccactagggccgccgccggcgaatctcaagttctcaacacctggcagaagcaaatcggcgtggcactcgccgggcaccgctcccttctccctcctcccacttcccagttctcgatcgtctcaactctgcgggctgcggttccgcctccgcctcctgacgacctcgcccacacgaccgctgcccgcttcgctcgtcgcccacaccgccgttctctcccccgggtgcccataaacccccttctccgcgccatcgttggcccggcgtaaccatctccgctgcggggacgaggaggagcaagcaaacaggaagcagccgagtatcttgccagtatattatatgcgttgaggtggcattgctgatgaaagtgaagacatgaggcttgaatgaaccctaactgcccccgccaaccgccgccgccgcagcagtcaccgactcctccagtcaaatcagccatgtcgccgccgccctgtgacgccctgcccaccgctgccaacaacatccagccatttcttgtccttcacaaggctgctgcctcctcggtgccatcttcccggtctcagcgccagattcagacctcacagccatcctcacccaaccgcaaatcagcaaacagatgtcgtcaaccagcgggtgaggagtgtgaggacgaaggggattcggagctatatgagcagctgcgtgctgaggccttccaccgaacttggtccaagatccagtccaccatcgacgaggtcctcagggccatcaacctcaagctgttcgaccaggtgctgcagtgggcgaaggagtccttcgcttcggcccatgccatcacgaaaaagcaccacactgaagtccagcagccataccctctcctgactgatgtgatctgcagaaggatcccgacggtattcgtcctcaccaagaatgcagagtttgttgatgatatcacaacgtttcatgaccttgcagggcatatgaagtccaatggatgtcacatagtcaagctgtcagcggctgagttatcagcaaaacatggagttggtggttgcttcaggagcctgttgggacagctattatccgatgttccagatgttgctgatgtatctgcgctagcatcatggtattgtgaagctgagaactttgatcagcctatcattgtcataattgatgatttggagcaatgttctggcgatgtgcttggagagtttgtgatgatgctgagtgagtgggtgtttaaaattccagtcttctttgtaatggggatagcaactacccttgatgctccaaagaagcttctctcgtcagaggctcttcaacgattagagccctgcaaacttaccttggggtctccctcagatagattgaatgcacttgttgaggctgtccttgttaaaccatgcgctggattttgcatcagtcatgaagtcgcactgttcgtcagaaattacttttttaggcatgatgggacaataacttcttttattactgctctcaagcttgcatgcagtaagcacttctccatggaacctctaagctttttgtgcttaggaatggtggaggaagattctgaggaattttggcatgataagcttgaatcgctccctcaaacaatatggaaacatgctttcgatctaccctcaaacaaaaatgcaaggaattcttgcaacatggtagaaggattgtctaggctgctgaaatcgcaaaaggattggagttctgttctcttgtgcctgtatgaagctggaaggcatgacaaagtgcagcttttggatatcttctgtgaggcagccagcccagattggcaaactgaaaatgcaccagatagttacctatttgcttctaaagtggctttattaggagtaaagtcagggtctgctagaagatttatagcccaagtaatgaatacaataaggtacttgcctacggaaattttgttacacgtccttgaggtttggagcatccatttaaaaggaatgagtgagatcaacgacagagtgaaggagcttcggtcaaaaggttgtggtgcagatagtgttagggccaaaaggaaatcaaccgccaatactggaaatggagtggttctaataaacgaggaagcggctgcgctgttacaggatgttatcaggaaatatttggtacctgctgaatgcttacctttccatgaaatagtctgcttcaagaatgttgacatcctccgatctgcgctgattggaaacccaagaagaatgattcaactcgatcttctgaggtcacagagccatctgaaatgctcttgttgcagtaggagtggtgctgccgtgtcaggatcgttgcacgacacatcaatcctgtgcagtctagcccaagagtatggtgacatgattaacctccatgactggtacacggcctttgaagggattataaagagcacaaactcaaaagccaaagggaaatcttgcagctctccctcgaagaagaagaagaaatcaaaccccacgcctctggagggtgatggcatgatccaagcaaggttctgcagcgccgttactgagatgcaggtcactggccttgttcggatgccgagcaagagaaggcccgatcttgtgcagagaatcgcgttcggtccttaacagctcggtgattacatgcatgctatacagacgaaacgttttgtgcacgctgacgataatcccaccatgtggtaaattgggcagccgtggaaggaaggtttggttacttgtatcggtgcttcgaagagagctgtgagatggagcagcagccgccgcttcagatatgcagtgctgatgttgcgtctgatggctaagctatgtcgttatttttttcctcttaagagcagtattaaacatgttttagctattgattcggctctctgtagagctgacatgggctcatgtagcccaaggggtacatttgagaaatttttatccttgaaacaaagggcatttccaattatttccccttttactgatctgttttcagttgcagcacagcatggaacaacgtatgaaaagcaaagcatagctgctgcctgctgatgatgtgaaaaaaaggtcaaaaaaaaaaacaaagaaaaaaaaaaaaaaaa

SEQ ID NO: 10067 - DNA, 773 bp, Zea mays
cccagcgtccgcccacgcgtccggggggggggggggtgctgctccggcgctttctgggactccggctaccactaccagtacttccaaagcaccagatcttatgtcaatcttctcagatgatgtaccaactggagtgactagtagtgggtccaccgatcccactccaggtgatgctatttcggtgagctcccaaagaggagcgactgcagtggcaccaaagaagggctcgagccttcaagatgccttgcaaaaggactcgactgcacggcaagtaggtgtgacaccgacagggaacaacaccaatcttttcaaggacttgctaggctaaaggggacagtaaggcacaccgtatgctccgcgtggcctctttgggtagatggagttcatctccgacatgtctcgatcactgaaacagcgatgatctcgctgtttgatcagcgtaggaaaagggttgcaagggctatatttgttctcgagtcacaagacacgacctgttctccttccagtttggaggggggttgcgctgttgagatctgtgaatggttgcgggtatttttcctttaacctcttgtgattttgtgctgagactattgtacatgtgtttacatgacgtgtaatctgtacatgagaccatggtccagaagcgtgtgccggcgcatttttgttcagctgggctagatacactacaattgctgggcactggaaagtaaacaatgaaataattggtgtcattctctggttggaatataaaacagccgcagatttgtttttgc

SEQ ID NO: 10068 - DNA, 3853 bp, Zea mays
tttttttttttttttttttataaaccaacactcctaaatgaagtgattaaaataggtcttccaaataaaatttttaggaactaaagtttctccttaaaatataagaggatggctgaagaaaccaaacacctacttacattattttgaaacatattagtacacggcttaaaattttcgtgcaaccgaggagtgaaaaacagacttgttccaacgtcccttgcaaaacagatcaaaatcagtaaaacgacggaaaagaaaagaaaaaaaacaggaaaaggccctcccgcccgtcgccaatcccaatcccgagctccaagcaaacccacctccccggctgtcccccactcgccgatccagatctcctccactccaaccggacgcctccgccgccgctggcatcggtcgagccacacgcgcacgccgctgaggaacccggagcgggcgccggcaatggagcagctgcggacgatcgggcgggagctggcgatggggtcgcagggcgggtgggggcagtccaaggagttcctcgacctcgtcaagtccatcggcgaggcgcgctccaaggcggaggaggaccgcatcatcgcgcgcgagcttgagcacctcaagcgccgcctcgccgaccccgacgtgccacgccgcaagatgaaggagctcctcctccgcctcgtctacgccgagatgctcggccacgacgcctccttcggccacatccacgccgttaagatgacccacgacgagtcgctcccgctcaagcggaccggttacctcgctgtcgcgctctttctcgacgaacgccacgacctcgtcatcctcgtggtcaacaccatccagaaggacctcaggtcggacaattacctcgtcgtctgcgcagcgctcaccgccgcgtgccgccttatcggtgaggaggccatccctgccgtgctgccccaggttgtagagctgctcgcgcaccccaaggaggctgtgaggaagaaggccgtcatggcactacaccggttctaccagcgatccccctcctccgtctcccacctcgtctccaacttccgcaagaggctctgtgataatgatccaggggtgatgggtgcaactctttgccccctctatgacctgattttggaggaaccaaattcgtacaaggatttggttgttagttttgttaacatcctcaaacaagttgcagagaggagactaccgacttcctatgattaccaccaaatgcccgcaccgtttattcagataaaactattgaagatacttgctgtacttggtagtggcgataaacaagcaagtgggcatatgtacactgtattgggtgacatatccaggaaaggtgacactgcaagcaacattggcaatgctatactgtatgaatgcatatgctgtatttcattcattttcccaaaccctaagatgctagaggctgcagctgaaacaacatcaaagtttctgaagagtgatagtcataatcttaagtacatgggtattgatgctcttggccggctaataaaaataaacccagatattgcagaagagcaccagctagctgtcattgattgcctagaggatccagatgacactttgaagcgcaagacctttgagcttctttataagatgacaaaatcaacaaatgttgaagtgattgttgataggatgattgaatacatgatcaacataactgatcatcattataagacagaaattgcatcacgttgtgttgaacttgcagagcaatttgcgcctagcaatcagtggttcatccagaccatgaacaaagtctttgagcatgccggagatcttgtcaacatcagagtggcgcacaatctgatgcggctaattgctgaaggctttggagaggaggatgaaggtgctgacagtcagctaagatcatcggctgtggattcatatctccgcattgtcggagagccaaagcttccttcttcgtttctgcagataatatgctgggttttgggggaatatggaacagcagatggaaaatattcagcttcttatattattgggaagttgtgtgatgtggcagaggcccacctcactgatgacactgtcaaggcatatgcgatctcagcaattctgaagacatttgcgtttgaaatcactcttggaagaaagatcgatttgctgcctgagtgtcaaacattggtagatgaattgtcagcttcacattcgacggacttgcagcaacgggcatacgagctacaggctttactaggcttggacaaaactgctgttgaaagtgttatgcccgcagatgcaagctgtgaagacattgaggtcgacagaagcctctcatttctaaacagttatgtgcagcaagccttggaaaatggtgcgtccccttacattccagagagtgaacgctctggtgttataagtgtcggcagctacagaagccaagaacaacaggaaacatctgcccatactcttagatttgaggcctatgagatgcctaaaccttcgttgccactagcaacttcacaaaccagcatgtccacaccacctactgatctggttccagttccagaggcaggctactacaaggaagacaatcaaacatcaatgtctcaaccaccaagtgatgcaatttctggtgagtttggtgtcaaacttcgccttgatggtgttcaaaagaaatggggaaggccaacatattcttcttctacaccctcaagctcgatctctagtcaaccaacacccaatggggcctctcattctgatgggggagggtcaagttcgcaaccacgggagtcatcatacggttctaagagacagcagggcacggaagtttcagcagaaaagcaacggctggctgcttcactttttggttcagcagcagctaaagctgataggaaagcacaagcttctcgaaagacagcaaaggacagtccctcaactgagaaagtggctaccactaatgtgactgcccagcctgttaaggagcaagtaatccctgctgcaccaccgcctgatctgctggatctgggtgatgagcctgtttcatcgagtccaccgtcggctgaccctttctcacagctagaggggctccttggaccagcatcggctgccccggtgctttctggaactccggctaccagcacttccaaagcaccaggccttctgtcaatcttctcagatgatgtaccaaccggagtgactagtgtgtccaccgatcccactctaggtgatgttaattcgatgggctcccgcaaaggagcagctgcagtggcttcaatgaagggcccgagcctccaagatgccttgcaaaaggatgcggctgcacgacaagtaggagtgacaccaacagtgaacaaccccaatcttttcaaggacttgctaggctgaaggggacagtagggcacaccatatgctctgtgtggcctctttgggtacgtggagttcgtctccgacatggttcgatcaccgaaacgacgccgaactcgctgtttgatcagcgtaggctggggttttagggttacaagggctaatatttgtttgagagtcacaagacacgacctatctccttccaattgtggtttgtggagatttgtggatggttgcgggtattttttttcctttacgctcttgtaattttgtcctgagactggtgtacatgtgtctacatgatgtgtaatttgtacatgaagaccatggtccgtccagaagcgtatgccgtcgtctttttgttcattcatgtaggaggggcatgctcatctgtgctttcagagtttcccatatatgttgattaatataacaattgatgtcattctctggaacttgggtgaaataaaaaaaatggtacgtgcccaccggtgcagggtttaaaaaaaaaaaaaaa

SEQ ID NO: 10069 - DNA, 3436 bp, Zea mays
  misc_feature (698)..(698): n is a, c, g, or t
  misc_feature (1240)..(1240): n is a, c, g, or t
gctacaccatagctacagacgtttcaacgctgaggccaacgagctatcaaccatagcgtcagggcgaaaactcgtctcggatggggtcttcgcctcagacctctacgaaccctcagtaaaaatcaagcaagtggaagaggaaagtgccgaggggacaaacggcccgaacacctcgccagcccacaccgacgagttggttgcgacggccgaccagtaggactggtgtcagcccctcgtcaaccgattatcagacggagtactacccaaagacgtgaccgaagccatgcgtttgtcttgaaaagcaaaatccttcatgatcattgacggagcactctataaaaaaagtgccttgggcatcaagcaaaagtgcatcacatgcgaagagggacgacagttgcttgccgaagttcacggaggaacatgcgggcaccatgcaacccaacgcacgctcgtcggaaaggcgttcaggcaaggattctattggccaattgccatggccaccgccgagcaggttgttcgtacctgtgagggctgtcagtactacgcccgacaaacacatatgctggctcaagcgctccagaccatccccatcatctggccattccttgcttgagaccttcaagaaagcacccgggggctgcacccacctgcttgtggcggtggataagttcaccaaatggattgaggccagaccaatngccaagctcacatcattggaattcgtatgcgcggaagttcaacgtggggcctacgatgacggtaggaaaccataccatatccatcgagccccggggctgaaccatgggacctgccgcacattaccgcatgggcgtcagcaatgaacccgccgcatagatgggagtaacgggcctcgccataccgggagcactacttcgtacgaccaggagaagggggcccgccacgacagccgaaggattctttctccctttactctctctctctctatgagatagagagagagagacaacaacataaggtctgtccctagaaatataaaagggaaggcccctcttcctcttacacaggcacacaggctataacacattccattgcaatattacgatcaacactacactggactagggctccggcttgaaccattataaatcccgtgtcccaagttattagttcgagtcccaacgattcaccatttggagtgagtccgctctagcatccccaccgaacacaaatcttattgtcccccagtttccgaaaccangacaatggttgtcatatatccctaaaaaccttgattgcaatgctagaaggttgagattccaaatgactaaatgtggttatttgttatttttcatgcacgtggaccttcccttttatttttcaaatttttttataaagagtaacaatcttgtacatttatgcttgtattgcaggtcgacagaaacctctcatttctagacagttatgtgcagcaagccttggaaaacggtgcatcaccttacattccagagagtgaacgctctggtcttacaagtgttggcagctacagaagccaagaacaacaggaaacatctgcccgtactcttagattcgaggcctatgagatgcctaaaccttctttgccactagcaacttcacaaaccagcatgtccacaccaaatactgaccttgttccagtttcagagccaggctactataaggaagaccatcaaacatcaaggcctcaaccaccaagcgatgcggtttctggtgagtttggtgtcaaactccgccttgatggggttcacaagaaatggggaaggccaacatattcctcttccacaccctcaagctcgatgtccagtcaacaaacaacaaatggggcctctcattctgatgggggagggccaagttcacagccacgggagtcctcatacggttcgaagaaacagcagggcacagaagtttcagcagaaaagcaacggctggctgcttcgctttttggttcggcagcagttaaagctgacaggaaagcacaagcttctcgaaagacagcgaaggacagtccctcaactgagaaagtagctaccactaatgtggctgcccagtctgttaaggagcaagtaatccctgctgctgcaccaccgcctgatctgctggatctgggtgaccagacagttccatcgagccgtccatcggctgaccctttctcacagttggagggtcttcttggaccagcatctgctgctccggcgctttctgggactccggctaccactaccagtacttccaaagcaccagatcttatgtcaatcttctcagatgatgtaccaactggagtgactagtagtgggtccaccaatcccactccaggtgatgctatttcggtgagctcccacaaaggagcgactgcagtggcaccaaagaagggctcgagccttcaagatgccttgcaaaaggactcgactgcacggcaagtaggtgtgacaccgacagggaacaaccccaatcttttcaaggacttgctaggctaaaggggacagtaaggcacaccgtatgctccgcgtggcctctttgggtagatggagttcatctccgacatgtctcgatcactgaaacagcgatgatctcgctgtttgatcagcgtaggaaaagggttgcaacttgcaagggctatatttgttctcgagtcacaagacacgacctgtcctccttccagttgggaggggggttgcgctgttgagatctgtgaatggttgcgggtatttttcctttaacctcttgtgattttgtgctgagactattgtacatgtgtttacatgacgtgtaatctgtacatgagaccgtggtacagaagcgtgtgccggcgcatttttgttcagctgggctagatacactacaattgctgggcactggaaagtaaaacaatgaaagaattggtgtcattctctggctggaataaaaatataaaacggtaaatgtgtagtgttgtttattgttgatgaaaacagtcgcagatttgtttttgcaacttttaactgttgagaagtaatgcaattctttttttcggttccattcaaacctacttgctgcgtagggccatggcccatggggcattcagtattttctctcataaaaaggtctactactattcttttctggttctatttagtcgagatcgttgtttttgtctagggagtctctaggtggtcgatggagatctaacggcatcacttcatctgatttcttgcgtcatcgccttgtcgggtaatcgtagccggcagggaccagcattattcattatccgtgtgtagctgcccggcacttgtagctataggtgtacattcggaccgtccggcccggcctaagcccgaaaagctcgtattgtttgaatttcgggccggtccggcccgtttgaatttcgggccgtgtcaagccggcccatgggcctagtcctcagcccacggcccgacccgta

SEQ ID NO: 10070 - DNA, 3488 bp, Zea mays
agattgggggggcaagaaactgcaggttcacttgaagaagcaatttaaaccagaattcacgagcaaaaacacatccaatcaacatatggtccaaggtttcttgatcctggtcacatagtggacatctctctggatggtccatacctcttttctgcagcctgtctgccgtccaaaccttcctgtgagcgaccaaccacataaaaaacttggtttttggaggagcccaagatttccatattctatgaaaaggctcaaactcagaagatcccaaaaagaaacccctatatgcttcctttgaggagaactttccgtttgcagctagacggaagaaatgtttgtcttcaacttgaggtcttaaaacaattgagtcaattaaatcccacaaaatgagaaattcattgataattccaaccgaaagagctccttgaatgtcagaaatccagctctgattagagatagcatccaccactgttctcttgctaacccgtctcttagggatgatcccaaataatcgagggactaactctgcaattctgtgacccgataaccacctatcagtccagaaaaaggttgtagccccattaccaagctcagtttgcatagccatggagaagaaatcttttacctttttagggacctggatagcaagagaggcccacgggcgagatggctcagttttagccagccaaagccatcgcattctaagagaccatgcaagttctttcatgctggaaatgcctagaccacccaattcgcgaggcctacaaacaattccccaagccacgtgacagtgaccaccttttacatctcttcggcctcgccacagaaaacctcgacgaatcttatcaatggctttaagggcccaagctggaaggtcaacagccatggccaagtagatcaccatccctgtgaggacatgctggacgtgcaccttacgaccagctttagtcaataactcagccttccatccagatagttgatttgcaatcttatcaatgatgggttgtacttggagttttgaaagctttttaatggcaagcggtaaacccagatagcggcaagggaattcagctaactcacaaggcaacatattctgcagcaaagcaaggtcctgatctccacatctaatagggtacacgctgcttttctgaacattcgttcgtaaacccgaagcatctccaaacagctgaagacaatctagaataacattgatatccatggctgccggccgaagaaagatcaccacatcatccgcatagagagaaacccggtgttgcaatgcccgaggagcaaggggctgcagcagtccatcctgtgcggccttattaatcaagaagcccaaagtatccatgaccaagatgaacagaaaaggagacagaggatccccctgccggagaccacgacgatgaaaaataggttgtccaggtaacccattaagtaacacatgagatgaggaagtccatagcaagccactaataatatctctccagacttggccaaatcccaaatgttgcaagacttccaggaggaagggccatgaaactgaatcaaaggcctttgagatatcaagctttagaagcatcctaggttgcttctgttgatggagatagcgggcggtttgctgcaccaacatataattatcctgaatgaagcggcctttaataaaagcactttggttaggagaaaccatatcatgaagtcttccagccaaacaattagcgagaagtttagtgagcaattttgcaacactatgaactaaactgataggtctgaaatttttaacttgatcggcccccctcaaactttggaataagggtgatattagcagtattaaggatctgaaaattagcgaaccttctgctcccaaccgccgagaaaacagccataacatcagccttaataatctctcagcagactctatagaattttcctgtgaacccatctggccctggagccttgtccgaaggaaggtgcaaaattgtgtcccatacctccttctcagtgaatggtgcatctaaggctgacagatcatgacaaggaattcccaaactttccagagagatagtttgctctctatcgctgcattgtcccaaaagattgccatagaattcgttgaccagatcagctttggcatcatggctggttaggacagcaccattagagaccaatttaggaacaaaattcttcttcttgcggaatcttgaatgcatgtggaataatttagtattagcatcaccctcacgcagccacccaattctggaacgaagcctggcaattgtcctttgaagtgaagatagagcaagggagtgtttcttaaggcataagagaaaccatagtttcagctggggatagcccacgactgtttttgaactatttccaactggtgcagagaatgagcttgatctccatgttcttagttgttcagttcatccttttgggttgggtatttgtgagatgggaagccttttttaaaaggatagactgctttctagagatatttacaatatataagtaatagttcgattcatccgccaagatagggcttaaaatttcagagaaatcgtttattcaagtaaaggttggatcttgttgggatttccggtcacccacatgaacgacatgtgtatataccaggtggtggcctcatttggcaagcttttgaggtggcacaacagtccaaggatcaaaacctatgtgttggtcaaatgcctatacatctctgctatggaggtcccccagaagtgccttgctctcttttggtgatgacaacacgggaagggtgtgttcttgatccatccctaactatatcctgactccagatgatgattggcatatggggaacaatgatgcaattgcgatcacatggaagacaacatcccccaatggcaatcctcacccttccccgaagacgacaacgatgaagattttctgcaggctgagagggacttcatggaaaatttggtcaatcagaatctaggcggtattcaagaagcccagggtatccaagaagcacaaggcgaccctatttgggaaaatgctgcacttaatttgggtctagctaatggttggcctgcctggcctcagcagccacaccctgctcctcttcagcatgtcgtgctagtcattcatgatcagttggtgcttgacccggaggatagggtgattgaggaggattctagttccttgtccagtggcattgttgtcagtaggggaattctgaaccgctttccctttagacaggcaggagatttcctcaagtttcattctcctgaaatgcctgattggattgctccttttgtgtctgatggcctccgaaggatcatctttgcaggcttaccacactttcagcccttggcctggtggggtaatgctggcaatgaagctgaacccatagttgctctcatttcccagtctgaatccagcggcaatcctgattttggccagctcagcaatttggtatggaacaagcaggagctcatcaagcagga

SEQ ID NO: 10071 - DNA, 5955 bp, Zea mays
  misc_feature (1170)..(1170): n is a, c, g, or t
  misc_feature (4265)..(4265): n is a, c, g, or t
ctcctccagatgtaccattaacattttgtcgaatattttgtatgtcgttgcaacgcacgggcacctaactagtttcatatgataaggctccgcctggtagatctcttcttctatcggttccaactctgtctctcgctccttaaaaaacagtcccctccttatttttaagaaaagctctagaaagaacatcatgtttagttggaaaataaatcttatcttatagccttttctataatgtagcgtcgacaaagagaaaaacatggaagagtacctagtagaaacttctttttctggcttccaactcctgctgattttttaggagctcctcgctcttttctagaaagagcccattaaagagccttcattttgatttttttaagaaaccattggaagagctcttgaatgagccctaccaaagggggcctaacatataacccatgctaacgctacgagaggagaaattgacaacagtggcataagtgagaggggaggtggcggcggagacacgacggaggagggatgatctaaataatattgttcaataacattaaatttgagtaagtgggatggtgttatctagtagtgtgaaacgttgtttttttaatgatgtgttagtctgagtacaatttgtttggtggatttgttagaggttatgggtgtgaaggtgatttaatgtgttttacaaagtttaaactggtggattatatagcagtatagactaaatgaattataatagcatcaattgtattatgctttgtttagatgttgatattgggtgtatgaaattgaattggatgcaataccaaaccaaccaaggtattggaataagatgtaatttcaattatattgtttagatgtcgcttaactggagtttagaattgtactgtctaattctacataatacagagagctgacgctcggtactgggaaggagaatagagagtttctagttatactccaattctaaagaattgggtctctgattccaaatctcaattataagtacaaccaaacgatagaatttagaaaaatcaatttcaattctcaattctgtgttccaatattaacatgcaaacgggctatgagataatttgtagtccactaatagtatgccttagaatcgcagttagccctcttttattgagtaggcaaagaaacgagggcaaaagnttcctgcacagtgcattctagtccgagctcctgcacagtgctttttcatcgctggcgggtaggagaatggaagacacctcccagcagcggacaggctgcgcctgcccaagttcgctcactctgcattctttctgttattgacattttaatttcgttcaaatttcttttattagtgagatggtggacacacgttttaaacaagcacaggctgcgccggcccctgtcagcactagcacagggggctcaaacaaattcacaccgacacatccatattcttgtttaaccggcgacacacacaccccaccacacagatgagatgacagacccatccaacctgcccctgcccctgcccctgcctttgcctttgaaaacctccactgcctgattggtcctttgaaaacctcccacgcacattcttggcagctactctactcaatggcgctgtcctcctccggccacccggcgacgacccgcctgctcttctcgcttctgctcgtgggctcggcggcgggcttgccggagcgggcggccatcgacagggtcaaccggcgaggcccttccctcggcctcgtcatgtcctacgtcgacgaggccaccgcgctgcaggcctccggctacttccagccttggcgtgccctccctttcgttgacctctacggtacgctgcctctctgatctcgggccgtccatttgtccatccatccacgtgcttcttatcatctatctccgatcccttccctgcgctctatctgcctgacacacacacactggctggttcctcttgccgttgacttctcctggtgccatttccatcaccaagaaaatgatcataagcatgcatgagatgactgacgagatgagattggctggtgtttcaggacggcggtatcacatcggcagcattcggggcgtgaacgtgatatacgcactgacagggcaacgcagggtacttattaacaaggaacccatctgcttttgcatctgcattttaccttgtgtcgtgtctgtgtatgctctgatctaaccttcctctggtcttccagctgaacgccgccgtcacagtacagacgctcatcgacgtcttcagcgtgtccggcattgttcactacggcacggcagggagctgcaacgactccatctccttcggcgacgtcagtgtccccaggctcgtcgcctacacgggtgcctggacatggaaggtagtataaataagaaaacctccaagtaataatcagttcaggccagcgcatgatctctggagctctggctaccgcagaagttcagatcaccgagagagtcatcggcggaattgagcttcggcgaatacaacgtcccagacggaggaggaggggagaatctgctcggatccctcaagtacagaaacgaggagctttactcggccggcaagcccatggaagaggtcttctggctgcctgtgcattcggcatggttcagaactgcagaacagctcacggtggtgactagatagactaccggcatcatcagtaacataatactaagtaactgcgtaacagagatactacatgtatgtctgtgcagtaacagtgacattattttctgcaggtggaacttgaaagatgcaacgacactttctgcttacccacagctccacggattgtctacgggctgaaggggtcgtcggctgacatgttcctcgacaacgcggaatacaggaagttccttttccaagagtttggggtgtctacaatggacgaggagagcgcagcggtggtgatggtcagctcagctcccttactcatacagtcatacttgcactacgtacatcccgaccatgtatgttacttactacttactagtaagataaatttagcgctcaactctgatgatcagacagcaacgtcgcctggcatacctgtgatcgtgttccgaggagtgtctgacttggctggaggggagccgacatggtcgtccacaagcctgatgaacctggcgtccattaatgcattaaaagtggcggtagagttcatcgctgcagttggcaagcatagttcaaccgcatcagtaaaaagatgatcgccatcctcgtccgttgctgctccaaaataggcctgcggcagtaactggaagttacttatgttcagaatgatgtcaaaccttgtggcttcaagtcataatataatacgtcctctctaataaagcggtaggaagattgacgtacatatccacattactttgctctcagttgcgttgcgtcgatcccctgctttggggatgtgtacccattctcgaggctataaaatggacctctaaatgtatggaacaacacatcaaacattctaagagtacattataactttgagactccgcgaccacgctgtttgaagagtttgagagatttgggcgcgtttctgaactctgactctgttgtcttgcgctcttttattctcttgtgtgtgttgttactgtaattgtgctcttgtgtgcgtgtgtccttactccccttactctggttttgatattgatcacttgtgtgaggcgtgagagactctaatgtgtggagatttctcacaaacgatagtgagttataaggaatatataactgacacttaagtttgatatttggatcatttgaaaggggttcagtgcaaccattgaccaaaaggaggtcaccacaacatggagtagtcattggccgaaccacgctaaaaatcgttgtatcacttgactctttactttcttgcgaccattgtcttcttgaagttatcatattcacttgaaatattgctcctagtttaatactcatcttaagtgagcaatcaagtgaggagctctcatctcccttattcctactattaaatttggttttatttatactaacacatattatagaccaatgttgtgttatttttgagtaaaatttgtagaatcatctattcatccctaggtgttatgatgctttcaacctgccgggcttgcatgcaacgagatagctctcaccagtgtatgacgttgcggtgcccacacgtcagtgaccaacgtcagaggaacttgggggcggctgactagcttcttcgcacggccgctcgtcttgagctgccgaccgccggggcggngtggctggacggtcgcgtctccaacacgaactgtctgtctgacgctggggagcaagctctgtgcggctgtgcttggatggcgatggccggctccgggctctctctggcttccatttgctatctctccctgtgcctgcggccgtcttgcatgccatgccggccggccaagtgttgaggtgccagcagcagccagccaagccagccgcccggtcaaacttttaaaaccgcgtgtcaagcatggccaagtaagcacaactccaatcatatatactagtagatagatagatacatcaggtacgtacgtagaaggcacaagccagctcatccaggcgtccagctcatgctcatgcacgtacggcagtcgtgttacatatgctgtgctgtacagtgcagcgctacctgccaggagtttttcatctggctccggttggatttacagcaattaactatatacctgatgatgaaagtacgcctgctgaggcgtggataatgatggtgatcgacgcgctgggcagctgatgaccgattctagctcattcacggtggaatttgatcggacagacgcaatgagcgcacaaatttcgatatttaattaacccttaattcatgcgcgcgccctctctacatttgacacttgattcacaggctttcataaattaatttgagtctagacatgtgaattatatacatttcgatatgagggatttctcggttgttctctcatttcctatatatttccaacacattgccctcttttactcgggtgacggggaatttttttgaatgttcttgttgttgtctccaatggcaaggactcaatgagctgtgtcttgtggttgtggatgcacgacccaaagtgtcgcgactaaacggaactccttgcggtaaataaaggatgataaaaaaatgttgttcttgttttgttgatgttgaggataaacccacaaaattgttttctaacttagttgttacaaaggcaagggccatgagggattgtgtaaaaatattgttttgcatcataataaagttttaaatagaagataagatatggatgaaatatgtgagtggctggagatagtccaataatgccacatgacttttgtgtggtggcgaggctaaaaggacgatgttgtagcacactgaatgcaccgatagttgtcaggatcttggaaattataattagcactcatgagtaagtttgatcatggaccactcgaatcgacctcaacccgcaaaaaaaaacctggtccgactcgaccaatacaacgggcgagcatgaatcatagtttttgacccgtaacaatccacaagtctgctaaggcctatgatttttgactaaaaacttgatccaacctaaaaaaactcgacctaacgctaaaaaaactatcccaacaactcgaccccaacacaatgcatgggttaaacatgaatcgtgccaatggcccacgataccaccgatgtttgaacaggtctactcattaggaagccgagcaggctaacaagctaacattcaatcgaataggtcattgtaggctctttgctatggatggcaacgaacacattttactgacatgcccgcgagtcaaaaccctatagagtggctttgggtgtgagtttataccaacatgcacaaacgattctaaaatcaacattttttttcttgcggatataaaaaaagttgtacccatac

SEQ ID NO: 10072 - DNA, 1469 bp, Zea mays
  misc_feature (1447)..(1447): n is a, c, g, or t
attgggccccccggggccgcccggcccggggaaaacctcccacgcacattcttggcagctactctactcaatggcgctgtcctcctccggccacccggcgacgacccgcctgctcttctcgcttctgctcgtgggctcggcggcgggcttgccggagcgggcggccatcgacagggtcaaccggcgaggcccttccctcggcctcgtcatgtcctacgtcgacgaggccaccgcgctgcaggcctccggctacttccagccttggcgtgccctccctttcgttgacctctacggacggcggtatcacatcggcagcattcggggcgtgaacgtgatatacgcactgacagggcaacgcaggctgaacgccgccgtcacagtacagacgctcatcgacgtcttcagcgtgtccggcattgttcactacggcacggcagggagctgcaacgactccatctccttcggcgacgtcagtgtccccaggctcgtcgcctacacgggtgcctggacatggaagaagttcagatcaccgagagagtcatcggcggaattgagcttcggcgaatacaacgtcccagacggaggaggaggggagaatctgctcggatccctcaagtacagaaacgaggagctttactcggccggcaagcccatggaagaggtcttctggctgcctgtgcattcggcatggttcagaactgcagaacagctcacggtggaacttgaaagatgcaacgacactttctgcttacccacagctccacggattgtctacgggctgaaggggtcgtcggctgacatgttcctcgacaacgcggaatacaggaagttccttttccaagagtttggggtgtctacaatggacgaggagagcgcagcggtggtgatgacagcaacgtcgcctggcatacctgtgatcgtgttccgaggagtgtctgacttggctggaggggagccgacatggtcgtccacaagcctgatgaacctggcgtccattaatgcattaaaagtggcggtagagttcatcgctgcagttggcaagcatagttcaaccgcatcagtaaaaagatgatcgccatcctcgtccgttgctgctccaaaataggcctgcggcagtaaccggaagttacttatgttcagaatgatgtcaaaccttgtggcttcaagtcataatataatacgtcctctctaataaagcggtaggaagattgacgtacatatccacattactttgctctcagttgcgttgcgtcgatcccctgctttggggatgtgtacccattctcgaggctataaaatggacctctaaatgtatggaacaacacatcaaacattctaagagtacattataacttcgagaaaaaaaaaaaaaaaaaaaaaaaaaaaaaaaaaaaaaggaaaaaaagaaacaacaaaaaacaaaaaaaagaacccaaaaaagaagggnaaaaagcgcgcaaggcgaaaac

SEQ ID NO: 10073 - DNA, 1441 bp, Zea mays
cccccgcgtccgtgcccaacccaaccgctgcttttatttatacacctcctttggcctcttgcatcatcagctagtttacttgcgctgggcaagtctctagtgccagcttgtttacttgtagatccaggctctctcctctccaagcctttagcacagcaaagtcccagtgccatccctgttctgccgttgtatgtgaaccctcctatgcaatagcaagatctccatctctctcagctctctccagcttcatttccactcaagagttgagcacggatgaagaggccgaccagcagaggttcttcaatggtcagcgggcaagcaaccacagatctacaagaagatagctgcaggtccatggagccgcacggagtggacggcgatgctacggccgcggctgagcgcgacgacgtggacgccggggcgtacgacgaggaggaggacgaagaagaggagctcgcagggtcccgcggcggcctcggggagaagaagcggcggctggcagcggatcaggtgcgcgcgctggagcggagcttcgaggtagacaacaagctggacccggagcgcaaggcccggatcgcgcgcgacctcagcctccacccgcgccaggtcgccgtctggtttcagaaccgccgcgcgcgctggaagaccaagcagatcgagcgcgacttcgccgcgctccgcgtgcgccacgacgcactcccgcgtcgagtgcgacgcgctccgccgcgacaaagacgccctcgccgccgagataaaggagctgaggggcatggtggaaaagcagatggaggtgaagctggagtccgcggcggaggagctgctgccggtggcgacgaggtcagcagcagcagccgctgtgtataacaaggacgggtcgacggacagcgactcgagcgccgtgttcaacgaggaggcgtcgccctacccttactccggcgcggccttagaccatcagcagcagcaagaaaccagccacccgctgggcttcacgggtttcacctccttcttgacgtcctctttcccttccgtataccatggggattcgcatttggaccaggaagcggacggcttcttcagcgccgccgccgccggcgacggattcttcgccgaggagcagagcgcaggcatcggcagctggtacggcggtgagggttggtagaacagcaacagctaagctgttggctgcctggaggctggagatcactcttggtatcgtatctaccattcttgtaaaatatggcgctgtacattatattatgcatgcatgggtccgggacgcggtaactatatactactatgtagagttaatttatatggagtagttaatttctgtatttttcactggcgggctgaaagcctgaaacacgggctacgagaggagataggccgggtaatacggttattgttctataaaaaaaaattgacatgcagttatttttag

SEQ ID NO: 10074 - DNA, 811 bp, Zea mays
acccgggattcggccttatggccgggggccgccactcagcgccgcgcttgcgttttcttctctccgcttccaagatgtcgaagcgagggcgtggaggttcggctggtaacaagttccggatgtcactgggtctaccagtggcagctactgtgaactgtgccgataacactggagccaagaacctgtacatcatttctgtgaagggaatcaagggtcgccttaacaggcttccttctgcctgtgttggtgacatggttatggcgaccgtgaagaagggaaagcctgaccttagaaagaaggtgatgccagctgttattgtgaggcagcgcaagccatggcgccgaagcgtgggcgcgccccaggtactttgaagacaatgctggagtgattgtgaacccaaagggagagatgaaaggttctgccatcactgggcccatcggaaaggagtgcgctgatctctggcccaggattgctagcgcggcaaatgcgatcgtctaaaggaagcagtttgtcgaagtttcatttaaaatggggacttgagaagggagttcttagttagacgagcttttgattgccctgaatatgtttccccggctaatgcttgtgctgctggaccgtttcctgatagctttgctttgatgacatcctccccgttatcgataacattttgcagagtttaagttgacttgttttggaggagggtaggggctatttctattttagctcctccaaccccttgcgcctaacactgtctaacgactagtttgggagccacaaaacccccctaaccctgagtggatttgaggtgctt

SEQ ID NO: 10075 - DNA, 2332 bp, Zea mays
gccttgggcagttgttggcatagtggcctagctcaccgcacttgaaacagccgttgggttggacaggtgcgttgtttctggcctgagtgttgttggtgccaccttgacggttctgtgaatttccaccagacctctggttggtctgggggttgctcctttgctggttctgactctgattatttctctggccttgctgtccagagcgttgcacttgataattgtttccaccctgatttccagagcggaactgcgaaccttgagcattgtttggccgggtgttccggctggactgaccttgaaattttctcttatggtcagatagctccttccttttgctttctaggccaattgccttgttcagcagtgtctggaagttggggaatgtatggctctgaagttggtagttcagaggtccaatcaacccttccaggaaacgctcttggcgcttctcatcagtgtccacttcctctggtgcgtagcgtgaaagctgagtgaagcgatcacgatactcactgacagacatattcccttgagtaagggaaaggaactccttcttcagcttcatgattccagaggggatgtggtgagagcggaagttctcctgaaactcctgccaggttatggtatctgcgttgggatgtgccgctgtgaaggcatcccaccaatcggacgcagctccctcgagtcttcccgaggcgtacaagaccttctctcggtcgttgcactgagttatgtccagcttctttccaatgactttgagccagtcatcggcatccaggggatcaaccgcatgagagaatgtcggcgggtgatgactcataaagtcccggtgcttatctctggccgggggtgcatactgctgctgctggggttgctgaatctgttggttctgttgtaattgttgaaccgcagcagtgagtccttgcagaatctgcatttgggcggcgatgaactgctccatattgggatttggtggtggcggtggtggtggtgcttgttgtccacgctggttccggttgttaggtccttgacgttggttcaccatctgattggttagaaagcgaacatcttagagaagagaagagtagaaagattctagaggggaaatgacttaagttttaaaatttttatatgttcttatggccatcattccataagaccattgcactcaaacaaagatccaaatcaaacatttcaatcaatcaccatcacatggttgatatttattaatatgaaaatttaaagatagtttccatcgtctaacgcgaagcgtaacttattacatcatgatcaacactcctaaagcagcctagtgactgatccgggctctccatagcgcagcctcttgcggggaggagacaacgccacggcggggacctgagcctctggcggatccagtccttgcagttgggctcccagggctgcaatcctggcgtgggcattctccagctccaagtgcacactgtagaggtccagagtggcactgtccaggtcggtgttgaggccggccactacaccagctagggtgttgaggcgatcctcaccaggttcacctgggacaatgttggtctggctctctccacgcaggcgctgaggaagatgcctgaaccttgtgttctgcagctgctgccggtaggtgtggctgagcgaccacagggtccgacgggcagcatcgctgaccgaggcagcgtaggtggacagcggtatcagggactcgtgagcagacagagtcctgaatcccctgtcacctgcatccattaccctaacatggatgcgagtgatgtaatagcaagcccggggaggctcgctcactcgcctcgtctcgtacagggggcgggcgtaggctcctagctcgtgcagcactgcctgcagcaggttggggaagtgccctgtctcgaacattgatgtgtaatgttcgacaactggaccaatccccatgaagtggtcctgctgggcgtagtcagcttcctcgttgatgtgtccgtcttctccatcgtcttcgtcgtcgtcgtcctcgtcatcgccgtctccggagtcgtcggggtcgtcgcctccaggtgcaggtgcttggaaggctggtgccggcgatgctgacgtcgatgacccagctgcgaaggccagggactcggccaacggggtgggggtcggcagctgctcctccgagctgtcctccaggttgatcacgttctccactcggacgggagggagatccgctggggcttcctcgactaccactgggtaggccgggatctgccggggctgaggggcgtagctggtgttgacgcgagtggtttgaagagtgcgaaccatcttcctcaggtactctagagca

SEQ ID NO: 10076 - DNA, 1188 bp, Zea mays
  misc_feature (783)..(783): n is a, c, g, or t
  misc_feature (794)..(794): n is a, c, g, or t
gccggccgggccggcgcgcccctatgcaccattgggcccgtccaggccggccggggccgccactcagcgccgcgcttgcgtttccttctctccgcttccaagatgtcgaagcgagggcgtggaggttcggctggtaacaagttccggatgtcactgggtctaccagtggcagctactgtgaactgtgccgataacactggagccaagaacctgtacatcatttctgtgaagggaatcaagggtcgccttaacaggcttccttctgcctgtgttggtgacatggttatggcgaccgtgaagaagggaaagcctgaccttagaaagaaggtgatgccagctgttattgtgaggcagcgcaagccatggcgccgaaaggatggtgtctacatgtactttgaagacaatgctggagtgattgtgaacccaaagggagagatgaaaggttctgccatcactgggcccatcggaaaggagtgcgctgatctctggcccaggattgctagcgcggcaaatgcgatcgtctaaaggaagcagtttgtcgaagtttcatttaaaatggggacttgagaagggagttcttagttagacgagcttttgattgccctgaatatgtttccccggctaatgcttgtgctgctggaccgtttcctgatagctttgctttgatgacatcctccccgttatcgataaagttgcgtagcctgacattttgcagagtttaagtaggcttgttttggagcaagggaagttaaaataatccgtcctcctgagtgatccattggnggaggaatttnctcccacatgggatccccctccaattcctctcccaccaaatccgccctaagggcccagtttggaaacttaatcctctttgaatttggaggggattaaagggaaaataggttcattttcatcctaatcctctttcgaagggccgttgagttttcaaactagccctaaactgtagaaagtgtttatgttgtttctacaagacactgatgcttcagcatcacaggatcaaatcgcatcagcagtaagtgccatttgcaaactcttcgccatgagttgctggctaaatatgctgtcaagatctcgtcatgtactggctgtcagcattgattatgacggtccacagccgatacatgttgaatacagagttgaattgcacaaagcataatactgaaaatc

SEQ ID NO: 10077 - DNA, 924 bp, Zea mays
  misc_feature (782)..(782): n is a, c, g, or t
cattgggggccccggggccggccgggaaaaaaccctaacctcgcgaccgtataaacgagccaacccgcccacctcccgcgccgccgccactcagcgccgcgcttgcgtttccttctctccgcttccaagatgtcgaagcgagggcgtggaggttcggctggtaacaagttccggatgtcactgggtctaccagtggcagctactgtgaactgtgccgataacactggagccaagaacctgtacatcatttctgtgaagggaatcaagggtcgccttaacaggcttccttctgcctgtgttggtgacatggttatggcaaccgtgaagaagggaaagcctgaccttagaaagaaggtgatgccagctgttattgtgaggcagcgcaagccatggcgccgaaaggatggtgtctacatgtactttgaagacaatgctggagtgattgtgaacccaaagggagagatgaaaggttctgccatcactgggcccatcggaaaggagtgtgctgatctctggcccaggattgctagcgcggcaaatgcgatcgtctaaaggaagcagtttgtcgaagtttcatttaaaatggggacttgagaagggagttcttagttagacgagcttttgattgccctgaatgtgtttccccggctaatgcttgtgctgctggaccgtttcctgatagctttgctttgatgacatcctccccgttatcgataaagttgcgtagcctgacccgtcgcagagtttaagttggctggttttttgtggggagggaaaatttngaggatctattgggggaaggaatttatctcacatgggtcccctccatttctctcccaccaatcagaataaagggttagtttggaaacttaatctctttggaatttggaggggattaaagggaaaataggttcattttcatcc

SEQ ID NO: 10078 - DNA, 1854 bp, Zea mays
atcagcgtgttttgttttgtttcgtctcgtcgaccgagccgtccgtcgtcctccctggcggtctggccgcctccgccttcctccccgtgcgtctcacccttttcctctacagcttcctctgcccaatcagctcgtcctctcccctcctctccctcccgtgaactgctaaaatccctcgccaagcatttccgtcgggttaggtggtagataagccgaaaatcgagtggaaaagcatcaatcgagtgctgcgctagttgcctggttcgtcccaacaaattccaccgggaatcagggtcgtccggcagcggctgaggcgtctgggttctggaggagcggccgtcggtgaggggggatggggggcggcggcggatcctccgggccggagctgtcgacggacaacatgaaggggatagtcctggcgctgctctccagcggcttcatcggcgccagcttcatcatcaagaagaagggtctccgccgggccgctgtcgcctccggcgtccgtgcaggtgtaggcgggtactcatacctcatggagcccctgtggtgggttggcatgatcattatgattgtaggtgagattgccaatttcgtggcatatgctttcgcccccgctgttctggttactccccttggagcactcagcataattgttagtgcagtgctggctcatttcattctgaacgagaggctgcatgccctcggggtgctcggctgcgtgatgtgcattgcagggtctgtggtcattgttatccacgctccacaggagcaggagattacttcagttaaggaaatatggaacatggcgacacaacctgctttcttgttatatgttgcgtcagttattgtgattgtttttgtcctggtgttctatttctcccctctctatgggcagtccaatgtgttgatctacactgccatttgctctttgatgggctctctttcggttatgagtgttaaagctcttggtacatcactaaagcttacttttgagggaacaaaccaattaatatatccagagacttggttctttatgcttgttgtggctacttgtgtgttgactcagatgaattatctgaacaaggcacttgacacgttcaacacggcaattgtatctccaatatattatgtaatgttcacaactcttacaatacttgccagcgtcataatgttcaaggattggtctggtcaaagccctggaagcgtcatttctgaaatttgtggcttggttgtggtgttgtctggtaccattttgttgcatgtgacgaaggattatgaaaggatcccacaatcaagaagtgtttatgcaccattatctccctctttgacaactagattaaatggagaattgttgaagcatgtcgtggatgagaggacttcggacgaagaaaaggccttgagaagacaggagatgtattagcgtgcgtcagaatatcaaaggaaatataggttactctgatggattctccggcaggggcttgtacatggcgtagtgataaccttcccatagcgattgttgattcctccattacagtttgttggtttgtgtatataactgcagcaatttgtggctaccgagtgattgcaaatctgccgaggtggtggaaggctgcagagttccaccaaaaagaatctaagtcgggtgcatagattcttatcgaattcccttcttcctttcgtaacttcctcagttttgtccacggcatttgttccatgtgagttttagagtgaatcacggaccctatgcaactgatgtacattattattgtcatagtgaagttcgtgcaactgtgaatgatgtacaaaaaaaaaaaaaaaaatgcttctgtgaaaaaaaaaaaaaaaaaagcggcc

SEQ ID NO: 10079 - DNA, 2414 bp, Zea mays
cctgttgtcgttgttgttgtttctgactgccggcggcggtggcggcggcttctttcgtcgcgttgttctggcggtggcggcggcgtcttgggtcttgttgtcgtcgttgttgttgttctgttaaggttggagatccctatcacgaccaggagctgcaaccaacggttaggatagtctatatcaaaaacgtgaacggacggctaagattaacactacttctgttcatgttaattagctcgtgtggaggacacagctaacactcgtaaggcttacctttgccggtaaggacaagacaaatcttatccggcgagtcggcgaccgaatagcccctgcaattaccgtgttattcaagtaaaccttctttttacgtttctgatgcaaaggaagtttgtagggaaaaaatttttgaaaacaacaaactccaaaactacctaatcatcagctgtcgaatctttggttcgatctcgaggatacgtaagcgaagcttcggcgtcactcgtttgaccaaacacaagtcgcgtcgttttcagctcaccgcaccagtttggtatcagcgtcgctcaaccaccgttcgatagacgtgcatgtatctttctcccttttccttcattctccctgctttctttttccttatttttttctctcccttcaatcggtgtctttgttaatggcatgcacaccggcgcgatagagccccggtgccccccacgcgtctcggcgtgtgacgaggaaaacgtgtttgcatgcactgcagcgaagggtatttgcgactagtattaattatgtgctctcaacgactttgttattagatggctggtcatggttcaattttagttgttgcagcctttatggtttatctgtttctagatcagtcactgaatccaccccttttaaaaaaggaacgtggcgccgaaccacggtgacgcgtctcggcaagccaccaggcagccaccgctccttccgcacgccagcgcagtaaaataagcgaaaagcgccgcgcccccggcacacactggacgacgcgcagtggcgggcagcgtgccgttgggggcaggtggagacttcacgtccccgcctcctatgtcctatcgcagtcgcaccacgcataaacccctatcgcagtcgcacctgcgcagctgcactgcccctcacagacgagtcaaccgcctttccacctcctcgccgtcgttccgtagtggcgccgcctatatagagagcgaaccgcgcgaggtcccagcacagcagccaggattccacaaacagagaggccaggttccaagcagaggcagtgcaggcagggcgtgtggagaagcagagcagcgggtggcgcacctgcacgtgccaggctgccagctctggccatggcggatcaccagaggatccaccctgtcgacctggaggccggcaatcggccaacgacgccgctggtgccgggaggctcgttccggtcggacaagggcgacccagcgcagcgcgctgatcaaccaccaccaacaacagcaacaacgaggctacgtctacgtcccggggcctctgcctccgccgccgcgccgcgccgcgccaccggcgccgccgctgccgccgccgaagcggcgcgggcggggctgctgctgccggttcctctgctgcgccgtgataaccgcggtcgtgctggcggtgctcgccgcggcggcggcgggcgcgctgtacctgttgctggaccccaaggcgccgcggtactcggtggaccggctctctgtctccacgttccaggtggacccgtcgacgctgacggcgcgggccgggttcgacgtggcggtgacggcggcgaaccccaactcgcgcatcgccatccagtacgagcccgggtccagcctgggcgtgtggtaccagtcgtaccgcctggcgcggggcgcgctgccgcccttctaccagggccaccgcaacaccacggtgctggcgctggccatggccggggaggtgcagctgggcggcgccgccgtggccgggatgcgggacgcgcagcgttcgggcgccgtgccgctcgtgttccgcgccgacgtgcccgtgcgcgtcgagctcggcaccttcaagctctggaaggtcacgtccagggtgcgctgcgacctcgtcgtcgacaggctcatggacgtcagcagccccatcaagatcaaggccagcaactgcaagttcggcctcaagctgtgatccgttcgtcgccgcgttggattcttttggctggctgagtgctggacctgcttgctggtagtatttgcgcaggtgcagacgtgcagtgcactcccgccaacctcgtcggtgttcatcccggctgtgtacagatggcagtgtatcattgctgttatagaggaataattttgcaaagattattttccagcgtccgcggacgcgtgggcggacgctgggcggacgctggg

SEQ ID NO: 10080 - DNA, 1705 bp, Zea mays
  misc_feature (1676)..(1676): n is a, c, g, or t
cagacgagtcaactgcctttccacctcctcgccgtcgttccggagtggcgccgcctgacgcctagtccggcgccgcctatatagagagcgaaccgcgcgaggtcccagcacagcagccaggattccagaaacagagaggccaggtgccaagcaaaggcggtgcagtgcaggcagggcgtgtggagaagcagagcagcgggcggcgcacctgcacttggcagctctggccatggcggatcaccagaggatccaccctgtagacctggaggccggcaaccggccgacgacgccgctggtgccgggagcctcgttccggtcggacaagggcgacccagcgcagcgcgcgaacaaccaccaccaccaacagcaacaacgaggctacgtctacgtccccgggccgctgcctccgccgccgcgtcgcgccgcgccaccggcgccgcctctgccgccgccgaagcggcgcgggcggggctgctgctgccggttcctctgctgcgccgtgataaccgcggtcgtgctggcggtgctcgccgcggcggcggcgggcgcgctgtacctgttgctggaccccaaggcgccgcggtactcggtggaccggctctccgtgtcggcgttccaggtggacccgtcgacgtttacggcgcgggccgggttcgacgtggcggtgacggcggcgaaccccaactcgcgcatcgccatccagtacgagcccgggtccagcctgggcgtgtggtaccagtcgtaccgcctggcgcggggcgcgctgccgcccttctaccagggccaccgcaacaccacggtgctggcgctggccatggccggcgaggcgcagctgggcagcgccgccgtcgtgtcggggatgcaggacgcgcagcggacgggcgccgtgccgctcgtgttccgcgccgacgtgcccgtgcgcgtccagctcggcaccttcaagctctggaaggtcacggccagggtgcgctgcgacctcgtcgtggacaggctcatggacgtcaccagtctcatcaagatcaaggccggcaactgcaagttcagcttgaagctctgattcattgggttttcagttttctgttctctcttttggagcgagttcagagtcgttgcgttggattctcttggcagagtgctggccgtgcacaggtgcatacgtgcagtgcagtgcactcccgccaacctcgttggcgttcatctgggccgacgtgtacaggtggtagtatataattgttgttagagagggacaatacgcatggctagaattttataattctagagttacttctatcaccacacaactgaatgcacaagacgcaacaaccaaagggaaaatgtgtgcctgccaatggaaagcacatcacaactacttctgcagcagcaaaatggagaatcgaatcacccactccagagaagcttggatttacaagcaaaagggttgttgtgagttcgctctggcaggaatttacttgcagacacaggtacaaagacagatttgcatatcaattcgtggaagatggaggtcgacacagtcacacaaatgatgaagcctataatgacagtatctcccctggtgtgagcccatctcatatttcaagaagcattgaacttgttgaggagtgagccgtttacattttcacctcaatatctcattctcattcatgggacgttactanaacatccgaattatataatagatctaata

SEQ ID NO: 10081 - DNA, 1146 bp, Zea mays
cgcccgtgtggccaagtgttcatggacgcataatcacagcgttgattgtatcacagctgcttctccttgggttacttagcacaaaaggcgctggccagtcaacacctgtgctccttgttcttcctgtagtgaccttctatttccacaagtactgcaacaaccgctacaaaccgacttttgtgaaatgcccattgcaggaggcgatgaagaaggataccctggaacgtgccagagagccaggatttgacctcaaaggatacctaatgaatgcctacatccacccggtgttcaaaggtgatggggacgacgacaagttctcagtcgcagatgaaccagaagccgagcaagtcctggtggcaaccaagcggcagtccaggcggaacacccccgtgcccagtaaatacaatgggtcggaatcaccttcgcttcctgaaattgtaaatgaccaacggctataaagatgtctacagttttcctatgtatactaggtatatgcccgtgcgttgccacggaagttaaaaaatagtataaaacatgtataccgaacaccatgttctagacaatgctagtgaaactgaaataaaaatagctacataattgcttaaatagttatacagctcgtagcacaaacaaaacaaagttgggcataacgttaagtgacacttttcctgtatcagacttggactatgtcccggctaatgcttgtagcctttgaatattatcgggacccattgatcactacactctacttgccccctgcactctacttgcactatagcaatctccaaatccttaggtggcggaggcatctgcttcaatgatttatggagcatcgtttatcgtgcaaacatttgggttttatgctatctctatgaattttttacgttatctatttacagaaaaaaacagaactgtaatttatggcatgcgtcccacgcggtaggttagttgttggtccgataatgcgcggtccagccagaccggggctggtcagttaagacttcctctaacatttgaaagctgaggctttgcgacgggagtaaaaaaattgtatgaaacatagagacggaacaataaatatcactatgatatgcaaaatcaatgtggtaatcattatcaatatcacataaattatcctaaagatca

SEQ ID NO: 10082 - DNA, 3021 bp, Zea mays
aattcggcacgaggcgcgctgccagaagagaaggggcgataaaaatcctgtccgtatcaccctcccttctcccagtcccagcccccgcgccggcggacgcgtggcggccgctgcgcagtacagtgcagtgcagtgcagggggtcgacggcgtctcccgccgtccgcttcgatcaccgtcggacgcggaggaggaggagaagcgccaagacgaggacaggcgggttgcggcgtcattcgcggaacgatggcggcctgccgcgccggcggttaggcccctccgctccgctccgctcctccgagattgttgccctcttgttcctgtgaccgagacaaattcaatagaattttctcctaagctatttaaaggacaactatggctacaattcaagatataggactctctgcggctatcaacataatgggtgctgtagtgttcctagttgcatttgctttccttcgactgcagccaatcaatgatagggtttacttcccaaaatggtacctcaaaggtgcaagagagagtccaagtcatgggggtacatttgtccggaagtttgtcaatttggacatgcgttcatacttaaaatttttaagttgggtgcctgctgctctcaaaatgcctgaggatgagttgattagccatgccggtctggattcagctgtgtatctgaggatttacttggtcggacttaaaatatttgctccaatctcagttctagctttcattgttcttgtccctgttaattggaccaatgatactctgcaattctcgaagttagagcacagcaatgttgataagctttcaatatcaaacataccagttggatcaaaaaggtttatagcccacttggcaatggcgtatgttttcacattttggacctgctatgtactattacgtgagtatgaagtagttgcaaagatgagactgcgatttctttcatcagagaaacgcagaccagatcagttcacggtccttgtgcggaatataccgcctgatccagatgaatcaattagtgagcttgtggaacatttctttcttgtgaatcatcctggtcactatctgacacatcaggtggtttacaatgcaaataaacttgctaaattggtgaaagagaaagcaaagatgcataattggcttgactactatcagctgagatttgaaaggaatgcatctaaaaggcctactactaagactggttttcttggttgttttggtacgaaggtggatgccattgaatactacacatcagaaattgagaggatagaaaatgaagaagcagaagagcgtgaaaaaattgtaaaggatcccaaatccattgtaccagcagcatttgtttccttccgatcacgttggggtgcagcagtttgtgctcagacacagcaaaccagtaacccaactgtttggttgacagaatgggctccagaacctcgtgatgtgtactgggataatttgtctattccatttgtctcccttacagttcgaaggctgataattgcagtggcattcttcttcctgaacttcttttatgtgttcccaatagcatttgttcagtctcttgcaaatcttgaagggattgagaaggcagcgccgtttctgaagcctctgattgaagagcatactattaaatcattcatccaaggtttccttccgggaattgctctgaagatcttccttatattgctcccaagcatattaatgtttatgtctaaggttgaaggattgacctcaatatcttcactggagagaagatctgcatcaaagtattatattttcatattcttcaatgtgtttctggcaagcattattgcaggatctgctttagagcagctaaaaagctatattcatcagtcagcaaatgaaataccaaggacgattggtgaagcaattccaatgaaggcaaccttttttataacatatacaatggttgatggttgggctggggtagctggtgagatattgagattgaagccactagtgatcttccacctgaaaaactttttcttggtcaagactgagaaagacagggaagaggcaatggaccctggaagtattggttttgactcaagcgaacctcaaattcagctgtatttcttacttggtcttgtctatgcggcagtgacaccatttatgctcccttttgtattggtattctttgggtttgcgtacgttgtataccgccaccagataataaatgtgtataatcaagaatacgagagtgcagcagcattttggccaagtgttcatggacgcataatcacagcgttgattgtatcacagctgcttctccttgggttacttagcacaaaaggcgctggccagtcaacacctgtgctccttgttcttcctgtagtgaccttctatttccacaagtactgcaacaaccgctacaaaccgacttttgtgaaatgcccattgcaggaggcgatgaagaaggataccctggaacgtgccagagagccaggatttgacctcaaaggatacctaatgaatgcctacatccacccggtgttcaaaggtgatggggacgacgacaagttctcagtcgctgatgaaccagaagccgagcaagtcctggtggcaaccaagcggcagtccaggcggaacacccccgtgcccagtaaatacaatgggtcggaatcaccttcgcttcctgaaattgtaaatgaccaacggctataaagatgtctacagttttcctatgtatattaaggatacaataatgctttcgaatgcctccagttaatactagtaaaagcagtgatggccaatatattcatgcgtgtggttctttgtcctcctgtgccaattgttttggattatttctttcacacttgtgatatatggtcatgtagaatattgtttgtatggtagactgtattgtttatatattaaattttgaaatagggggtgtggtaagagattgaatgggtaggctgctgtagacattcttaggattgttggccataacaagggactgtttgcaagcaccaaatattctaagaaatttatttctatctct

SEQ ID NO: 10083 - DNA, 1280 bp, Zea mays
  misc_feature (2)..(2): n is a, c, g, or t
gnacccggcctgctctttcctctcatctctatcagctcatctccattctccaccggcctccatctatcgtcgtcgtcgtcgatccatccatggcggagcagctggacctgccagggttccggttccaccccaccgaggaggagctgctggagttctacctgaagcaggtggcgcacgggcggaagctcaagttcgacatcatccccacggtgcacctgtaccgccacgacccctgggagctcccgggcctggcgcgcatcggcgagcgcgagtggtacttcattgggtacctcgaggccggccggccagcagcaccaccaccagtcgtccggcgcccgacccagccgcaccacggagcgcggcttctggaaggctacgggctccgaccgcgccgtgcgctgcgcccacgaccccaagcgcctcatcggcctcaagaagacgctcgtctactacgagggccgcgcgcctcgtggcaccaagaccgactgggttatgaacgagtaccgcctccccgacgcctgcaataacaacaacaacaataatgccgtccccggcgactcatcggcggcggcggcggcctcctccacatgcaccaccaacaactcgcccaaggaggacatcgtgctgtgcaaggtctaccggaaggccgtgtcgctcaaggagctggagcagcgagtggccatggaggagctggcgcgcgccacgccgtccgcgtcccacaacgccgggtcgcccgccgactccatgtcgtcgtccgaccaggaccaacaaacccagcttgggcagggaggagtggagatcatgatgacgatgcccgtcggcggcatctcaccacaaccaccactaccaccgcctgtgatgatgagcatgaagcaagaggaggtggccgagcccgaggcggcgccgctgccggcggtgctgacgaggccgtcgacgctgagcctgccgcagctggaggtggcgaagcagcagcaggagtggatgcaggaccccttcttgacgcagctgcggagcccatggatggagagctggtctccctactaccccagcgtcctcaacttttaaccaatgcaatctcagaatctcagatcgaccgtcgtcctcgatcaagtagctatatatatatgggcattggtccacagacctatactaatagctagcatgcatactgctgctaggtatcttttggtttggcattatcatatatacatactgatgacgagctagtaccgtacctaaaaaaaaaaaaaaaaaagcggccaactagttctagatcgcga

SEQ ID NO: 10084 - DNA, 1238 bp, Zea mays
gaacccggcctgctctttcctctcatctctatcagctcatctccattctccaccggcctccatctatcgtcgtcgtcgtcgatccatccatggcggagcagctggacctgccagggttccggttccaccccaccgaggaggagctgctggagttctacctgaagcaggtggcgcacgggcggaagctcaagttcgacatcatccccacggtgcacctgtaccgccacgacccctgggagctcccgggcctggcgcgcatcggcgagcgcgagtggtacttcattgggtccctcgaggccggcctgccagcagcaccaccaccagtcgtccggcgcccgccccagccgcaccacggagcgcggcttctggaaagctacgggctccgaccgcgccgtgcgctgcgcccacgaccccaagcgcctcatcggcctcaagaagacgctcgtctactacgagggccgcgcgcctcgtggcaccaagaccgactgggtcatgaacgagtaccgcctccccgacgcctgcaataacaacagcaacaacaataatgccgtccccggcgactcatccgcggcggcggcctcttccaccaccaccaccaacaactcgcccaaggaggacatcgtgctgtgcaaggtctaccggaaggccgtgtcgctcaaggagctggagcagcgagtggccatggaggagctggcgcgcgccacgccgtccgcgtcccacaacgccgggtcgcccgccgactccatgtcgtcgtccgaccaggaccaacaaacccaacttgttgggcagggagtggagatcatgatgacgatgcccgtcggcggcatctcaccaccaccaccactaccaccgcctgtgatgatgagcatgaagcaagaggaggaggtggccgagcccgaggcgccgctgccggcggtgctgatgaggccgtcgacgctgagcctgccgcagctggaggtggcgaagcagcagcaggagtggatgcaggaccccttcttgacgcagctgcggagcccatggatggagagctggtctccctactaccccagcgtcctcaacttttaaccaatgcaatctcagaatctcagatcgaccgtcgtcctcgatcaagtagctatatatatatatggtcattgttccacagacctatactaatagctagcatgcatactgctgctaggtatcttttggttggcattatcatatatacatactgatgacgagctagtaccgtaccc

SEQ ID NO: 10085 - DNA, 1243 bp, Zea mays
ctcgaattccgttgctgtcgataatgctggctgggtcgtcctgaccaattgatggttctgcttctgctttaccactcaatctggttgagagtcgccggcgccggcgattcctcctccaccgattcgcccggcgggagtctccgcagggctcaccgggaccgcgggtccacgatggccgccaacttctggacgtcgtcgcactgcaagcagctgctggaccccgaggacgtggacctggtgccggcggcggaccgggagcgaggcatcacgccggaagagttccgcctcatcaagatccatatgtcgttccatatctggaggctagcacagcaggttaaagttaggcaaagagttgtagctacagcaatagcttacttcaggcgtgtgtatacaaggaagagcatgtcagactatgatcctcgtttggttgcacctacttgtttgtatttggcatctaaggtggaggagagtacagtgcaagcccgacttcttgtattttatataaaaaagatgtgtggttccgatgataagtatcggtttgaaattaaggatattcttgaaatggaaatgaagctcctggaagctctcgactattatttggttgttttccatccatatcgtcctctcttacagttgttgcaggatgctggcataacagacctgacacaatttgcctggggccttgttaatgatacatacaagatggaccttatcctcatataccctccctacatgattgcactggcctgcatatacatagcgagtgttttgaaagataaggacaccacagcatggtttgaagagctccgtgttgacatgaacatagttaagaatatctctatggaaatattagacttctatgacacctacaagattgatcctcaaaggggcatccctgaggataagataagccccgtgatgaacaagttgccggcaaaggcttaactcagatttggcgagcttaggagttgtaaactagtagtaaactacatcatacttccaccatgtgtgtactcagcctgcactgtcgcttgtgacgtgttgatgaactacttgatagattcgatgcaagaaccccatggaattgtttgtgtatgctgctggagtttattcaagttagtagcatctgcatctattaactatttattacgattgttattccagggttcttgatatttatttgaaaggggcgtccttgttgttttacccgaaaaaaaaaaagtcgacgggccgcgaattgcca

SEQ ID NO: 10086 - DNA, 862 bp, Zea mays
  misc_feature (842)..(842): n is a, c, g, or t
ggggtactcttgcggccgtccggattacattcatcacccgccgccgcccggggcctccgccacgggccctaccagtttcggagtgccccagtctcccacccccagctccaccaagtcaccgcaccgccgcatctaggtcaccgcctcgccggcgtttcgccatggccggggactggcaggacctgggccaagcggcggccataggcctcctcttcgccttcctgctcgccaagctcatctccaccgtgatcgccttcaaggaggacaacctccgcatcacgcgctcccctccgtcctcgcccacagccgccgccgccgccccagctcccgcgacgcctcccctcccctcccaacacgacgccggaatcggaagcggcagtgacagcgattgggagggcgtggagagcaccgagctggacgaggagttcagcgccgcctccgccttcgtcgcggcctccgccgcctccggcaccagcgtccccgaggaggcgcagctgcgcctctacggcctctacaagatcgccaccgagggaccatgcaccgcgccgcagccgtccgcgctcaagctcaaggcccgtgccaaatggaatgcttggcataagctgggtgctatgcctacggaagaagctatgcaagaatacatcacaattgttcaggagctattccctaactgggatgcaggtacaagtgcgaaaaggaaagatgaagatagcattacttctgcatcagcttcgaaagggcccatggggacctgtgtttagcagtttgatgtatgaggaagacgaaggaaatgattcagaacttgctgacatccatggtttagcgaggggaggagcgccggngatatagtgaagtttctgca

SEQ ID NO: 10087 - DNA, 1429 bp, Zea mays
ggtaccctcgggggtgccccggagcactttcctcttttttactttctcacctttcttccttcccccagtctcccacaccccaactccaacacagagtcaccgcaccgccgcgtctaggtcaccgccatggccggggactggcaggagctgggccaagcggcggccatcggcctcctcttcgccttcctggtcgccaagctcatctccaccgtgatcgccttcaaggaggacaacctccgcatcacgcgctcccctccgacctcccccactgccgccgccgccgcagccgcgcctcccgtcccctcccactacggctccaccgacggaggcagcggcagcgacagcgactgggagggcgtggagagcaccgagctcgatgaggagttcagcgccgcctccgccttcatcgcggcctccgccgcctccggcaccagcgtccccgaggaagcgcagctgcgcctctacggcctctacaagatcgccaccgaggggccctgcaccgcgccccagccgtccgcgctcaagctcaaggcccgtgccaaatggaatgcttggcataagctgggtgctatgcctacagaagaagctatgcaagggtacatcacaattgttcaggacctattccctaactgggatgcaggtgcaagtgcgaaaaggaaagatgaagatagcattgcttccgcatcagcttcaaaggggcccatgggacctgtgtttagcagtttaatgtatgaggaagacgaaggaaatgaatcagaacttggtgacatccatgtttcagcaagggaaggggcgactgatgacatagtgaagcttctggcagctggtgttgaggtcaacgtgagagataccgaaggtagaagtccgttgcactgggctgttgatcgtggccatcttagtgctgtcgaggttcttgcaaatgcaaatgcagatctgaatgctaaggacaatgaagggcaaacggcactccactatgctgctgtttgtgaaagagaagacattgcagagttgcttgtcaagcatcatgctgatcttcggatcaaggacgaggacgggaacacggcacatgacttgtgcccttcgagctggtcttttatgaaccaggcaaactgataacacgaatatacggatatgcttgaaggtgtcatctgccaagaaacatgctagctgtatcctaaagcccatacggcacatatggtgtatcttagtgtcatgtgtgacgtgtgggaaatcaggcaggttgtttgcgtacgtggtgccctctctgaaatcagatgagttgttttatcgtcctcatcgaaccagttgtcaaaggatagtattagtgttgggaagatacatgtattgctttaatcaaaagaatcatgctggacaccaaaaaaaaaaaaaaagcggccaaaaggatgtgcggacaaaaaaaaaaaaaaaa

SEQ ID NO: 10088 - DNA, 1291 bp, Zea mays
cttgcgcctctactgctgacggggggaagggagcggatctggtgatccgtggtaacgtagttctcaatacattcatcatcctcctcctcctcccgtcgacttcgaccacgggccctaccagtttcggagtgccccagtctcccacccccagctccaccaagtcaccgcaccgccgcatctaggtcaccgcctcgccggcgtttcgccatggccggggactggcaggacctgggccaagcggcggccataggcctcctcttcgccttcctgctcgccaagctcatctccaccgtgatcgccttcaaggaggacaacctccgcatcacgcgctcccctccgtcctcccccacagccgccgccccagctcccgcgacgtctcccctcccctcccaacacgacgccgcaatcggaagcggcagtgacagcgattgggagggcgtggagagcaccgagctggacgaggagttcagcgccgcctccgccttcgtcgcggcctccgccgcctccggcaccagcgtccccgaggaggcgcagctgcgcctctacggcctctacaagatcgccaccgagggaccatgcaccgggccgcagccgtccgcgctcaagctcaaggcccgtgccaaatggaatgcttggcataagctgggtgctatgcctacggaagaacctatgctggaatacatctcccgtgcggttttttctatctatgtttgtttgcttcggttcaatttagtttacaatgacttcagatcaacgccgtggcccatgcgcagtaaacataatatatgatgcttctataatttaatcctaatcgttaactattgagcctgtttgtacaccggtcattcatgctagtgttggctgagcgtagaatgactttgatcctgtgcccttgctatatgtacaaaactgccctggtcatcatgctgcataactctgcagtgcctagatttttcagtgtgcagatgttgttttgtgtttcgagtatttgcaagcacttgaattcacggatcgactgcgtcctagcacttatattatcagcgtgccactgttgttggcttcacagtctctgcctgtgcttgttgattttgaaaaaggaaatcacttcggtttaacattgtccatatgtgatctgaatatgccaggaatgcttggcataagctgggtgctatgcctacggaagaagctatgcaagaatacatcacaattgttcaggagctattccctaactgggatgcaggtacaagtgcggtaagttctgtaggtccttattgttctcactcttgctgca

SEQ ID NO: 10089 - DNA, 884 bp, Zea mays
cctcgaggccggccgcctcggggccggccgcgacgggccctaccagtttcggagtgccccagtctcccacccccagctccaccaagtcaccgcaccgccgcatctaggtcaccgcctcgccggcgtttcgccatggccggggactggcaggacctgggccaagcggcggccataggcctcctcttcgccttcctgctcgccaagctcatctccaccgtgatcgccttcaaggaggacaacctccgcatcacgcgctcccctccgtcctcccccacagccgccgccccagctcccgcgacgtctcccctcccctcccaacacgacgccgcaatcggaagcggcagtgacagcgattgggagggcgtggagagcaccgagctggacgaggagttcagcgccgcctccgccttcgtcgcggcctccgccgcctccggcaccagcgtccccgaggaggcgcagctgcgcctctacggcctctacaagatcgccaccgagggaccatgcaccgggccgcagccgtccgcgctcaagctcaaggcccgtgccaaatggaatgcttggcataagctgggtgctatgcctacggaagaagctatgcaagaatacatcacaattgttcaggagctattccctaactgggatgcaggtacaagtgcgaaaaggaaagatgaagaaagcattacttctgcatcagcttcgaaggggcccatgggacctgtgtttagcagtttgatgtatgaggaagacgaagggaatgattcagaacttgctgacatccatgttttagcgagggaaggagcaactgaggatatagtgaaagttctggcagcgggtgtgggaagtcacatgagagatactgaagggtagactctgctgcactgggc

SEQ ID NO: 10090 - DNA, 3456 bp, Zea mays
aggataccccctcctacgagctggtgcattctgtctcgcttgcgagggtcataaagtaccaatatttgtactcgtgcctcgcagcaacaagatttaactgcaactagcatgcagatgcaggaaaatcacattggttcgcaatgatacatggaaatcaaagatcacagcttcccataaagaaatggtctatctgcagtagtatttataaatgtttcaaaaaaggcatctttctacaactcttttgagcgttaatctctgaatgttaggggttcactagaaccctcacagttactagatctgttaataaccaaattctgcagtcagctacaatctaattggtactattagattgcatgatgctacacacaaggtatgacaggtaaaatcgtattgttcccaaattcaatatatttggtcatctacatcatcacactccattaggggatgtttagatgctgacctctttgagcttttatcggaggaatctctgcccttaccaaacttcttgattgaccttttcggtgacattgtatagctttgcagattttgctgccctctgaagttcttcgatgactgaactacctcatcaaaagccttggacagtgaatctttagcgactgcatagatttcagcagattttgaaccttcttttgcaaattttaccacatgacagaagagatcattgaaccttgcagttgaaggatcatcacggccccccctcagatcaatgtaattatcagaggtgtcaatattttttgcatgctttgtccaacgtttcagaatataagcctttggaaggtcatgtaccccggccgcgaccacgctccgaagagcgtgtctgcacaagataccacagctctcaaacaggcagcagctacaattcaccgtaccttgatcaggattgaaatagacagtatgtatctcctcatcaccttcatatctgttaacacgatacttgtgtactgtgtcatcctcaagtctctctgcgtggtacccaaaagaatcaacaaattgcccctgaaataagccaaaaattgtgctagtgaatattgaactcccttgtttttctactggtgaggctgtactcaacgctggcatttgaaacattgtgaaataatctgcctgaacttcagcttcaaatgaactagaaattacttgtccaagttgacaaacagccacccgcaattcagtcttggacgaaaagtacttctgaatagccttctcaatacttccaaaggttgttggcatcagatttctgggataaaatacatttttcgtgtatgctggggcccatcgttggcgaatatcatagagagactgtaaaagctcattgttgctgagttcatgctttatgatgaccgagttccaacctgagtcaaacagttcttctattctggacccatcaatgcacttccttagatcagttactaaagccactggatccggaaacgtaccatgtagatcctccttcattggtgtctaagatatgcctttcacagaaaatatggtgggtattgggcaataccttggcaacagcagctgccattcctcggttcaactctgttagcaaagaaacaggtggacccatgtgcattgcttcaagccatttctcaaacaaccatgtaaatgatgcttctgactcgtcaagaagtagtgcgcagccaaaaacaacaggctgcacatgatgattaacacctgagaatatgacaatagggatagtctccttgtttttccgatacgttgtctcaaacctaacagcatcaccaaaatggtagtaagccatcctagccttagcatcagcccagaagatattggtggagtgcccattcttttcatactgcacagcatagaaaaatgaagggtcctcttcctgtctcttcttaaggtattcaaataagctttgagcatcctctggccctaaatcattatacctcacctctcttggatgctgagaatcttggccattcagaaggagattacgagtgtcagaaaagttatttgcaatgacaagtacctcaccttgcgagcgaacacagtgaactctacttgctggtgctggtttcagctcatgggtatgctctaggatgagtttggagactgtccaggtgtcttttcccttccgaattatctcaaacaatgcatcacaaccatccctcgaggggtccatcgcacgtactctcttggtatcctctccattgctctcccgtccagaatggtaccgatgccttgagcacacaagcttcagcatcttgagtgactcatcctgtgacttgcgggactggcgtacacgagcttcaaatcccacacggctggcatacgagtagtagaatgtcttggcagactcaagggactcgaattccataccaatgtaagggtcaaccacagtatcactctcgatggcaatatactgcactcgactgggcaacccgacctcatgattgtgctccttgacaagcttggtgacaatccacttgctatcacctctgcggagcacttcgagcatggcattgcaaccctccctgatggaggcagggcgcttcctcgtcttcttcccagctgtgaccacacgtttctccttactgaacccttcccttgagcacacaaatcttagcatgattatggactcactgcacttagacttgcgtgaccgggcaatgcgaacggagaaaccaacacggccagcataggcaatgtagaaggtcttggcagcctcaccggactcaaactccatccccagccgaggctccaggcaggcgtcggactccaccgggaagaggtccctgcagacggactgcggctgtatcgccgcagccgcagctgccagcgctgactgagcttggtggtcgacaatatggacgctgtgcagcggcatctggtccacgtgggggctgacgccgagggaggcccagaagttgatgctgtcatcctcgaggtccaccacttggggctccatcatcccgtggcccgccgccagctccccgacctccgttaccctcccgcaatctccttccccgtgttatctcctacactccaacaacaaaccaagaaccatggaaacttctacctgacgccggccgccacgctcaattgaagaaccaatccagctcaaactcccgcgtggctctggctccggcactccgacccctagcaaactgccgcggagaagcaagaaatctgaagctttgataactccgcgagtgaagaagaggaactaaaagcagatggccccaattgaggaaatgggaactaaaagcaggtggcaacaattgcggaaatgggggccaagaaccctagagaattgacttggtgagacctgggattcgacagaaatgcaagaaatcaggctcgaattgggtagaggaaagactgtacctctggatccttgaggctgtttaagctctaccagcggcggcggctgctaccgacagcggctcctttgcgttactttcgcttcat

SEQ ID NO: 10091 - DNA, 795 bp, Zea mays
  misc_feature (585)..(586): n is a, c, g, or t
  misc_feature (588)..(588): n is a, c, g, or t
  misc_feature (597)..(598): n is a, c, g, or t
accccatcccccgccaccggtcaccgaaacgcagcaactgacaggcacctgacggagagctagccgctctgcagccgagtcgagtcgaactagcgcgcgagcgagcgaggaagaagaagagctagctatactgctgcttcctcgcgcgcagcagcagcagcaaacgaagaaaccagccccatgggcggcagcgcggatgcgaacggcgcggggtcggtgcgggtgccggtgccgccggcgcggccgttcctggacacgttccgcgggaacctcaaggagaccttcttcccggacgacccgttccgcggggtggtgcgggagcgcggggccgggcggcggaccgtggccgcgctgcgctacttcttcccgttcctcgagtgggcgccggcctacgcgctgtccaccttcaagtccgacctcatcgccggcatcaccatcgccagcctcgccatcccgcagggcatcagctacgccaagctcgccaacctgccgcccgtgctcggactctactcgagcttcgtgccgccgctggtgtacgcgctgatggggagctccaaggacctggcgggtggggacggtgccgannantatgatgannagaaagactcaaaggaggacaaggaaaacaccgacactgctggtgatggcatcgtcgacaaagctactaaggagacgagctcaactgatgaacaattctaacacaggaaactgaactaccttgttcgtgtctcagctgtagaaatctaggaacagcgatacattagttcctgtaatagaagcgagtccatgctgcta

SEQ ID NO: 10092 - DNA, 1102 bp, Zea mays
gaaaacttttttccggccccgcgggccagcggaaaagtttccgtttccctgctcgagccgctcccccgtcctcttccttcctctcgagtagcctaccctcggttggtagctgtcctatttcaatttcgaatctccccttcccctcagtctctcacacgcacgctcctcccctacgcagcaaaaccctaaccctagctgcggacgccgtcgccgcctccgcgcccaaccgatgtctgattctgaggcgtccccaccgcccactccggccgccgcaacgcccgcagcgccggtggagacctccccgtcctcggcgaggaaggaagaactgctgcctgtggaggaaaagatctcggaattaagtgaatcacaatcagagcttctagggaggctccgtgggcttaaggaggatttgctgagttggaggagtaatttagactcccaagtgacgaaatacaaagtggaactctctgacatcaagagtgcactcaataatgaaatagagcagcttcgctcagatttccaagagctgaggaccacccttaagaagcagcaggaagatgtgtcacttagcttgaagaatttggggcttcaagatgctaccgaaaatgatgggaacaaaggaaatggagacggcacaaatgaggtcttgtcagctaacttggggaacttgaaactggatggttcttctgaaaactatgatgaaagcagagagtcaaaggaggacaaggtggaaaacaccgacactgctggtgatggcatcgtcgacaaagctactaaggagacgagctcaactgatgaacaattctaacacaggaaactgaactacactgttcgtgtctcagctgtagaaattctaggaacatcgatacatgagttcctgtaagagagcgagtccatgctttgctatggctcagtcgggttggttatggaactctattgggacctgtgagtcgtgaggatccaaatctcctctagaattgtgtaccaattgaaagttacgatatggtatcatggacatttgctcacctgaatgcatttcagctggtttgtcgtttgcaaaaaaaaaaaaaaaaaaaaagaggccagttctctctcctcgtgc

SEQ ID NO: 10093 - DNA, 1160 bp, Zea mays
ggggtacccccgaggccggcccggtgggtccctcctcgccccccgcccccgtcctcttccttcctctcgagtagcctcggttggtcgctgtcctatttcaatttcgaatctccccttcccctcagtttctcacacgcacgctcctcccctacgcagcaaaaccctaaccctagctgcggacgccgtcgccgcctccgcgcccaaccgatgtctgattctgaggcgtccccaccgcccactccggccgccgcaacgcccgcagcgccggtggagacctccccgtcctcggcgaggaaggaagaactgctgcctgtggaggaaaagatctcggaattaagtgaatcacaatcagagcttctagggaggctccgtgggcttaaggaggatttgctgagttggaggagtaatttagactcccaagtgacgaaatacaaagtggaactctctgacatcaagagtgcactcaataatgaaatagagcagcttcgctcagatttccaagagctgaggaccacccttaagaagcagcaggaagatgtgtcacttagcttaaagaatttggggcttcaagatgctaccgaaaatgatgggaacaaaggaaatggagacgacacaaatgaggtcttgtcagctaacttggggaacttgaaactggatggttcttctgaaaactatgatgaaagcagagactcaaaggaggacaaggtggagaacaccgacactgctggtgttggcatcgtcgacaaagctactaaggagacgagctcaactgatgaacaattctaacgcaggaaactgaactacactgttcgtgtctcagctgtagaaattctaggaacagcgatacatgagttcctgtaagagagcgagtccatgctttgctatggctcagtcgggttggttatggaactctattgggacctgtgagtcgtgaggatccaaatctcctctagaattgtgtaccaattgaaagttacgatatggtatcatggacatttgctcacctgaatgcatttcagctggtttgtcgtttgcaatatccaagcctccaaggccatgattttattagacctacttgaaatggcggtaggtgatgtactgatgtggattttgtacgaggaatagtggaataaggtattctggtgggtttgttgttggtc

SEQ ID NO: 10094 - DNA, 2166 bp, Zea mays
cctcgaggccggccggggtgggctcatttcaggcctaatcgctctagcctgcgcttgccgcttcgtctccgggcggccgggcgggggaagaagaccacctggatccatctccttctcggtcaactacaaggagatcttatttcggttacaatgaagcgcatgcacagaatgcaaacgagaaagtcccattcatggtggtgggacagccatattagcccaaagaactccaaatggctagctgagaatttggaagagatggacaagcaagtcaaagagatgctgaagctcatagaggatgaaggtgattcttttgccaagaaggctgagatgtattttcaaagaaggcctctgcttgtaaatcatgttgagaacttctatcgcatgtaccgtgctcttgctgagcgctatgacaacgtgactggggaattgcgcaagggtcttgcgctgcagtctcagggctctggtatatccgaaactgattccgagacacaatcaacttcatcgtgtccagagcctaacatggaacagaacacagcaaaaccgaagcgtaatgtgctccttggttctggtggaagctcagacatttccaagaaggagagtgatggatcatcttcttcttcttcagattctgattcagaggttgacgaggcaagtgaagaaaatggcaatgggatttcttatataagtgatgaacggattgctgagctggaagatgagcttcaggaagcaaggcaacaaattgaggcgcttgaggtaaagaacatgcactgccaatgtgagaaacttgaagagagtctcaaacaagttagcaatgaaaaggaagatctggtagctgcgattctggcaagcaagaatgaggtcgaggatctaaaaggagacatggtctcggcagctaaacattttgaagcccaactagtgcaccgtgaccatgagattgagaagtgcaagcaggaggctgagcaagtttctgaaaagtatttccatgagaaatccactctcgaatctgaaatcgaaaggctccaggaagttgttaggagttttgaagagaacctaacaaaagttgctggagagaaatttcagcttgaggcccaggtaaaggaacttgaacagacttctaatgatttagatgactcttctgcggagattataaagctacaagaaataatcaaggatctgcaaggaagattggaaaatgactcaaacgataagagtgtacttgaggaacgtgctatggagctggagcaagttcgtaggcagttagaggattcaagggctgaggctagtatgaagctacaaactacaattaagaacctgaatcaagttcttgaagagaaagcagaacttgagaatcgtatgaaggatgcggagcaggcaaccagcgacctaaactccctggtcggttccctcgacggcaagctgaaagccacagaggcgcagctcgaacagcttcacgcggagaaagcagaagcgatcctcgagagcgagaaacagatatccgagctgaaccaagccatcgcccgtctcaagacgcggctggagctgctgtcttcggagaaggccgcagtcgataccaaggcgtccgctctgctgaccgacgtcgccgtccgcgacgagaagctgaaggagacggaccgccacctgcagcagctgcacctggagcacgtcgagctgatcggagcggcggacgccgcgcggaaagacgcgtcggggctgcgctcacgcgtgcgcgagctcgaggtggaggtcgagaggcagaggctcatggtggcagacagcgcggaggggaagcgcgaggcgatcaggcagctgtgcttctcgctcgaccactaccgccacgggtaccagcagctccggctgctcctgcagggccacaggcggccccggcccatggtgatgacagcgtgatgagttgaagtggttattgtcctggatgttgggacttgggaagtatgtaagctgctgcttctcggtgtgtctgttgtcctggcgacatgagtgagtttctatctggatgagagcgggtgttaggaggatgtcgaaactctacatagttcgaggagagcttgtgctctgtagttatttgcactgcggagttactcgtcaatttgtgctgtgtgatgtagctatatggttctatggataatcacggtgttcccttctttattt

SEQ ID NO: 10095 - DNA, 1710 bp, Zea mays
gtaatatgaccgaaatatcattcatgccaaatttaaggatatctcataaattttactaccacgaataatgcttcacgcgtgtgaaaaatcactggccaggcaaaaacacatgacaacatcaatttgagcaccggacggagccgtgccatgcaaccttgttcagacatcggagcaacttgagctagagaacaaaggagcgcccgaaagatctctcccggctcccctccagaagctttcaccatccactccaattcggccaagtggcgtcttcgccatctcaggataagccctcctttcctaccactaccaccggcaccgccgcctcttgtttctcttcctcttcctactcggcaatcaccacacgagagaagagaagctagcgttcaacagaggaagaagcgagagagctgacaagaatcgactgccatcaatggctctggcgccggcgcctctccagtgcttcctcacgagcagcagaccggccgtatgcacggcgacgccgcccaataagcgcgcgaggaggccgtcgaggatctcgtgcagggcgtccggcgatgacaaggacaaggtcccgtcgtcgggagggagcgatcttggggtcaagcagctcgggaagctggccatggtcgcgctggccgccggcgtgctggtgctcggccccgtcgacggtgccgtggcggccaagtccggcggcagggtcggcgggcaggcgttccggtccgcgccccggtcgtccggccctcggatcaacaactccaggaccaacatctacatcaacccgccggtggcgccgccgctgggcggatacgggtacgggagcccgttcttcggcggctacggctacggctggtcgccggttcagttctacatgtcggcatgcatgtagccgtgtgttcagttcaaagctcagacttagaatagatgacgtcgtcttcattcctctcaccgattacgggctctggatgtctgtgaactgttgtgaagctatagatagatttcgttcgtccttcttgtggcaaccttcatggatgcacatcagcacatgctgcgtctgtctgtctgtctgctgaatgcgaaacgttatcttgtttgtgtggtgcgcatgccgcaggaccaacatctacatcaacccgccggtggcgccgccgctgggcggatatgggtacgggagcccgttcttcggcggctacggctacggctggtcgccgttcagcttcttcgcccccgggccgagcgtcgccgtcggggtcggcggcggcttcgacacgctcgtcctcttcttggtgctgggcgccgtcgtcggagctgtcaggcggttcctcaacaggaacaacgacgattacgacgactactgattatcagtgccaggctcctgctacgtacttcaccttcgtgtgtaatatatgacgaaatttttcccgtgcggaattctaggaacggagtgtactgacgatgcatcaggagatgtatgtaataattttgtccagtgaaatgtaatgagcatagcgtctatagttagggccagttgcaaacagccaaatactccatagcatcgatcgagccaccgactacgaagtgcatgatgaaaatacttgcatggctgctattgcatagcttgacaaattgttagacacggcatagtacatcacagtgcgtcaggctgctcaacgctagcctcatttctacaacctttaatagctgcatcctact

SEQ ID NO: 10096 - DNA, 882 bp, Zea mays
cattgggtacctcgaggccggccgggaccgccgcctcttgtttctcttcctcttcctactcggcaatcaccacacgagagaagagaagctagcgttgaacagaggaagaagcgagagagctgacaaaaatcgactggccatcaatggctctggcgccggcgcctctccagtgtttcctcacgggcagcagcagaccggtgtgcacggccacggcgacgccgcccaagcacgcgaggaggccgtcgaggatctcgtgcagggcgtccggcgatgacaaggacaaggtcccgtcgtcgggagggaacgatcttggggtcaagcagctcgggaagctggccatgggtcgcgctggccgccggcgtgctggcgctcggccccgtcgacggcgccgttgcggccaagtccggcggcagggtcggcgggcaggcgttccggtccgcgccccggtcgtccggccctcggatcaacaactccaggaccaacatctacatcaacccgccggtggcgccgccgctgggcggatacgggtacgggagccccttcttcggcggctacggctacggctggtcgccgttcagcttcttcgcccccgggccgagcgtcgccgtcggggtcggcggcggcttcgacacgctcgtcctcttcttggtgctgggcgccgtcgtcggagctgtcaggcggttcctcaacaggaacaacgacgattacgacgactactgattatcagtgccaggctcctgctacgtacttccccttcgtgtgtaatatatgacgaaatttttcccgtgcggaattctaggaacggagtgtactgacgatgcatcaggagatgtatgtaataattttgtccagtgaaatgtaatgagcatagcgtctatagtt

SEQ ID NO: 10097 - DNA, 1047 bp, Zea mays
attgggtccctcgaggccggccgggatccactccaattcggccaagtggcgtcttcgccatctcaggatgggccccccgtccctggcactaccgccggcaccgccgcctcttgtttctcttcctcttcctactcggcaatcaccacacgagagaagagaagctagcgttcaacagaggaagaagcgagagagctgacaagaatcgactgccatcaatggctctggcgccggcgcctctccagtgcttcctcacgagcagcagaccggccgtatgcacggcgacgccgcccaataagcgcgcgaggaggccgtcgaggatctcgtgcagggcgtccggcgatgacaaggacaaggtcccgtcgtcgggagggagcgatcttggggtcaagcagctcgggaagctggccatggtcgcgctggccgccggcgtgctggtgctcggccccgtcgacggtgccgtggcggccaagtccggcggcagggtcggcgggcaggcgttccggtccgcgccccggtcgtccggccctcggatcaacaactccaggaccaacatctacatcaacccgccggtggcgccgccgctgggcggatacgggtacgggagcccgttcttcggcggctacggctacggctggtcgccgttcagcttcttcgcccccgggccgagcgtcgccgtcggggtcggcggcggcttcgacacgctcgtcctcttcttggtgctgggcgccgtcgtcggagctgtcaggcggttcctcaacaggaacaacgacgattacgacgactactgattatcagtgccaggctcctgctacgtacttcaccttcgtgtgtaatatatatatgacgaaatttttcccgtgcggaattctaggaacggagtgtactgacgatgcatcaggagatgtatgtaataattttgtccacagtgaaatgtaatgagcatagcgtctatagttagggtcagttgcaaacagccaaatactgcataacatcgatcgagccaccgactacaaagtgcatgtggaaaaaaaaaaaaaaaaagtggtc

SEQ ID NO: 10098 - DNA, 972 bp, Zea mays
gggtacctcgaggccggccggacaccggcaccgccgccccttgtgtcccttcgggccgggggtcgggaatcaccacacgagagaagagaagctagcgttgaacagaggaagaagcgagagagctgacaaaaatcgactggccatcaatggctctggcgccggcgcctctccagtgtttcctcacgggcagcagcagaccggtgtgcacggccacggcgacgccgcccaagcacgcgaggaggccgtcgaggatctcgtgcagggcgtccggcgatgacaaggacaaggtcccgtcgtcgggagggaacgatcttggggtcaagcagctcgggaagctggccatggtcgcgctggccgccggcgtgctggcgctcggccccgtcgacggcgccgttgcggccaagtccggcggcagggtcggcgggcaggcgttccggtccgcgccccggtcgtccggccctcggatcaacaactccaggaccaacatctacatcaacccgccggtggcgccgccgctgggcggatacgggtacgggagccccttcttcggcggctacggctacggctggtcgccgttcagcttcttcgcccccgggccgagcgtcgccgtcggggtcggcggcggcttcgacacgctcgtcctcttcttggtgctgggcgccgtcgtcggagctgtcaggcggttcctcaacaggaacaacgacgattacgacgactactgattatcagtgccagctccgatcctgctacgtacttcaccttcgtacgtgtgtgtaatatatggcgagattttttccgtgcggaattctaggaacggagtgtactgacgatgcatcaggagatgtatgtaataattttgtccagtgaaatgtaatgagcatagcgtctatagttagggtcaaaaaagcggccccaaatgccccctagcatcgatcgagccaccgactacaaagtgcatgatgaaaatacttg

SEQ ID NO: 10099 - DNA, 5095 bp, Zea mays
taattcagaagtataatcctttctgctagaaacgtgaagctgaccttacagtgaccacccatgcacatctgatatttgaagtacaaagcaaccggctcaattctgtccacaacactgcctgaaccagaccaaccgtatcagcatcagcgtaccggccgcggaggagccatctctctctctctctctctctctctctctctctctctctctccaggcgcatcaagccatggctgctcccaagaagacgatgagagctctgcggtacgacaagtatggtggaggagctgaaggcctaaaggtccactaaccacactagcacgtgctgttcctgtctttcgtgtccaagtagctagagtcttttcttgatgctcttgctgcctcgattcagcatgtggaagtgccggtcccatccccgagcaagggggaggtgctgctcaagctggaggcggccagcatcaaccccatcgactggaaaattcagaagggcatggtccggcccttcctgcctaggaagttccccttcataccaggtacactttacatgtctcaacggcacgttatgtagcctcagattggctcagtagacgcatgtcacatcacatgaccagtgtcgattgcgcgaacaatcgcctgtcatcacatgaccactgaattatctgaagaaactgagggttttttgtttgtttgttttgcttcagctcacttagtgtttctgatcctgctgtatatactctaattttgatcctgctgtatatactctaattcggaacccttgccttcatcatggatacaaactgcactagaacaacgtgttgatcataccaaccgtggtccgtggacgatgttcaagacttaaaatatattgttttttttttttttttgatgcgagaactcgatcttgtttctgtgccaaaaaaaacagttggagacatgtctggcgaagtggtagagctaggcagcggtgtgaccgacttcaagccaggtgacaaggtcatctccatcactttcccggtaatatattatcctcactttcgaattccatttactactgcgttacctatcgatccagcagcgacaaacttacctaccatctctggaggaagaatggaggcgggctagccgagtacgcggtggcgccggcgtcgctcacagtggcacggccgccggaggtgtccgcggcggaaggcgcgtctctgcccacggccgcgtccaccgcgctgcagcagctcaaggccgcgggggtaagcagcttcgacggcggctccggctccggctccggctctggcgccgacagtgacggccccaagaacgtgctggtcaccgcggcctccggcggcgtgggccactacgccgtacagctggccaagctggcggggctccgcgtcacggccacctgcggcgcgcgcaacctgggcctcgtcgcgggcctgggcgccgacgaggtgctggactacaagacccccgagggcgccaggctgctgagcccgtcgggcaccaggtacgacgcggtggcgcactgcgcgactggcaccccctggtcggtgttcgcgccggttctggccgacagggccacggtcgtcgacgtcaccccgggggtcgccgccgcggccaagtcgttccttcagaaggtcaccttctccaggaagaggctggtgccgctggtcctgatccccaagaaggaggagatggagtggctggtggagatgaccaggcaagggaagctcaggacggtggtcgactccaggtactcgttgagcagagcgcaggaggtgtgggccaagagcatcgatgggcatgccaccggcaagatcgtcgtggaaatgggcggtgctgcagagtgaacccggcaagcgggcatgcgtgcacattgtgttggtttgttcatggattgttctctctgttcgatcatcgcgacagccattcataataagccatccatctgatggaagagaactttgcacaccaacacactactgacttactgagtactgactgacacaattgtttacgttcacagtacgtacttgtaagcatgttcgaaggcatgccctgtctgatatcagtatccgatacatccgtcttatcaatcaaagaaccaggcattatagatcctctccgagacacatcagagctcctcacatctcccaagagcagccgattccctctaccttcccgtccctcagcgatcctttcaatttcctcaaaacatcctatttgaggattagcctctaccttcccgtccctcaaagcacaaagccatgtagaatcgagaggaatctcggagtcggagatcaggagaagaaaaaatagggacagtggaagaatacatgtctcaactccagtccttgcaatatgatattaccatgcacagctgccagcttgccaccactataacgaccccttatttgcttcgaagtatgtcggtggcctcaaagatgaaatcagggcaacagccgaacctgaagtgccttgtacagtgtacagagcatttgtcgttgctaaaatccaacaaagagtcttagacagaagcaaactcaaataacacagaaatcctgccacaccagaaccgccacaattcagacatattaaaaaaaactgcacccacatatggtaacttgtggagggacgagcaatccagagagtattttaaggccaacaatctctatttccattgtggggagaagtttgagcaacgccatgcagaggtctgtatcaagagaaacaaacctcaaatgaaggttgtggttcttattcttaatgacttggataaagagctaaatggagacctcctgaaatcctgaatgagatggctgtagcaaagatattcggtgaagactttccccaaccctcccttaatgccttggcggggactaaatctactcattgtatcaaattgaaaaccacagtgaagaacaaaaccatgcttatgttggtcgagagagtatatacagggagagtgatgaagcagagagagaacatgagagcgagagaatgagtgggaggtcatgttctggtgcctgcattacttctctgagttggacagctgggctaacttggggggcttgaaagctctacaagtggctccttgatctgtgcatagcatgtattgacggacgaactctcgatcacaccggatgatccgctagctagagcataaacgtgcatctgtaagcctgtgcatgttaaggttccagaggaacgtcgagccgccaaaacatccagtgcccaggattattcagtttctccgtatcttggtttctaaattgaatttcatatttatatgatatccatgatgatgatgtttaagatcatgtcatgatcgggtaccaaaaacttggaaatcctggttatctctctagcgggcctgtggtacactttagcttttcatagctctgtcggctgctctccagtcaaagcctctacggctatgtgttgaattgatctccaccggttggcccaacggctaactggatctgtctaacccaaagcaaggttggtaggctcagcctataaataaaatagagaggtgggggttgacggctcagacagtagtcatctacgtttcatcacctcaaaccctaaacggatctagaggaaggctgtcagcaacatgaagctcaccaccgacgaaatcgcttcaccgaccgtcgctaccctagcgcagaccttgacccacgaacgtgacagtgggagatcaagttccgctgcgtctccggccatgtacacagtcttcatttgccaaccgccccttccccaagcttacacacaggttctttggcatttcacaagattccggagaaagtaggagctgttgcttaccgcttagaacctcctgatgacagtcgcaattaccccgcgcgtttcacatactaggaatcatggtttgtaataattctaggtgcgtggaactttgaagtctgacataggtttgacaagaccactgtacctccacccatatactggataccagggaaaactttatcggcgatattatctccgatgaacccgattttcctgtttcgatatatttttttctatcagccgatgaactgagttattttttctaggtgcgccacgctttttaatgtgtctatatccgataaaattccgataaatccgataatcccgattttccttgcacaagctgattgaaatgagaatttcctttttcaaaaagactaaaactatggaagagttgaaaatgagaggcaacgtataaaaagaaagggagaacatgtgtctggataatctgcaggtcgtcgctggcgccaaatggtaccgactaccgagttgcaagtccaaccaccgccactgtcaaatacaaaatctaaagcattgacattcaagtcacagtccaaaggctgggtcatattccttcgatacaaaaccgttacgcttccaatcccgcctacatagaaaatgtcgcctcgcgcgcgcgcgcgcgtgtatatatatatatatatattggataaatccgcaacatatctgtctgtctcgattcctcgaccaggcgaactcacattaaaaagcgtggcgctttggattcgagcatgcaagtcacgtcgttgctaacgctaagaccgaaggtacggggcagattcaggtcgccaccgatggtttgcttagtgggtctggcagttggcaacatctcgccatccaaccgaatccctgctgcttggcgcgtaatggaggcgagccagaacgatgtgataggaacagccatgtttgcggcgagcaagccatatccatgcagttggattgggtctaaacataatacaaatacaactacctagagcacgagagagagagagagagtggaactcacttttttcgcatgttggtgaagaactcacagacaatgtcaagattaggccacggtttctggatcataataaatgacgatatgaacgaaggatcatatacagacgggctctttgtgaaaatatatgaattaacctctcttagatacgtctaatgaatgggattgtacctgccctagcatatatctgtcgctttctgcacaacttatcagatcctctctggtcctacgagccctgatcgattcaatgcgttgttttggggggggggggctgca

SEQ ID NO: 10100 - DNA, 1963 bp, Zea mays
agtcttcgagcagcgtcgttccaaaaagaaaaaagaaaaactcagccgccggccgctgcccctctcggctgcacgacgtccgtgagggcgtgccccctggccccgtcccttgtcgcctgcccgccggtgcccgcacaggctgccagtgccatactgccatccctccgtccggccgtctgcccaggctgcctgcccggcgccctggcctcccggtcgctggctctctgcccaggcgccaggccgcaggtcccaccgccccagaccacccgcgaaccagtccgctgcaggctgcaggccaccgtccctccagttcgccggtcagattattaaccattcagataccccagctccgcctagacgcgaatcctccgccactatggtggcagcggtgtccctgccgagccaagcacaggccgtgcttcggagccggctctgcgacccggtcttcatccactccgccctcagtagctccctggacactaattacagcaagctgaagtacctcgtcgccagctcggtctccgaggcctgcaacaattctgtcctcctcttgggtccccgcgggtgtggaaaagcagcggtggtcgacatggttcttgatgatctgaaggaggagcacccagatgcgatttccgtgatcagactaaatgggatgctacataatgacgacaactgtgctatgaaggaaattgccagacaactttgtttggagcatcagttatcattttcaaaaatggcttcttcagatgacaacactgagttcatgattgacatgttacgggagtgcggactagctcacaagacaatactatttattctagaagaattcgacctctttgctcagggtaaacagaggttgctttacagcttacttgatgcaatgcaatctctaacatcccaagctgttgtcattggtgtgagttgccgcttggatgcagatcaactcctagagaaaagggttagatcccgattctctcataggaaacttttatttatttcgccttcgttggatgatatacaacggttggtggagcatttgcttatactggccaaagactcaggtttaccatcaaagtatatcgccgattataactcaagacttactagcatttttagtgataagaaattcaaaggttgtctcaactccctcatggatgctgatgcaacaacgagcaacattcaaagatttcttttcagagctgtgtcatatatggacatggaatctggattcctgtcggtagaaagcttcctaaaggccctttcttccatgcagaggcaacctaagatggacagcttacaagatctctcgattttggaattatacattcttgtgtgcatgcacagattagaaagtaaggagcaaacctcatacaacttcaccagcataatgaaagaatacagatccatacaagacgcctataagacttctgataaatatgcaagcaccgtttgttttagggcctttgagcaccttttggatcgtgagctgattagttttggtgacaatagatggagaaaccaggcgcttgaataccgacctgttaagctcctcatatcctcccgcgagctcgctgagtccctcaagctgaacaccacctgccccgctgtactgcagaagctgtttgatcgtgaaagatacatgtagaatctcctttcagatggccgcgcttcacctgacttgagtcgccgctttcatgtttcaccgggttgtcaagttcatgtttcactgtaaaccggcgattgtattagtatcttgtccactgttcgctggaaaaggtgtgggccgtgtggccaactgcccagcgtgagtcgtgacctgcctgtcaatcgcttgagtcttgaccataggccacacggaattagatatctgtggtgcactgattttgggctgaaaaaaaaaaaaaaaacagcgtggtgacagtattttggtagctttgaaatgaatgcgctattcggagtttac

SEQ ID NO: 10101 - DNA, 2715 bp, Zea mays
ctgcagcctacaggacgacacaaaatgccttgatcccacagccccgcgctgcgactgcgaacccaaaacaggcaaacacgcagcggtgcgcgcacaccgcctgctacggccagcatccagaagcgttaggcgtaggcgccgaccgcttagcgcccggtggaggccaccggacatcgccgttcgccgcatggccgtgcctctcgccaaaaccgcgacgcaactcccccgtatccgccgcaggcattgcgacttgcggaagccacaaaaccacgcacgcgcacacctacctcctccgttcatcaaaaccagcggcaactgccggccgcgccgcgctgaccgaccgaccgatcggggccctctcactttccgtgcctcgtcgttattaaaaaaacacaccggaggcgcgaccgcctcgtccgcgtctgcttctgcatctgcttctgcttgtgctgctgctgacatcgaatcaaagctgctaaacctcggtccatccatcacccgcggcgcgacacacccaaaggcctctccctcccgtcccgtgtcccgatcgcaccgctccccacgatggcgtcgcacatcatcctgccgccggacgacgccgacgagaaccacaaccaccaggcggcggcggcggcggaggaggaggaggaagagcgggacgagctggggcgcgacgacgacgacgacgagcacggggtgccaccggcgcttctgcccaaggcggcgctgccgttctcggccacgtgcgtgcggatctcccgcgactcgtaccccaacctccgcgcgctccgcaacgcctcctccgtcagcctcgctgacgccgcctacgtcaagatctccgaggccgactttggatacgtcctcgacgacgtgccgcacttcaccgactacctccccgacatcccgacttatcctaatccactacaagatcatccagcctattcaactgtcaagcagtattttgtcaatgaagatgacaccgttcctcaaaaggttgttgttcagaagaacagtcggcgtggtgttcacttccgtcgtgctgggcctcgtcagagggtttattttggcaccgatgaagtgaaagcctgcattgtaacttgtggaggcctgtgccctgggcttaacactgttatcagggaactggtgtgtggcttgtcacacatgtacaatgtcagcagcatttttggaatacagaatgggtacaagggtttctattctagcaactaccttcccctgacaccaaagagcgtcaatgacatccacaaaaggggtggtacagttcttggaacatcacgcggtggccatgataccaaaaagattgttgataacattcaagatcgtggaatcaaccaggtgtatatcattggaggagatggaactcagaagggagcatatgagatcttcaaggaaatccggaagcgtggcctcaaagtttctgttgctggagttccaaagacaatagataatgacattgcgatcatcgacaagtcttttggttttgatacggctgtggaagaggcccagcgtgccattgattcagctcatgtggaagcttgcagtgctgagaatggaataggtttagtaaaactgatgggccgttatagtgggttcattgcgatgtatgctactcttgctagtcgagatgtggactgctgtttgattccagagtctccattttatctggatggagagggtggattgcttcaatatgtagagaagaggctgaaagagaacaagcacatggttattgttgttgctgagggagcagggcaggatcttatcgcgaaaagtttagccacatcagatcaacaagatgcgtctggaaataagctgcttcttgatattggtctttggctgactcacaagataaaggactacttcaaaagcaaaaagatggagatgacgattaaatacatagatcctacatacatggtccgtgctattccaagcaatgcatcagacaatgtctactgtacacttctagcccacagtgctatccatggtgcaatggcggggtacagcttcactgttgggatggtcaacggaagacatacctatatacctttctacagggtgacatccacaaggaacaaggttaaagtcacggacaggatgtgggcaaggcttctgtcgtccaccaaccagccaagtttcctgagtcagaaggatatcgacgaagcgagtgaggcggataggctggcaaacaggccaccactgccaacgggtgccagctctcgcgtggcgaggtctttcgatcaatcttcgtcgtgttcttccaatggagagatctaagtgattgctggtgcaccgcaattgtgtacagaacctacttactatcgttctgagctctggtgcttgggcagcttcgccacgcaacgagttttgctcttgttagtcgttatgcatatgccttgagttgtgtaggaggacacgcggatgtgggccctgttagcacgcgtaataaagaaacaccattgatgaagctacttactagaggctccatctatcatgtatttgctgcagttattatgcaatcggctggtgttctatctgtactaccgtgcattttcctttggcaccgtgaaatttgtaaggacaattctacatatgccattttaattttgtctggtatctcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10102 - DNA, 2991 bp, Zea mays
  misc_feature (2085)..(2085): n is a, c, g, or t
gcacatttctattctcgtttcagagcaaagaaccttctttttttgtttgcttcagccatcttgactttaccagcttatctactattgtagggttcattgcgatgtatgctactcttgctagtcgagatgtggtaagtatgacacctttacctgtagatgttatgttctgcttagtctattatttttttattcttgctcgcttgccggagtatttttttttcaaacatcagtgttagaattacgattttccattttcgacaggactgctgtttgattccagagtctccattttatctggatggagagggtggattgcttcaatatgtagagaagaggctgaaagagaacaagcacatggttattgttgttgctgagggagcagggcaggatcttatcgcgaaaagtttagccacatcagatcaacaagatgcgtctggaaataagctgcttcttgatattggtctttggctgactcacaagataaaggtacataactatataactaaaatattcttgctgctggatttgagccacttatcttatgttgtagtttggtattcactgtctcgggtattgcaaatgagctaaatggctccactatactgtatgtggttcttgaaagttttgcttaataggccttgtgctaattcctcgtaggactacttcaaaagcaaaaagatggagatgacgattaaatacataggtagccatttgtaactcttatttttgctattgatatagttgtaacacatttctagattggtctgtgacaatattccatcggaattggcagatcctacatacatggtccgtgctattccaagcaatgcatcagacaatgtctactgtacacttctagcccacagtgctatccatggtgcaatggcggggtacagcttcactgttgggatggtcaacggaagacatacctggatatacgctgcttcttgatattggtctttggctgactcacaagatataggactacttcaaaacaaaaagatggagatgacgattaaatacatagatcctacatacatggtccgtgctattccaagcaatgcatcagacaatgtctactgtacacttctagcccacagtgctatccatggtgcaatggcggggtacagcttcactgttgggatggtcaacggaagacatacctatatacctttctacagggtgacatccacaaggaacaaggttaaagtcactgacaggatgtgggcaaggcttctgtcgtccaccaaccagccaagtttcctgagtcagaaggatatcgacgaagcgagtgaggcggataggctggcaaacaggccaccactgccaacgggtgccagctctcgcgtggtgaggtctttcgatcaatcttcgtcgtgttcttccaatggagagatctaagtgattgctggtgcaccgcaattgtgtacagaacctacttactatcgttctgagctctggtgcttgggcagcttcgccacgcaacgagttttgctcttgttgttagtcgttatgcatatgccttgagttgtgtaggaggacacgcggatgtgggccctgttagcacgcgtaataaagaaacaccattgatgaagctacttactagaggctctccatctatcatgtatttgctgcagttattatgcaatcggctggtgttctatctgtcttcgcctatctgtactaccgtgcattttcctttggcaccgtgaaatttgtaaggacaattctacatatgccattttaattttatcttctagtatcttatttgtcgtctttctataccaaaaaaaaaaaaaaaagaaccggccatgttgttttcttagcctttaatgccaccgcgcgctctgtcaatgtgattaactccatgctctgtttctcattcaaaatgcaagaatgtatacttgtctaatgtctacacacaagttgtcagaatactaaaacgtagtcaagcggaatgcaacctacacaagttatctttctcatactaagccgcggaatgcatacatgatgtctatgcacaagtcaagtacgctgtgcctgtgcattctttcccacgggaggtggcacaacgcacaaccacgnaccacctctgttcctgtgtaccaagcccgaactcccctactgccctacagaatttccggcgccgcgaggaaagaaaaaaaaagtcagaagtccacgggcctcggccaccgaagtccgaagtcatgctagttggcaccctcggatacgttgatccagagtatgccaaccatgcaactctgctctatgtcaagccccattccctttctcattttttttcttttcctgcctgactgcctcggcgcagcgccccaccatgaccgacgtcgtcgcgcagctccagcctccaggagtgcctccagctcgaggaggctcgcgccaccgccgccggcgacgtggacggcagcggcagcaccagcgacccgtactccggttacaatgcgtacgccgccgccgctgatggccagtccagcgccgggtttgaggtggagcacaacttcgggagggcgtcaacgatgcccacgggtcctgccgcgcggtagagacttcgttgcacgtctcgacggccatgccgctggcttgtcttttggtggtgacgtcgtgtagacatacgtgagctttttaattgtaacaatccatcaagagttgatagcatagcactgcccagctttgattggtcggatccatgaacagccatacgtgttgacggactactagtttggtcacacctttcattagatacatatattccttaaaattaaaaaaaatactctaataatctagctgtttgatctcactcttgctagttgttacccggaatctgccgtagcatagcaggttccaaagacattgggtcggctagtccgactcggatcctttggactaaagggattaggctagcagccgaagcacccatggcccatgggccttgaccaaccccagcccagaatgcgaggacgccgcatgccc

SEQ ID NO: 10103 - DNA, 2065 bp, Zea mays
  misc_feature (334)..(334): n is a, c, g, or t
gtctatttatatagattacgaaaaatataaagaggctcttagagttgctcttctagcaagttcaatagttatgtaaattttagctctctaatcatagatttaagaagttgctaaataactttaggagtaaataatgtgaattcttctataattctttaaatatatgttgtagttttgttttgtatctatccaaataaaaaaagaataagtcacaaatttcaacaattaacttcattacctacataatgcagtcaacatttttgtttaggaagttgttaaatgtagagagtaaatgtgtttagataagaagttgttaaagttaaaaaatttattnagagaactgctggagaaaagtttttatgttaactaactaaattattaatttagaaaatctctatagattatatctgcaacagtatgaacatctgactttaattcaagcgaaaatatatagagaacgttttttagcaagtaataagtagtgctttgaatgatgatttttgttggccttgataccatttttttcttcctcaaatgctgatccgtttgttagcaacgagccaaggacgcacaaacggcatgcttgccagatgtaactgcccacgtccgcgtgtgccttcaaacatgctcgtctggcaacacaaagtgccaagcttgttgcatgtcgtcagggcgcagacctcacggcacggtgccacgtacgcgagagcacctgcaccacctggccgcctccctccaactccaagccgcgccgcattaacacacttacacaccgatcgcgaaactgcttcctagcttcgttccggttccggagcgccagagagagaaagaaagggaaaagaagcgcctttgcccaccgcgcgatcgatcgatccggggtccggcggcctgccatggtgaagctggcgacggccagggaggcgcggctgtacgggccggcgctggcggcgaggcggtgggagtacatcaacgcggggacatacgtgttcgcggcgctgctcctggtcctggcggcggcgctgtccatgtccgtgtccgcggccaggctggggctcgccgtaggcgccgtggcgctggcggccgtggcggccgtcaacgcacacgacctcgccgcgcacctggctggcgtcgactgccgcgtgggactggcgaggtacgatgcccagctcgggctcgtggagttcctcgtgccggccgtgcacgcagccgggtgcgcgctcgccgccgccggcctggcgctgctggcctccccccactcccactcccagtcccagcagcggcacgcggcgaccatgctgctcgtcgcggcgctgctgtgggtgctgggctccgtgctcaactcctgccaggtgtacgagcgcgccgacggccgcgcgcagctgctgcagtcgggcgtgcaggtgcctcagctgctggggagccttctgttcctggtcgccgcggcgctgaaccgcccccgcagcggcggcgagccggcgtggctgtgcctggtcgggagcgtgctgtggctggcggcagcgctgctcaacgtgctgaaggtgttcgccatgcaccagagcgacgcgctgcggctggagaagctccgcggcggcgcgcaggagtggctcagccgcgaccgcgagggccgcgtgccgctcaactgggaggaggccgccaggagacgggcgctgcccaccgagctccggtgatcatcgcccgcgccaggcgccacccatcatttcccgtgccgtaaaatgaggggaaaagggtagataaataaattgtttcagcgccacccttttgggccgttgcttgggctcaatggaggcccgaagccccggattgtagggcccattagctgctggagcttatcgcattccatttcctatgtccgagtcccttgcggctcctttggaaggaaaaggaatgagagaattaagagatggattgaagagggttggaaggattaaatttctttaaaaaaaaaaaaaaaaagaatgggtttgggctaccctaatctttcttaatctatctctaactgaacaaatttagggttagaatcccttactatttaaaattgaatttt

SEQ ID NO: 10104 - DNA, 2822 bp, Zea mays
ggtaccctccgggccggccgggggccagagccgaaaccaatattcttccgccgccggccgactgctgcattcaattccccttcgcgccccgaaagccgaaccaacgagcctcgcaggtcggcggtctcgattagggaggaggaagggagtggcccctgatctgggtggcgggcgagatgaggctactgcgggtcgccacgtgcaacctcaaccagtgggcgatggacttcgacaccaacctccgcaacgtcaaggagtccatcaagcgcgcccccccccccccccccgtcatccgcgtcggccccgagctcgagctcaccggctacggctgcgaggaccacttcctcgagcaggacaccaccgcccacgcatgggagtgcttaaaggacattttaactggggactatacggacaacatcttatgcagcataggaatgccagttattttcaatagtgtgcggtataattgccaggtcttctgcctaaatcgtaagataatcatgatccgaccaaagatgtcccttgcaaatgatggaaattatcgggaattccgttggttttctgcttggacatttaaaggcgagattgttgattttcagctccccgttgaagtctcagaggcaatatcccaggatacggtgccttttggttatggatacatgcggtttatagatgtgtctttggctgctgaaacctgtgaagagctctttacagcaaacgctcctcggattgacttagcattgaatggtgttgaggttttcatgaatgcaagtggaagccaccatcagttaaggaagctcaatcttcgtattgattccataaggagtgcaacccaaacatgtggcggtgtttacatgtatgctaatcagcagggttgcgatggtggccgcctttattacgatggttgttgctgcattgcggtaaacggtgatttggtaggccagggatctcaattctcgttgaaggatgtagaagttctggatgctctggtagatcttgatgctgtatcgagttatcgagcatctgtttctagtttcagagagcaagcaagccacaaaacaaatgtaccttttgtgaaggtaccatataaactttgccaaccatttcggagtggaatggttccgacttctccagttgagattatgtatcactgtcctgaagaagagattgcatttggacctagttgttggctatgggattatttgaggcggagtcaagcatcaggatttttgcttccactttctggtggtgcggatagttcatctgttgcggcaatagtcgggtgcatgtgccaacttgtcataaaagatatagagaaaggagacgagcaagttaaggcagatgctcttcggattgggcagtataaagatggggcaattcccatggatagcagggaactggctaaacgtttgttttatactgtttacatgggaactgaaaatagttctgaagatacccgatcacgtgccaaaaggctagctgaggagattggttcattccacttgaatgtacccattgatagtatagtatctgcttttctttccttgtttgaaacattgactgggaagcgaccacgctacaaggttgatggggggtcaaatactgagaatctgggattgcaaaatattcaagcccgaatcaggatggtgttagcctttatgatggcttctctaatgccatgggtccacaacaaatctgggttttatcttgttcttggaagctccaacgtcgatgaagggttacgtggttatttgacaaagtatgactgcagttcagctgatgtaaaccccattggaagtgtaagtaagcaagatctgagagcttttttacgatgggcagcaattcatcttaagtattcttccttggccgaggttgaagctgcaccacctactgccgagcttgagccaatacgagcaaactacaatcagttggatgaaatagacatgggaatgacatatgaggagctgtctatatatggaaggttaaggaaaattttccgatgtggtcctgtttcaatgtttcagaacctgtgccacagttggtgtggaagattatctccgtctgaagtggctgacaaagtaaagcacttcttcaagtactacgccataaaccggcacaagatgactgttttgaccccatcttatcatgctgagagctattcaccagaagataataggttcgaccttcgccagtttctttacaactcaaggtggccctaccagtttcggaagatcaatgagcttgtgcaagagatggacaaagatggcaaatggggaacttctgcagaagggaagctgggagcgcagacaggtgcacagggaactggaatgggagtggtggcagcggggtctgccaatcccagtgccggcttctgaagagaaccatactaacgcgtggaagctagttcctccagtttttcggccttgacagaataatgcaccagccgtccagcccccaccccaggacacgggctgctaatgttaatttgtctgcttggttcccttgtactgcatcacttctccctgctagagagctggaatccccacaaaattttaggctaccagttctgtttcttccatttgtcatagtacgatctacaaagtatcaaccaaagaacatgtgaaaaataagatggaatccctttaatcagattgtttgtccgaagtggcatggcgatgaaaaggaaaacatcagtataaagaactagttactcataattctttgttctgtaaagagtcctttctaaataatgctgtgtgcatgatgatgatgatgtgatgtgatttctaccatgacttcaaagaactcaatatttgcacctg

SEQ ID NO: 10105 - DNA, 2546 bp, Zea mays
gcacgccgttttcagagagcaagcaagccacaaaacaaatgtacctcttgtgaaggtaccatataaactttgccaaccatttcggagtggaatggttccgacttctccagttgagattatgtatcactgtcctgaagaagagattgcatttggacctagttgttggctatgggattatttgaggcggagtcaagcatcaggatttttgcttccactttctggtggtgcggatagttcatctgttgcggcaatagtcgggtgcatgtgccaacttgtcataaaagatatagagaaaggagacgagcaagttaaggcggatgctcttcggattgggcagtataaagatggggcaattcccatggatagcagggaactggctaaacgtttgttttatactgtttacatgggaactgaaaatagttctgaagatacccgatcacgtgccaaaaggctagctgaggagattggttcattccacttgaatgtacccattgatagtatagtatctgcttttctttccttgtttgaaacattgactgggaagcgaccacgctacaaggtatttcttcaacatgacatcactttactagattactgcaatgcagcgaacataaaaaaactagaccaaccaaggaggaactaggtggcatttcattaagaagaaaatagtcacccaaatttggacttgaacagctttctgtgcaagaacaatagatttgaatttatgtttattcaccttctcatagtattttagtttgtggccaacaaagattgttgaactggaaatttttcttaataccccctaacagtatgccatgcatttttttgctataattatgaaatgtggcctcgggactgggtagttaggcaggcacttaggcttaggtggtgttgccgtgttggtcactctcagccttttctcttatgggttatgttctcttgtctcactggcattttgggcttctgcgaggaaatactaaccctgacctcaagatacaaggagtcaatgaaaaagggtatcatgaatataagttaccacccctacatctaagaccatccatataaagttaccagtcctagatctatatgcttttaaatatttccagattagtatcataagtacaaagggtttcgatgatattgttgtggccaaaagttctcattagcaatggtaatagattaaaatattggtggtagccagccatttgtcatctggctagccttcagcagtaaacattatcagaccaatggtacatatgagttttttttcttgaacaatgcaggagagctgcatgtaatttcattaagaatatgatttttaatttacggaggaagtccattttactactcgaaaacatttcttgtttgcttcaggttgatggggggtcaaatactgagaatctgggattgcaaaatattcaagcccgaatcaggatggtgttagcctttatgatggcttctctaatgcccccgcgccccccctaaatctgggttttatcttgttcttggaagctcgaacgtcgatgaagggttacgtggttatttgacaaagtatgactgcagttcagctgatgtaaaccccattggaagtgtaagtaagcaagatctgagagcttttttacgatgggcagcaattcatcttaagtattcttccttggccgaggttgaagctgcaccacctactgccgagcttgagccaatacgagcaaactacaatcagttggatgaaatagacatgggaatgacatatgaggagctgtctatatatggaaggttaaggaaaattttccgatgtggtcctgtttcaatgtttcagaacctgtgccacagttggtgtggaagattgtctccgtctgaagtggctgacaaagtgaagcacttcttcaagtactacgccataaaccggcacaagatgactgttttgaccccatcttatcatgctgagagctattcaccagaagataataggttcgaccttcgccagtttctttacaactcaaggtggccctaccagtttcggaagatcaatgagcttgtgcaagagatggacaaagatggcaaatgggaaacttctgcagaagggaagctgggagcgcagacaggtgcacagggaactggaatgggagtggtggcagcggggtctgccaatcccagtgccggcttctgaagagaaccatactaacgcgtggaagctagttcctcgagaataatgcaccagcccccaggacacgggctgctaatgttaatttgtctgcttggttcccttgtactgcatcacttctccctgctagagagctggaatccctacaaaaatttaggctaccagttctctttcttccattttgcatagtacgatctacaaagtagcaaccaaagaatatgtgaaaaataagatggaatccctttaatcagattgtttgtccgaagtggcatggcgatgaaaaggaaaacatcagtataaagaactggttactcataattctttgttatgtaaagagtcctttctaaataatgctgtgtgcatgatgataaaaaaaaaaaaaaaa

SEQ ID NO: 10106 - DNA, 517 bp, Zea mays
ttgggtgccccctcgccgcccgccactgcactaagctgcgatccagagagggacaaaaaaaatgaggagtctagcttctcgtgtcgtttgtttctgcatgatctcctcgttgttcatctctgcatttgcagccagtcgtcagccggcgatctttcaatcggactatgcagacgatccaagtcctgctccgacaccgcaccgacctcatgcggcaccgataccgccaggtgacagtcgtatctggatgaacagccatgacggcggaacgagtacgctgccccgagatgcagcgaccccctctgcgtcaagatgaaatgaatcaacgatacctcagacttggatcccctggtggcctgtttgggagatcttagttttaggcacaaaacgggtgtaaatcactggcccaataatgacaataatatttccagagttaattacttatccgatcatatatcccagcttgtttggttagaagggcgaacaatccttaaaataaaaccacatctgccaaaaaaaa

SEQ ID NO: 10107 - DNA, 2735 bp, Zea mays
  misc_feature (831)..(831): n is a, c, g, or t
  misc_feature (2033)..(2033): n is a, c, g, or t
aattcggcacgacggctctgctcccatccccgcctcgtccgttaccataaatctagcttgggctctaatctaaccgagggaacaggtgggatatgaggaactcggtgtcggagcggagcttcctcatcgagagcgacgatgacgacgatgccgccgtggaggacgggaagcggcgcggccttggcggcggcggcggcggcgacgacgacgacgacgggtccgactcctcgtcgccgtgcgacagcccgcgggtggtggcggcgcggtgcagccagccgagttcgtacacgcagcaatggccgcagagctacaggcaatccattgacatgtacagcagtgtgcactctcccaacctgagcttcttgggcacgccatcactgagccggttgtccaactcgttcctcacaaactcattccgggggaagccacctgagatcatctccagcttaatcaagccattactgccgacaagcattgcttccgccagcgatgaccagcagcagcagcagcatgaggacgtccggaagagctcccattacctgccaccatcacgcaaggcgtcgtcgctgcagaggatccccgaggaccagagacctatggttgggggccatgaggtgggtccctaccggcagtgctcctatacccaaggggtcatgaacggagtgaatgtcttatgtggtgtggggatcctgtcaacaccttatgctgtcaagcagggtggctggcttggactggtgatactagcggtattgggtgcactggcttggtacactggcatacttctgcgccgttgcctggacagcaaggatgggctcgagacttaccctgacnatcggacatgctgcctttggtactgctggccgtatcatcatctcggcaagtattttctgcactagcaacgctcaccagttgtcagttttgtattattcatatcatgcagtgtaatggagtgtggttttttttttttgctaactcttctgcttttgtatgcctttgcaacctgcagataatactgtatatggaactatatgcatgttgcattgagtatttgatcttagagagcgataacttatcaaagttgttcccaaatgcacacctaaccatgggtaacttgactctggattcacatatgctatttgccatcttgactgctcttgtcgtcatgcctaccacttggcttcgtgatctcagctgcctcagcttcatttcagctggtggagtcattgcatctatcgtcattgtctcctgcttgttctgggtgggacttgttgatcacgttggcacagtcgagagtgaagggacggcactgaaccttcctggaatccccattgccatcgggttgtatgggtattgctactcaggccatggagtgttcccaaacatctactcttctctgaagaaaagcaaccagttccctgctgttcttttcacctgtatcgctctttctactgttctgttcgctgctgctgcaatcatgggatacattatgttcggtgaatctacagagtcccaattcacactgaacttacccccaaatcttgtggcttccaagattgcggtctggactacggtgacgaatccaataaccaaatatccttggacttctacttcagctttctgtgtgcatttgttcccatacttaacaagtaacattacatgatatcttactttctctaatcacatgtaactccatgtagccatctaggtttgtgctaatcaaacatattttaaattttgactagaaatatctataaaaagtattatcttaaataagcagagttatttggttttaataaagaatttagcaatgtcaatgttatttttctcgttctatataaattttggatattcatggtcaaagttaaaaaatatttgacttaggacaaatatagatatacctgcattgttattttagtgagtcctatagttctcctccccaaactttgctatcaacatctaacagttaatccagttttcatgaataaatgtagtttcaatcgttctgtgttgtttaataatgttttatggatcgncatgctatgtccttaactaatacctacatatgcgctgaccatgactcctctagccctgagtttggaggaactgctacctccaaataagcagacatacccgaacataatgatgcttagatccgctctggtggtatcttcccttattattgctctgtccgttccattttttggacttgtcatgtcactggtcgggtcttttctcaccatgtttgtggcctatattctaccatgtgcctgctttttgtctatcctcaggagtaaagtgacctggtatcaggtagtactgtgtgtgttcatcattgtcgttggactttgctgtgttggtgttggcacgtactcttctctttctaagataatacaaaagtaccaatgaattgtgccctagaattatgtatgatgtgtccatgtgttttcgaatagccagttttcttttctgggatggtggcgctggtctggaagggggagggggatgtcattcgttgtaaattttttgttggcatgagaggaagtggaggaatttgataaaatagggcaggttgtgttatcgaaggagtattttgtctgaaattgttctcgtgacggtaggtgctgctgggaacgaccttctgttgacgctgccattttcgtttgacccatattgtttcttgtctaaaaaaaaaaaaaaaaaaaaaaaaaaaaactcgagggagggggcgtgtaccc

SEQ ID NO: 10108 - DNA, 2112 bp, Zea mays
ggccgggaacaactattaccaaacggctcctataagcccgtccctctccgatcctcggcccgcgctctctgctcccatccccgcctcgtccgttaccatacatcgggctccgcctcgccgcccgccgagggaacaggtgggatatgaggaactcggtgtcggagcggagcttcctcatcgagagcgacgatgacgacgatgccgccgtggaggacgggaagcggcgcggccttgttggcggcggcggcgacgacgacgacgggtccgactcctcgtcgccgtgcgacagcccgcgggtgggggcggcgcggtgcagccagccgagttcgtacacgcagcaatggccgcagagctacaggcaatccattgacatgtacagcagtgtgcactctcccaacctgagcttcttgggcacgccatcactgagccggttgtccaactcgttcctcacaaactcattccgggggaagccacctgagatcatctccagcttaatcaagccattactgccgacaagcattgcttccgccagcgatgaccagcagcagcagcagcatgaggacgtccggaagagctcccattacctgccaccatcacgcaaggcgtcgtcgctgcagaggatccccgaggaccagagacctatggttgggggccatgaggtgggtccctaccggcagtgctcctatacccaaggggtcatgaacggagtgaatgtcttatgtggtgtggggatcctgtcaacaccttatgctgtcaagcagggtggctggcttggactggtgatactagcggtattgggtgcactggcttggtacactggcatacttctgcgccgttgcctggacagcaaggatgggctcgagacttaccctgacatcggacatgctgcctttggtactgctggccgtatcatcatctcgataatactgtatatggaactatatgcatgttgcattgagtatttgatcttagagagcgataacttatcaaagttgttcccaaatgcacacctaaccatgggtaacttgactctggattcacatatgctatttgccatcttgactgctcttgtcgtcatgcctaccacttggcttcgtgatctcagctgcctcagcttcatttcagctggtggagtcattgcatctatcgtcattgtctcctgcttgttctgggtgggacttgttgatcacgttggcacagtcgagagtgaagggacggcactgaaccttcctggaatccccattgccatcgggttgtatgggtattgctactcaggccatggagtgttcccaaacatctactcttctctgaagaaaagcaaccagttccctgctgttcttttcacctgtatcgctctgtctactgttctgttcgctgctgctgcaatcatgggatacattatgttcggtgaatctacagagtcccaattcacactgaacttacccccaaatcttgtggcttccaagattgcggtctggactacggtgacgaatccaataaccaaatatgcgctgaccatgactcctctagccctgagtttggaggaactgctacctccaaataagcagacatacccgaacataatgatgcttagatccgctctggtggtatcttcccttattattgctctgtccgttccattttttggacttgtcatgtcactggtcgggtcttttctcaccatgtttgtggcctatattctaccatgtgcctgctttttgtctatcctcaggagtaaagtcacctggtatcaggtagtactgtgtgtgttcatcattgtcgttggactttgctgtgttggtgttggcacgtactcttctctttctaagataatacaaaagtaccaatgaattgtgccctagaattatgtatgatgtgtccatgtgttttcgaatagccagttttcttttctgggatggtggcgctggtctggaagggggagggggatgtcattcgttgtaaattttttgttggcatgagaggaagtggaggaatttcataaaatagggcaggttgtgttatcgaaggagtattttgtctgaaattgttctcgtgacggtaggtgctgctggggaccccccttctgttgcccccccctttttcgtttgcccc

SEQ ID NO: 10109 - DNA, 2955 bp, Zea mays
ctaaatttagccatcaaacaagcacttaaaaaactattggagaagtgtttttttactttttaaatttaagatttaaatagttggctgcatgtatgtattattcatatagagaacaagagaggaaacatatatggtgcacgtggtgtatatattaaattatcaccactcattttagatctaacgtctctaattgtttggtatattttgctaagaacaccctccaacgtggtggtgtgtagtggtggaaggtgttatttgtaaattgaatgatcaattagagacattagatctaaaatgagtgatgatgatttaatatatgcaccatgtgcaccaaactttcatgtgcccgagatatgtcctcaacaagagaacctcactcttacctgagcaagaaatacgggatttctacagggtgcttctgcaaaatctttagaagaaacgattatttatcccctctcctgccggccgggccgggaggacccgtgtgccccgctccgtcctacgccaccgccgccggattcgctcccacctccggcggtcacgcccgttaccaacacccccacctcgcgtcgtccgccagctcctctctgccgcggcgcaaccatctccatctcccacgattacagcgaccacaagaccagcgacgcctccaccaacgagaaggatccattcaattcatccagtccacgcacacccccgtctttgactcgcactccgcttccagatctaggcgggccgaggaacgatgaacggaggcgccgccccaccatcagctgcggccgcggcgacgccgcctcaccggcggctgccggactttctccagagcgtgaacctcaagtacgtcaagctggggtaccactacctcatcacccacctgttgacactgatgctgctcccgctgatggccgtgatcctcctggaggccgggcgcaccgaccccgaggacctgcggcagctgtggctccacctccagtacaacctcgtgtccgtgctggtcctctccgccgtgctcgtgttcggcgccaccgtctacgtgctcacccgcccccgccccgtgtacctcgtggacttcgcctgctacaagccgcccgcgcacctccaggtccggttcgaggaattcatgcgccactccaagctctgcggcttctccgacgacgcgctggagtttcagcgcaagatcctggagcggtccgggctcagcgaggagacgtacgtccccgaggccatgcacgcgctcccgccccagcccacgatggccaacgcccgcgccgaggccgagaccgtcatgttcggcgcgctcgacagcctgttcaggtccacgggcgtcaggcccaaggacgtgggcgtgctcgtggtgaactgcagcctcttcaacccgacgccgtcgctgtcggccatgatcgtgaacaagtacaagctccgcgggaacgtccgcagcttcaacctgggcgggatgggctgcagcgccggcgtcatcgccgtggacctggcccgcgacatgctgcaggtgcaccgcggcacctacgccgtggtggtgagcacggagaacatcacccagaactggtacttcgggaaccgcaagtcgatgctgatccccaactgcctgttccccgtgggcggcgccccgcgcctccgcgcgcgccgcggcggcgaccggcggcgcgccaagtacgtcctgaggcacgtggtgcgcacgcacaagggcgcggacgacagggccttcaactgcgtgtaccaggagcaggacggcgagggcaagaccggcgtgtcgctgtccaaggacctgatggccatcgcgggcggcgcgctcaagaccaacatcacgacgctgggcccgctggtgctgcccgtgagcgagcagctgctcttcttcgcgacgctggtggccaagaagctgctggtgagcgccaagacgaagccctacatcccggacttcaagctggcgttcgagcacttctgcatccacgcgggcgggcgcgccgtgatcgacgagctggagaagaacctgcagctgagccccgcgcacgtggaggcgtcccggatgacgctccaccggttcggcaacacctccagcagctccatctggtacgagctcgcctacatggaggccaagggccgcgtccgccgcggccaccgcgtctggcagatcgccttcggcagcgggttcaagtgcaacagcgccgtgtggcacgccctgcgcaacgtcaagccgtcgcccgacagcccctgggaggactgcattgaccgctacccggtggagctcgtcgacggcttccccgcacaccaatagtactagtatccgttctcttctcaatcccacccacccacccaccccggctcccctcccctccacacatccatcgacaaagagatcttagcctcaaatcccctaatctggctggctggctggcatggcaaggagggtgctttccctggacaagtgttcggcggcagcatcgggtctttggtgtgtacttgatggatcatcccccagcttgtgtccaagcgagggcgagcatggtccccctcccccagcttgtgtggctgcacctgcacctgaacctgcggtaagcttgagtacgtactgctgatgattgttgtatgtgcatctgtctgttcagccatcgctgccagccagtgtcatttaccgatattagctagctagtggtccagtatccagatcacagaggaaagtgccgttccttccgtttctaccaaagaaggtcatgttggtgacgaggaaatcctgagtgtcttgagtgtgcccatggaccatggacactctgtttgccgtgttcgattggaaatctcgctcttgcttgtttaactgtacatggatcactggtctgccattgatgaggcgatgtatgatttatatccgttgttttcccttcatcaaaaaaaaaaaaaaaaaaattcgtaagatcttgttcacaaaagctgtttcacttctcc

SEQ ID NO: 10110 - DNA, 4121 bp, Zea mays
atttgagaaagttgaaaaatcaagactgaccgaccagatgaaaatgggtatccgaactgttataacaaatctaatattttaaaatagatatgtataaattttgatgcaaatctttttttgtgttatcaagcacattattacagctaataataaaaatttatataaattgttttgtgcattatttgctttctacaacaaaaaaagaaaaaaaatattcatatttgtacctgaattgtaacgaattttatatctatcgtttggaagatatatgatagatttaagatttacttttaatgaaacattacaagctcaatgttaaaaacaaatacataaatttacgtagtagattttatatcatttttatttacaataaaagaaaaaaaccacaaaattgatattcaaataaatacccgttttcatcgctgctgttggtaaccggccagccctgtttcagctggattagcacccttcaaagttgttttgatttagtttggactccgaataagttgatatcctaatatatcttcagatagtctcgacgatacaaatataatggcagagttttttatacactttgaacaatgcgtcaacaattggtattttgttcatataagtccataactttcatggtttgactaataaggtgacatttgtcagctcaacaacagtatatacatgtgtagcactgtaccagaacgctatcttaggatgtctctaaccgctactctatgacgtttactatcatattctatattttaaacttcactttataaacaatataatctgcagtacaatatgccgacagacaacaggactgcatggcgagttgacactagtgttatttttgtgaagtactttcgtcctatttgtctttggaacccatgcttttcgaaagggtccataaattaattagttgggcgtctatttcagctttttgttgcaataattaatccgacctggatttcgtttctaaaaagaaagacgcatgcagcactgaaagattgaggttgaaatacctgctgaaagcgataaggtagttagaagacgctttcgtttcattcactcggttgtactgtacgtaaaccttggtcacttgtatcttatccgcaagagcccgcaactagccgacgtgtggtcactgcaaaaatcctgcatgcgcgtccatcaaccttggactggtcattattactacttgactgttgtttgctgttactaccaaattcaaaagcccttcactgcagttcgcctgaacatctgaacacctccacagtccacacaaggaccacgagttcagggaccatggattccagttcttctttctttcttactatacgaaagacgggtttcaagttcgtcttcctcagttcctcgccataacgtgtggaggtgcatatacactgacctgtccatctgagttttgatgatgatgctggctttgatccagtatagctgacattatgtggtgggcagctaccgtgttcgtcattgttgctgtcccacaggtctctccgtctctgtctgtggcctctgacgagtgatcatcgtaggccgttccagcgctttaaattctccctgcctctcctcgtctcgcttcacttcagtaatcagtgctcgctagcccaccacgccctgaacctagcccggacacccgccaggacaggccagcccaacgcgatgcgaccgccgcctcagggtccgcgcaccaccatgtccatgggctccccggtgcagctcaggcggctgaagcctctgtaccagctggtggtgaacaacatcctggccatcgtggccgtgccgctcgccgccgcggtcctgctcaaggcgtcgtcgctcgggcccgaggagatcctggcgctccggccggcgcacatgttcctggccgcgttcctgcctgccgcggccacggtgctatacctgatgctccggccgcgcgctgtgtacctggtggactacgcgtgcttccgcaccagccccaactgccgcgtcccgttcgcgacgttcctggagcactcccgcgtgtggccgggcttcgacgagcgcagcgtccggttcatgacgcgcctgctggagcggtcggggctcggggaggagacgtgcctgccgtacgcgcagcactacatcccgccgtcgcgcgacctggagtcctcccgcgccgaggccgagctcgtcatcttctcggccatcgacgacctgctcgccaagaccggggtctccccgcgggacatcgacatcctggtggtgaactgcagcctgttcgcgccgacgccgtccttcgcggacatggtcgcgcaccggtacaggctccgcggcgacgtgcgcaacgtgcacctcgccgggatggggtgcagcgcggggctcgtctccgtggagctggcccggaacctgctgcaggtggcgccgcggggcgcgcgcgcgctggtggtgtccacggagaccatcacccccaactactacatgggcgaggagcgcgcgatgctgctgcccaactgcctgttccgcatgggcggcgcggcggcgctgctgtccaccgacggcgccggcgcgcggttccgcctggcgcgcgtggtgcgcacgctgcgcggcgcgtcggacggcgcgtaccgctgcgtgtaccaggaggaggacgagcgcggcaacgtgggcatcaacctgtccaaggacctgatgagcatcgcgggcgacgcgctgaaggcgaacatcacggcgatggggcccctggtgctgccggcgtcggagcagctgctgttcgcgctgtccttcatcgcgcgcaaggtgctgaacaaccggatcaggccctacatcccggacttccgcacggcgttcgagcacttctgcatccacgcgggcgggcgcgccgtgatcgacgagctccagcgcagcctgacgctgtcggacgagcaggtggaggcgtcgcggatgacgctgcaccggttcggcaacacctccagcagctccctctggtacgagctcgcctacgtcgaggccaagggccgcatgcgcaggggcgaccgcgtctggatgatcggcttcggctccggcttcaagtgcaacagcgccgcctgggagtgcatccgccccgccgccaacgccgacgggccgtgggccaactgcatccaccggtaccccgtgcacattcccgacgtgctcaagcactgagcccggcgccagctccagtttcgtgccgtgccttgcctttcccttttcctcctcgcccggttgccattgcacctgctgctacatttggtttgtggacatcaaaacgaaccgctggaacagcgattggccgtggtcgtgaactaggttggtggaatatgtgatggagagtgacagagtacttgtcgtgtcgtatcaacgggggctcaaggcggcggggtggtcgtcataaaggaggcgaggtcgggccaggctgccgtacatgggcgcccggggaacggacgtgtgttgtgcttgtccggggcgttgttgtattatctaccatttactatttcttacaattcattcctgcagtataccatgaaaagagatatgacatgagctactagtagacgacaagacgagcaaaagctttgatgtatgtgtgcacctactctttatacaatcaagtgttctcatttaagtaaaagcgcctacatgcattgcactgatgagtggagacccagattgttcactgtttgctcgctgcgtgattgccgttgccactgtgcggctctcgcaggcaaggcatgcacggcctgccaagcgcctgtgtcgctgccgcggattaattgccgcggccggctggcaccggcgccgcgtgccgtcgctttttagcgcagggatttcaaagctcctcgtcgccagaactcacactcacacggtgcggtacgcgttggcggtgcggacgcctgcctctgcagctctgctcaagtgctcagtctcagtgaatgcccggcgccccggcagggccgtacgtgcacccgtacgtatagatgtccaaacgggccgcccggcccggtccggtccgggcccggtgaagcccggcccgttttgggcccggcccgctaggtacgattaaaaaaccgggccgggccggctaagcacgcgggctcaattccttgtccgagcccggaacgcaacaagca

SEQ ID NO: 10111 - DNA, 2082 bp, Zea mays
cccacgcgtccgcccactgcgttcgcggaggcgggggcccaatttttaagaccccaccacggcaccacctcctccgaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgcgttctccgggtcggtgaacctcaagcacgtcaagctggggtaccagtacctggtgaaccacttcctgacgctgctgctggtgccggtgatggccgccacggcgctggagctggcgcgcctcggccccggcgagctgctctcgctgtggcgctcgctggagctggacctggtccacatcctctgctcggcgttcctggtcgtcttcgtcggcaccgtgtacgtgatgtcgcggcccaggccggtgtacctggtggactacgcctgctacaagccccccgccagctgccgcgtgcccttcgccaccttcatggagcacacgcgcctcatcagcgacgacgacaagagcgtgcgcttccagaccaggatcctggagcgctcggggctcggcgaggacacgtgcctcccgcccgccaaccactacatcccgcccaaccccagcatggaggcctcgcgcgccgaggcgcagctcgtcatcttctccgccatcgacgacctcgtccgccgcacggggctcaagcccaaggacatcgacatcctcgtcgtcaactgcagcctcttctcaccgacgccctcgctctccgccatgatcatcaacaagtacaagctccggagcaacatccgcagcttcaacctgtcggggatgggatgcagcgccgggctcatctccatcgacctcgcgcgggacatgctccaggttcacccgaactcgaacgcgctggtggtttcgaccgagatcatcacccccaacttctaccaggggagccggcgcgacatgcttcttcccaactgcctgttccggatgggcgcggctgcgatcctgctgtcgaaccggcggcgcgaggcccggcgcgccaagtaccggctggtgcacgtggtgaggacgcacaagggctcggacgaccgcgcgtaccggtgcgtgtacgaggaggaggacgagcagggcttctcgggcatctcgctgtccaaggagctgatggccatcgccggcgacgcgctcaagtccaacatcacgacgatcgggccgctggtgctgcccatgtcggagcagctgctcttcttcttccgcctggtggggcgcaagctcgtgaacaaggggtggaggccctacatcccggacttcaagctggcgttcgagcacttctgcatccacgcgggcgggcgcgccgtcatcgacgagctgcagaagaacctgcagctgtcgccgcgccacgtggaggcgtcccgcatgacgctgcaccgcttcggcaacacgtccagcagctccctctggtacgagctcgcctacatcgaggccaagggccgcatgcgccgcggcgaccgcgtctggcagatcggcttcggcagcgggttcaagtgcaacagcgccgtctggaagtgcctccgcagcatcaagacccccaccaacgggccctgggacgactgcatccaccgctaccccgtcgacgtcccggaggtcgtcaagctttgacctacgggctacggctacgacgacaacgagcgagctcggccggcaccgccgccgccgccgccgccgtcctactgtgtacctgtacgtcctctctgttctcttctcttcccatttccttcgctattaatataaaaaaggtaaaaaaagaaagaaagatccatatacactctgactgttggaagtattgtcatccctcaggcaagggattgggtgattgtaatttgcttgaatgagaatgaatcgtgcacttgtaaattgtaatccacgttgtaactgtgtgaaagggatacatgcattctcctgatacttggttgatgaaaaaaaaaaaaaaaaaaaaaaatttgcggcc

SEQ ID NO: 10112 - DNA, 2351 bp, Zea mays
tgcagttcccctgaacatctgaacacctccacagtccacacaaggaccacgagttaagggaccatggattccagttcttctttctttcttactatacgaaagacgggtttcaagttcgtcttccttagttcctcgccataacgtgtggaggtgtgcatacactgacctgtccatctgagttttgatgatgatgctggctttgatccagtatagctgacattatgtggtgggcagctaccgtgttcgtcatggttgctgtcccacaggtctctccgtctctgtctgtggcctctgacgagtgatcatagtaggccgttccagcggcacgagaccattacctagaacatcctaatcgaaaacttcagtaatcagtgctcgctagcccaccacgccctgaacctagcccggacaccagccagaacaggccatgtccatgggctccccggtgcagctcaggcggctgaagcctctgtaccagttcgtggtgaacaacatcctggccatcgtggccgtgccgctcgccaccgcggtcctgctcaaggcgtcgtcgctcgggcccgaggagatcctggcgctccggccggcgcacctgttcctggccgcgttcctgcctgccgcggccacggtgctgtacctgatgctccggccgcgcacggtgtacctggtggactacgcgtgcttccgcaccagccccaactgccgcgtcccgttcgcgacgttcctggagcactcccgcgtgtggccgggcttcgacgagcgcagcgtccggttcatgacgcgcctgctggagcggtcggggctcggggaggagacgtgcctgccgtacgcgcagcactacatcccgccgtcgcgcgacctggagtcctcccgcgccgaggccgagctcgtcatcttctcggccatcgacgacctgctcgccaagaccggggtctccccgcgggacatcgacatcctggtggtgaactgcagcctgttcgcgccgacgccgtccttcgcggacatggtcacgcaccggtacaggctccgcggggacgtgcgcaacgtgcacctcgccgggatggggtgcagcgcggggctcgtctccgtggagctggcccggaacctgctgcaggtggcgccgcggggcacgcgcgctctggtggtgtccacggagaccatcacccccaattactacatgggcgaggagcgcgcgatgctgctgcccaactgcctgttccgcatgggcggcgcggcggcgctgctgtccaccgacggcgccggcgcgcggttccgcctggcgcgcgtggtgcgcacgctgcgcggcgcgtcggacggcgcgtaccgctgcgtgtaccaggaggaggacgagcgcggcaacgtgggcatcaacctgtccaaggacctgatgagcatcgcgggcgacgcgctgaaggcgaacatcacggcgatggggcccctggtgctgccggcgtcggagcagctgctgttcgcgctgtccttcatcgcgcgcaaggtgctgaacaaccggatcaggccctacatcccggacttccgcacggcgttcgagcacttctgcatccacgcgggcgggcgcgccgtgatcgacgagctccagcgcagcctgacgctgtcggacgagcaggtggaggcgtcgcggatgacgctgcaccggttcggcaacacctccagcagctccctctggtacgagctcgcctacgtcgaggccaagggccgcatgcgcaggggagaccgcgtctggatgatcggcttcggctccggtttcaagtgcaacagcgccgcctgggagtgcatccgccccgccgccaacgccgacgggccgtgggccaactgcatccaccggtaccccgtgcacattcccgacgtgctcaagcactgagcccggcgccagctccagttccgtgccgtgccttgcctttcccttttcctcctcgcccggttgccattgcacctgctgctacatttggtttgtggacatcaaaacgaaccgctggaacagcgattggccgtggtcgtgaactaggttggtggaatatgtgatggagagtgacagagtacttgtcgtgtcgtatcaaggcggcggggtggtcgtcataaaggaggcgaggtcgggccaggctgccgtacatgggcgcccggggaacggacgtgtgttgtgcttgtccggggcgttgtattatctaccattttcctatttcttattacaattcattcctgcagtataccatgaaaagagatatgacatgagctagagctactagtagacgacaagacgagcaaaagctttgatgtatgtgtgcacctactctttatacaatcaagtgttctcatttaagtgaaaaaaaaaaaaaaaa

SEQ ID NO: 10113 - DNA, 2638 bp, Zea mays
ccctctccgaatagcccgtccccgccgccggattcgatcccgtctccggccgacgcgaccatttcccgcaccgccagatcctctcggctcggcccggccgccgcgcacctcccgcaattacagcgaccgcaataccagcaacgccattgggaccctcgaggccggccggggagggaggatccattcagccagtccacgcctttgactcgcactccgtttccagatctaggcgggcgggccgaggaacgatggacggagtctccgccccgccgccccaccggcggctgccggacttcctccagagcgtgaacctcaagtacgtgaagctggggtaccactacctcatcacccacctgctgacgctgacgctgctgccgctgatcgccgtgatcctgctggaggccgggcgcaccgacccggacgacctgcgccagctctggctccacctccagtacaacctcgtgtccgtgctggtcctctccgccgtgctcgtgttcggcgccaccgtctacgcgctcacccgcccgcgccccgtctacctggtcgacttcgcctgctaccgcccgcccgcgcacctccgggtccgcttcgaccagttcatgcgccactcccgcctctgcggcttctccgacgacgcgctggagttccagcgcaagatcctggagcgctcgggcctcagcgaggagacgtacgtccccgaggccatgcacgcgctcccgccccagcccaccatggccaacgcccgcgccgaggccgaggccgtcatgttcggcgcgctcgacgccctcttccgctccacgggcgtcaagcccaaggacgtcggcgtgctcgtcgtcaactgcagcctcttcaacccgacgccgtctctgtcggccatggtcgtcaacaggtacaggctccgcgggaacgtccgcagcttcaacctcggcgggatggggtgcagcgcgggcgtcatcgccgtcgacctggcgcgcgacatgctgcaggtgcaccgcgccacctacgccgtggtggtcagcacggagaacatcacccagaactggtacttcgggaaccgcaagtccatgctcatccccaactgcctgttccgcgtgggcggcgcggcggtgctgctgtccaaccgcggcgcggaccggcgccgcgccaagtacgtcctcaggcacgtggtgcgcacgcacaagggcgccgacgacagggccttcggctgcgtgtaccaggagcaggacggcgagggcaagaccggcgtgtcgctgtccaaggacctgatggccatcgcgggcggcgcgctcaagaccaacatcacgacgctgggcccgctcgtgctgcccgtcagcgagcagctcctcttcttcgccacgctcgtcgccaagaagctgctcagcgccaagacgaagccctacatcccggacttcaagctggcgttcgagcacttctgcatccacgcgggcgggcgcgccgtcatcgacgagctggagaagaacctgcagctgagcccggcccacgtggaggcgtcccggatgacgctccaccgcttcggcaacacctccagcagctccatctggtacgagctcgcctacatggaggccaagggccgcgtccgccgcggccaccgcgtctggcagatcgccttcggcagcgggttcaagtgcaacagcgccgtctggcacgcactgcgcaacgtcaagccgtcgcccgatagcccctgggaggactgcattgaccgctacccggtggagctcgtcgacggcttccccacgcagcaatagtaccttcttttctctatattcccctcccacccgtccgtcccccagcttgtcgtcgctgcacctgcacctgaacctgaaccagaaccagaacctgcggtaagtttgagtagtcctgatgatgattgctgtactatttgtctgttcagccatattgctgccagacgattgtcatttagtggtggtccaggcggaggaagggggccgttccttctcactcttactaccagaaaggtcatgcatgctgatgacgaggaagggagtgccttactctagcgcgcgtgtgtgtgtgtgccgatggacggatccatgcatctagtctctgtttgtagtgttcatttggaaaccttgctcttgctcttgctcttttttaactatatatacatacggacataccgcatgcctgcctttgatgagcttgtcgtatgtatgcaccatggttcgttcgttgctgttttccttcgtcagattatatcttgttaatttcgtaatctctgagggttcgttgatcttgttcagacaggttgtttcacttatctctctatcagtttgttcggtttgtatccacgtccatcaagcgcccgcctgcaacgtggtttggtgattcatcttcttttttattttataataattcacattcaaggctaataatcgctgtcaacattttttttcataattgaaacgcatgggcatcgattattagaccacacttgtcaacatttaatggaagagcacgcatcttgtaccacacacacacgtacacacacacatgaccggaggagggtccatgtcacctcctgagccatcgttcttttcgtactgacaagggatttatgatttaagaagcgcattaattagaggaaaaaatagccata

SEQ ID NO: 10114 - DNA, 3598 bp, Zea mays
gctaaaaacccatggtattacctataaactgtaatatactttcagtcccaaacaggccctaaaacattagtgttagcagcacacttgcaatttaggtgatgtaaatattgataataagggctgaaaactaagttccactccacgcaaacgtgcagattgtattcttcacctacccatatacaacatggtttactctcatatattgaatcattgtaactctatacatacactggaccccttgtatcatttgcaaatatttacatgctcagggttacggtgatggagaactaaattgctataaataatttctacatgtgattgtggtcatttgttcaaaccatggggaaagcttgttggatggtgttgatgataactaataatcgattcagtttaaaaggggctctttcagttggagctttagtggattacttgcggttgtaggaattgctatcagaagtggtggtacagtttaagtagaagatgagcatatattcagtttagctagggatggcaagtacttggccaaatcaccctattaaggtctcttcgcaggttcaactgtttttggccattatcctttggtgtggaaaagttgccccccaaagtgtcgtttattcctctgtctggttgcccacatgagatgttggactgcggacagactagctaagaaagggatggatcacccgacaagatgcctcttatgtgaccaggaagcagaatccttggaccatctcgttgtctcttgtgtgtttacaagagatttttggtttcatcttctgagaccttttggattagaaagcctggctccacagccttgatcatttgcattttcataaagtaaatccatcgctaaaagaattttttgtacttctgttggacattttagtttagaggtgaaatagtagatacagatctattgcttcttactatttcagcatccctggcttgcattcccttttttcttggggttttgtatcagaatcagaatttaaccttgactattattttgacaaaattcatgcaaaacaaggaatctgggaatcctggagcctgattcaaaaacaaatagattgccagaaagccataaataattccttgaaatatttactgtgtaggttctgctttttttgctttgccagaaacttccgtgactgcaatttatagtctgttactaatgtcatttcttgcatcagtgttctgtagattttattgataagttttttatggcaatcttttggcagatgcaagtgtgattctacgtacagaatcacatgctccttgtccgtattctattccagtttctgacaagttcaagcatgtggattatgaggacaatgaggtgatctattctacttatatgccccagttgaatgaatatgaggaagaggatggttcttctgagctgggtgtctctcagtggcacatgaaaggtaaacgtaacaatcgtaatgccgtgaagagattagtggatatgagagatggaaatacatggttaaataaatacaatggatcattaaaaggatctttgcataacacaaatggtgggaatcccagaaaagaaggtatgcacacatctggtgagcagttttttgaggaaagcttttaccaaataaaagaggagcccaattatgattctgatgaaactaatttatttgagaacatgagccattcagagactaacttgtactatggtaaaaaatacccttcatacttgagaaccacaagagatcttagccgaggctacagttactttaatgactcttcaaatgtttctcccctaaacaaggacactgaacgaatatatcatgttgatcggaatgcatattgggatagaccttcattttaccaaaggaagttgacttcaagttttggtggcatgggaccaatgttgttcaatgttaacctcaaagttcaggccagctaccaaggagagcatgtccctcttgtctctttgatgagcagacttaatggcaaagcaattgttggacaccctatccaaattgaaatagttgaagatggttccacagcagtattctgtggtgacagtggtatgcaagagaccacagctgctccacctgcttggccaacaggtagaaggactgccatgcaaagagttccccgttcaaatccatcaggagcactgttggatggcgataatgaaggtggtcttgtgtattctgattatgagacgaaaccaaccttaagaaagtactcatcttcttcgaatcaccaggttaaggtgaataataaaatcagttctaatgctaagaggtcatcagctaagccccctaagaagtcatccaagaaaacaaacctctcaagccagaaacttagagctctctcttccatctccactgcaaaaaaccatcatggagaaggtggtcaagcgaaggcaaattggcacaatgacatatttggtggtttaatcggatcagaaggagcagttcctctagtgacatgtgtcccaacgaaggttgtgttcactaggatattggaagcagttggaaggccacctctgtctgccgctcgccgtgttagaatggctagtcctccggtacgagatcctccataggcttcaactgtagtgctacatgcggtttatgtcgccagccatcgacatgcaagttttatgtacattcctgttaattgatgaagaggcagaccattcaatcatccggtaacacctgtgaggagtcgattgacatggttgctccgtaataacttggaacagctgatcccttattagcagtggtgacaacctgtaaaaatcagtaatatttctgactggagactgaggtcatgaatgcttcagagcagctcacatatttctgactggagactgcgtccatgaatgcttcagagcagttgagccatcgataccatgaagaggtactcttcggtgtagctagcactggtaactttcgtcacaactgtctcctgtaaagtactagtttcaacattttaggtggcaatttagtcaaaacatttgtgccgtcatatatagcgataggtcatagatttcctaatgccatgtataatcccttaattacatcctgatgtgtctgtcatttgttgtcgagaagtagttggttcaactgtatgtttagagaagcatgtgtacctagtcgatgtaatatatactagtccagagcgcgcgccctgcgcgcgtttataaacaattaggtataaatgcataaacatcttttaatcatgaagttgcatattgaatacttatatttgtaccaacacaaagatcattcatctgtgtcttcagtcaccggttttgggctctctgaagttggaagttgctttgatatattgtctagtcagtaccggggaatagatgtatcaaacaatctccacctttgattgtcctcatatagtgtcttcagtcccctccgatactttagatcaatagaattatttttcgcattacagagcttagatttttgcggttggtattcacactttcagcaggagcacacttcgtttcctggtatcgatatctcagtacgctaatggcagtgctagtgatgaatataagctgtagcataagttgaagcttccacaaatatgtagcatgtgacgaagagttcag

SEQ ID NO: 10115 - DNA, 1869 bp, Zea mays
attacaaagccttaaattttcgcggttggtattcatactttcagcaggagcacacttcgtttcctgtatcgaaatctcagtacgcttgttctcctcccacccctccacaattgctaatggcaatgctagtgattgaatataagtttgtagcgtaagtcatagcttccacaaatatgtagcatgtgacgaagagtttaggtggcccggcgagcggcgtgggtccacgcccatgtccctgtgtaaggtggcgccgaccacgatctgttggaagcagtgcacctcttggtcattgtccacgtcgctggaagaatagagtggagcttgcccacccagcataccttcatcccgctgagcaagagctgcacccgccccggaactggtgcgtcctgactcctgatgaacaaatggcaccagcacatctgtgtagccgtgctacaggttgccggagaagccaccgttggagaagaggaagccagggacagagttgttcctggtgcacacgggcgccaccgccggctccgagagcggcttgagggtgtactcgcggatgtgggccatggccacggggtcgtggtagcacgcatatggcctggtcctccactccctttctatcccgctgacgtagatgaaagagcggttcctgtccacctggatgtcaccagacacgtcgcagctccgagcgcttgctcctcatgtagcacgtcggcctgcccttgcccttctaccccttgcttatcctgttggccctgacggtcggcggccgacgccccactttcttcttccgcttcctgctcatcgtcctcctcccagagagagacagctgaatacatgatatagtttacagatagaggctaaaaatacactaagtgtagaatatgaagttgtatgtaaacagtacagccaatataaatttaaatacataataagtgtgccaaccttgtattcacataccacatagtttcggatttaagtcaacatcttatgcgttgcaaaagcaacatgcactcgtaagagtaatgaagtccatagcacaaacatgtggagaaaatagttaaaaattcactgaaactgctagtgcgcctataggattctttaccaactaaatatgaggtagcaaaaaatcgtttaagcagactgatgttacctggctataatgaagtaattaaatcattagtaggtagatgactttgtcaaacctgaatcctttgggaactgaacttcatctgcagttgtgaatgatgcaatcaaagctcgcatagttctatcatctgcaaactccaatcatccattcgtcatgattattccatttcagctcaagaacatcatattcctcatttgaaacgaccaatagatcggcaacttctcctgagaatatggcatggcaataccctccaattgttcttttgaatagtggaattgtactaattacaacaggaaagtatgttcccagcctgtgcatcttttgtcgctttgatggcagtaatccgacgttcacctgcgatcgtggcgagtgagtatggcttcttcaccggcgtggcaaccgccgaggtgtaggtcttggcgctagcggaagtcgaatggaatgatgttgcgccctcgaatgaccggataaagttgttgaggcagcgacggagctggtgaccagcggccgaagcgtggcgcggggaccggctggtgcgaacgcgaaggcgagaggccaggatccaggtcgctgggcggcgttgaggcggatgcgacgcgagcagatgcagaatcgcgttgaggcggatgcgacacgagcagatgcagaatcgtgagtcagggctggaggacgtcacgagccacgacttagctggattgaattgagatttcgggtccgcagcgaagatt

SEQ ID NO: 10116 - DNA, 1059 bp, Zea mays
  misc_feature (1012)..(1012): n is a, c, g, or t
  misc_feature (1038)..(1038): n is a, c, g, or t
  misc_feature (1041)..(1041): n is a, c, g, or t
  misc_feature (1043)..(1043): n is a, c, g, or t
ggtaccgggcccccttctcgagttttttttttttttttttttttttttttttttttttttttggaatattaacaagatttttattacattgatacttcggcttgttcgaaggtgatgacgcgagagcaattacaatccagcgtgaacagtacgggggtattgttcacctatctatagacacgggatgcagcccgagtaaaaatacatttatgacattaacattctttcacaattgtaacattaatcgttagagactagataatcttttccttttcgacacagcatcatgcttgatcttcgataccattttaagccaaagttgttactcttgggttatagcttcggcgtccattgttgtcattttcgagttatatcctcgtccttcatcccgctgagcaagagctgcacccgccccggaactggtgcgtcctgactcctgatgaacaaatggcaccagcacatctgtgtagccgtgctacaggttgccggagaagccaccgttggagaagaggaagccagggacagagttgttcctggtgcacacgggcgccaccgccggctccgagagcggcttgagggtgtactcgcggatgtgggccatggccacggggtcgtggtagcacgcatatggcctggtcctccactccctttctatcccgctgacgtagatgaaagagcggttcctgtccacctggatgtcaccagacacgtcgcagctccgagcgcttgctcctcatgtaaaaagtcggcctgcccttgcccttctaccccttgcttatcctgttggccctgacggtcggcggccgacgccccactttcttcttccgcttcctgctcatcgtcctcctcccagagagagacagctgaatacatgatatagtttacagatagaggctaaaaatacactaagtgtagaatatgaagttgtatgtaaacagtacagccaatataaatttaaatacataataagtgtgccagccttgtattcatgttttgtggggaaaaagtcttncctgaccgggttttgcatgcgtttgnccntnggtcttcctagacgtt

SEQ ID NO: 10117 - DNA, 2841 bp, Zea mays
ggcatcacctatccacatctttctccctctctctctcctcttccgtccctcctctctctccctctctacgccacgcctccacctccacacctgcacgcctctcgctctctctcctaacctgtcgagctgcccacagcccgtacctacctgcccccagtccccgccgccccgcctgcccgacccgcggcttatccaccacgtccaccgctgggctggatcgatcgggaccggggtcgcgccgccgccgctgccctccgcactcgcgggatcctgttcctaccatgcagcagcgctgcgcccttgcccgaccgcgccggcccgccgaaccgcgcgttccgctccccgacgatcactccctcgtcgccgtcttctccttcctcttcatccccacctaaatcaacctcctcgccgcgaaattctgctacaatttcttcatcttcccttgccgccgggagcggacggatcgccgcttcctcggccggcgggatgagccgggaggcgcagaaactcgactgcaccgccgccggcggcgggatcggggtcctgtcgctggacctgctgggccaggtgctggaacacctgcgggagccccgggaccgcaagacgtgccgcctcgtcagccgcgccttcgagcgcgccgaggccgcgcaccgccgcgcgcttcgggtgctccgacgcgagccgctcccgcgcctgctccgcgcgttcccggcgctcgagcggctcgacctctccgcctgcgcctcgctcgacgacgcctccctcgccgcggccgtcgccgacgccggcggggggctcgccggcctccgcagcgtgtgcctcgcgcgggccaatggtgtcggctggcgcggcctcgaggcgctcgtcgcggcctgccccaagctggcggccgtcgacctgtcgcactgcgtcagcgccggggaccgcgaggccgccgcgttggcggcggcgtccgagcttagggacctgaggctggacaaatgccttgccgtcaccgacatggggctcgccaaggtggctgttgggtgccccaagctggagaagctcagcctcaagtggtgccgtgagatctctgacattggaattgatctgttggccaagaagtgccctgagctccgcagcctcaacatatcctacctcaaggtgggcaatggatcccttggatcaatttcgtcacttgagaggcttgaggaattggcaatggtttgttgttcaggtatagatgacgaaggcttggaattgctgagcaaggggagcgattcgctgcagagtgttgatgtgtcaagatgtgatcatgtgacttccgaggggttagcttcactcatagatggtcgcaattttcttcagaagttatatgctgcagattgtttgcatgagataggacagcgttttctatccaagttggcaagactgaaggaaaccttgacgttgctgaaactcgacggtcttgaggtctcggactctcttcttcaagccattggtgaaagctgtaacaaattggttgagattgggcttagcaaatgcagtggtgttacagatggaggaatctcatctcttgtagctcggtgtagtgacctaagaacaattgatctcacatgctgcaatctcattaccaacaatgcgcttgattcaatagctgacaactgtaagatgcttgaatgtttgcggttggaatcatgctctttgataaatgagaagggactaaagcgaattgcaacttgttgccccaaccttaaggagatagacctcactgactgcggagtggatgatgcagcattgcagcacttggctaaatgctctgaattgcgaatattgaaattaggcctatgctcaagtatttctgacagaggcattgcatttatcagttcgaattgtggaaagctcgtggagcttgatctctaccggtgcaactctattactgatgatgggttggcagctttagcaaatgggtgcaagaggattaagttactgaacttgtgttactgcaacaagatcactgatactggtttgggtcacttaggctccctggaggagctcacaaaccttgaactgaggtgcttggtccgcgtaacaggcattgggatctcctcagttgcaatcggatgcaagaacctgatagagctggacttgaaacgatgctattcggttgatgacgctggcctgtgggcccttgctcgttatgctttgaaccttagacagcttacgatatcgtactgccaagtcacggggttgggcctgtgccacctgctgagctccctgcgatgcctccaggacattaagatggtgcacctctcatgggtatcaatagaagggtttgagatggctctgcgagcagcctgcgggaggctgaagaagctgaagatgctctgcgggctgaagaccgtgctctcccctgagctcctccagatgctgcaggcttgtggctgccgaataagatgggtcaacaagcctcttgtctacaaggactagacagactcgtgttcctcattgtgtgtgcagtgtcagcatcagcatgtattgtcaagatcttgcaggtttgccctggctcacgttgtgagtccgcaataatcgttgggggcgtaagctcccgtccccaagatgtggttatggtgcctttggggcacttcttgcgccatttgtcactctctgctccggtgtatctgtgtatgcaaacggaggcaccggtaatgttcatgtgtatatagcgtgcagtagaatgatcccattttatgggattagttagtgtgtaattgttacctcatttcgcatgattcgaatcttgagatgaaagaatcataaggggtatgatcgatgcattgcattccaaaaaaaaaaaaaagg

SEQ ID NO: 10118 - DNA, 2935 bp, Zea mays
tctctcgcccccccgccctcttccgtctctctcctatgctccacacctccacgcctctcctcacctgtggagctccccacagcccgtaactacctgcccccagtccccgccgccccgcctcgcctgaccccagtccccgcggtttatccaccacgacaccaccacctctccaccgctgggccggatcgatcgggatcgcgccgccgccgccgccctccgcactcgcgggatcctgctcctaccatgcagcagcgctgcgcccttgcccgaccgcgccggcccgccgaaccgcgcgtcccgctccccgacgaccaccccttcgtcgccgtcttctccttccttttcatccccacctaaaccaacctcctcgcagcgtaattctgccagtatctcctcatcttctctcgtcgccgggagagcgaacggatcgccgcgtgctcggccgacgggatgagccgggaggcgcagaaactcgattgcgccaccggcggcggcggcggcgtcgggataggggtcttgtcgctggacctgctgggccaggtgctggaccgcctacgggagccgcgggaccgcaaggcgtgccgcctcgtcagccgcgccttcgagcgctccgaggccgcgcaccgacgcgcgctgcgggtgctccgacgcgagccgctcccgcgcctgctccgcgcgttcccggcgctcgagcggctcgacctctctgcctgcgcttcgctcgacgacgcctccctcgccgcggctgttgccggtgccggtgggggcctcgccggcctccgcagcgtgtgcctcgcgcgggccaatggggttggctggcgcggcctcgaggcgctcgtggctgcctgccccaagctggaggcggtcgatttgtcgcactgcgtcagcgccggggaccgcgaggccgctgcgctggcggcggcggccgggctcagggagctgaggctggacaaatgccttgctgtcaccgacatggggctcgccaaggtggctgttggctgccccaggctggagaagctcagcctcaagtggtgccgtgagatctctgatatcggaattgatctgctggccaagaagtgccccgagctccgcagcctcaacatatcctacctcaaggtgggtaatggatcccttagatcaatttcctcactcgagaggcttgaggaattggcaatggtttgttgttcatgtattgatgatgaaggcctggaattgctgagcaaggggagtgattcgctgcagagtgttgatgtgtcaagatgtgatcatgtgacttcccatgggttagcttcactcatagacggtcgcaattttctccagaagttatatgctgcagattgtttgcatgagataggacagcgttttgtatccaagttggcaacactgaaggaaaccttgacaacgttgaaactcgacggtcttgaagtctcggactctcttcttgaagccattggtgaaagctgtaacaaattggttgagattggacttagcaaatgcagtggtgttacagatgaaggaatctcatctcttgtagctcagtgtagtgacctaagaacaattgatctcacatgctgcaacctcagtaccaacaatgctcttgattcaatagctggcaactgtaagatgcttgaatgtttgcggttggaatcctgctctttgataaatgagaagggactaaaacgaattgcaacttgttgccccaatcttaaggagatagacctcactgactgcggagtggatgatgcagcattggagcacttggctaaatgctctgaattgagagtattgaaattaggcctatgctcaagtatttctgacaaaggcattgcgtttattagttcaaattgtggaaagcttgtggagcttgatctctaccggtgcagctctattaccgatgatgggttggcagctttagcaaatggatgcaagaggatcaagttactgaacttgtgttactgcaacaagatcactgatactggtttgggtcacttaggctccctggaggagctcacaaaccttgaactgaggtgcttggtccgcataacaggcattgggatttcctcagttgcaatcggatgcaagaacctgatagagctggacttgaaacgatgctattcggttgatgacgctggcctgtgggctcttgctcgttatgctttgaaccttagacagcttacgatatcgtactgccaagtcacggggctgggcctgtgccacctgctgagctccctgcggtgcctccaggacattaagatggtgcacctctcatgggtctccatagaagggttcgagatcgcgttgcgagcagcctgcgggaggttgaagaagctgaagatgctctgtgggctgaagaccgtgctgtcccctgaactcatccagatgctgcaggcgtgtggctgccgaataagatgggtcaacaagcctcttgtctacaaggactagaccacctgttcctcatcgtttgtgaagtttcagcgctgccatggattgccaagagcccaagacctaccaggtttgccctgtgagccatgtgagatgttctgcaatagtccttgtgagatattccgcaataatcgttgggggcgtaacatatctagcggcgattatcggctctgctccagtgtatgtacactgaggcatcggttatgttcatgtgtatagcctgcagtgggatgatccacttcctgggattactttagtgtgtttgttacttcattccgcatggtttgggcctttgaagttaaaagaatcataagaccttgttcggttattgatattacatgtgtattggagtgtattaggtgggattaggatggattttgacttgttatggatttaaaccggctcaatcctattcaatacatgtggattatcccccaaacgaaccagcccagggatattatccgggtttggttaaaaaaaaaaaaaaaaaaaa

SEQ ID NO: 10119 - DNA, 1829 bp, Zea mays
  misc_feature (1795)..(1795): n is a, c, g, or t
  misc_feature (1804)..(1804): n is a, c, g, or t
ggccgggccgggatccagtagcaaaagcgctagagagattagagagagactccaagccaagaccaaggggaatcagaagcagctgccaaatggccaaatcccgaaagcccctgtccccagcccgcctctcaaacccctaatccctagccacaccacgccctcttccctccttccccgttggcttcggcggcgggcggccatcagcaaccagcatcgtacggaggagaagcgctgtttacacccgtctggcagggatgccgctggggcagcgttcgggggacaagagcgactcccgctactgcggggtggaggttctcgacttccccgccggggagggcctccctgccgtcctcaatcactccctcgcctccgccttcgacttcatcctcgcccctctggttgatcccaactaccggccggcgcccggcgccgttctgccagtgtcagcgtcggacctcgtcctcggcccgtcccagtggagcaaccacgtcgtcgggaagatcagcgagtggatcgatttggacgcggaggacgagcggctccggctggactccgagctcacgctgaagcaggagatcgcttgggcatctcacgtctcgctgcaggcatgtgttattcctgcccccaggagatctttttgcggcaattatgccagagttgtgaatcaaattttgcaaggcctgaccaatatgaatttgtggcttaggttgcctctggagaagtccgagcctatggatggtgatcttgataaaataaagaacaacaaccacacgctacagagtgaaatagcagactcatgggaattatggaattcattcagattgctatgtgaccatagtagccaactatgcgtggcacttgatatttcgggcacactgccatcaatgaactcattagggcgctggtttggggagcctgtaagggctgctattctgcaaaccaatgcttttcttacaaatgcaagaggatatccttgtttatcaaagcggcatcaaaggctgctaactggactttttaaccattctgttcaggcgataatctctgggagatcgaatcacaatgtttttccagcatctgaaggagtgctctcaggagatgagggcaacgctgaagattcctctgttcgacatgcattagctccgtacctggagtacattgcatacctgtatcagaagatggatccgcttcctgagcaggaacgctttgagattaattacagggattttttgcagtctcctctccagcctctaatggataatttggaagctcagacttacgagacttttgagaaggatgttgtgaagtatactcagtatcgaagagcagttgctaaggccttggttgatagggttgcagatgatgcagtctccacaactaggacggttctgatggttgtgggagcaggccgaggacctctagtaagagcatcattgcaggctgctgaagaaactggtcgcaagttaaaagtatatgctgttgaaaaaaatcctaacgctgttattactcttcatagtttgatcaaattggagggttgggaaagcctggttactgtaatttctagtgacatgcggtgttgggatgcccctgaaaaggcagatattttggtcagcgaattgcttgggtcctttggggacaatgaactatctccggagtgtctggatggtgctcaacgattcttgaagcctgatgggatttccattccttcatcatacaccagcttcatccaaccaataacagcgtcaaaattgcacgacgacatcaaagcacacaaagatattgcacattttgaaacggnatatgttgngaaactacaccgcatagcgacactt

SEQ ID NO: 10120 - DNA, 973 bp, Zea mays
  misc_feature (4)..(4): n is a, c, g, or t
  misc_feature (6)..(6): n is a, c, g, or t
  misc_feature (10)..(10): n is a, c, g, or t
  misc_feature (14)..(14): n is a, c, g, or t
  misc_feature (50)..(50): n is a, c, g, or t
  misc_feature (55)..(55): n is a, c, g, or t
  misc_feature (60)..(60): n is a, c, g, or t
  misc_feature (70)..(70): n is a, c, g, or t
  misc_feature (90)..(90): n is a, c, g, or t
  misc_feature (130)..(130): n is a, c, g, or t
  misc_feature (134)..(134): n is a, c, g, or t
  misc_feature (139)..(139): n is a, c, g, or t
  misc_feature (164)..(164): n is a, c, g, or t
  misc_feature (174)..(174): n is a, c, g, or t
tccnanatanattnttgttcaaacccggccaaaaggtagggcccattggnagttnagtanatccgccaanggaggccaagctcccttttnaaaacaattaaaggttttacggagttagttgacaaagaangttncgtanatcgggtttccaacgagccttcatncggagtaaangagtttgtacatgctgcaaaggctcaaggccttccaaagatcgtgagcatccagaacagttacagtctacttgtgagatgccgctttgaagttgatcttgttgaagtttgccacccgaataactgcaacgttggactgcttgcatactccccgttggctggtggggttctcactgggaagtatcttgacgctaacgctgacatctcaaagagcaggctaaatctcttccctggatacatggcacgctacaatgactctttggctaaagaagcgacattagagtacgttaagcttgccaagaagcacgggctaactccagtccagcttgcccttggcttcgtgcgtgatcgtccattcaccgctagctccatcattggagcgaccaccatggagcaggtgaaggagaacatcgacgcgtttaccagcactccacggcctctaccacaggaagttcttgacggcattgaggatcttttcaagagatacaaagatccagcaatcctctagtttttcattcaccttttttggcgaaaagtagcaatcctcggacaatacaaagcccagaaaacatattacaacctatgatcgtatggtcataccattttgttcatgctgatacaattattgctttgttcttgtattggctctacaggcaataccagcagagcagaattatgttttttttccttcactgtgtaagtagaatgcaggttttcactgtgtaagcgttcttttatactctgctagtaactgtatgatgtcttcgacattgacaggtctcaagtggacaggtttaacc

SEQ ID NO: 10121 - DNA, 1491 bp, Zea mays
  misc_feature (1315)..(1315): n is a, c, g, or t
  misc_feature (1339)..(1339): n is a, c, g, or t
  misc_feature (1390)..(1390): n is a, c, g, or t
  misc_feature (1395)..(1395): n is a, c, g, or t
  misc_feature (1398)..(1398): n is a, c, g, or t
  misc_feature (1417)..(1417): n is a, c, g, or t
  misc_feature (1421)..(1421): n is a, c, g, or t
  misc_feature (1437)..(1437): n is a, c, g, or t
  misc_feature (1452)..(1452): n is a, c, g, or t
  misc_feature (1479)..(1479): n is a, c, g, or t
  misc_feature (1483)..(1483): n is a, c, g, or t
gtacacaaaaaaaaaaccggcccggcgcatatcccccacccaccccatcaggcatcagcgcctctgccgacttcatcttttgcgttccccgtggcgggttggcaggccacttcatccgcctcgtcggcttcattcatcaccagaaatttccatcgccgcgcccggcgtctcctccactcgcctcccctacgctatagcattccattcctgagctcgctaactgcgcttcttcggttcgccggaaagccacgggttgggttcggcgggaggccgggaaacgggaatttatttcaccagtatgcaacagatggccatgccatcgttcgccgtaacctcacctccgtcgcatggcactaccttatgggcgcctcatgctcgtcgtcctcaaagactgcacaggagacacgtgcgcagccaagtccgggcagtggcacaagcacagctgcagtaccagaagctgggggactcagacctcctcatcagtgaggtcactcttggaacgatgacttttggcgagcaaaacacggagaaggaagcacatgacattatcgcttattctttcgatcaaggtgtcaatatcctagacacagcggaaatttacccagttccaatgaacaaggaaactcaagggagaactgatctttatattggcaggtggatgcaatcaaaaccacgagacaagataattttggccaccaaagttgccggttattcagagcggtctacatttcttcgagacaatgcaaaagtggttcgtgtcgatgctgccaatatcaaagaaagtattgaaaagagtcttaaacgcttgtctacagattacattgatttgcttcagatacactggccagataggtatgtggcactatttggtgagtttagttataatccgaccaaatggaggccaagcatcccttttgaagaacaattgaaggctttacaggagttagttgacgaaggaaaggttcgctatatcggtgtttcaaacgagacctcatacggagtaatggagtttgtacatgctgcaaaggctcaaggccttccaaagatcgtgagcatccagaacagttacagtctacttgtgagatgccgctttgaagttgatcttgttgaagtttgccacccgaataactgcaacgttggactgcttgcatactccccgttggctggtggggttctcactgggaagtatcttgacgctaacgctgacatctcaaagagcaggctaaatctcttccctggatacatggcacgctacaatgactctttggctaaagaagcgacattagagtacgttaagcttgccaagaagcacggnttactccattccacttgcccttgntttcgggccggatcgtcatttaccggtactccatattggacgaccccttgnacagngangaacctttaccttccacantcangcttccccagagtttnggtttggacttaaanacaagaccccttcttatttatactttngaanacatccgc

SEQ ID NO: 10122 - DNA, 1828 bp, Zea mays
gacgcaaaattttacctgatgctgggatgtgcaagcaggaatttatttcaccagtatgcaacagatggccatgccatcgttcgccgtaacctcacctccgtcgcatggcactaccttatgggcgcctcatgctcgtcgtcctcaaagactgcacaagagacacgtgcgcagccaagtccgggcagtggcacaagcacagctgcagtaccagaagctgggggactcagacctcctcatcagtgaggtcactcttggaacggtgtgtatgattctggagcttcagagttcaaaccctcttgctgcaagtaatgttttctccatctcaaggtgaatccttttctttccagatgacttttggcgagcaaaacacggagaaggaagcacatgacattatcgcttattctttcgatcaaggtgtcaatatcctagacacagcggaaattgtcagtacaagattccttccttacttttattaactatccctctctctgtattttcaagtgatcggatatacttctccattttcccttttggcctttagtacccagttccaatgaacaaggaaactcaagggagaactgatctttatattggcaggtggatgcaatcaaaaccacgagacaaggtaacctaaatggattgttaaatttttatttctgtactaacaacgattcttacacaatacacttgctttcgtccttcaaattggtgccagagtttagaagcataacttttactaataagtaataacaccgtgctacctatcagttcttttaatgcacaatccccaagtttcacactatgtgatgttatgtttaatgtctgactgtaagacgtgtcttgtttttttcctttggattttagataattttggccaccaaagttgccggttattcagagcggtctacatttcttcgagacaatgcaaaagtggttcgtgttggtgctgccaatatcaaagtaagtattgaaatgagtcttaaacgcttgtctacagattacattgatttgcttcagatacactggtcagtgtcagattgttccacttgtatagctatatgcctgacaaaaacaacatttaggactttaggttcacttttctgttgtcagtcttttaccaacatacatggaaacattccattagacatcagttggaattttcctccctcgtacagaattatgccaattttttttaaggaaattgatgaatgtattggtcgggaaagtcaatatgcattgtataatgtaaaatcaggtctgagcactcaggtctggcggctgaaggtgtcttttctattccatgcttcacataaggttcagcttgttctcatattgctgagtaatatagagaaaatacaaatgaatatattaactgaactcttcttggacttctgtttgtgttccttgtaaaatataggttataatatgtgagatacctaaccaagtacttttcactatttcagttcagtttatttctcccgctcggtcaatttgaagtagccagttctttttttctttgcctttgacaccagctttctttgagtgcagttttatgagttttatgaactaatttccccctcaattccctctaatccccccgtgagattttttcccctgcttgtgtcgcggttaggcgtaatggatgcctcttttgctgctcgcatgtgcttgttttttttcctgctttgcttagcattcataagaaaatgttgtcgtccccgtatttggatagataaatggatctaattaaatatcccgtgcctaccataatgttcacgttgctagcagatttaaaaggggtagtggggaaacaccatttttcatggtc

SEQ ID NO: 10123 - DNA, 3124 bp, Zea mays
attcaaaataaacacaaaaaactgttttactaaataaattactgtgtccttagaaaatccaaatagtcggagaagtaagagccggaattgttttcacagtaacagaagtcctggaaaggcaaaaaaaatatataaacaaaccggctctatatctcgcgcgtccaatgcaccgcgctcgccgtgaaacgccacatgtatactttttaacgtggccggttatcattggattgatgactcaattcgcgccgatcctgctcggcccgtagccaaaatctctaattgcaataaatgaaggacaaataaaaaggaaaatttcggaatccgaaatatagcaggagcacgccctctgcacggaaaaaaattctgtgcataccggatgcaaaccctttagtaatttatttttaatctatttgtatggaccagcagtgggggtatgtgtaaaaggtggggtttgcattccgtatgcaaagaatttttttcccgccccgcctccgccccgtcctcgagatcgttctcgcctccctccgctccccttcccctcgtgcgcagtgcgctcctcgagcaccccacactccagatctccgaacccctcccacatgccattgccattgcactgagcggcagccaatagccaactagccacacgccatggcgcagtcctgcagttggggaatcctcctcgccgtcctcgtcgcgggactcgcggcggccgtcgccgtcccgccggcgaccgcggcggtggcgagcatcgacctcggctcggagtggcttaaggtcgcggctgtgcatcttgccccgggccgtgctccgatcgctgttgccaccaacgagatgtccaagcgcaagtccccggccctcgccgcgctcgccgacggcaaccgtctcattggggaggaggcggcgggcatcacggcgcggcacccgtccaaagtattcgcccgcgcgcgggacctcttggccaagcccttctcctacgtgcagtccgtcacggagtcgctcttcctcccctacgacctcgtccccgacgcgcgcggcgccgccgcggtccgcgccgatgacgggcaggtatactccctcgaggagatcgtcgccatggtgctccactatgccgcggggctcgccgatgcgcacgttggggcgcccgtgcgggacgctgtgatcgccgtgccgccctacttcgggcaggccgagcgccgggcgttgacgcaggccacgcagctggctggaatcaacgtgcttgctctcatcaacgagcacgctggggccgcgcttcagtacgggattgacaaggacttctccaatgcgtcgcggcgtgtcatcttttacgacatgggcgctggtagcacctatgctgcattagtgtgctactcggcatacaacgccaaggagttcggaaagacagtctccgttaaccagttccaggtgaattccctatcttgcctttctggtagttgttcaattgcgcctctctcaaatgcctggtggcaatctttgatgaaagtatttcttatggtcactatgatagatctgacgaaaatatgcttttctattattgagttgtgctgctatgtgagatgatgagtgacaactccagaatactatattgctaacactaatctgcaggttaaggacgttagatggaactctgaacttggaggcgtcgaaatggaaatgcgtctggtcaactattttgctgatcaattcaataagcagctcggtaatgtggttgatatccgtcagtctcccaaggcaatggctaagttgaaaaagcaagtcaaacgcaccaaagaaattcttagtgcaaacactgcagctccaatttcagtagaatctctgtataatgatgttgatttcaggtgcatctctactatcttatatactttaaactcataactattggtaaaaaaatatggatgtagcatgtaagaaggtcaaggatcaagataaatgaaaatgcacccaacattgcaaaatttactctcaaacctaatttgtcagcttaaaattgttctgtaaagaatgggatttcaactcattaattaaaggtgtcctggaagcagaccttctaggtttggagtttgcatggacgaaagacattttatttgtctagtgtcttgacatgtatgatgtatcagattaaatttggttattttttcttttgaagtgcatcgatgcaatctcatctaaataaaggttactgcaaacaaaggctgtgtagttctggaccacttgggctacttcttaattgactctgtatcagctgttgaagttttttatatgggagacgcggaaattatgttctgtaacaatcgggccaattatgaggactcttaatggttgagttttcagtttttccctagcttgtgctttaagctttccttggtttaaacctgtatagtaagctcgtggtcttaaataacggttggggcaatatgcattgtgttacctactgagcttatgcactattttttttttacaggagtagcataacacgtgagaaatttgaagagctgtgtgaggatttatgggagcaagctctaactccagttaaagaagtgctgacacattctggcatgaagatcgatgacatctatgctgtagaactaataggaggagctacccgggttccaaaactgcaggctaagctgcaggaatttctgggtaggcgtggcctggataaacatcttgatgctgatgaagcaattgttctcggagcttcacttcatgctgctaacctgagtgacgggattaagttgaaccgtaagttgggaatgattgatggctctacttatgcttttgtacttgagatagatggcctagattatgtcaaggatgaaagcattgaccaaattttggttccaagaatgaagaaaatgccaataaagatgtttagatccatcagacatacaaaggacttcgatgtctctctcaactatgacaaagcttatgaactgcctccaggcattccatcacacaagtttgcagagtattccgtatcaggattgacagatgccagtgaaaagtatgcaaaccgtaatttatctgcacccatcaaagcaaatctacatttttctttgagtagaagtggaattattgctcttgatagagcagaagcagtaattga

SEQ ID NO: 10124 - DNA, 1217 bp, Zea mays
gtttgggccgaatcacaggtgcctttggagcccggaaacgggagtctggagattttccgagttgtctccaccgcgcaagcgacgagaaggcggcgcgccaccaccgctgctggcctgccgccacgactcgccggcagactaggctcctatggcgcgccgccgcgtgctgctcttcctcaagcccttcgacgtataccctccccgcccgtacgtcggagctgcggcctcttctcccacctctgcgccctcgtcactgccgcaaccgcgcgccgccaaccccaaggtcttgagctatctggatgataggtgcagagttcacaaggacactattgatctctgccagagtgtcttacagcgcaagtcccttgactggattgctgtgcagcgcaatcatttgtgtcagccaatacgtgatgtggatcttgtggttgctgtcggcggcgatggcacccttctccgggctagccattttttggatgattcagttcctatattgggtgttaattcagatcctacttgtactaaggaggttgaggagctatctgatgaatttgatgcaaggaggagcacagggtatctttgtgcagctactgcaggaaactttgagcagatacttgatgtgacgcttgatggcagtaggcgccctttggagctgtcaaggatatcggtgaaactaaatggaattcagctgccgacttatgctctgaatgatatattggtgtcacacccttgtccagcaagtgtgtcgcgcttctcatttaggaaaaggaacaatacaggagagaactcgcgtttaattaattgtagatcaagcggtctgagggtctcaacagctgctggatcaactgctgccatgctatcagctggaggatttacgatgccattatcaagccgtgagcttcagtatatgataagggagcccatttctccaatggatgccgacaaagcaatgctccatgatgttcttaagcaagaacaacacatgcatgtcgtgtggtacaatcaagagggtgctgtttatgttgatggttcacacgtagtgcattcaattcagcatggggactcacttgagatatcctcaggtgctccgaccttaaaagttgttttgccagaacatttgctaaagatgggacctgaatggtgaaataacaatatttttgtgatgttccttatctatttaatatgatataggagttgagcaaaaaaaaaaaaaaaaa

SEQ ID NO: 10125 - DNA, 3199 bp, Zea mays
  misc_feature (3170)..(3170): n is a, c, g, or t
gaagatagaagctgaatgccgacagataaagttggttgatgctccagtatctggtggtgtcaaagggcggcggatgggacactaactggacagatgaagccctccattgcactggttctgttctatcagcgctgagtgaaaagttgtatgtaatcaaaggaggatgtggagctgcaagttctgttaagatggtcaaccaacttcttgctggggttcatatagcttcagcagctgaagccatgtcatttgctgctcgactaaatttgagaacgagaagagtcttcgaaattatgcaacatgcaaggggttattcatggatgtttggaaatcgtgtgccacacatgctcgataatgattatacaccctattctgcagtggatatatttgtcaaggatcttggtatagtatcttgtgaaagttccaattcgaggatcccagttcacgtctctagtatagcccaccagctgtttatttcaggatctgcttctgggtggggtagatatgacgatgctgccgttgtgaaggtctatgagacattaactggtgtaaaagttgaagggaaggctccgatgctcagtaaagaagatgttcttcagtctcttcctgctgaatggccagaagatccaattgataatcttgtacctattgcatctcatagtagcaaaaagtttcttgtagttttagatgatgatccaactgggactcaaacagttcatgatatagaagttttaactgaatggcctgttgaagcccttgttgaacagttcctcaagctaccaacttgcttttttattttgacaaactctcgttccatgactgctgataaggccatgctgctagtacaaactatctgtaaaaatcttaaagctgcggcagagaaggtccctggtgttagttatacaatagtcttgagaggtgattcaactctacgtggtcatttcccagaggaagctgacgctgctgtctccgtattaggtgagatggatgcttggataatctgtccattttttcttcaaggtgggagatacactattaacgacatccactacgtcgcagactctgatagattaattcctgctggtgaaaccgaatttgccaaggatgcagtttttggctataaatcttccaatctcagacagtgggttgaagagaagaccaaaggacgggttttggagaaccaagtttcaacaatttccataactctcttgcgtaaacaaggaccaactgctgtttgtgagcatctctgtagcttggagaagggctctgtgtgcatcgtcaatgctgctagtgacagggacatggctgtctttgcttctggaatgatccaggctgaattgaaaggaaagcgatttctctgccgcacagctgcaagttttgtgagcgcaaggattgggatcaagccaaagccacctatctgtccaaatgaccttggcttaaaaagagctttaactggaggcctcataattgttggttcatatgtgccaaaaactacaaagcaggttgatgagttgcgatcacagttcgggcaatctcttcgagtcatagaggtgtctgtcgagatggtttcaatgaaatcaatggaggacagagaccaagaaatcagacgaattgttgaactagggaatgcttatatacaatccagaaaagacactctaattctcaccagccgccaactcattactggaaaaactcctgaagaaagcttagaaattaattataaagtgagttcagcactagtggagattgtgagaaggattgatagtaaacctcattatatcattgcaaagggaggaatcacttcatctgatattgctacaaaggcgctggaagctaaacgtgccaaagtcatgggacaagcattagctggtgtacccttgtggcagcttggtcctgagagtagatttcctggggtcccttacattgtttttcctggtaatgttggtgataacagtgctcttgctaaagtggtgaaaagttgggcttccccatctagaagttctacaaaagaaattcttcttaatgcggagaagggcggttatgctgttggtgctttcaatgtgtataaccttgagggaattgaagctgttgttgcagcagcagaggctgaaaagagtcctgctattcttcagattcatccgagtgctctaaagcaaggtggagtcccactggtagcatgttgcattgctgctgcagaacaatccagtgtgcctatcagtgtccactatgaccacggcatttccaagtcagacttgcttcaagctcttgaagcgggatttgattcagtcatggtggatggttctcatctaactttaggggataacatcttatacacaaagagcatatcttccttggctcatgcaaaaggtttacttgtggaagctgagttgggtaggctctcaggctctgaagatggcatgaccgttgaagaatatgaagcaagatttactgatgttgcccaggctgaggaatttattgatgagacaagcattgatgctctagcagtttgcattggaaatgttcatggaaaatatccacctagtggaccaaaccttaaattcgacttgctaaaggaccttcgtgcattaacattaaagaaaggagttagcttggtcctccatggagcatctggtctatctcatgagctcgtaaaggagtgcatagacttgggcgtgagaaaattcaatgtgaacaccgaggttcggaacagctacctggcgtccctcagaaagccagaaaaggacttgattcaggtgatggcgtctgctaaagaggcaatgaaagctgttgtagcagagaagctgcgcctgtttggatcgtgtgggaaagcctgagcgaagtacttgcgttgcgccggcaacatgcagtacaagaccgactgcatcatcgggttcgtgatgctgctgctactgtgcagttgcttacagttacagctcattgcgttgaacagctgaagtggttattgtactttgcagtgtagcgcaactaaggctaattcataaatcgtaataatgtatgtatgctgccccgctgtaaaaatgctccgtcgttaataaatgccatcgcgcttgctgtgccttttgtttacaaaaaaaaaaaaaaaaaaaaaagagaggcacacaaaaaccaacgaactacacctataagaaatctcgtgcgccggccccgttcanttagctcccgcttccccccttgcgggggg

SEQ ID NO: 10126 - DNA, 890 bp, Zea mays
  misc_feature (845)..(885): n is a, c, g, or t
ggccggccgggccgggagagcagggtgtactcgagacagacaggacggacggccacatccgccatattcaggcatggaagcaccggctgcgaagcgcgtcctccgcgtggccgccatcagcggctccattcgcaaggcctcctggcacagcgggctcatccgcgccgccgcggaggtgtgcgaggactgcatcccggggctgcgcgtcgaccacctcgacgtcgccgacctgccgatgctcaacaccgacctcgagacgaacggtggtacgggcttcccgcccgccgtcgaggcgttccgcgccaaggtccgccatgccgactgcttcctcttcgcctcgcccgaatacaactactccatcaccagcccactgaagaacgcgcttgactgggcttctagaggagtgaactgctgggcagacaagccggccgccatcgtcagcgcgggaggcaacttcggcggcggcaggtccagctaccatctgcgccaggtcggggtgttcttggacatccatttcatcaacaagccggaactgttcgtcttcgccttcttcgagccggccaagtttttcgacagcgacgggaacctcatcgacgccgacaccagggagcgcctcaagcaggtgctcctgtcccttgaggccttcacgcgcaggctccagaacaacaaggactgaagcagcagctcccgggatcgccgtgctaataataataatctctacttccttccttcagcaattagtaattcgtggtcgtcttattacaaaccaaagtatatgtgctcgaacctataataaaatacatggagaacttcgctaaaaaaaaaaaaaaaaaaaaaatccgtannnnnnnnnnnnnnnnnnnnnnnnnnnnnnnnnnnnnnnnnaaaaa

SEQ ID NO: 10127 - DNA, 1555 bp, Zea mays
cattgggtacctcgaggccggccgggggcctccgctccctctggtctcctcccccgggtgctcctgctcctccagacctccactccacccctccaaaaggtctagtaaaatagaaggaagccgccccccaatcgttcctagcccggcgcacggcgcacgaaggggttcgatcggatcggcgccggcgggggcgagatgtgggagtcggtggcgctgacgctggcgggcaccgccggcaataacatcggcaaggtcctgcagaagaagggcaccctcatcctccctccactctccctcaagctcaaggtggtcaaggcgtacgcgtcgaaccagctctggatcagcggtttccttatggacatgtgcggtgccgcgctcatgctcaccgcgctctctcaggcgccggtctccgtcgttcagcccattgctggttgcggtctcgcaatactctgcgttttctcccatttttacctcaaggaggttatgaacggcctcgattggattgccatcacgctagctggtctcggcaccataggtgtaggtgttggaggtgaggaacagaaagttgaccagatacctcttttaaatataccctggctagtgctctccattgtcatcttgtttgtactgctcaacacttggcttcatatgtataaaaagcaaaggcgtgagcaagagttgactggacctgaagtgattgaggagatcatatatggcttagaatcaggcattttgtttgggatttcttcagtgatctctaagatgggatttgtgatgtccgagatgggttttccaaagattgttgtgcctgctgccatatcttgtagtgtttgctgcagtgcagtgggatttgtgtatcagactcgaggcctcaagcatgggagggcaattgttgtatctacatgtacatcagtggcatctatagtgtccggtgttgttgctggcatgattgcacttgatgaacatctgcctaaagctcccacagctcggtttttcctcttactgggatggttcttcatcatcacaggagtaatactgcttgttagttcaacccgattgattgcgcgtctacctaggtctgttcagaagtatttgaagagcaacatagagcgcacccacagcatcaggaggcctggttcagcacgagggaaggatcccatcccaacaacaacgatccatacgtcgtcactacacttgcttgcttctccaacaaaggagaaggcctagaaaaatgttggcactagagcaacttcgtttgggcacctcacgtttgccatgttattgattgattgaatggttccgtgaacgtagtctagagtagcatcttaaaagcttgggttggttattcaccatactgccctttataggtctaacagaaacttggggaaaattgctgagtttttatcaggtctcgttttttgtttggttgctgagtgcaaaatctgaagttgttactctccgacccttaactctcgttatggaaagtatgttggtcaaactttctttaagtttgactagatttattgataatattattaatatttgtgctttttaa

SEQ ID NO: 10128 - DNA, 1638 bp, Zea mays
accttcttctcaccgggtcggctcgggccgggcccacgccagctccccctcccaatctcgattctcctcatcacatatcactgccgatgaaccttccagtagcctgtagctagagcgcctgggccatcggtagcagagaggttttgctgcagagagctcaagaaagatgtacgtggtgaaggatattggcggcgccatcgggctgatggcggtggcgctggtgctcctgggcacctggccggttgtcctggcggtgctggagcgccggggccggctgccgcagcacacgttccttgacttctccgccaccaacttcatggccgccgtgctgatcgccctcaccttcggccagatcggccccgccagcagcacgcccaacttcctgacgcagctcactcagttcaagaacaactgggcttcggtcttgtttgccatggcgggcggcgtcaccctgagcctgggcacattggccacgcagtacggctgggcgttcgtcgggctctccgtcactgaagtcatggcctctagcctcaaggtcgtcatagggacaacgctcaactatttcctggacggccggatgaacaaggcggagatcctctttcctggcgtcggctgcttcctgattgcggccatccttgggtcacttgtccacgcttccaatgccgccgacaaccaggagaagctggctaataataacgcttccaatgcagctgcagctgcagatgaggagaaggatctcaccaaacacctcctagagctagagatacaatcccaagaagcagagccggatgcaggaacggcagggttcctggttggtctggaggagaagaggtcgattaaagtgctgggatcccacacgcttctgggccttgggcatcgtggtgttcgcgggcatcttctacgcgctcttcgcgcccgcgttcaacctggccactaacgaccagtggcacacgctccccgcccgcgtgccgcacctggcggtgtacacggcctacttctactttctccctcgcatgcctcgccgtcagcgccgccctcaacgtgtggctcctctaccggcccatggtcggcgtgccaagctccaccctggcggcctacgtcctcgacggcgacggcaggggcctcgcgatgctggccgggatgctgtgcgggctcgggaacgctctcacgttcatggcagggcaggccgccggttacgccgccgccgactccgtgcaggcgctgccgctggtcagcacgttctgggccgtcgccctcttcggcgagtaccgccggtcgtcgcggcgcacgtacacgctgctggcgagcatgctactcatgttcacagtcgccatggtcctcctcatggcttcctcaggaagccgctccatcattcactgagctggccacgtggatggatatgcgatgcgatgcgatgaggagaatggacaccgggatagctcttgtcttgtgctggaatggaatggaaccaacccactagctgtacagagcgatcatgctacgtccacccactcgtccatgaattgatttgtctctgtatttttttttaaaaaagcgtgcgctgtcacccgcgggccgcggtagcatgcagcccgtctccagcggtctacataaagtttacttaaaaaactgttttat

SEQ ID NO: 10129 - DNA, 1000 bp, Zea mays
gtctggttgggaaagtaaaagcaggttcgttctcgggttttgattgggattgggttctgctgttggtcgaattccatccatttcttccgttgcatcggcccctcccttccttctctagttcccttcccttatagtattaactacgacgatggtggtggatgctggtgttggtgttggcggcggcggcggcgccgggacatgtgccgtcggaggattcgcagtctgggacgtgctgctgtggcgccggggccgcgccgacgtgagcgcctgcctgctggcgggcaccgtctcctcctggctgctcttgtacggcggctacaccttggtgtccctcgcctccaacgtgctgctcctgctcctcaccgtgctcttcctgtgggccaaagcggcgcgcctcctgaacaggccgcagcctcccgtcccggagctgcgcgttccgcagcaggccgtggacgaggcggcggcgctgctgcgctctgctctggacgccgcctcggacgccttccgggacatcgcgctgggcagggactcgctgctcttctacagagtcttcctctgcctgtggagcgtgtccatcgtcggcagcgttacagatttcccgaccgcctgctacgcaagtgtggtggctgctctgaccatcccggcgctgtaccacaggcaccaagagtgcatcgccacctacatgagcttcgcctacatgaacctccggatgtacgagatggcgtacgagaggctgtccatgaaatgcttcctcaaggtcagggactggacaatggagctactcaaggatccatgatcccttggttgtttgcgagtgagtgcttcaggtatagagttgattgattggtagatagaatagtggtggttttgattgatgctgactcttgttgtttgatcgatcagtgtgctctggtagatatagtagtggttttgattgtttggtccaacaaaaaaaaaaaaacattcctgagctactttagcatgcaaacattaaacattc

SEQ ID NO: 10130 - DNA, 2216 bp, Zea mays
tgtgtaacatgctgacaaccaatttttttgtgtgtttttgggcaccttcgaaagacgaaggccccatcatcctcctcctcgttactttaccaacagtgcaagctaaagttctaggcaacaacacttttgagtgtcaatatgtgttcaactgaatttgtgcttgaaaatatgcacctagatctgcatatctgaccgaaaatgacacaggtctgcagatattgtaaagtatacgtgggagcctggaaggaggaggaacccctaggcgtctctccttttctatcttgatcaagttgactcggtatccctatccatcccaccagccccaaagcagcacattcgggttccgacgtcatcgccgtcacggcttgcacaagcaaaggcgagcaagaactcggctcccgtcccatctcgccatgaaagaaagaaagaaagaccacctaaaaagaacagaacaggtggtcagcttccttccagtgcaccgtacctgtgacagcaacagtctaaagcaccaggaaaaaaaaaggaggcagaaaatctgatgcctgatgcggaagttagcagaaagaacagcatgtggccacagcgcatctgcagtacaaaaaaacaactcaattatttggatcccaaagaaagagatagctgttactacttctctcgtcacccattgctgctgtcgcctgttgatccggatcatcgtgagtcctgacctaaccattaaccagcatcctttcagtgcaagcaagcaagcaagcaattggtttccagagaagctaggcacgctgccactggaattgatgaaaaaggcttgtgctggactgtgtgtgtcatcagcagtgcacaccgcacaaatgcccaagcaatgaagcaacagtggcgcacaagacaggacaaggtgcctgtcgcaggagggattccctgttgtggcctgacctaacagtcgcccctagagtctgaagctgccggcgttcctcataataatcccaacaaggctcatgactcttgtcaatggcaggtcgctttcggtagctactatagcatcccctgcagggtggccggatggcacctgcatggatggatggagagcataaaaacctttgccatgagctgtattgtcactccgttttcttttgggaaaaaaaggaagaggaacagcggcgcgcgcacgtcgagaagtgagatggggcgggtgatccaggaaatcaaatcgccatcgccatgggggtcgtccatggcaagtggagtgataaaagatttatcatttatatgtgcatgggccagagcccagggatgggagatagataagcaacttgatagatatccactgaaaactccagacaaagttcttcacctccagattcctcacagagacaagccctcaattattacccccttccccccaaaaaaattcaatgatgctagtcgtacctcgtcctcctttataaagcaacaaactgcaagctgcttctgatgcaccatccagccatccaggggctgcaagcctgcaacctaaagcaagaacaagcagagcaagagagagagatatggagcgaggagacgaggcatcgtcagtagtgagcaaggccagcacagcagagcagcgactcaccagggagcagcacggcgacggcgcggcgtggctgaacctgacgctgggcgcgagcgaatcgccgtcgccgtctccgtccccggacgccgcgagctgctccgcggactccgagtccgggtccgggtccgggtccgccgccaagccgcccccgcacaaggtgttctcctgcaacttctgcctgcgcaagttcttcagctcgcaggcgctgggcgggcaccagaacgcgcacaagcgggagcgcagcgccgccaagcgatcctcgtaccacgcgcagcgggtggtcgtgggcggcctgccgctgcacgcgcacgccgccctcatgcgctccctccgagccaacccggcgccggcgccggcggtcaggacggcggcgaggttcctcgagggcggcgtggcggcggcggcctgggcaacggtcccgtgcgaggaggcgccgagctcggcctggcctgggagcttcaggctgagagcgccgcactcggagtatgagcaagcgtgtgagccgattcagccgagtaagatcgacttggacctcaggctctgatggtgatacgctggtgtggtctggttggttcgagatcgagtgcgtgagttcggccccgtttcaatc

SEQ ID NO: 10131 - DNA, 2357 bp, Zea mays
gaggaaactggtgtctgatcagacagagttgggagggagaaagaaccaacagccatgcatgacgcatctacagtacatggctcgattattggatcccaaagcgatagcaccggccgggcaagcataataaaaaaacaagggtacccttgctgccctcacctttccagctctctttagccggatagtagttctctctcatcgcctttatatatatatatatatatatatatatatatatatatatatatatatatatatatatatataattcagatcacaaggctgtaacactgatccgggggagatccggaaagcatgcgcgttttaagatcgagcacggtcgttattgaacaatgacctattgctgctgtcgcctctgctgatctgtattaataaggctacgagttctgacctaaccggcatgctttcagtggaagccattagtttccaagaaagaagaaaaaaaaaaagctaggtatgtatggaattcagaaaagactgtgtcggcggtgcgcatacgcccaacagtacagtacagtagtgcacaagacaagacgagacaaagatgcctgctgttgcagggttggctgctatggcggcggcctaacctaaaactatcagtcaccctagagtctcagacaagccgtcggcgtccggcgttcctggtagtcccaagtcccaacgagatccaggactcgattggtgatgagtactgaagcacacttgccagtgagagaaacgacttgcagtggatcgtattgtgttgtcgctctctctaatttcttttgggaaaaggaacaggaacaggggtgcacacatcaacaggtgagaagagattggatgaacgatgggccatgcatggcaagtggtgtgatagaatacagatacatatatatggctatatgcatggggcagagaggagcccagggccagacagacaggcaagaaagagaggagatagataagcaacttgatatagatagatagataggtatccactaactccagacaaagttctttacctccagattcctcacaaataaaggccctcaattattaccctccaaagaaagcaaaaaaaaatccaatgctcctcctacctcgtcctcctttataaagcaaattgcaaactgcttctgatgccccacgcgtccgagcaagagcaagcttcaacctttgcatgcagagacctagtggaatagagcgaggggaatggagcaaggagacgaggcgtcgtcggtgaccaaggagagcccggagcagcagcttacccgggaccgggagcagcagcacgacgccggcgtggcgtggctgaacctcacgcttcgcgcgggcgagtcgccctcgccggacgcggctgcgagctgctccgccgagtccgggtccgggtccgggtccgggtccgggcccgagcccaccgccaatccgtccgccgccccgcacaaggtgttctcctgcaacttctgcctgcgcaagttcttcagctcgcaggcgctgggcgggcaccagaacgcgcacaagcgggagcgcagcgccgccaagcgctcctaccacgcgcaccgcatgatcgtgggcctgccgctgcacgcgcacgccgcgctcatgcactcgctccgggtcagcccggcctcgtcgccgatccacaaggcggcgggcccggccagagcggcggcgaggttcctcgagggcggctccgcctgggggacgacggtcgccgcctgcgaggaggcgcccggttcggcggcgtggcctgggagcttcaggctgagagcgcagcactcggagcacgagcgagcgttcgagactgaacagagcaagatcgacttggacctcaggctctgatggggggatgtgcccgtgcatggtcagttcatctgctgaataaatctggtctggagatatgatcaggttcagctcactgtcaggtgaaaacccatagagttttggacatattgagtcgcttagaattgttttgatggtactgcaattatgcatttctgtagctggaaactgtactttagatctattgacagacatcagttttcttgcatgttttcgacaccgtcctctcaaagaacactcaaagcactgcatattgcaagagctattgtaggtaaacgagaagcatgctttcaggcttcatagacgcaactctgtcatgttgacaaggaacacgtttcaggcatgcagccaacacactgtttcagacgcatttccaaaatggtgatttacgcgtctgagcaaaaccagaatatgcaattattattagaacaaatatataaatatatattgccacgatggcatcagagtgagaaagatagccgagctgcaggtcgactgtacaggcatacaccggg

SEQ ID NO: 10132 - DNA, 2070 bp, Zea mays
  misc_feature (18)..(18): n is a, c, g, or t
  misc_feature (38)..(38): n is a, c, g, or t
  misc_feature (97)..(97): n is a, c, g, or t
ttttttttttttttttgnttttttttttttttcacacnaaagcaacagtgtttattacacaggctgtcatagcacggcccatttttgcaaaaatggnggttgggccttatcagcatcacagctcagcccagtccagagacagtgatgttagtttgtgttgtcctcctgctcctcctcctgctgctccacggcgtcggcgtcggcgtcggtggcgccgttccggcgagccctccgaatcctactcatcctagctagcgctgcctgccctgcttcactccctcccaccctcactggcgcctcaccatgatccatgtcgactttccctcctccaccccccagcgccgctaggagccccgtcgcccgggtgcgcctcgaccacctggtcccgttcgacggcgccttcaccccggcctacgcgcgcgcagtcgaagccgtcgctgcttccctcacgcgccacggcgccgccgccgtcgacctccctgcagcggacgccgctgtcgtccggtgcgccctcgagtccgcgcgcgccttcttctgcgaccgctccggcctctacgtctaccgcgccgggagggctctggatgatggagagttgtcacctgcttgcatgtctgatgctttcagatgtttgggtaagacagcccgtgctgctctctgtgcaatagcacggaaccttcgcttacgttcagatgctttcagccatttgcttgatgacaacccattgcctcttgatgaggtttcggcttcagaattgatggtgtcattttctcatgggcacccccaaagcagccaggcacctatggtgggcctcaggccatcaatggctgaagttgatagaggttttgttacactggttgcttctgaccatccaggaattgaggtttgcaacccaaatggtcattggtacccagcggatgtgggctcaagccctgatgtcctgttgcttttgactggaagagccttgagtcatgttactgctggcctacgtctaaattctcagtacaggatcattaataatgaaaacagggcatcactcatgtttaggctcatgcctcgtgccaatgcaatattggactgctctccaatttcagctgctgggcattgcacaccacagatccaccggcccatatctgcaagtcagtttatggatgatttgcgtgctgaagagaatgtttaccatcacttagaagcaccgcctgaatcacagggaaactttgttaatgaaccatcgctcatgaagtgtactgtcagaccctttgtctggggcttttcttgaagacgctatggttctcccatgtgggcactcgtttggtggcctcatgctgaagaaagttcttgaattggcaaggtgcagcatttgcaacggagatgttgatgaggcctccttatttcctaaccttgctctaagagcggtagctaccgtggtgaagatggaagacgataggaggctctttcacaatgcggcccttcgaaagcgcaggaaagaagtgactgagcatatggatgcccaaaggcgaaatggaagtagcaaggacagtattgagctggggctagaagctgaaagccctagagcgttcaagggggtgcagtacccgtttgtggtgggtgagagagtcctgatcatgggaaacaaaaggacgcctgataaattcgttgggaaggaggcagtggtgacatcacagtgcctgaatggctggtaccttgtgaaggcagttgatagcggagaaagcatacggctgcagtacaggtcgctgaggaaagcaggggagctacaggtgcaagcactcctgcagagtagacgatgatttttgcactagtgttgcttgtctcgtgttttgtttctgtcctatgcgatgaaaaggaaaaggaaaggatgcagcgtccttttgtacaaatttccattcagttttgccagccaagtcacgtagctgtaaaatgacagatgttgtgtggtgttctgtggcctttgtgcttgtgcactaagtcttgttaattgtcatacatgctcccttcgtaaaaagaagagtcttaaatacaagattttttcttcttctaaaaaaaaaaaaaaaa

SEQ ID NO: 10133 - DNA, 4589 bp, Zea mays
  misc_feature (2179)..(2179): n is a, c, g, or t
  misc_feature (2315)..(2315): n is a, c, g, or t
ttttttttttttttttgtaatcaaaacaataatatccattttgagatgagggaaaataaagcgcctataagatagacaaataagcttgagagctgtagcagctccgtgcaccaggaagcgatggccggtggctgctcctatagcccgcggcgaagacggaggccaggccacaaggcttttgctggatggcttcgagcacgggccgttggtagagatggaggagtgtttgatcactccacggcgagtcggcgacgatgttttgcttttgccatctgccgtatccatccatccgtccgtcgcgtcgccgcgcaggcagagaagtgaacacacacggcacctgccccgtaaaaaccaccccgcgccgcgcaacgcatcggcacgaggctgcctccggctccgctccgctccccctcccactcccccacctaacccctcccacctacctaacaaaccagacgtccagaccagaccagagctggcggtgtgagaaaaaaaagcagccaccacgacccgggaagggaacacggccacacggggcgggggggaccaaaccgccgggccaatccaatccaatccacgcgcccgtctccatggacgccgcagctttgctcgacgccttctccgccgcgccgcgccaccagctccgcccggcagcctggtgcagatccacgcgcttcgcgtcccaggcgtgccgcgccaccgccccattcgcccgcgccgactggcaggccgcctgcgccatcctcgccagcaacagcacgggcggcgccggccacgatgccagcagcaacaacaacgcgcagccagcgccgcgggtcaacggccagaagcccccgccagccctggaggcgacgccgacgccggacgagctggatctggtgcccgtgtccaacctcccccgcccgctcagcatcagcgacctgtccccggcgcccatgcacgggtcgcagctccgcgtggcgtaccagggcgtcccgggcgcctacagcgaggcggccgccgccaaggcctacccaggctgcgacgccatcccctgcgaccagttcgaggtggcctttcaggccgtcgagctctggatcgccgaccgcgccgtgctccccgtggagaactccctcggcggcagcatccacccccactacgacctcctcctccggcaccgcctccacatcgtcggggaggtccagctccccgtccaccactgcctcctcgcgctccccggggtgcgacgggagctgctcacccgggtcatctcccacccgcaggcgctggcgcagtgcgagctgacgctcaacgccatgggcctcaacgtggcccgcgaggccttcgacgacaccgcgggcgccgccgagcacatcgccgcgggggggctccgggacaccgccgccatcgcgtccgcgcgcgccgccgagctctacggcctccaggtcctcgccgccggcatccaggacgacgccggcaacgtcacccgcttcgtcatgctggcgcgggagcccatcatcccgcgcaccgaccggccgttcaagaccagcatcgtgttcgcgcacgacaccgacggcacctccgtcctcttcaaggtgctctccgccttcgccttccgcgacatctccctcaccaagatcgagagccgcccgcaccgccaccgccccatccgcctcgtcgacgacgccaacgtcggcaccgccaagcacttcgagtacatgttctacatcgacttccaggcgtccatggccgacgtccgcgcgcagaacgcgctcgcggagatccaggagttcacctccttcctcagggtgctcgggagctaccccatggacatgacgccgtgggacgccgcgctctcctctcgcgccagccagtactagtgattgggcgagcaatggtcagccagccaaggcatagcgccaattcattgctttttaatcagtcagtcatcacaagaaacgttgctttggttctttttatacacttctctctcctgcatgctttttctttgcttcgaattcggtgaccaaactcgcagaaggggctcctgtttaatacgtatggtaagtacagtgtattctttcttctttacaaacctactctctaccttgcagcaacaatcaagtgaaccaatccaaaccatcacttctatttttttgcaacaaacaagcattgctgcctgaatctgtatgagcagcanccaaaaatgatccatggccatggaaggagcttggtgtttctgttgttggtgcctcttgggacttgccgcctagttggcgtttacatttttttgattgccttgtccttcaattacaagctatactatctaaacccangcacacctactctgagcttagaactacaatctataacgaaaataactaaaatacaagcacccccctgagagacaccgaaggcggcctccaatgatggtaagcacctccaatgatgatgagcacgtttctctgactattatagtacatctatccataagacaacactacaaaaaaatagaaaagctttaagagcttgtttggttagttcttagtagaactaggttgatttaaatctcaaacaattcaatttttttaagtttttttaatcccatctaatttatgtataatgggaataaccgaacactgttccagacaaaaaaaaaacctgggtgagccagcgctcgaatcccagctggctgcgtttacatttgggaggaagtctgggagacaacggcggcgggattggtacttgcatggcttctagtcggatttggtatcctcgttaagcggcgaagtcgttgatgagacaaacccaacgtttatttggtcacaccagatacgtgcatcaaacaccatcacaaagcggcggcggctacccttttggtggctcgcatgtcgcctccgtaggccatctcaagtggaacggtggatatggacgtataaaattaaatagtgttttatatcttagactatattataaagtagattttaaaaatagttttgtaattttaaaatagagactatgataaaatgccattcaagatagtaaaaggaagtaacaaccttttcaaaaaaaaatagtctaaaataaagtaacaacattttcaccttcgtgagtgactagctagcacgtcatggagctctattcaccgtcaccgatagattgctcagtttccttcttcaaagattatttgcctatccgcttataaatagttcacagccacttataaatagttatggtctgatgcctatgtgagatgaacattatgactacattgtctggcgctctagttgcttctagtctgacacctgatctgacatctttgttcactgccagttagagaatatgtttctaaccttatggttcgatgtctccgtaagtcgaacattgtggtccaatgccttgtaatccctattagattgcagtgaacctcaggatcaccttaagtctctagaatacccatctaaaagatctacacctcaatgatgattgtgataaaccctaatctgactgaggggtgcacatggtatacctttttggctggtgttgatgttggcagtgttctcgagggcagtggcacttgttgatgttgacgctcctccctttggagctcctcctccagtggctccaccatctcctacagtagctccgacgtggttgtcatactcggtgttagtgagatcaatggggggctcctcgaccattcctcccgcgagggatggcgacactgtggaagccattagaagtggcaattctagtcactggtgggctaaggtgatcagaaccttttgaatgtggtagctagggtttcgagcgtaggcgcgttggcgttcgtgctggtctatgcctcctttttataatgtcaccgtgatcgggggccacaatcatgggtgtggtcgtgcccccgatcagggcacttacatgaccacatgaatagggaaatgttccctagcttctctccctttttgttactagagaacatatacgtatcttatattctcccctttgttctctaggcttcttgttctttaacttctctaggtttcatccattgacaagttcacataccatatgtttctttccttgtacgacaacaccctttgattgttgagagcacctagagaggggtgaataggtgatcctgcaaaaataacttaaaacaacacaagcttggtctaataattaagttagtgcaaactaaaaccaagtttgggtgagaagaagagtgaaaagttcccttcacttgattgctcttccaagatatgaatgattctaagagcaatattacaagtgagtagagaaaacttatgaagaagaaaaatcgctataatgtaaatgagacaagagacatggtgatttgtatcatgtggttcgatcaagcgtaatatggttgcctactctacgttgtggtgtcccaatgaacaaggccttcactcaacccctctcaagcgatcacaacgatcaacttgagtgtcgtagtcttcccttatcacttatatccctttgcgaggaatcttcacaacttggagtctctcgcagccttacaaatgatcaaaatcacaacttagagtaagggagggagatagaatgcacccacaagataaaatcacatc

SEQ ID NO: 10134 - DNA, 1693 bp, Zea mays
cattgggtacctcgaggccggccgggagcttctcgctctgaagcttcaaacttaccccagttacccggcgcggttccttccttctgccgagcagagagcacaaaaccaagaaacagcagaggcggagaggtagctacctgaaccaatcggtgttgcaatgtctgcagcgggtatcaccagggcgccgatcgggcagaatccgaggctcgggtgctacgccccggggaggggcggaggcgtggtgaggtgctcgttgcagggcgcggtcgtcggcggccgggcggagtggcagagcagctgcgccgtgctgtccagcaaggtggccgcgctcggtacgcactccgtcaacggccacgtcgcgccggcgccgactcagaacggggcggtgctggatttggtccccgtgagtagtagtagtatcaatggcgccatcaccaagaacctgccgcagccgcttcgcatcgcggacctgtccccggcaccgatgcacgggtcgcagctgcgcgtggcctaccagggcgtgcccggcgcgtacagcgagaaggcggccgggaaggcgtacccgggctgcgacgccatcccctgcgaccagttcgaggtggcgttccaggccgtggagctgtggatcgcggaccgcgccgtgctccccgtggagaactcgctgggcggcagcatccaccgcaactacgacctgctgctccggcaccggctccacatcgtcggggaggtgcagctccccgtgcaccactgcctgctggcgctgcccggggtgcgcaaggagtgcctgacccgcgtgatcagccacccgcaggcgctggcgcagtgcgagcacacgctcacggccatgggcctcaacgtcgtccgcgaggccttcgacgacacggccggcgccgccgagtacgtggccgccaacggcctccgcgacacggccgccatcgcgtcctcccgcgccgccgagctgtacgggatggaggtgctggcggacggcatccaggacgactccggcaacgtcacccgcttcgtgatgctggcccgggagcccgtcgtgccgcgcaccgaccgccccttcaagaccagcatcgtgttcgcgcacgacagggagggcacctccgtgctcttcaaggtgctctccgccttcgccttccgcgacatctcgctcaccaagatcgagagcaggccgcaccgccaccgccccatccgcctcgtcgacgacgccaacgtcggcaccgccaagcacttcgagtacatgttctacgtcgacttccaggcgtccctcgcagagccccgcgcgcagaacgcgctggccgaggtccaggagtacacgtccttcctccgggtgctcgggagctaccccatggacatgacccccatgaccgccggctcctcctccaccgttgtttcctcgtccgatgatccctcgtcgtcttgattgccgttggaggctggagctagctccgaggagaagtcgtcgagtagggacgttggttttctgctcatgtcgtcctactcgatcgcccctcgctgcagccggagtagttaattttgagtttcctttaatctttcatggtaatagtattatgtacgtgtaattgttcaaaatcatccgcggtgaatatatctgtgaaacagtactacatgacattcataatttcatattaatcagttttcagaaaaaaaaaaaaaaaaccactac

SEQ ID NO: 10135 - DNA, 2290 bp, Zea mays
attgattagtctccgtttttaaagattaaaccgccatatgagttttggatggatgtggtttgtccctattgtgggaggtaagtgactaaagacttattttccaaatcagtttagataaaacggttaaaggtgggatcacgtctaacattttcccgtgtgagctggggttagtttacgtttttcccgtgtgagctggggttaggttatgttggtttggtgtggcggagatacattgtcacggtgaccgaactaaccaccctccccgtcccggaccccccggggcccgactccatgaacctgcgcccacgcatccccaccgcgccaccaaccccttgcactccaaacgccggcgccccctatatatcggtcgccacctgcccttgccctcctcagcttctcgctctgaagcttcaaactaccccagttatccggcgcggttccttgcttgtgtcgagcagagatcacaaaaccaagaaacagctgaggcgccgcgcgcggaggtagctgcctgaactaatcggtgtcgcaatggctgcaacgagtatgatcagggcgccgattgggccgaacccgaggctcgcgtgccacgccccggcgaggggcggcggcgtggtcaggtgctcgttgcagggcgcggtcgtcggcggccgggcggagtggcagagcagctgcgccatgctgtccagcaaggtggccgcgctcgggacgcactccatcaacggccacgtcgcgccggctccggcgccggcgccagcggtgctggatttggtccccgtgagtagtatgaatggcgccgtggctaagaacctgccgcagccgcttcgcatcgcggacctgtcccctgcgccgatgcacgggtcggagctgcgcgtggcttaccagggcgtgcccggcgcgtacagcgagaaggcggccgggaaggcgtacccgggctgcgacgccatcccctgcgaccagttcgaggtggcgttccaggccgtggagctgtggatcgccgaccgcgccgtgctccccgtggagaactcgctgggcggcagcatccaccgcaactacgacctgctgctccggcaccggctccacatcgtcggggaggtgcagctccccgtgcaccactgcctgctggcgctgccccgggtgcgcaaggagtgcctgacccgcgtgatcagccacccgcaggcgctggcgcagtgcgagcacacgctcacggccatgggcctcaacgtcgtccgcgaggccttcgacgacacggccggcgccgccgagtacgtggccgccaacggcctccgcgacacggccgccatcgcgtcctcccgcgccgccgagctgtacgggatggaggtgctggcggacggcatccaggacgactccggcaacgtcacccgcttcgtgatgctggcccgggagcccgtcgtgccgcgcaccgaccgccccttcaagaccagcatcgtgttcgcgcacgacagggagggcacctccgtgctcttcaaggtgctctccgccttcgccttccgcgacatctcgctcaccaagatcgagagcaggccgcaccgccaccgccccatccgcctcgtcgacgacgccaacgtcggcaccgccaagcacttcgagtacatgttctacgtcgacttccaggcgtccctcgcagagccccgcgcgcagaacgcgctggccgaggtccaggagtacacgtccttcctccgggtgctcgggagctaccccatggacatgacccccatgaccgccggctcctcctccaccgttgtttcctcgtccgatgatccctcgtcgtcttgattgccgttggaggctggagctagctccgaggagaagtcgtcgagtagggacgttggttttctgctcatgtcgtcctactcgatcgcccctcgctgcagccggagtaattaattttgagtttcctttaatctttcatggtaatagtattatgtacgtgtaattgttcaaaatcatccgcggtgaatatatctgtgaaacagtactagatgacattcataatttcatattaatcagttttcggaaactctgaacactttccactactactactactagttgctatgaaaaaaaggaggttaaattaaaggaaacaaacacctgctttttcactacaaagcctgaagttttgactgcatcccaaatgggtaggtgggattgaatggcatattgctggccaatgcgatgcatctagcccactctgtccgcccatgtcacacacatttcctggaagttgaacgaaatcgtcaggaaagtggagtggaaaaaaaatgtgttg

SEQ ID NO: 10136 - DNA, 2373 bp, Zea mays
gggtacctcgaggccggccgggagcttcttgctctgaagcttcaactaccccagttatccggcgcggttccttgcttgtgtcgagcagacatcacaaaaccaagaaacagctgaggcgccgcgcgcggaggtagctgcctgaactaatcggtgtcgcaatggccgcaacgagtatgatcagggcgccgattgggccgaacccgaggctggcgtgccacgccccggcgaggggcggcggcgtggtcaggtgctcgttgcagggcgcggtcgtcggcggccgggcggagtggcagagcagctgcgccatgctgtccagcaaggtggccgcgctcgggacgcactccatcaacggccacgtcgcgccggcgccagcggtgctggatttggtccccgtgagtagtcccacgcgcccccccgcgcggcccctgccgcagccgcttcgcatcgcggacctggccccggcgccgatgcacgggtcggagctgcgcgtggcttaccagggcgtgcccggcgcgtacagcgagaaggcggccgggaaggcgtacccgggctgcgacgccatcccctgcgaccagttcgaggtggcgttccaggccgtggagctgtggatcgccgaccgcgccgtgctccccgtggagaactcgctgggcggcagcatccaccgcaactacgacctgctgctccggcaccggctccacatcgtcggggaggtgcagctccccgtgcaccactgcctgctggcgctgcccggggtgcgcaaggagtgcctgacccgcgtgatcagccacccgcaggcgctggcgcagtgcgagcacacgctgacaggcatgggcctgaacgtggtccgcgaggccttcgacgacacggccggcgccgccgagcacgtggccgccaacggcctccgcgacacggccgccatcgcctcctcccgcgccgccgagctgtacgggatggaggtgctggcggacggcatccaggacgactccggcaacgtgacccgcttcgtgacgctggcccgggagcccatcgtgccgcgcacggaccgccccttcaagaccagcatcgtgttcgcgcacgacagggagggcacctccgtgctcttcaaggtgctctccgccttcgccttccgcggcatctcgctgaccaagatcgagagcaggccgcaccgccgcaggcccatccgcctcgtcgacgacggcaacatcggcaccgccaagcacttcgagtacatgttctacgtcgacttccaggcgtccctcgccgagccccgcgcgcagaacgcgctggccgaggtccaggagtacacgtccttcctccgggtgctcgggagctaccccatggacatgacgcccatgaccgccggctcttcctccaccgtttcctcgtccgatccctcgtcgtcgtgaattgccctcctggatgctggagctccgaggagaagtcgccgagtagagacgttgggtttctgcttatgtcgtcctactcgcccgcccctcgctgcggctggagtaattagttttgagtttactttaatctttcgtggtaatacgtgtaattgttccgcggtgaatataatgtgagatatatagtaccagtatggcattcatgttcgtctgatctcggtctccttctccccgttgttgctagtacaaaagaattgcaggttaaattaaaggagaaaacacctgcttttcaactacaaagcctgaaattttgaccgcgtccaaaatcataaatgggtaggtggggtggggatggccaattggatgcatctagccccctctgtgcgtccatgtcgccacccatttcctggaagtggaacgaaatcgtcaggaaaatgaagcgaaagagaatgtgttgatgccatcagcgatagcatgcgcgttgtttggtctttgaaagaaaagaaattaagggaggtgaactgctcccctctactacgtatataattatcaatgtagcctcattgctcacgtgtttgtggtgagacattgacgaatctcacgttatatcagagacggacgagccggcggagggccgccggaccccaggacagcaacgtcgcaccctacaccacgcgacggccggccacccacgcagactaacacagcagccacaggctgttccacaaagaccgcaatatatagatatagctcctagagctgaatataaaacagagggtatcggcatcaggattcggatcaattatatacactctttccaaaaagaagggtttcaacccatgatggtctcgacgccaggaagaaatagcacgtagacagacgactattataggaccacctacagcatacccaatcaaattctaattaaagatgggcgcaacaattttaaatgtccatcaattgtatctac

SEQ ID NO: 10137 - DNA, 1710 bp, Zea mays
gcacgagaccattaccgggtacctcgtccccgccggacattccatcggtcgtgaaaagaaaaagggaaacaaaccaagctagctagagaaaagaagaagctggtactagctagctagctagcttagctatgggcaccatcgtggacgctgacgtcgggttcgcggtgaagaggacgagcaggtcgctggtgccgcctgcgtcggcgacgccgcgggagacgctgcggctgtcggtgatcgaccgcgtggcggggctgcgccacctggtgcggtcgctgcacgtgttcgccgcgggcggcgacaagaagcggcagcaggcgacggcgacgccggccaaggcgctgcgggaggcgctggggaaggcgctggtggactactacccgttcgcggggcggttcgtggtggacgacgcggagggcggcggggagacgcgggtggcgtgcaccggcgagggcgcctggttcgtggaggccaacgccgcgtgctcgctcgaggaggcccgccacctcgaccaccccatgctcatccccaaggagcagctgctgccggagccctcgccggacgtcaacccgctggacatgccgctcatgatgcaggtgacggagttctcgtgcggcggcttcgtggtggggctcatctccgtgcacacgatcgcggacggcctgggcgcggggcagttcatcaacacggtggcgacgtacgcgcggggcgccacgtccgccacgcccaagcccgtgtgggcgcgcgacgtgatcccggacccgcccaagatgccggcgcctccgccgcgcctggacctgctggacctgcgctacttcacggcggacctgagcccggaccacatcggcaaggtgaaggcgcggtacctggagtcgacggggcagcgctgctcggcgttcgacgtgtgcgtggcgcgcacgtggcaggcccgcgtgcgcgcgctgcggctccccgacccggccgcgcccgtgcacgtctgcttcttcgccaacacccgccacctgcttccggcggcggccacggccgggttctacggcaactgcttctacacggtgaaggcgacgcgggcgagcggggaggtggcggcggccgacgtggtggacgttgtgcgcgccatccgcgacgccaaggcgaggctgggcgccgacttcgcgcgctgggccgcgggcggcttcgaccgcgacccctacgagctcaccttcacctacgactcgctcttcgtctccgactggacgcgcctcggcttcctcgaggcggactacggctggggcaccccgacgcacgtcctgcccttctcctaccacccgttcatggccgtcgccgtcatcggcgccccgcctaagcccaagcccggcgcccgcatcatgaccatgtgcgtccaggagcagcacctgcccgagttccaggagcagatgatgagccagcaggccgcctaggcctagctagctcctgatcatccatgttcatctatatcgtcatcgtcatcatgcatgcggcgtgcacgtttggaatatttgttaatcaatcaataacggtgaggtgaggttgctattatatgaagtagtagtaacacctcaacaacaacaacccaatgcaatgggaactcgcgtgtaatttgctccttcttcttcaaatataattccgcctcaattgtatgtatgtatgtattaaaaaaaaaaaacagacaaaactaaagctttttgtttcttt

SEQ ID NO: 10138 - DNA, 635 bp, Zea mays
acattccatcggtcgtgaaaagaaaaagggaaacaaaccaagctagagaaaagaagaaggtactacatactagctagctagcttagctatgggcaccatcgtcgacgctgacgtcgggttcgcggtgaagaggacgagcaggtcgctggtgccgcctgcgtcggcgacgccgcgggagacgctgcggctgtcggtgatcgaccgcgtggcggggctgcgccacctggtgcggtcgctgcacgtgttcgccgcgggcggcgacaagaagcggcagcaggcgacggcgacgccggccaaggcgctgcgggaggcgctggggaaggcgctggtggactactacccgttcgcggggcggttcgtggtggtggacgcggagggcggcggggagacgcgggtggcgtgcaccggcgagggcgcctggttcgtggaggccaacgccgcgtgctcgctcgaggaggcccgccacctcgaccaccccatgctcatccccaaggagcagctgctgccggagccctcgccggacgtcaacccgctggacatgccgctcatgatgcaggtgacggagttctcgtgcgggggcttcgtggtggggctcatctccgtgcacacgatcgcggacggcctgggcgcggggc

SEQ ID NO: 10139 - DNA, 5096 bp, Zea mays
  misc_feature (3879)..(3879): n is a, c, g, or t
  misc_feature (4552)..(4552): n is a, c, g, or t
acccctgctcgctgtgtcttctgtcttctccacttcgccctgcgtacgctccccagtctcactctctctccccctctacctcgttcgtggcgacgacagggcgaccgccgctgccaccgccgcctctccactgtgggcctggtgctttgcccggccgttcgccggcgacgggcactcaccaccaggtgacaaaggaaaaggaagaggggcagcaaatcggtgcgctgctgttcatcaaatgctggggaggaaatcaacagatcaggggcctggtgaaatgctgcgcagcgagggtgactgactggccactccgcccgccgacccccgtttcgtgcttactggcatgctcgcagcataaaggaatcttctcggaattagccccccttcctgtggtcgtgacggccccaagtttcaagacatggaccatgtgccggctctagttcttgccgggtgctgcttcctggccctgctgcctggctgggcctgtggccttggctccatgtcgtccattgcggtgtcctatggggaggatggtccggtgttctgtggcctcaactccgacggctcccacctcgtcgcctgcttcggtgctgatgcatctgtcctgtacggcgcaccacccaacatccctttccttggcctcacggcaggggatgggttcgtgtgtggcctcctgctcgacaccaggcagccatactgctggggtagcaactcctatgtcaagagcggggtgccacagccgatggttgagggcgcaaggtactctgagctcagtgcgggggacaaccacctctgcgcactgagagctgctcaagatgggggtcgtggttccagtgctgctacatcgctgattgactgctggggatacaatatgaccgccacacatgctgttgatgaagccgtgtcgactgtttcagctggttcggtgttcaattgtggcttgtttgctcggaacaggacggtgttctgctggggcgacgagacggtgagtggtgtcgttgggctggcaccgagggatctgcactttcagtctataggcgcgggcggttaccatgtctgtggggtgttggagaatgcacaggtgttctgctggggcaggagcttggagatgcagcaggtggtgccatccagtgctatcggtgatggtgatgtgaacatagtgccgatggatgcaatgagcactgtggttggcgggcggttccatgcttgtggcatcaggagccttgaccaccaagtggcttgctggggcttcactcttcataacagtacatcgccaccaaaagggctgaagatgtatgctcttgtggctggggattacttcacttgtggagtgcctgctgagacttcgctgatgccgaggtgctggggcaacagtgggccattggcattacccatggccgtacctcctgggatttgtgtacctactgcatgcagccatgggtactatgaatatgtgaaccatggtgaagttggcagcatcaaggtgtgtaagcctgcaaactctagactctgcttgccctgtagtacaggttgcccggaaggcttgtatgagtcatctccttgcaatgcaacagctgaccgtgtttgccagtttgattgcttgaagtgtgtcacagatgagtgcctgtcattctgcttatcacagaagcggaccaagagccgcaagttgatggcttttcagatgcgcatctttgttgcagagattgtctttgctgtcgtcttggtactcagcgtgtcagtaaccacttgcctgtatgtccggcacaagcttcgacattgccaatgctcaaatagagagctgagactggctaagagcacagcatactctttccggaaggataacatgaagatccagcctgatatggaggacttgaagatcaggagagctcaggaattctcctatgaagagttagagcaagcaaccggtggcttctcagaggattcacaagtcggcaaaggcagcttctcatgtgtattcaagggcatactgagagatgggacagtggttgctgtgaagcgtgcaataaaagcatcagatgtgaagaagagctcaaaggagtttcacaacgaacttgacctcctatccaggctcaaccatgcacatttgctgaatttgcttggttactgcgaggatggcagtgagaggctcttggtttatgagttcatggctcatggatccctgtaccagcatctgcatggcaaggatccaaacttgaaaaagcgactaaactgggcaaggcgggtcaccattgctgtacaggctgctaggggaattgagtacttgcatggctatgcttgccctcctgtaattcaccgggacatcaagtcgtcaaacatattgattgatgaggatcacaatgcccgtgttgctgactttggtctgtctatattgggtcctgcagatagcggtaccccactgtccgagctgccagcagggactcttggctaccttgaccctgagtactaccgtctccactacttgactacaaaatctgatgtctacagcttcggggttgttctcctggagatactaagcggcaggaaagcgatcgacatgcagttcgaggaggggaacattgttgaatgggcagtacctctgatcaaagcaggggacatttttgccatccttgatccagtcttatctcctccctcagaccttgaggccctcaagaagattgcttccgtggcatgtaagtgtgtcagaatgcgaggtaaagatcggccttccatggataaggtgacgacagctctagagcacgcccttgcactgctgatgggcagcccctgcatcgagcagcccattctaccgaccgaggttgttctcggaagcagccgcatgcacaaggtgtcacagatgtcctctaaccactcttgctcagagaacgagcttgctgacggggaggaccaggggatcgggtacagggcaccttcctggataacttttcctagcgtgacctcatcacagaggaggaaatcatctgcatccgaagctgacatcgttggtcgaagggccacagacggcaggaacgtcgggagcagcataggtgacggactgcggtcactggaggaagaaatcgctccagcttcaccacaagagaacctgtacttgcagcacaacttctgaagaaattcaggagatgcaggaacctgagcagcgactttctgccattgttgagcagtattttaagttcggcctttcatgccctgttgaagtgttcatacgttctatataatagcagcctaaaaacagggagctaattagtactggaagaattctttttagcgtccagaagcattcatctgtagattcgtatggtcccttttattttcctggtacaatttatcttctggtggctgcagttgatggattatcgtgtatccttagcttgcaaaactgggtagtttccttaatccttcagatcatctctctggctcccgatgctgtttctgcatcctaaatggcagtagctttgggaaccaactgcatgtctgggtcgggtcaccatgttcagcattctttcgcttgtatccttgtggaaggtttcttcagttgcttgatttgtgattcgcagcaacaggctgtctgcccattcttctcttcagagacaggtgagatgtggttctcagaggtctacctcagcaatggctgctgtcatgttccatgatcctgtttagggtgctgttttgaacacaatgaaaggcaggttgttgctaaccatttaatgtttcttggacctagctaacttgccattatgtctgatgcctgatgccaatgcttcttccagaagtcatcttagtttgtaaggccgtacgcactgaatgaattttattgcttctgggacagaaaagattcaataatgtctcaggctttcatctttnatcccttgtgatcagtattggccttcgcctgggacaagagcggtgttgcaaatcctatcacaatgttttagctctctacactgcaaaatttttatggaaaatctgaagaaaggaaaaagggaaaattgggatgacaagtagggacttgcgtcgtatgcaaaaaatcaatataattagcacaaggtgggaaatttaacttcaaccatcaatcaccaatgtgtcaagtttgccttgaacagtaattttacattataccaacaactctgtcgtgttttctacacgcatcttcttgtaccagttgcactattttgtgacttaatgtgccatttttcttttgtaaaaaaagtttttccccgggcagaactatatatgatgcaggttacacgtggacgaggcacccacaagagatgtgtaagaatcagggttaaccataccgtttgctattaaaaaaattcacccaccggttttatattctaaattcaaaattttcaaaaaatggtttacggacaaaaaccagctgtaaatcggttaaaccgtcgggaaaacaacaaaaatcgacgggaaaccgattttaggttttattaatcttttgacagttttttatttttcaaattcaaataaaacgggattttgatatttcttggcggtaaaccgatgtatttttgcagattcntcttgtttttattgtttttaacaaaaaatgctgattaatttaaaaataaaataaaataaatatgaggtgtactagaaaaatatttagtcctttatcatattttcttttgatttttataaaattttcaatttcgttgaatttggaacgaaatttgaaaagaaaccggtgggaaaccgttctcggggtaggcggtttcaaaaaaaaaaaaaaacatgcagtaaaccgctggtttccacctgtttttatttctctagtaagaactaggggccaccttttgttgagcataagtaggtgattggattggtggattgtccgtaatggcgtaatggccttttatcgtattatggcaaaacattttttgtccatcccctacaagaaaaaaacaaaatttcgtcggccaagctaacttcctcgacatttagggtgtgtttggtttgaggaataaagtgattcatcttcttctcactcctcatatttttattttgtttgttgaatagaatgagttggtccatcaccaccacattcctcataagctaataattag

SEQ ID NO: 10140 - DNA, 731 bp, Zea mays
  misc_feature (730)..(730): n is a, c, g, or t
ccggccggggccttcgatctgcttcgtcgcctcctgttgtttgtggttgtggccagtccttcccctctcatcccgggccccggggaaaattttgcccccagaaaccctagcgcgtcggatcagcaagggcaaaattttctgcgactccggctgaaggacgctgcggcacctatgtcggacgacactggccgcactatacccaagttcggcgaatgggacgtgaacaacccggcctctgccgacgggttcacggtgatcttcagcaaggccagggatgagaagaaagccccggcccaaggccacatcagggacaggtcggcgtcggccgacagcaaggactccaggtccagggacgagaagatgacctcctacagctccaggaccaacgcatcgaagaaatggttctgctgtgtctcgcccagtcccacacagtcttgaggaagctaatgagccgtgcagtgctgcagtttctgtgatggttatgcgtagctcttcgaattcaatcctatactgcttgccagtgacaggggctctatgtatagccattgcaaatgagaaaattactctgatgggtgtctgcttatagcgttcttagctgtgtataccatcagttcaagctgatgtctgcttgtaattttcttttctggccccttctctatggtgtaacccttcctcaacgttatcagtgaatctgagctactcctcaataaaaatttgcggactttgcggnc

SEQ ID NO: 10141 - DNA, 3482 bp, Zea mays
agtgacaagcatcgcattcgcaatgcatcgcaccgcttccgttcgtttccctcgaaaagtccggtgcctatccctgtcgtgccgtgtcgctgacgtaatgctgggacccatgcgtcagcgattggaggtcggccagtcgactcgggtctccaaacccatagaagccgtccatctccctccgtcggacgatcacggccatcaagtgcgcaaaccgcgtggtctgctcggctgctcctcgtcttcttccgcttcgtttcggtttctcctcgaaaagtccaaaccaaaccccaacagaaggagcaccggcagaagaagcagcagcaggactgcgcccggcccgcccgacgccatgtccatccgcaaggcactgggcgcggtgaaggaccatgcgacgatcggcatcgcgcgggtgacgggcgccgtggcgcccgacctggacgtggccatcgtgcgcgccacctcccacgacgacgcgcccccggacgagcgccacgcgcgggaggtgctccgcctcgcgtccgccacgggcgccgcccccgcctgcatcgcctcactcgctcgccgcctctcccggacccgcgactacgtcgtcgccgccaagtgcctctcgctgctgcagcgcctcgcctccgccgagggcgacgtggagggcggagccggcacgcggccgttcctccacgagctgctccgccccgccgtctcgggccgccgcgcgggagagcccgtcctcgcgctgctcctcgacttccgcgacgacgcacacccggggtcctgggaccactccgccttcgtccgcgcctacgccacctacctcctcgaccgcgtccgcttcctcgtcctgctcctccccgcgccgccgcgcttttccgacggccgcgtcgcgccgggaccaccgcaggcgccggcggacgacatggacgcggaggcgctcctgggccgcgcgcgccacctgcggcacctgctcgaccgcctcctggcgtgccgccccgcgggcgccgccggtgccagccgcgtcgtgcgcgccgcgctccacccgatgctcagggacagcttccgcgtctacgaggacgtggcgctcctgctcgccctcctcctcgaccgcttcttcgacatggactactccgactgcgtcaaggccttcgagacctacgtcggcaccgccaagcagattgacgcgctccgggccttctatgcctggtgcgaggacgccggcatcgcgcgctcgtccgacttccctgacgtcaagcgcgtcgacgacaagttgctcgagacgatggagcagttcctgagggagcgcggcagggcggggcgcgcctgggcatcaccgccggcgccatcacgactcgcacaccagcctgatgcgaacgcgcaaggcgacgacggccatgtcgacggcatgaacagcatcaaggtgctcccggcgccgtcaacgcgctccatcggcgctgagcctgccacacccagaccggcggaagaggccagtcagtccgacctggtggacctaagagaaactgctgctaccgcggacgaggagggcaacaagctggcgctcgcgctcttctctgcgccgccggccacgaacggcagctgggtcacgttcccatcgggaccggacgccgccccagagccagcggtgacctcggcgtggcacacgcccgccgcggagcccaggaatgcggattgggagctggcgctggtggagacggcgagtaacctctccaagcaggcggcttcgctgggtggcgggatggacacgctgctcctgggcgggatgtacgaccacggcgccgtgaggcggcaggtggccgcgccggggagcgcgagcagcatggcgctgctgcccgggcatcaggtggctccggtgctgatgctcctgggccccgacggcagcacagcgcgtcaggtggccgggggcgacccgtttgcggcgtcgctggcggtgccgccgccgtcgtacgtgcagatggcggagatggagcggaagcagcagctgctggtgcaggagcagcagatgtgggcgcagtaccggcatggtggcatgcaggggcagcccgccgggttcaacaacggcctcgccggcggcagcgtgttcgcgccgaacgccgccatggccgtgccctatggggggtatgggtactattaacgatgcgactgcgagccttgctaattttccgcgatgaatgatgaagtctttgtcagcaaaccagtatcagcagaggtaactgaagtgttgggccaggaagataaggctgaaagtgtccatgggctgaaaaggagcgacagatctgggccagagtggatggcgtgaggcaaatgctgcagcagaagatggccgtaatagtgtcgcttgagctttaagctagtgggctttgtgctggcatgtaataagtagtggaaaggagttggagaaaggcatcaaagattgtaactgaattctgtttcctaagattctctcggctgctgccgttcttcccgcgtctcctgctccattcttaccttccctgcttctccatctcaagagttcgccaccagcgatcttcccagccaccaccacgttaacatcctcgccctccgtcagccgcctcgccccttcccagtccgcgcccgtctcccgtgggcgggtggccgttcgcgccatggacgagtgggacgagactacgagaggagccaggaactgtagcgcgaaaatatcgaggggaaggcgtacgtggattcatgggacgaccggatgcgagagacctgtgcgctgctgaagcaggtgcgggagccgggctctcggggatcgtaacctcaaggactcggagaagcaggagatgtacggttgcacaaggaggaccccgcgacttacatcgtggagcggctagccaaggacttccgcgtcatgcgacagcgcgtgcacgccatcctctggcagtctggctcaaggagatggaggaggaagaggagaggaagaggggtcagccactcgacaactccatcgaaatccagctcgacagttgcccagagtacgtcaaatagttggttttctgtttaaatataaatactccaggttcttatagtttaggcttgtttaagttcagaagcaatcgaaagtgttaaataagctagaaatatacataaactcatgggtatcggttaataacattaatttgttagttgttgcaccatgtgaatttccctcgatagaattatcaattgttctaaaacataaacacatttgcaaggcttagtttagaacttagaattatatgattgaaggaaaacaaacctgtatggctgtatctcttttgaaatggatgctgtagtttggcgctgtctcaaatatatgatagatgtatagtcaaataaatgaagtgattgacaaattcttttcagggtatgagatgcactcagttagatatttggtatatataaaaacttgatgagttcatcatatctttgttaattgcagttgttaatggatgtaaggttttctgcaggca

SEQ ID NO: 10142 - DNA, 1525 bp, Zea mays
gcatcaaacatgtcttaccatgtcaaaaaatccatacaacaaacatgcctccacctatattacaacatatcgtcgatgcctatctacaattggggtattggtaactgatgaaaacatttaatcactctcccattctctaaaagaatcgtcatcctcctcctcattattgcctgaggtaattggtacctcaaacatttggagctatatggtgtgggacaaaggatgcctcagagttgtccatctcatccactctatgtggcggcggagatggcggaggtgatggttcagaaatgtctacgtcatcagataccaacgatacaggtggcggcgaaggtggatcatcagtgtcgtagttgcttatcgaaatggcatcattgttcagcgtctcctcgggtgttaggtacaatgatgacaaagatgacggtgttgtgtacatctcatcggatgtggtcatcgtctcctcagttgttcggtagaatgatgaaaaagacgacgacgttgtgtacatctcatcagatgtgtggtcgtcgtctgggattcaccactatgcaatcggtcacctgtcccgaagatcttggcaaggagatgtcggagcaagcctattccgaaaattctagcaacaagtattgctatgtagaatactactacgagagcctcattggcgatatgaacccacgtgctcatccacccaatatccacgctccattgcttcattgtatgatgtgtgtcccagccgacaaacaccatcctgacgtacatggagcccgccgcgaaggcgaaatggaaaaagccatacccatatgatacgtcgtcttctgactctacaatgtttcataacatagatttggatccaccaggatggagccaagacagagatgagagaacagaccatgaagagggcaatcttcactggccaccacccggagtgccatgaatttctcaactcattcaccttgccggtgcgtacagtggagaagaacatggtcataaaaaagagctgggcgatttgttaaggtcagagcaatcataatacagaaaattgttagataaaaaacaatcacacataataaagagcatggcttgccacgagcacgctttcaaccgcgagacaaccccggtcaccctgacatccgctgagtcgctgcttcaggtgatatgatacggtgttctctcgtgcgaaccacgcagacaggttcgccaggaggaagatagccgcatacaggtatctgacattcatagggctgaggccctgacagtggcaggagaagacacagttcatcgtcatccgtgatttgcttggcggccatagatttagatccattaggatggaaccaagatagagatgaaagaacagcccatctcaagagggcaatccttctctggcgaagagctatctatcctctccaatacaactggcgaggcgagtgcagttgtgagcccgatgaacgacgggggtgtgctgggctgctggctatctgtctaatgcaacgagcgacacgagtgatcaagcagctaccgttgtttt

SEQ ID NO: 10143 - DNA, 1413 bp, Zea mays
gcacgagaccattacctagaacatcctaatcgaaaaagcgatcccaatccccgactcctccggcagcccgcaacgactcgcgccgcctccggtcgcgccgggtccaggtaaagcggcttccatctcctcggtctcagcgcgtcatcccctcctccttcctcttccgtttcccttagggttggagtagacacgtcggctcaaggatccttcgagggtcaggacacttattgattttcaacaaagatctagcatggaaccatcctcacagcctcaaccaatgatgggtgttgggtcacaaccttatcctgctgctgctccctatgtgccagtacctggatctcttgctgttcctcctggctcacagccagcagcagcattccccaatccaactcaactcagtgctcagcaccagatggtgtaccagcaggctcagcaatttcatcaacaacttcagcaacagcaggaacaacagctcagggagttctggactacccagatggatgagatcaagcaagcaaatgacttcaagatccacaccttgccacttgcaaggataaagaagataatgaaggctgatgaggatgtgcggatgatctctgcagaagctcctgttgtgtttgcgaaggcatgcgaggtattcatattagagctgacattgaggtcatggatgcacacagaggagaacaagcgccggaccttgcagaagaacgacattgcagctgccatcaccaggactgatatatatgacttcctggtggacataatcccgagggatgaaatgaaagaggaggggctcggacataatcccatagttggcctgccgcctgctatgggggctccagctgatcatggttctcatccatattactatgtgccagctcagcaggtgcaaggagcaggtatgatgtatggtggccagcagggtcacccagtgacttatatgtggcagacgccgcaagggcaagcggcagagccccccgaagaggagcagcagcagtctgcctgaatgtagcaaatagacgataacagcaaagcaattacatcttgatctgaagttctgaacttagttctctaaacaaacaaatatgatttggttatgttaattgtgcagatgattgcaggctgaaacaattgtcgctaattaggtgtcatagcctcatagggtttcctaatggtagtttcgactcccgacgctgccacggcagcagtagaaaatgattgtaatttgcagactaatgtagtaagattagccttttctgtctaatccaatatacgattgaggccctcgaaaaaaaaaagaaaaaaaaaaaaaaaatgttggtttgccttatttttttaaccattgtgctctttgcttggctagaatattgcctgtcaccaaagtttcgtagttaattccaggctgaactgatt

SEQ ID NO: 10144 - DNA, 2023 bp, Zea mays
aggtaaggatggcccgccggcgtggggaccctcgaggccggccaccgtcattccactccatcagtgggcagcgctctgctctcctccactcacgaactcactcactcactccccttgcccccatccatccgctagccactagctccagcaggctcgccgccgacactccactagtgctctgctctctccgctccactcacaaactcccctcgctccccccccccccacaaatcggcgatggatctgctgctgcggcggcggctgctggccgtggtggccacggcggcggtgctggccgtgtgcgccttcacggcggcggaggggttcgacatcctgcagatcctggggaagcacgacgagttctcgcagttctgcaagctgctcaacgagacgcacctggccggcgacatcaaccgcgaccgcacaatcaccgtgctggccgtggccaacggcgacatgggccacctcgccgccggccactactcgctcggcaccatccgccacatcctcgagctgcacgtcgtcgccgactactacgacgacaagaagctcaagcagctgtcgcacgccgccaccgccgcgtccaccttgttccagcgatccggatttgcccccggcatggcaggatacgtgaacataacgcagcaccgcggcggcaaggtgtcgttcatcgtggacgacgcggcggacagcgtcaagcccgtcacttacgtgaagcagatcgagagccaccgctacgactactcggtgctccaggtcagcggcgtcctgtcctccccggaggccgaggcacccgtcgccccgccggcgcccgtcaacctcaccgacatcctctccaagaagtactgcaagagcttcgcgggcctcctcgccgccgaccccaaggtcttcgacaccctcaacggcaccaaggacaccgcgctcaccgtcttctgccccgtcgacgcggcggtggccgccttcatgcccaagttcaagaacctcacggccaaggccaagacggccatcctgctgtaccacgccgtgccggactactactccatgcagttcctcaagtccaacaagggcaaggtcaccacgctcgccaccaccagcgtcgccaagaaggactacacctacgaagcggagagcaaggacgacaccgtcacgctcgacaccaccgtcgtcacctccaccatccaggccaccgtcagggacgacgacccgctcgccgtctacgcttgctccaagttcctgcagcctaaggagctgttcaaggccaaaaccgctgatctcgcgcctgcgccggctccacaagggcccaagaagaagagcaagaagaagcccaccggcacttcggcggcctccgcgccctcggacgatgaatctgcagatggcccgtctgccgacgacgactcgtccgatgatgccgcggacaaggctgccgccgcgccgtcgtacctgtccgctcgatgggtgaccgccgcagtgacgaccgccgtcgcgctggcgctggcggcgtaaggtgtgcgctcatgtgctatgttttttttataacttattggaccccctatcttcttttcttttgtccaagtcgtgtcccttccttgttggtgaacaaaataagaagggctatttttgtttttttatatttattaccgcattccattaaaaaaaattagaggtgtgtgtgagtgatgtaagtcttgattttgttcattgggttgtggtgatcattttgtaatggtagtggccaatggaattggagagtgggttaagttttcacatatgatactatatataaggcatcatatggagtttagaggtgcagcagtgtttgttgtttacacatgctttcaaatgttagactatataagattttaccctgtacgtaacctattagaacgaataaaactaggttcgtttctttagaagtttaggatgtctccataataggaaggagagactctagcggtcggtgtcagagtcgatgtacaatggtgaaagtgtagaggcatcaatcttctccttaccgtgttagaat

SEQ ID NO: 10145 - DNA, 1687 bp, Zea mays
acgaaaattatctaaacgaaatttagtcagaatcgtaaacctcggatgttccgtttcgtgatccgagaaaataatgtgcgtagtcgtttgccgtatcgtgcatcgactctttgtttatcactaaaaaattgagatccgattatcacaaattgtccgcaatcatggaatcagacgtttagtgcagataaatttatcagaatttcgaatcaaatcaaacctggttcaaattttatcgccagttttgtttgattcgacctgttcatattttttagacccagatttcagaaccccaaatatccgtgattttcgataaaagaagaaagcaaatgtggaaaaatctttaaaaaggaaaaaaaatcgtttcaacctcatccttcggccgccctctctcgctgatcttttccctggaacatgcgtcatctttcttatctgcaattgctccttttctctagatttttcaggttgcatcactcttatccatacacgttggctctctggttattggcgtacccccccgtccgtccgggattctcaacttgtgaacgcagcttcctcctcattccggtgacgcaaggttccctagcaacttcctcagccatcataatctcttagactcctcctgcacacgcacaggctctagaattctctacgcattccttcaccgcatgtcatcggccatgcggttgtgtgctcctcagccaatactttggtacgatgctcagctagtggatgagcacaatcaagtcgctggtaatttttttagttgtcgagctcgccggtgacaccatggccggtcgtccctgctcccccttgcctccctccgcacgcacgccagccgtggttccagctcacatccctggacgttgtgtggttcccagttcgtccatgtcctcttcctccctgctcaattcccatggccggtgctctgctcggattctgcccgccaagctcccagccgagtctcctcccatggcttgagcctccctgttgctcgcgtcatggcctggccccagctccggcccgtcgcggctcctatggcgctcggccatctctgcgcccgtccatggcggttccctgcgcgcctgaattctgctccgttcgggttccgtttgccgcgcccctgcgctcgtcgcggtgctccagctcggattcagtcctgcacgcagccgcttttcatcttcctgctcagctcgctgcgccgaactgcccagggtcgcgcgcctagctcggccgtctctagctcgccttgctccctgctgctcgcccggtcgagctccctgatcgccgcgcccgtgattttcctgcgcttgcatgtctccttgcgcacgcccagcactctggggatttccggatctcgcgcgcccctggctcctctgttggtcgcgcggttgtttcctgcttcctgcgcgcgcgagctcgccatccattttgctcgcctctgcttctgctcggaattcccatggccagagctttcccctagcccggatctcacccagtcgccgagctcggctctgtccatactccagctcgccccctctgtttgctctcgctgctgggtcgggtctgctcggccgccgagtccgatccgctcctctgcacgcagttcaccccaactccagtctgtagtggtcgccagtcgtcgaccatactcccatctcgccggctcgctccagactcgatctcgtcg

SEQ ID NO: 10146 - DNA, 868 bp, Zea mays
gggtacctcgaggccggccgggattctcaacttgtgaacgcagcttcctcctcattccggtgacgcaaggttccctagcaacttcctcagccatcataatctcttagactcctcctgcacacgcaccagctctagaattctctacgcattccttcaccgcatgtcatcggccatgcggttgtgtgctcctcagccaatactttggtacgatgctcagctagtggatgagcacaatcaagtcgctggtaatttttcttgttgtcgagctcgccggtgacaccatggccggtcgtccctgctcccccttgcctccctccgcacgcacgccagccgtggttccagctcacatccctggacgttgtgtggttcccagttcgtccttgcagctcggccatgtcctcttcctccctgctcaattcccatggccggtgctctgctcggattctgcccgccaagctcccagccgagtctcctcccatggcttgagcctccctgttgctcgcgtcgtggcctggccccagctccggcccgtcgcggctcctatggcgctcggccatctctgcgcccgtccatggcggttccctgcgcgcctgaattctgctcggttccgtttgccgcgcgccctggcgctcgtcgcggtgctccagctcggattcagtcctgcgcgcagccgcttttcatcttcctgctcagctcgctgcgccgaactgcccagcgccgcgcgcctggctcggccgtctctagctcgccttgctccctgctgctcgcccggtcgagctccctgatcgccgcgcccgtgaattttcctgcgcgcgcatgtctccttgcacacgcccagcaccctggatctcctgatctcgcgcgcccc

SEQ ID NO: 10147 - DNA, 2440 bp, Zea mays
ccggccgggagtggcctgccctcacctcatcaccaccctgcagaggcttcccgctgtggctgcacttcatccccggcataagttccgcaccgacacgagcctttcaaggcggagatgcagcgcttcacagccaaggtggtggacaccatgaagggggcggggctgtacgcgtcgcaggggcgggcccatcatcttgtcccagatcgagaacgaatacggcaacatcgactcggcgtacggggcgcccggaaaggcgtacatgcggtgggcggccgggatggccgtctcgctcgacaccggcgtgccctgggtcatgtgccagcaggccgacgcgccggaccccctcatcaacacctgcaacggcttctactgcgaccagttcacgcccaactccgccgccaagccaaagatgtggaccgagaactggagcggctggttcctctcgtttggtggcgccgtcccctaccgccccgtcgaggacctggccttcgccgtcgccaggttctaccagcgcggcggcaccttccagaactactacatgtaccatggagggaccaacctcgaccgcagctcaggggggcccttcatcgccaccagttacgactacgatgcccccatcgacgagtacggactagtcaggcagccaaagtggggccacctaagggatgtgcacaaggccataaagctctgcgaaccagcgctcatagcaactgatccgtcatacacttctctaggtccaaatgttgaggcagcagtatacaaagctggttcagtttgcgcagcattccttgccaacatagatggtcaatctgataaaaccgtcaccttcaatgggaagatgtacaggcttcccgcttggtctgtcagcatcctccctgactgcaagaatgtggtacttaatacagctcagatcaattctcaaacgacaggttcagaaatgagatacttggagtcgagcaacgtcgcatcagatggctcatttgtcacgccagaactggcagtatctgactggagctacgccatagagcctgtaggtatcacaaaggacaatgcacttacaaaggctggactgatggagcagataaacaccacagcagatgccagtgatttcctctggtactcaacaagcatcacagttaaaggtgatgaaccctatctaaatggcagccagtctaatctggcagtcaactcacttggacatgttcttcaggtctacatcaatggtaaaattgcaggaagtgcacaaggtagtgcaagcagctcactcatctcatggcagaaaccaattgaacttgtacctgggaagaacaaaatagatcttctaagtgcaacagttgggctgtcgaattatggtgcattctttgacctggtaggtgctggaattactggcccagtaaaactgagtggactaaacggtgcgctcgatctgtcttctgcagaatggacatatcagattggactcagaggagaagatttgcacctatatgatccttcagaagcttcaccagaatgggtctcagccaatgcttatccaatcaatcatccactgatttggtacaagaccaagttcacacctcctgcaggtgatgatcctgtcgcgattgacttcacgggaatggggaaaggtgaagcatgggtgaatggacagagcattggtcgatactggccaacaaatctggctccacagagcggttgcgtcaactcttgcaactatagaggagcctacagttcaagcaaatgcctcaagaagtgtggccagccatcacagactttgtaccatgttccccgttcgtttctccaaccaggcagcaatgatctagtccttttcgagcattttggtggtgacccaagcaagatatcctttgtgatgaggcagacaggaagtgtgtgcgcacaagtatcagaggcacatccagcccaaattgatagttggagttctcaacagccgatgcagagatttggacctgcacttcgcctggaatgcccaaaagaaggccaggtcatcagcagcgtcaagtttgcaagctttgggacaccgagtggcacatgtggaagctacagccatggcgaatgcagcagcactcaggctctctcagttgttcaggaggcttgcatcggagtgagcagctgcagcgtgccagtgtcgtcgaattattttggaaatccatgtacaggggtcacaaaaagccttgcagttgaagctgcatgctcgtgacatgtctgattaatattgattcataggaagcaaatcacctaggacaaggtgaaaccttctctgtaggcaagcaggcaaaaaggaataaatgttcccatcctaatcaaaaggaataaaaatattctgaaaattgccacatccaagctattagatggtatgcttatgaagtagtgttatcgttaagatataaatccatccatcatgacagcaaaaaaaaaaaaaaaa

SEQ ID NO: 10148 - DNA, 3352 bp, Zea mays
tatgtaggggtaccagcctagctagtccggcgatcgaccagcacgcagagcaggaaagagaggcgcgcgtcctgatggattcccctgcctgcagctagcctcacgcaccgagctagcgatatgattttactgcaagcgttttcctgcggcggcatcgtcaactgttgtgtgttcagggcagcgctactcagtttcccgacagggacaggccaaaggccgaaccccaccatgcggccagcggccggccgtccagcccagcgcgcccgcgtcccatggtatcatatcagggcgcgcccgcgcctccctcctccagtggggcgctgccacattcctccacccggaggatcacctcgcgtgtccggccggcacctgccgccttcctcctccggtcctccccgttgctgcattggctagcttagctccgagcctccgactcgatccatcctgctgacctgagaggcgcggtacgtacggtaccagcagctgcaggtcagttagttagctagcccgtcccccgtcccctccaggctccagttagccccatggacagggggatggcggacaggcggctcctcgcctcctgtattccgggcatggaggcggcggcggagagggaggacgaggggctggagctcagcctctcgctgcacccgtcgtccccgtcgtcgccgcccaggttccaggcggtcttcgcctgctgctactgccccaggaagttccgcagctcgcaggcgctcggcggccaccagaacgcgcacaagctgcagcgcaacctggcaaggcgaggccgggaggccacctcggcgccacccgcgccgccgccgccgccgccggtagccgaccagggcattggcagggcgtccggcagcgacagcgcgccgccgccgcgctccagggtggagcccgcggccaccggtgcgtggggggaggggaggcaccaccaccaccgccgtccgcaccagcaccacctttatcagcagcgcccggacccggcggggggcgccgaagcctcgtccggtgcgtcaaggggcggcggagaggatgcggaggagattattgacctgtccctcaagctatgaactgatccatccatgagctctggctagctagctagctcagcaggccagcactactagcagcagcagcagctcctcctccgatcctcttggtcctcttccattagcttattaattgcttagtcgtttcttcatcacgccattattatttcttgtttgatgatctaccgtacgtacgcgtgttcttccttgtctcagctctgtggactcatatgcatgattgagatattccagtgtgttcagctcaggggggcacgcagggatgttaaggtaataattgggggcacgcgcatcagagaagcttcttcgcggaactcttgtagtactactagtgctgatcgctctgtaaataatgttctgtcctatagaattattgctacgacctttggacttagctttctgcaggcttccggtaactaactaactaaactacttttaacttgttgcgtctatgtctatcccagtagctagtcctttgtactagtcaatttgtgccatatgcatgcctaatgttgtgttaagaacgacttatatatgataaacccatttttccatgttttttagtatgatagtcactgaaaaaatattatagacaaatactatcatacatacacacattaatactagatgttcttttattccctaataaaatatgtttattacttaagaacgtatcccttcatttgaatgtgctctttgagttcaattcatatacttgctattggtggatttattagtttatttttcattgttgggcacagatgtctcaggtcccatcagctagcactagaagcctagaaggtgatattgtagtcacatgtgatggtcagatgcacagatatacatttatctcctgactatatatatgaataagaagtatatatgtattagagttctaataatcttagctcacaaacctagctattagaaatgttagaataggaagttaagtcagagttccggtgagcagggacctgtgaacacaacgatacatgccttctctcttaactaatcacgtagagattagatcgtacctcgtatgtgcttagaaaaaaaaagtacaatgaatgttggttcgtgtgtcggcctcttgcttgttatgtgaaaggccacaactaataataagttgttgcgccccccgatcaaagagtgatgtttggtccaagtcaatattctaaccaagtcagatgagatgaacctaacattctctcccttgatctcattcttaaacttaatcttttagcttacaatttacattcctccatatatcaatataccaagaccaaggcgttataacaaatattcattcgctattgaactcaatgactatagtacgcctttctatcttaaagcagagaacttgtttttgagggagatggtttcattgatgaccctttgatccaaaatcaaagtagctccattaaaccattcccgctatgtgctttttgaacacgctggatgaaagtcctttaatgagctgatatacaagtattagctatatttgcatgctcaacttcaatcatttgatcatgaactctccctcctttataatatactacttaatatcaatgtgtttaacatcaacacttgatttattatcgcagcatatcttaagtgtgttttgttatgtttcctaccactttttaatcaggtatataaatttccactaccggaaacaggctctttgccgagtgctagtctctttgccgagtgcaatttatcagacactcagcaaaatacgctttgtcgagtgcaactctcggcgaataatgacattcaacacaaacctcctttagtgagagctaaacactaggcacacactgacgatcagcaaaggagtctttgtcgagtgtgaagctctcagtgaaatgagatgcacagcgaagggtcgtcagcagccgtctatagctgacggtcgttacctatgccgagtgtactgagtggacactcgataaaataacttctttgctgagtgtcctctgcaagacacacgacaaattacttattggcagagtgtctttctccgacacttgacaaagtatatttttgtttttttctttttttcaccaaaccttatctaatatgtttcctacgctatatagacctaaaagtattcggcaaagaagacgttgccgatgtacagttcaccgagacttctttgctgagagtcacactcggcaaagggtttgtcgagtgttttgttggctttgccgagtgtttgaagcacttggcaaagcagttgtgtccagtagttttctttatacacacaacctgtc

SEQ ID NO: 10149 - DNA, 1562 bp, Zea mays
gaaccctatctaaatggcagccagtctaatctggcagtcaactcacttggacatgttcttcaggtctacatcaatggtaaaattgcaggaagtgcacaaggtagtgcaagcagctcactcatctcatggcagaaaccaattgaacttgtacctgggaagaacaaaatagatcttctaagtgcaacagttgggctgtcgaattatggtgcattctttgacctggtaggtgctggaattactggcccagtaaaactgagtggactaaacggtgcgctcgatctgtcttctgcagaatggacatatcagattggactcagaggagaagatttgcacctatatgatccttcagaagcttcaccagaatgggtctcagccaatgcttatccaatcaatcatccactgatttggtacaaggtcagtatggaattcaaatgatcatacattcatagtaccatggaaccattccgcaggggacatttaaacacagccagtatgggcttaaaaaacaagatatatacagtctatttgtttggctaacccatttctcgagttgctgcattgggttgatgtgctaactgtaatttccaaaacagaccaagttcacacctcctggcaggtgatgatcctgtcgcgattgacttcacgggaatggggaaaggtgaagcatgggtgaatggacagagcattggtcgatactggccaacaaatctggctccacagagcggttgcgtcaactcttgcaactatagaggagcctacagttcaagcaaatgcctcaagaagtgtggccagccatcacagactttgtaccatgttccccgttcgtttctccaaccaggcagcaatgatctagtccttttcgagcattttggtggtgacccaagcaagatatcctttgtgatgaggcagacaggaagtgtgtgcgcacaagtatcagaggcacatccagcccaaattgatagttggagttctcaacagccgatgcagagatatggacctgcacttcgcctggaatgcccaaaagaaggccaggtcatcagcagcatcaagtttgcaagctttgggacaccgagtggcacatgtggaagctacagccatggcgaatgcagcagcactcaggctctctcagttgttcaggaggcttgcatcggagtgagcagctgcagcgtgccagtgtcatcgaattattttggaaatccatgtacaggggtcacaaaaagccttgcagttgaagctgcatgctcgtgacatgtctgattaatattggttcataggaagcaaatcacctaggacaaggtgaaaccttctctgtaggcaagcaggcaaaaaggaataaatgttcccatcctgatcaaaaggaataaaaatattctgaaaattgccacatccaagctattagatggtatgcttaggaagtattgttattgttaagatataaatccatccatcatgacaaagaaggtgatctttttgtaatccttcttgaaaaaatagaatgatttgaatttcgacaagttaactatacatccttgccaaaaaaaattgaattacacttctcaacg

SEQ ID NO: 10150 - DNA, 1203 bp, Zea mays
ccggccggggtaaaaaaaagtacgaacaatccaaaaggagtccaaagtccatccatcggtcctgccctcccggcaagcttcttcatctcctccgtccttcaccgcttccttgaccctctctctcccccaccccacccacggaaagcttcgagctttcactctataccccagggagaaggaaggaagccggcacagtctactggccttgtggtgccggcaactgactaggatcgagaaatagggttcttggagagcggccggtccatggcacagcggggcgagctggggcggcagctcccgctgagaggccccctcaaagccctagaggcagacatccaccacgctaacgccatggcagatgctattcagaggaattatggtggcgcatgtgtgcagatgaggctgtcgttcagctccctggctccattgtttttgtacttcatccaatggctggactgcggctgctgttatgcccttcccagctatttaggattgtttcacattctcatatgcaaggtttatgctgatggagatagctcagtgtcgacatatgaaaggcgggcaagccttagggaattctacgcaattatctatccgattctgcagcagcttgagagtagtttgatcgagagggacctgaaagggaagggccgatgcaaggatatagtgagtaggaggaggatggaggattggaaaaaggtttccggtagggatgtggaaagggaggatgaatgcgggatttgcatggaggcatgcaccaagatggtcctgcctaattgcagtcatgcaatgtgcataaagtgctatagggactggtataagagatcagagtcttgccctttctgccgaggaagcctcaaaagaatccgctcgacagacctttgggtgcttacaaattccaacgatgtcatcgaccctgcacatttagaaaaggaaaacgtgaggcatttctatagctacattgacagcttgcccctaatacttcctgatagcattttctttttctattacgagtatctactataacgctgaggcaacatacatcagatgtgtaaattgcgaaaagcagatgaaatcatggttttcttttgtagatgaacccccctctcactctgaccacatgcatgtctatttactcataggctgctaatgtaaacattaatgcatctgtcaataaagttgttaggagatatttaaaaaaaa

SEQ ID NO: 10151 - DNA, 1889 bp, Zea mays
aactcactttcccccctcccagttcccaacttttctagtgtttaaacacctagaacacccgccgcggcaaattgattaccttgccgccccttgaccaaaccaaaataacacaagtccccattgcttgcaccctacagctcctcacacccaaggtatggaggaggcaccaacgagggagccgaagaggctgcgccaggacgccgcggttacttccgccgcggcggcggctgaggagcctcagtacgtgtacctgcctatcgccgacgccatgaaggttcccggcgtccgggtttgcctcttcgccgttgtctccgagatcggcatcaccgaccgcagccgtggcacggatttcactcttaggttgaggattgtggatcaatcatgcatggatggaatctctgtaacagtttttgctgacaaaactactctattgccttgtgtcaagtcaagtggagatgtgatcagtctccataacgtcatgataacgatgcatggggagttctttgtttcatttaacaaagaagtttcttcatttgcgctatttgaaagcaaagtagctgagtgcagcccatatcagacttctgtgaaatatcatggcagcaaacatgacaaagaacttttaacccagatgagaacgtggcttgcatataatcctctaggtctgaaagattttgaattgcagttaagaagtttaaaatctgattctacttttgatctagtatgcaaggttgttcatgtccatgaagataacgacaaattgatattttatgtttgggatggaactgatacccctgctgttgagtttcaggcaactttggatccaaaggcagttgaatcaccccctctatttgaagggccacctctacccagggaggttttgtgcacaatgccaattatcggaactgttttgaggattttttcagatatgcctatcaaggaagtatcccacatgcaaaatagggtttattgggccagattctgtaacattacttgcaaggaagagtttggcatttggaaaggcattttgctggcctctagtaaagttcggcttttatctcatgaagatggtagcgttgttgatcgtcgaaattctatcagatgtagaatatgaggaagaatggcactcaacgttaatgcagtctttaactcataaagaggtgacacacaaactcaaaaccttggcccgtgttgtgggagcgtatccatgtcaagctagtggtctccgtttgctgtcaactggtaacattcatctgcggttgactcttgaggatcctacagcgagaattcatgcgtacgtccataagaattatctggtccaattcttcggtggttttctgacagaagaagcgataacaaagaagatgaacaagctacttggtatcccagaaccagaggacagcgaggaaggtgcccccttgactaggaatccaccttggatatggtgctgcttgacatcattctatatggacaaaaacaatccctgggacagcagaaagtaccgaatctttgccacagagatgagggattgaggagggatgctgctcgaatatgcaggaacggccttgcaaatgaaccgaactgattctatgtagtatttctgtgtgctctcgttggcattttgcttggaggggcatcttgctgggatgcagcgagacacgctttagttgtagcctgcgtactgtcagtattattccctagatgcaatgttgttgcagtgctgctgctgaccttctgctccatccagaacactggtagcagtctgtatgcgcgcccacgctacagaactctagattatcttgtgaaatgttagtgcacacagcaccaacttttggcttggaagttggaacgtgaaaaaaaaaaaaaaaataattcggagcctaaaaaaaaaa

SEQ ID NO: 10152 - DNA, 1441 bp, Zea mays
cgtgctcccccccgccccggcacggctgggaaaatgacaaagaacttttaacccagataagaacgtggcttgcatataatcctctaggtctgaaagattttgaattgcagttaagaagtttaaaatctgattctacttttgatctagtatgcaaggttgttcatgtccatgaagataacgacaaattgatattttatgtttgggatggaactgatacccctgctgttgagtttcaggcaactttggatccaaaggcagttgaatcaccccctctatttgaagggccacctctacccagggaggttttgtgcacaatgccaattatcggaactgttttgaggattttttcagatatgcctatcaaggaagtatcccacatgcaaaatagggtttattgggccagattctgtaacattacttgcaaggaagagtttggcatttggaaaggcattttgctggcctctagtaaagttcggcttttatctcatgaagatggtagtgttgttgatcgtcgaaagatgtttgccagtcgtaaggtcaaccaagttctctgccagccgatggcaagctttccctctaatgttactgttctatcagatgtagaatatgaggaagaatggcactcaacgttaatgcagtctttaactcataaagaggtgacacacaaactcaaaaccttggcccgtgttgtgggagcgtatccatgtcaagctagtggtctccgtttgctgtcaactggtaacattcatctgcggttgactcttgaggatcctacagcgagaattcatgcgtacgtccataagaattatctggtccaattcttcggtggttttctgacagaagaagcgataacaaagaagatgaacaagctacttggcatcccagaaccagaggacagcgaggaaggtgcccccttgaccaggaatccaccttggatatggtgctgcttgacatcattctatatggacaaaaacaatccctgggacagcagaaagtaccgaatctttgccacagagatgagggattgaggagggatgctgctcgaatatgcaggaacggccttgcaaatgaaccgaactgattctatgtagtatttctgtgtgctctcgttggcattttgcttggaggggcatcttgctgggatgcagcgagacacgctttagttgtagcctgcgtactgtcagtattattccctagatgcaatgttgttgcagtgctgctgctgaccttctgctccatccagaacactggtagcagtctgtatgcgcgcccacgctacagaactctagattatcttgtgaaatgttagtgcacacagcacacatcaccaacttttggcttggaacgtggcgagaaccccttttcttgttcggccccttgcagttttatcggtttccacaaaatgggtaaaaaaaaaaaaaaaaaaaaaaaacaaagtagt

SEQ ID NO: 10153 - DNA, 4164 bp, Zea mays
  misc_feature (3960)..(3960): n is a, c, g, or t
tacgaatgtatgatatactctctaccaaaccatcatacactcttctctagatgtaaaggaccaccactgttattgtaaacctcctattgggtgggctcttcctccctccatgtagcgagggcccccaaaattatcaagttgatttagtagatcatttcaaaattgcttcatctaaagttttttttaaaaaaagagttgattacgtcattaactaaggtagtgttacatccggacggagaaaatcttaaattcctagaatccaccgtgtccaggagttcgctcgttcgtatatgtcaccagctgcacggcagaataatgagtagccagattggcccgtgactccctgtggcgagtctcatcagattggcgatcctgattggccgctagtggtactaccgtctccatggagatggaggtgttctttctgtggcatgatgatccgatgctgcaaaaagttgggtcaaatcaggatgcaaaagcaaggaaacagtacttttattgcatgcccccatctcatgagagagagagaggggggggtagcacaatgatcagccattgagcctgcacgaaggctcgaggttcttcagttcttgctgctcgtgtggttttacctggactcgcaaggaccactttacctttacacacacacgaactgtccaaaccgcaggcgccttttctcatctttttcttgggaacaagaaaagccatttgcaccggatacatttgaacacgtccagccagccagccacagccaggtcgttgcttggacttgtttgacgatacggagtagcaatagcaggcgcatgtgggcagcagtagcaccaaccgtttttgagacctgagctggtccctttctgctttgcagcttctctcccagacccttttgttgagcacactagctaagctcggcatgtacatgggagtaaaaaatgatagtaatagtattacaagttagagccagtatagcaataagaggctgttagtaaggtgtatgctcgcatgtgaaagagaaaaagaagagaaagaggtacttgttcgactgcacttgagccgcagttgttcggactgctgcactataatctatagagacaaaatattatataagtagcctgattaaagccgggtctactataatataaactggctgtaattatccatataaaaaacctaatccttacctgtggacactgcgatattttattctatcatgtccttcctatccatcgtgtacgcaggccaggctgcaactgcgatgcaagcctagccgcagtccatggattgaaggaggggcatggcatggcatggcatgtgtgtctgtttgtcaggtagctgcggtctcctctgtctagtccttttgcacaggggaagcaaacacttgtctctagcgccccacgggaataactaagcaatgggttggtcatgtggtgacaagaatgacggccgagatgcccggccgggctcctcgaaatttgacgacaaggtaagatatatattttttggtgtcagcagtcagcaagtgtggcacatccggggccatgttcgtttaggctgttcccggccgggaacagcgaccaaacctcgtggatcccttcccatggaaataaacccggcccacagaaatacaagcgttcggttaagtccgatgtggcctgtatccagatcgttcctcgtcgttccagcccgggaaacacgcccggtcgaccgggggtggaaaatatcccagcctggactgcacgcgaacgcgaagggcacgcgacttctcgtcggtgtcgatctgctccggcgaccgcttgtcatcggtatgtttcttcctccctgggctttcccttcccaccatctcagcggacggcttgaagtttcctctaagtggtgggcgctcgctacccgcagctcccatggtctgcttgaagtttcctcgccctaaaccctaaccctaaatgtggctcccatgtctgcttgatctccttttagctgctgtagtgatggcgccatggccatggtctgcttagtttcctcgccctatccaacacgaaagctgccgccgaagcacggtcggtcacgtcgttcctgctgacatggtcttcttgagtttggggacaaagaaacaagaagaattagactagaaggttcagactttagcctctcctacaccggtggtcatggaaacagatggtttgactacctgacagttagctgccctagcgttctgaaagaactgttctccaaatttgttcccagttgaactgaaaagaggcggcttgtaacagcaaatcttcccaaagtactaactatatttagttttaatatagtcaagccaagaggatgcatgataccccagccgttgtatccttaatatatgtagggctattttgacggctagctgcgaagaagcttgtatcagtgagtttagttgtgtgcactgaactgaaactgctaatagattgcttgctgcatgtcccataaagttctagcgagcattgcatggatatagaataatctgtggggctagaatgtgtgtgtgttttggcctttgaggggcgagcaagtaggattgggcactttttttttgtttttaatattcagttttggtttccaatatttgtctgtatcggtactcagttgcagtttcagttttagatggaaaccgaacctaacactggttcaaacccaaacacgaagcattagataagaatgcggcaattagcaactgaaaaggacatataatcagttgatttgtcgtgctttgccagtgtaaaaactgtttggtgtttagttcagagtacatattttttacttgtaattgtctagacgtatttctaacaaaaacctattatatttctagattatccctacatcggtttgacttggagaagacgagcttccaccatcttgggaccctataccctctcctttagagagctgcacctgaagaaaccaatgaacattaggtattacaaataagggctgtattgtattaatgtggttcttgtaaactaatttttcctttgaattttgtaattgaatcatccacaggtgtgcgacttgcttttgtttatgtggatctattaattatgttcaaacagttgcttcataattggcattggcattggctgctcaattgtgtgcccctcgaacctcccctgcaccatctagagatattttgtgatgccattctagtattgcttttagcatttttatccataggcttaaccgaacaggattttggcacagggattattccctgacagagattgtacccccaacgggattaagtgacagcatgaggatcactcatgccctgggtggaaaatttcatcttggggattatatcccagggaaccgaacataaccccaaggggatgtcatgcgtatggcattcgggttcggagatgcttgtgtatatatactctgatgtacgcagacaagtctactatgagcatctccaaaagctcactaaaaaatgactcctgaaaatcagttttaagaaacatctaaaaaattagtgggtgtagattttaatttttttctctaacagattccttaaagcggcaaattatttctggggagctcaaaaaaaaactcctcatttgtagctacaaatgagggagttttatgactataaaaaagttgagagcactttagattaactgttagagataagtttttgtgttttttccaaggaactttaatttagagaaacttctggagagctcttagagatgctctaacaattagcagcacctgtttagatcttagcaactacgggctgttagcggcgaactagttgaggccctgtgcagatagatgtacgcagacaagtcgacgaccgaggcgagctagttgaggccctgtggccggctggtccagttttcctggccgacgcaaccgggcctccaccaacgtacgtgcatgtgcatctcccgcctcccggcttttttatcggtcggctttagtccaccngaaaacctccatggtcgacatgaaacccgaaacgtggcaatgtagttcaactcggcctcaatgactattctgtttcgacaaaaaaataaagtttgtggataacaacaaattttaaagtaccccatggctgaattcgcctgggttgtgggcaaaattttcatacttgaggttgtcaaaacaaaaacaaaaaagaagaagaaagtt

SEQ ID NO: 10154 - DNA, 816 bp, Zea mays
attatatttttttcgaaatcatttcatttcttgccgaatgttttctgggcactgaagctccctgagttatctgatttacttcattgagctattcgtatttcctctttgatagaagctagtaacattttggaaccctaggtaaactagtttcttttcctggatctctgaactgaaatgtggaggtcaggtcacgtttatgcatacaattcttcatatggtggtagaattatcaattgttggtcgcgaagctttggaaaaagagcaagttattctagaacagtatgagagagcagggtttgttatgtttgcttgtatggcatctgtgcttttctttctcttggtggagtcaaagtactaatatgtccaaattcataattactgaagtgcgtattagttgtacttatgctgcatagtactgtggcaatagccaaacaatgagactgaaagtggtactgtaaatgcaacaaaccaagtaggggaaattgtggtaatagtagacaactatgcagggcaggccgttccaaaatgacaagtggtcggtgtttgtaaaagtagcctgggatctaggtctttccttcatatggaactgcaagcttcaaacatcttgttttcttatatatgcagtccatatggatcattcattcaaatggtaaatatgatgagcaatcatagttctttgaagtgaaactatagttttactctttttcatatacattgtttgaaccattcctgccttttttttttggggagataaagagccccctccagtacgatcattttagacggcttgccgacgaaaatagatcatatgatgct

SEQ ID NO: 10155 - DNA, 774 bp, Zea mays
  misc_feature (20)..(20): n is a, c, g, or t
gcgttcggtttgtgttgctngaagtgcagggcaggatttactgcaaaaatcaaatgcaactgacgcttcaggaaatgtgatacttagtgactttggtgtccacatgcagcagaagatcaagaagcatttcaaggacatcggtgttcccgctgatctaaaatacattgatccaacatatatggttcgggcctgccgggcaaatgcatctgatgctattctctgcaccgtacttgggcaaaatgctgtccatggagcatttgctgggttcagtggcatcacgtcaggtgtttgcaacacacattatgtctaccttcccatcacagaggtcattacaacaccaaagcacgtcaaccccaacagcagaatgtggcaccgctgcctcacatccactggccagccagacttccattgactacttcattaacacctgagagcaaggcgccaggagaatatttaatcccacaagggactgctaacaggaaacttgaataaatctggctaacccaaaattttgtgaggctggaggagctcataacgaaattgccagagccaccccctggtcatccagacgttgtaagcatgcataccctttctattggtttgcaatcccaagtgaaattaaaagttagaagttgtttgtgctgcaaacaattcaccataatcccaccagtacaaaactggctccagccttgtgagatgttttattgatgatgtactatgcataataggcaattggatattcttaaaaaaaaaaaaaaaaaaaaaaaagcggcc

SEQ ID NO: 10156 - DNA, 2107 bp, Zea mays
agccgcatcaagtatttgatcattacttctacaacccattccaaagagatttttgttgtatatgattcggccgaggataagcattggccatatccatgattttgaccactaatattgttgcttatagttgacagaagctctcacttcttcacttctagatggagtccttttgatacttggggtgttcagtaagttggtgttcaattgcagtatgttgcataatttcgtagctttcttaatatgccaattctgttgatggagctttacagacatgccaatttataaatggagcatgttgcagttagatgtagtctatttcagaattgagtgtacaaatagattttacttataatgtgttgcataataggactaagctttaggggagtgcttttgtaccaatggtagtaattggttagtatctgatgatcttcatgagaaatatgacatcattatatggttgtatttggtagcacctgatgcaatttttttgaattggccaagtagtgtggtctcgtgcccataatagaatagtgacacttagttgatgttttgttattctttttcagatgtgaagaccaagtaggagaacaactcatggggcgtaagcagattttctagaagaggagagcagcacttgatgactttgataggttcaaagtcatgctggcaaaggccgagaggggtggtgctatcaggcaagagctcgccaagttgaagaaggcacccatggcttaatggttatcttttagtggatgtcatgttagagtttttggttctaagttggatcagcaattcgattgagtgtcgataaagacagaagtactaatatgttccctgtgaatgcatttcaaactttatcaagcatgggtgtgctctagatattttatcgtgaatgatatataatatataaggtagcttgcgtcaaatgcgtgatctgtaccatttttgttttgtttaacattggcataatctattttgcgatattgtcaaggttgatatatcttttttgggattataaaaaaaaaaaaaaaaaacacgtggaaatgtagctatttgtgtgagaagacgtgtgatcgactctttttttatatagatagcattgagatcaaccgtttgtatatatcttgtcataacatttttacttcgtagcaacgcacgagcgttcacctatttgtatataagttatcatgatatttataagttaccgttgcaacgcacgggcactcacctagtatcactataagagcacatacaatgatatagacaactgtcgtctctaagtgtattgaaggtcgcacacagacagtaaaaaagacagctcatacaacactatgtcggtaagactgtctatgtactatttaattcataaaaagcctttattgatctgtattgatcaagtatacattggatctttgtagctattttgctgcatgtttaagagctcatcaagatactcaattaagacatgatttatataaacataatataatttataattatatcatttgatacccgaatcatgaaatggcattgcaaaataggaaacaattagtatgaatacatagcttcatgtcaatctaattttgattgtttccatagcgttgccatatgtgttcaaccaaatctgtcctaagctgagtatgagttgagcgagcacggagagcagtgtttctctgtagcacctccacgaagcaggggtcaggattgtcactagtacgcacttcaggtggtagcacaatagttggacttggattctcgttcaagtccaacggaattgtaaccgattctttttcatcttcgactatcatattatgaagtataacacaagcttgcattatgttcacaacatccttcctcttccataaacgtgctggtcggcgaacaatatcaaaacgagattgtagcacaccgaacgcgcattctacatctttccttgtagattcttgacgtagtgcaaataatttgtctttttctaactgaggaagatgtatagtcttcacgaagactgcccactctggatatatcctatcggcaagataatatggagtttcatattgattcctgttgggggtatgcttcgtagccgaagatcctaaagaaataaaca

SEQ ID NO: 10157 - DNA, 3871 bp, Zea mays
agacggcatgacacgactaaatggaccgtcattgaatcgacacgacatgaagtgaggtactaaatagaaaactagcgtttaaaaatggttatttcatgttccaatatttttatctcttcataaaagttatagaaaacattgatctctctttttatatgatttttttagtttatagcaaaagttatgaatattttcataatgtattttttagatatatataagttttttttgtccctatcgtgcttaggatggtatcctcctgtcgtgcttcgagtcgggtcaagcttagtttttagtatctggacacgttacaacctagcctacaattattttctgtcgtgttggtaaaaaaaaaagttagcccgagtccggacaactttcagctctaatcctgtggtggtgcacgtatccgtatcgtggcagccttgggcgctcaccgcgctcacgtctctgacgtaccgtacgtactggaaccgatcaatcatccctggcaaaacgttaattcaccaacaagtcgcattcgacgttaattatgttgcttcgttttttcttccgtggaaggtgactagaagcagtctttttcgctgttctcttatcaatactcgatggatgttttggtgcagctgaggccggcacgtcgttattatccggatatctaatgcaatttttcaatgttcgtttgtgtctgcaattttttttgacggttaccgggcgagagcctctccaaatgaacggtagaaaaccgtgagaacgatataaatcgaaatcaggaccggccagctcgtaaccgccgtcgagcatataccactgagctacggtcagggacggagctaggtagccatgggcgggcaggatgtagaaggggctcctgctatagcggtttagttgctcctcttaacatttaggtgtgtgtgcgcctggacaatttgctgtggacactctatctgaatgcaacgaagcctagttcttcgtttttgaagagaagaaatcagatctagagtgatcggcggcactcggaaatgacaaaagaaaatgtcagccgtagaaaaggggaaggcgcgtttgacacagtaaaagcgggcctccggtcgcgacctggacgacgaaaccacacgtcactctctatcatgagacagcgtcgataccgacacgacgagccactgccttgtagaccaggccgtacgaaatggaggtggttatatacggacgcacgctctcacagagtcacagtcccgcaacgttttctagattagttggcgcgactgtttcctccccgttcccggcccggctcaccgtgccgcaagtttccagccgcagtcgctgcaccgtcgttttcgacttcgaccaccctgcttgcccagccaggcaaaacgaatcgaagacaaagaaaaccggcgccactcgccgacgtggcgatctgcacccgccgactaccggtccggagatcccagcagcgagccgaggacagacaaccccggtcgggcggccaaaacccgcgtgccgcgcggccgaaaaacgtgagcgcgtccgctcagacgtttaaaagcccgctcgcttcgccacaaagaaaacccaccaccacaaggaagggaagcgtatcagtatcaccagttcaccatcctcggatccttcgccttaatcgcccgcgtcagccatctcacgtaccggtcctccagtttcctcccatctttcacacacaccacgccacgacccggccccggggtataaaagcactagggcgaagccgcgcaacgactcgatcggctgcagccagggctcgcctcgggggaccgcgtgttgctagcgagctcggtgtcggtgctaccggctgccgccccagtgcgaggcgatggggaggaggctggacgtgctgctggggcggacgacgaagcagacggcgcggctcaagtcgctgctggggctggcggcgacgcgcctcggcgtggtgcggggccaccgccaggtgcggtgcgggcaggcgcgcggggacgtcgagcagcttctccgcctcggccacgcggaccgcgcgctggcccgcgccgagcacgtcgtgcgggagcagaacgcgctcgacgtcctcgccgagctcgaggcctgctgcaacctcatcgccgagcgggccgcgctcgtcgaccacgcgcacaggggggagtgccccgaggagctgcgggaggcggcggcggggctggtatacgccgccgccaggtgcggggaccttccggagctgcaagaggtccgggccatcctcgccgccaagttcggcagggagttcgtctccgccgcgtccaacctccgcagcgggtgcggggtcaaccccaaggtgaggcccggcggcgacccgcgtactctggctggctggccgactgacttctcaaccttggattctcgactaaacttggattctcgacagatcgtgcagaagctgtcgaccaagcagccgagcctggagagccgacagctggtgctacaggagatcgccgccgacaaagggatcgccgtgcgcatctacgagccgcctcctccctacgaggactcggggagctcccgccgccgccacgagggcacggagcacgatggcgagaggatcagtaggacgccaccagttgatggccgcgacgaagacatctccggccactcggcgcagaggtacaaggacgtggaagcggcagctcaggccgcgttcgagtcggccgcctcggcagccgccgccgcgaaggcggccatggagctctcgcgtggggagcccagggggcccggtgacaggaggagggcagggaggacgcaaatggatgatcctgagatcgagaaacaagatgaggtgcttcatggaaacaaacccgagaagattgggcatggccggaattacagttcagatgttgagatcacgccggaggacgacgaggcaaaccacggcaacgttgcagtggacgaaccgaaacagcgggagcctgccaggggaaagccggcatcggtcagaacaaagtggggattttagcggcatccagatcgcaacggaggagatggtttcttcgtcttgtcaatatattggcatggaagttgttttttttcactgtagtagtatgtaattaacgacggttaccaaaaaaacacatgagcgatttgatttattgccaacagtttgcacactagtacactatgcctgtactaatgctatgttctgttaatgtgtagcgttaattgtagtacatgttctttggaggaaaaatattgatgttgcaattcaaatgatctgcttggaaaggatgagattgtttttttattatataaggaagtagattatatattatgaggcaggacaatacaataaagcggttatcccagaagacaaattgacaaatgtcatggcaagaagtttggaaaataataatatataatgatgccaattgccaagaaacaaattgatgacacagcacaacacagctccaatgatcacacacagcaatcacataaagggaatgtgtggctaacatatgtggaaggtgctagcgcaaggctggtgagtcaactcacacaagtaggatgatccgagatcctcgtaggctacagccccatcagatgtgaagacagtgcaaggccactgcgcgagaaacgatcacggcactgatttagggattttgcttgtagcaggtctaggtgcacagaatggcgtgcgcaaagacacggtattttagaatgcactatataggagtttttttttgaaaaggaagatttttcattgcatttaaaagtttgatacaaatcgtctcccggcctctgcaacaataagatgcacacagcctagaaaagaaagaaaaagagaaaagaaaaagaacatggcaaacacattcttaatggctgtcaatcctacgac

SEQ ID NO: 10158 - DNA, 1638 bp, Zea mays
gcacgagaccattacctagaacatcctaatcgaaaaaaaacccaccaccacaaggaagggaagcgtatcagtatcaccagttcaccatcctcggatccttcgccttaatcgcccgcgtcagccatctcacgtaccggtcctccagtttcctcccatctttcacacacaccacgccacgacccggccccggggtataaaagcactagggcgaagccgcgcaacgactcgatcggctgcagccagggctcgcctcgggggaccgcgtgttgctagcgagctcggtgtcggtgctaccggctgccgccccagtgcgaggcgatggggaggaggctggacgtgctgctggggcggacgacgaagcagacggcgcggctcaagtcgctgctggggctggcggcgacgcgcctcggcgtggtgcggggccaccgccaggtgcggtgcgggcaggcgcgcggggacgtcgagcagctgctccgcctcggccacgcggaccgcgcgctggcccgcgccgagcacgtcgtgcgggagcagaacgcgctcgacgtcctcgccgagctcgaggcctgctgcaacctcatcgccgagcgggccgcgctcgtcgaccacgcgcacaggggggagtgccccgaggagctgcgggaggcggcggcggggctggtatacgccgcggccaggtgcggggaccttccggagctgcaagaggtccgggccatcctcgccgccaagttcggcagggagttcgtctccgccgcgtccaacctccgcagcgggtgcggggtcaaccccaagatcgtgcagaagctgtcgaccaagcagccgagcctggagagccgacagctggtgctacaggagatcgccgccgacaaagggatcgccgtgcgcatctacgagccgcctcctccctacgaggactcggggagctccaaccacagccataggaagacggagcacgatggcgagaggatcagtaggacgccaccagttgatggccgcgacgaagacatctccggccactcggcgcagaggtacaaggacgtggaagcggcagctcaggccgcgttcgagtcggccgcctcggcagccgccgccgcgaaggcggccatggagctctcgcgtggggagcccagggggcccggtgacaggaggagggcagggaggacgcaaatggatgatcctgagatcgagaaacaagatgaggtgcttcatggaaacaaacccgagaagattgggcatggccggaattacagttcagatgttgagatcacgccggaggacgacgaggcaaaccacggcaacgttgcagtggacgaaccgaaacagcgggagcctgccaggggaaagccggcatcggtcagaacaaagtggggattttagcggcatccagatcgcaacggaggagatggtttcttcgtcttgtcaatatattggcatggaagttgttttttttcactgtagtagtatgtaattaacgacggttaccaaaaaaacacatgagcgatttgatttattgccaacagtttgcacactagtacactatgcctgtactaatgctatgttctgttaatgtgtagcgttaattgtagtacatgttctttggaggaaaaatattgatgttgcaatccaaaaaaaaaaaaaaaa

SEQ ID NO: 10159 - DNA, 1643 bp, Zea mays
cttaagttgatggatctaccaggtgtggaggcgctgcaggttccagggaactctgatgggcaaacattaatcgttcgagaaggggataatggtgttgcatattcatggaattcagcagagttaaaatgggacaaaattggtgaagtagtggatggacctggtgaagctgctcaaggccaagttcatgatggtgttcggtatgattttgtttttaatgttgatattggagatggagaacccatacgaaaactaccctataatcgttcagatgacccatacacagtcgcggacaagtggctcctgaaagaaaatctgcctttgacatatcgccaacaggttgtagaatttatactgcagaattctggccagaacaactttgttccagatccatcttttcgggatccctatactggggccaatgcatatgtgcctgggcaaccatcatcatcatccaatggtaatactccggaaccaattttcaagcacataccgaagagtggaatgctgtcatttgagacagctcagtttgatggaatcctaaagaaagttgcagagtttaattcaaaactttcatctgactcggaacagaaacaattatctctgtctgagacggagatgtcaagattacctgccatagtgaacgtgttgaaagagacatcattttatcacacaagtaagcttgcagatgctgatatgacattgttggtaaagatattgaagtcttggcctccacaaatgatgtttccagtcattgattttctgagaatgttcgtgttgcatcctgatggagcttctttacttctcaagaccatcgaaactggaaatgatatacttttggaaacctttcgtaaagctgttgcgtcgcctgtacagccagcaaatttgcttacagtcctcaaagctgtgacaaacttgtttggcaactcatgcttgcaccagtggctgaggacccactgtgctgagatcattgattcggtgtcaaactgcaagtcttcttttagcaagaatgcacacttggcatatgccacgcttctactgaactacgctgttctttcgattgaatcaaaggaggaacagagtcaggcgcagattctttctgccgcccttgaaatcgccgaagatgacacccaagatttcgactcaaagtaccgggcacttgtcgcaatcggttctcttatgctcaagggccttgtgaagtcccttgccctcgaccttgatgttaagagcgttgcaagcagcgccaagtcttcaatggaccagaagattgcggaagtaggaggtgacatcgaatcgctaacaagatgactacaataggtttgcgtgcacttggtcgttgcggacattgctgctccttcgcttgaggcgctacagtgcataacttaaagccggtctgtgttgcagaccaattcagacgccctccacgtctctaccaaaaaatcgcaatgggttatgattattttttcacctttgtaaccatcatggaagtgtggattttgggtggtagcgcttagattttgtaaattgaatagctgggctactctgcagctacagttcaatatttctcgcggagggatgcagatcagacatgcaacgaatatttcgatatcagctgcatttctgtcaggcacgcaactaaaaaaaaa

SEQ ID NO: 10160 - DNA, 1041 bp, Zea mays
tcgggagacagcggctgcccaaccatataaccgttggggaccccggggccgcccgcggacattacaaccgcgcgcggagcacgcggtgacagaagagagacgacggtcgacggagagctgccatggccgcaggagccgcgttgtactactaccacccaggcgccgggaaggtgagcctcgaggcggtcgccccgtcctctccgtcgctggccctgaggccatcgcagagcaaggtgctgtgcgtcagcagcagccggtggtggatgaggcgaagatgggaggggaaggcgagcagcgtcagcagcagggcaagggcaagcgcaaggcctgccttgttctcccctgtggccatggactggcaggagtgcactaccgagcttgaagttgatgttccatgctcggtggcctatcagtgttactcagaacgggagagtattcctcagtggatgccattcatctcgtctgtcaagatccttgaagataaacctgatctttcacggtggactctgaagtacgaggtgcttgggcgggatgtagaattttcttggcttgcacgtaacatgacacctattaaaaaccagaagatccattggcgatctcttgaaggtcttgctaatagaggtgctgtccggttcttccccaaaagctcatcctcctgtagagtacaactgacggtggcatatgaagttcctgaaattttggccccagttgcatcagcactgaaaccgtttctggaaagcttgcttctcaaaggtttagagcgctttgccacatttgccaaggagcgtaatagcaagatacctcaggcttaacagcgccattactagttccattctagtgaagccacatcacaatgcatgtaaagaatgatgtcattatggatgtgcccaaataatgtacccaaagagaagtgaatacaaatctgtcaaaagttggaagtaagcttcttgctgtatgtcattgtagtgttataacgccattataaatcttgaatataattattggtagcatcagaaaaaaaaaaaaaaaaaaaaaaataaa

SEQ ID NO: 10161 - DNA, 1585 bp, Zea mays
cctctttccatttccgattgcgtgctgtagagccgtctagattcaggcaacacagaacgagagcaagttgctggccatggcggcaagaagcaggagcatggccgtggcggcgctggcgctcctcgtcctcgcgctgcccgcggccctcgccgtgacgtcgccgtacgtgcgcccgccgccgagggacacgctgtcgtcgctgctcgaggacgacgccggcgccgacaggcagacgccgcagcaggtgcatggtagggccagacaaggtgcgggtgtcgtggatcaccgcggccgacgcgccggcgactatcgactacggcacggccccaggccagtacccattctccgcgaccgggaacacaacggcctactcctacgtgctctaccgctcgggcagcatccacgacgccgtcatcgggccgctgcagcccagcacaacctactactaccgctgcagcggcagcgcctcgcgggagctctccttccggacgccgccggccgcgctgcccttccgcttcgtcgtcgccggggacctaggccagaccgggtggacggagtccacgctcaagcacgtcgccgcggccgactacgacgcgctcctcctcccgggcgacctgtcgtacgccgacctcgtgcagccccggtgggactcgtacggccgcctcgtcgagccgctggcgagcgcgcggccctggatggtgacgcagggcaaccacgaggtcgagcgcctgccgctgctggagccgcgacccttcaaggcgtacaacgcgcggtggcgcatgccctacgactacgccgccgccgacagcgtcgccgccgcgccgccgtcggacgacaacctcttctactccttcgacgtggccggcggcgccgtgcacgtcctcatgctgggctcctacgccgactacgccgcggggagcgcgcagctccgctggctccgcgccgacctcgcggcgctccgccgccgcggcaccccgccggccttcgtgctggcgctcgtgcacgtgccgtggtacagcagcaacgaggcgcaccagggggagggcgacgccatgcgggacgccatggaggcgctgctgtaccacggcgcgcgcgtcgacgccgtgttcgcgggccacgtccacgcgtacgagcggttccaccgcgtctacgccggcaaggaggacccctgcggccccgtctacgtcaccatcggcgacggcggcaaccgggaggggctggccaacaagttcatcgacccacagccgtcgatctcggcgttccgtgaggccagcttcggccacggccgactcgaggtggtcaacgccacgcacgcgctctggacgtggcaccgcaacgacgacgaccaacccgtggttgccgaccaagtgtggatcaacagcctcgcggccaacccagcttgcaaccgaagcgacaagatgtagtaatgtgtctgtttactagtttggggttaatttattattgaaagcatatcatatgagactctattgtatatgatttacacagtagactatgcataccgatccaggattgatccaattagagggacctactaagttaaggctaaaacaaaaaaaaattgtcc

SEQ ID NO: 10162 - DNA, 2644 bp, Zea mays
cgcacaactagccgttgcgcacgacgtcacggtcccatgtcctatcacgattcacgagctgcttccggtggcccgtcgtgtgccgccgttgcactggacacaagcaaccagggccaacggctaataagtacccgaaagtatttgaaaacgaacccagcggccactgccgcctcgcctattgctgggcctccccccgcggaaccgaaaaatcgccaagtttttttaactatacaatccaggaaggaagtcactgtcacttggtgagatcgatggcccgcgtcgccgccgtcctcgttgctctcctcgccctctttgccgtcgcggccacggcgcaggcccctgccgcgtcgcccaagcgcgccccagcccctgcgccacccaagatggcccctctcccgccgccgccgaccagggcccccatggcctccccgccctcgcctcccacgatgtcgccggcgtccgccccctccgccgacgctccagccacgagccccgccggtgcgggatttggcgacgcgatggccccggcgggagcctccgctctgactccggccgccgcgcccgtcacggagaagagcacagccgcatctgcctccgccatcagcttcgtcgccatcgccggcgctgtggcagccgccgccgtcgtgttctagacatccggaagtggatctgaggagctgcagctgcacctgagccgctctgctgttgttgatagatgccctctgtttgctctgttttacgatccattgtttatttatttatttgtttgtttgtcatttagaggtctgagacagagatgaggatgtgtaatcctatcaattttctgaacgggagttgtttctatgctccgcaagcaaacatatgacactgcaagaaaaaaaaaaaaaaaaaagcttatcgatgccgtggccgggcctcctcggcgacttccttggacgcgtgctccaggagcacgaccgctgtcctcagcctcccgttctcgggcagctgctcggccacttccgacgacaccttctctgcgacggtggccgcgtcctcgacggcctccgccactacctccgccgtgtctttcaccatatccacctcacctgatggcatcggcgcagagttaaattttgcatcggtgcagagtttcgcggcgcgcggtacagggctctttgctctactctgaatcagcaggaacgacgcccatctggaatgcagcattggcgctgcagcagcaagaatagaaccgacggccagccttgccctgcagtgcagcagaggaattaggagccgcaccgggacccactaataactgtacaacggacagaacagtcgagcaatcacaagatgaagaaaggcgtccgctccttgtcctgagactgatgctggctcggccgagccggcggacgtctcacgtctcccccgtggctggagcccgagaatcccgatcggaccaacgcctggaaacgcggtggcgccgccgtcgcggatccgagacgggtggtggagcggagcttctgggagtagagagacccgaacgacctgaccagggacgacatggccgattgctggaggacaaaacagtcagctcctgatcgctgggtccttatgcacatcgatcaacaacgtggaacgagcgcgtatatgtacaacatggacacctcgccacgcgcaacggcgtgaggattgaaagcgtgtccattcgttagcttgcaaggaattgttggatgtgaagttagggtgaatgatctgtgcacgtcaaaggcagtcgatttccggatcagatatagccttgggaaggcaaaaggggatgcggtgtcatgtgtggattgtgagacggatagcagacatgctagcatgctggtgccgaaacctgaagcttccaagcaacaacgttcgggtggatatcctttttcattttctcagttagttcggatcgacgtaaccctatgacgacacgtggcttgtaagtttcgtatatcatcataaacttcccgctttctttaccgatcaagtatcaagtgcactcgagtatggctcgctgaactagcgatgacaacgtataacaccctaaaattatattttaggatttataaaagttttttaaaagttttaaattgaaatatcttttaataagtatcttattacctttcaagttacttatcccaaagtaaatatattttctaataaaatattacaccaaatgagttaatttatccactttttgttaaactatattttttaaaaaacaacatctcttaatgaaagttctacacgaggagttaatattattagataaccatttctattctctaagggttgcatatgaggcatttgactaaatgaataattggtatataagtaaaatcaaccatgcattgcatgcggagccttttttgttgattgtgcatttaattgggtgttcaaactatatttgaaataggagaaatgataaaacaagaaaaagaaaacaggaaaaaatgaaaataaaaaatatatatagagagagactaccttgtctgggccgaaacctacattccggcccagaaccgcatcaccagtgcgatccagcagtactccagccgcgcgtctgctgacttggagaccccaccgatcagtcactatcgtgcgctggccaaattcctctgcctggtgggct

SEQ ID NO: 10163 - DNA, 901 bp, Zea mays
gccgccaatttacaccctccttaaagggggacaccaaaacgtgggagttcccccccccgggtgggcgcccccctctaaaaacttaagggattccccccggcttgcccggaatttccccggaggcccttttcttaaggaccatccttattggacaaattcggcaagttttttttaacttttcaatccaggaaggaaagtccctgtcacttggtgagatcgatggcccgcgtcgccgccgtcctcgttgctctcctcgccctctttgccgtcgcggccacggcgcaggcccctgccgcgtcgcccaagcgcgccccagcccctgcgccacccaagatggcccctctcccgccgccgccgaccagggcccccatggcctccccgccctcgcctcccacgatgtcgccggcgtccgcctcctccgccgacgctccagccacgagccccgtcggtgcgggatttggcgacgcgatggccccggcgggagcctccgctcttactccggccgccgcgcccgtcacggagaagagcacagccgcatctgcctccgccatcagcttcgtcgccatcgccggcgctgtggcagccgcagccgtcgtgttctagacatccggaggtggatctgaggagctgcagctgcagctgcacctgagccgctctgctgttgttgatagatgccctctgtttgctctgttttacgatccattgtttatttatttatttgtttgtttgtcatttagaggtctgagacagagatgaggatgtgtaatcctatcaattttctgacgggagttgtttctatgctcatataagcagattacatttgttcgttgccaaaaaaaaaaaaaaactcgcgcaccggaatacttgacgattacaacggcaacaggcccacctcgcctta

SEQ ID NO: 10164 - DNA, 6249 bp, Zea mays
  misc_feature (3906)..(3906): n is a, c, g, or t
  misc_feature (4171)..(4171): n is a, c, g, or t
  misc_feature (5157)..(5157): n is a, c, g, or t
actaaataagacaaggcagccaaaattagtaaagaaaagtgaaacgaattctaaattaggacagatggagcaatatttttaatttgtaggacactattttaaagcatcttgttggagatgctagaaattagacaaaaactaacttgtttatactcaatccagttttcgaaagccagattcttaaaaaaaactcgagggttccgtccttagctttggatctgtttttttccccgtaaattggacgtggtcgagctgtccctgcagcacagggggcgggagtgcgtcgcaatcagcgggcattaggggcgagcacgaatccacggcacgctgagtcagacgcaccggggctgcccgacacgcgaatccacgcacccgtctctgtcccatccgcagccccaccccacggaaaagcaagcaggcccatccagccgcaggcatgcgggggcagcagaagcggcaaaccgcgcgcccgcccacgacgcgacgcgacgagcggcggacggggcgaacgcgcggcgccccggaacgcgtggtggaaccgttccgcacaccctagggccaggaggaggacgcgatccgacggcccgcgggtgcccgaccggccgcggagacacggagccgccccccgcgcacccgaggaccttggaacttcctcgcacgacacacacacaccctcaccgcaccgcaccacctggcggggcccgcctctctgtctgaccccggtccaagcctctggttacctaacctaaccaaccatggttgctcgtgcagctccagcactctccaggggcctatatatctccttccccggcagcgaaccagctgttctcttcgttccgtctcgcagtggtagcaccgcagcagagagaagagagatcttctagcctagtagtagcatctacttactagtgagtgagtaggagtacttggctaggacgggggggccgtgacgacggtagcagcatgagctgcaacgggtgccgggtgctgcgcaaaggctgcagcgaggcctgcgtgctgcgcccctgcctccagtggatcgacgccgccgaggcgcagggccacgccaccgtgttcgtcgccaagttcttcggccgcgcgggcctgctctccttcatctccgctgtcccggacgcgcagcggcccggtacgcttccgtcccgtcccgtccccatgcatgaactatcacacaccgaccatgatccctagctagcttattattgcttaccaggcttactgtggtccatggcacctcctcgcagccctgttccagtcgctgctgtacgaggcggcggggcggaccatcaacccggtgcacggcgcggtggggctgctgggcacggggaactggcacctctgccaggccgccgtcgacaccgtgctgcggggcggcgccatcggcccgctgccggagcttggcgccgggacgggccacctgtacgggccccccgccgccaccgacaagcgcgccggcggctggtccaccttctccacggcgaagcgggcgcggaaggccgccgccggtgccggggcgccgcccgcggcggaggcggcggcgtactgcgacctagggctgtgcctcagcagcagccccgggtccccgccggcgacggcggacgggaggagggcccccctcctgcggcccggcacgccgtccatgagctcggacgagtccgtcacgaccacggccggcggcgacagggagcccgtgctgctcaacctttttgcctgatgaagccgccggtcgacgacgcaggccaaaccaaaccaaaccacacgcgcagcggctctcttgattggccgccgtgtgatgtgatgttttgtctggacgatctgtcccggcggccaggcgttttctctcgtcgccggcgacggcaaggccgtttttcattcgtttctggctgcggccttagattttatttttggttgcgtagtagcggtagtagaaaagaaactaccagtagcagccggagccggcctcgaagccccgtttgcgtgtgggcgaagatgagactatgagagcgccggtggccaccccaccaaagtataactgttttttccccctgttctttttttccccttctctcctttattgaacaattactataatataaataaaatactatagcaccaccactacatctgagcttcggtgggtcgaccgaccgactgtgtgcgtttgtgcttgtacgtataactggtgtgtgtgtggtttattactgttgtgattgacatgataattggcgatgacgtcccgcgaacagtgacgtgtgcagcgggatggtgacgatcggtctcgatgcgttcgcgccgggggcaagaaggggaatggtcttggagcgctgcacggccccgcgtctcgcgggtacggagttgacgagggatcaacgcagaggcagcagcgggtcgcgctcgcgcctcgtccgccgcgccactcgatcgagcctgccgtgcgcccgtgccctgacgagagagataccggacgcgacagtggccgacatgggtgctccaaagtccatcggggttttgtacccgagagtacgaggacaaaagcgggcacgtcgcacaatgcaccctcatctccgtgtcgccgcgtgacattcattggacggacgggagacgccggccggcgtggggaggacgggattactctccctagtccctactctcactcgtctacgtaggcctacgtacgtacgggaaaaatctgttttcaactcgtatatagaagcagtaccggaatctacttcttccatccaaaaaaaatataattaagtgcatttataaatatatataattgttctagaatgtaattgatgtgcttcgagaatagataaataagaaaaaagacaattaaaattaagtggtcctatactgctcccttcttttttttttatttaccacgttttagttgaaaataaattagccggcgacaaaataattgagaacggagtattactatatagatacaagtgcatttgttttagagttctaaaatattgttcaactatccatctacaaccatcaacgctgcggtagtcgagtattttctgtcattacccaaagcaagtttgacctacgagtactcttgaaggtaaatatacgtcttcataaagtcaatgcatcatcgtagtattggaagccggtgacaacgcggtatcagacgagttcaagcaaccttgagatgaggctaaggccctgtttggaatcttagcattttttacggttttgaaggaatactatggtattgaatgatactatgtataggaggccaaataaaatatatttgctcgtatcgggtaaaacgcagtttcgaataacatgatctagctaaaatcgtattatttttacagttttgaaaacttcacttgaacttcagttttcaaaggcttagctgcctatgatgcgtgcgttgtacgtgagatagtacacggccaaacagttctcagtatttttgaaaactgcttgccatgaacaaatgtaagtcattgtatttaaatcaaaactttgttgcgaatcacgccctaaaaaaatgcaagctactctcgtcgccgtcaaaggctcaaagccagatattctggttgtggtttgtttagagcaagtatgccatcccaatggctaggtaactgcagatgcgtggggacccaaaaaaaaagatgagatagtttggttctagtaaaatcaatgactcaggcacggaacactatgtaatggtgaagtggagcaacaatcaaagtataacaagagggtggttaataatatagtcgactattggttgaaatatgtgtattatatatgcatcatacatttaaatataggcagcaaaaatcaagagctaaaataggtactattttggtacggacgtagtattatttggtctaaattatactatgtttgatatgtttnagagtctgggtggtggttacaaatcctatagtggcgtcttttcatacgtgatatagggaatatatatatatatatatatatatatatatatatatatatatatatatatatatatatatatatatatatatatattacacgacggcgaggtcttgttattgtaccgagcaggtgtctatattccgcgcactgtgtgagagccccatccatccatgatccatccgcaagttgttgcgagacgacgccgcggcggggtccgcctggncgcggaacagcgaaaggctctcgggtgcgcggcgaggcgcacggccggacaaaaagtacacgcgcggagatgagagggccggctgtcccgtcgtcagacgcgcgcaccgcaacttgcgtcctggcgccgggacccaccacgaaccggcgcggcgatcaccagctgcaccgccaccgcctggtgcggccgcatctgtcgcttccatccaccacgaatcggccggccgggcggccccggggcgagaaaagggcgcctagagagagtttcctgtcgcacacgggcgcaagttggctcgacgagaaggacgcacgcgcggggcgccgccctccgcagctgcggtgtgggagtgcgaacctgaggggtggggtcggccgtcgtacgctccgccacgtgcgtgccggtgaaagcgtttcgccgaggaacgaacgagatcggatgtggatgtggtgtggagggggcggcgggaggaagtttcgtcgcgtcgcgtcccccctcacccccgtggtccaggagatgcggggcccgccgcgcggcgcggccctccgccgcagccaaggggtggggtgcgatgggacgccatccggtcttggcttttgtcgcccgctcctctcggccggccggcagctcccactcccagtgtgcttgctacttacatcacacggaacaacaagtggacgtgcattcgactccgctcctgctgccccccggtgctctgttccctgatacgatacgactgacgcccgttctacgtccacacggaccacacctactcgagagcccttgtccaagcagcacacggaggcaggtttccatcccagcaaaagtattctgttaagccctcgttttttccataacggaggccgtgctggcgtgtgttgccacttgccagtggcaacgatctagcagatcgagcatgcgattgtctcctaagcctcctctcgtctcgtcacgtcatcatcaggtccggtggaccggtctggggcggnaaacaccgcaccatgcgcgcggatgctgtgcccgagcctagcgacctgacctgctggcgtggccattcacgtgtgcctgccgtgccgtgccgtgccgaggccacggcggccggcgcgtttcggcgccgaatttgctgaccgcgtcgcgagatggttcgacctcgacctcgacctcgaccggtccgcgccccgaggtggggacggcggccgctgtcagcgtgcggctgggaagcgacgtggtctcgtccgattcggcccctggatgctggaggcccctcccgcgctcggtgcatgcacctgcacctgcgacagcgagaccgaggcacacacactctctctctctccctgtcagcccgtcacgttttcgttcacgtgggcgggaatcgcctcgccgctgcggccagtccccagcgcccctggggagcgtgcacgcgtcggcatctcgggccatgtgccgccggcacgtgacgagggtgcccacgcagcgtgggtcggcttccgccttcctgtacctgtttccgtttctgcttcgccttccggggacgttgctgtccaccgaagacaacgtgcatcaaggtcagcgtcgttgctggcatgtcattttcgtctggtcacgcagccgccgcacgctgcagctccgggtttgctttaccacgaagcattggagtagacaagtaaatccctactactctacattaacgtccacattagcctcaccatgccccccacggccgcagcaccgacaactcctgccgtcccccgcgcacatctcgccgtgcctacgcgcacctccggccatgtccaggccgtgtccacatgccgcagccctggcacctacctccctctcccccccaccgcacctgcaactttccatcctcgtctgcggccagggtggaagccgtggaggtggacgaaatccaagccgaaaccaccgccccttccatcctagacgctctcttaccatcctcggtattggaacttgctctcctgggcaggttgatccaacgggaaagtagaaaaagtatttgcaaagtttgttgagggatggcaaaatcttcgttaatctccccgtaagggcactgtacagaagta

SEQ ID NO: 10165 - DNA, 1184 bp, Zea mays
agttctcttcgttccgtctcgcagtggtagcaccgcagcagagagaagagagatcttctagcctagtagtagcatctacttactagtgagtgagtaggagtacttggctaggacgggggggccgtgacgacggtagcagcatgagctgcaacgggtgccgggtgctgcgcaaaggctgcagcgaggcctgcgtgctgcgcccctgcctccagtggatcgacgccgccgaggcgcagggccacgccaccgtgttcgtcgccaagttcttcggccgcgcgggcctgctctccttcatctccgctgtcccggacgcgcagcggcccgccctgttccagtcgctgctgtacgaggcggcggggcggaccatcaacccggtgcacggcgcggtggggctgctgggcacggggaactggcacctctgccaggccgccgtcgacaccgtgctgcggggcggcgccatcggcccgctgccggagcttggcgccgggacgggccacctgtacgggccccccgccgccaccgacaagcgcgccggcggctggtccaccttctccacggcgaagcgggcgcggaaggccggtgccggtgcgccgcccgcggcggaggcggcggcggcggcggcatgctgcgacctagggctgtgcctcagcagcagccccgggtccccgccagcggcggcgggcaggagggatcccctcctgcggcccggcacgccgtccatgagctcggacgagtccgtcacgaccacggccggcggcgacagggagcccgtgctgctcaacctttttgcctgatgaagccgccggtcgacgacgcaggccaaaccaaaccaaaccacacgcgcagcggctctcttgattggccgccgtgcgatgtgatgtttgtctggacgatctgtcccggcggccaggcgttttctctcgtcgccggcgacggcaaggccgtttttcattcgtttctggctgctgcggccttagttttttcttttttggttgcgtagtagcggtagtagaaaagaaactaccagtagcagccggcctcgaagccccgtttgcgtgtgggcgaagatgagagcgccggtggccaccccaccaaagtataactatttttccccctgttttttttcttcttctctcctttattgaacaattactataatataaataaaatactatagcaccacc

SEQ ID NO: 10166 - DNA, 1092 bp, Zea mays
  misc_feature (910)..(910): n is a, c, g, or t
  misc_feature (1019)..(1019): n is a, c, g, or t
  misc_feature (1071)..(1072): n is a, c, g, or t
gccggccggctcggggagagaacctttactagcgctcgctgttgctgtgcgctgtgcagggcgcatctatccgcatctccgcccccccccacggtggcatcgcctcgcctcgcgtcggatcaatccatcccctcgccctcgccttctgctcttcctcatcgggggcaggcggagccgcagagggaggagccgccggcgctaggaatccccaatccgtatcgctcccccaacgattttgagtatattgctgctgcttctcaagcctattcttattgtagatcgaatcgatcaattcgctgcatcgactgatagtagatagggttcatacgcccattccattgattcgacgatgttccgccgcgactgtgtgggatcgccgccgccatgacccccggctacctccctccaccttcgtatcccgacgtcttgaccaaaccccaaacctgactccgaccccggttccccgctggaagagtataatagccaaaacacaagcggcccgtgcgcaccaaccaccaccggagcaacaggatggccgatagcggcggaatcagcgccgacaacgccgcggccgctaacgacgacgacgacaccaacacggcgcctttccccgacacggtccaggtcggaggatctcccgagtacaaggtcgagaggaagcttggcaaaggtggcttcggccatgtctttcttggccgacgtctgactgccgcccacgccgcacgctccgcggcgtccgctgcccaagaggttgccatcaagtttgagcacactagcagcaagggctgtacctacggccctccagctgaatggcaaatctacaccgctcttggaggcacacacggcgtgcccaaggtgcattataaaggtcgtcagggtgactactatgtcatgattatggatatgctgnggcctagtttgtgggattcatggaattcattaggccaatccatgccatcggaaatggtggcttgcattgccatggagtccatttccatcttggaaagcatgcattctanaggatatgttgcatgggagacgtcaaacctgagaactttcttctggggcagnncttcacgcctcatgaaagaa

SEQ ID NO: 10167 - DNA, 2304 bp, Zea mays
gcacgccgtaaccccaaacctgactccgaccccggttccccgctccattagaataatcgccgcggcgctcgcgccccggccccgcccaccaccaccggagcaacaggatggccgatagcggcggaatcagcgccgacaacgccgcggccgctaacgacgacgacgacaccaacacggcgcctttccccgacacggtccaggtcggaggatctcccgagtacaaggtcgagaggaagcttggcaaaggtggcttcggccatgtctttcttggccgacgtctgactgccgcccacgccgcacgctccgcggcgtccgctgcccaagaggttgccatcaagtttgagcacactagcagcaagggctgtacctacggccctccagctgaatggcaaatctacaccgctcttggaggcacacacggcgtgcccaaggtgcattataaaggtcgtcagggtgactactatgtcatgattatggatatgctggggcctagtttgtgggattcatggaattcattaggccaatccatgccatcggaaatggtggcttgcattgccatggagtccatttccatcttggaaagcatgcattctaaaggatatgtgcatggagacgtcaaacctgagaactttcttctggggcagccttcaacgcctcatgaaaagaaactttatcttgtggatcttggattagcaacaaagtggagagatactgctaatgggcagcatgttagttatgatcaacgtcctgatgcctttagaggaacagtcagatatgctagtgtccatgcacatttaggaagaaccgctagcaggagagatgatttggagtcacttgcctatacactagtattccttcaccggggcaggttgccatggcagggatatcagggtgataataaatcatttttggtgtgcaagagaaagatgagtacctcacctgaggccctctgcggcatatgtcctcaacctttcaaggagtttcttgaggccgttgtcaacatgaagtttgatgaagagccaaactattccaagttgatttcattgtttgacagtttaattggaccaatcccttccattagaccaatcaatactgatggagcccaaaaggtagggcagaagcgtgccaggttgcttaatgatgacgacgaccatgtaaaaaagaagattcggctgggtgctcctgcaacacagtggatttcagtatacaattcaaggcaacctatgaagcagaggtaccactataatgtggctgatgcaaggttagcgcaacatgtggagaaaggaaatgaggatggtttgttgataagttcaatatcatcatgcgcaaatctttgggcaatcattatggatgcaggaactggcttctcagctcaagtttatgagctatcttcacactttcttcataaggagtggatcatggaacaatgggataaaagtttctacatcagttctgttgctggctccaacaatggaagttctattgtagtgatgtcaaaaggcacaccatatacacagcaatcttataaagtcagtgattcctttccatttaagtggataaacaagaaatggaaagaaggttttcatgtgactgcaatggcaacatcaggcaatcgatgggctatagtcatgtcccgcagtgctggattttctgagcaggttgtggagttggacttcttgtacccgagcgagggcatccatagacgctgggacaatggcttccgtattactgcaatggctgccacgatggatcagtctgcgctgatcctaagcaagccaaggcgtcgcccaagagacgagacacaagagactctgcggactacacagtttcccagtcaacatgtcaaggacaagtgggccaagaatctctaccttgctgggatatgctatgggcgaaccgtggcctaacatcgtccgttgctgacctagctgttgtttgatgtatattttgagttttttatcagctgctaccagcatgagccacaaggcatttgccttgtcgtaacccatggaaattggaaaggggatgaattccgatgtatgtgcccgaacttgattctagggttggtctcgtaagttaatcgggaaaggcgggtgcagacactactgatgagccgtaacgtacccgtcagatcccccagatacaataaaacgagtctgtaatgtggcttttgcatcgtattttctgcatcgtgttaaggagaattctgtttttttattcaaaaaaaaaaaaaaagggaaaaaaaaagaaaaaaaaaaaataagttaaatagttttcagctaaaaaaaaaaaaaaaaaaaaaaa

SEQ ID NO: 10168 - DNA, 642 bp, Zea mays
ggctagcgtgcccacacaagttcatgtctgcccatggcagattggcagcagcagccagcatatacaggtagctagcgttgcaacgctctccactggagcagaccaactgctttggcctttggttgggagtatagtcggtctcggtcggcgtcagcccctcccttgcttgccgatccctaccgctccaaacacccgccagggctgagagctcgactccgactcgagatatggccgactggggccccgtggtggtggcggtggtgctgttcgtgctgctctctccgggcctgctgctgcagctgccggccaagggcgccggccgcttcgtcgagttcggcaacttccagaccagcggcgcctccatcttcgtccacgccatcatcttcttcgccctcgccgccgtcttcctcatcgccatcggcgtgcacatcactacgtactagccttggaatcttacttcatcagtctgcctgcacacccttgtgcagacctagcaagtggtttatatggctgtgggctagctgcctgtactcgtgtgtcgatgcatcaactgtgatccagttattcagtggcgcggcaagaaaccctgattatttaaaactactctttcaggtccaaaaaaaaaaaaaaaaaaggccccta

SEQ ID NO: 10169 - DNA, 1170 bp, Zea mays
ggtcgtccgtctgttccacctgatctggctaatgggcaaggcgaagaaatggtgggcggctctcgagatctacgaggacctgctggacaaagggccgaagccgaacaacctgtcccacgagctgatcatgtcgcacttcaacgtcctcctggacgccgccaagcgaaggggcatctggaggtggggcgtcaggctgctggacaagatgcaggagaagggcctgaagcccggaggcaaggagtggaacgcggtcctcctcgcgtgctcaagggcctccgagacgtctgcggctgtggacgtcttcaagaagatggtggagcgagggctgaagccggacgtggtctcctacggagcgttgctgagcgcgctcgagaaaggcaggctctacgacgaggcactgagggtctgggaacacatgcgcaggctcggcatcgaacccaacctctacgcgtacacgatcctggcgtcgatctacatcggcaagggcgaccacgccatggcggacgctgttcttcacgacatgctgtcgaagcggatcgcgccgaccgtcgtcaccttcaacgcgataatcagcgcgtgcgcgaggagcggttcgggtgggaacgccttcgagtggttccacaggatgaagacgaagggcattgagccgaatgagatcacgtaccaggtgttgattgaggctcttgtgcaggatgggaagccaagacttgcctatgagatgtacatgaaggcttgcggccagggtcttcagcttcctgcaaagtcgtatgacaccgtgctggaggcgtgtaaggcttatggttccgtagtagatgtagctactctgggtcctcgaccttccaaaggggtggaagtggaacccatcaggatagagaatagcttctccagtctctctcagttcaaggatgtgcatggcagctctcatcgttttgcaggcgttggaatgtatgggttttacggatacagaatggcaaggtaaacaaaccaagcatgtaacctactatcaatccccctctccctcttgtaatcaccctcccaaacccaatgccacatttttaaaacatttgactcgtgtatttgtaagctcactaagttgcgaaaaaaaaatactagtgcactgccctttatgttagtgtggaccaaaaaagcgatgcaactttttggtgcgca

SEQ ID NO: 10170 - DNA, 1106 bp, Zea mays
  misc_feature (1075)..(1075): n is a, c, g, or t
  misc_feature (1085)..(1085): n is a, c, g, or t
ccggccgggaaaccccagccaacgccctcccccctgttcccctcgtctcgtcgccgcctacgaaaatggctgcgctcgcgacactcctccgccacagccgccgcagccatgcccacgtcctccccatctcccgtgcgctctccaccaccaccccgaccaccggcggcaccgatcccgttgccatcacgttgtcggacgccaagagacaactcctccgcgagcgcgatccggaccgcgtggtctccatcctcgacgccatcgacacggcgtccatctccgctgcttccacccggcacgcgctctccctcgccgcgcgccgcctttctcgctcccgccgcttcgctgacgcggaggccctcctctcctcccatctcaccgcgtccaccaccgaggcccacctcgccgccgtcctgtgctcctacgcctccgccaacctccccgagaaggccatcgacgcgttccgctccgctgcgccgtcccttccaacccccaactccccgctccccttcaacgccctcctctccaccttcatacgatgtcgccgctacagacgcgtccctgtcctcttcgctgagctctccaaggagttttccatcacccccaatgccacatcctatggcatccttgtcaaggcctactgcatggcccgcgatgatgctaaggccaagcaggccttggatctaatgcgcgagcaaggtatctcgccgaccaacaggatctacaccacgttgatcgattccatgtataagaggaagatgaccaatgaggctgagtctttgtggaaagagatggtagaaagtgaatgtgagcccgatgtggcaacttataatgtgaaggccatgtactacgcgctccatggaaagccagaagaggttatggaggtgatgacagagatggaagcggctggtgtgaagccggacaccaccacctacaatttcctcatgactagctattgcaagagtggcaaattggaggatgctaaggttctttaccactccctagctgagaaggggtgctcggcagatgctgccacgtacaagcacatgttagcagaactctgtgcctatggagactntgatgctggnttgggcatcttcaaggatagc

SEQ ID NO: 10171 - DNA, 4040 bp, Zea mays
atcgtcgatgtatttaagcgtgccggccccgaggcccggcgcgggatcttatcccttccaggcagcatccccagcctgacgaaggaattgaggaggctcgagctacgtcaggatccaacaccaccatggttacgggaaagaagaggacattcgtgctctacccgtcgctgggcgtgggccacctgaccccgatggtggagctggccaagcacctcttgcgccacggccacggcgcgctcatcgccgtggtcaacccgcccgacaccgacgccgtgtcggccgccgcggtggagcgcctcgcggcggtcaacccggccatcgcgttccgcctcctgccggtcccggccagcccggacgccggcgcggactgggtgaagcgcgacctggacacgctccggctcgccaaccccgtgctccgggacttcctgctccggtcccagcccgccgccgccgccgacgcgctcatcctcgacatgttctgcgtcgacgcgctcgacgtcgcggcggagctcggcgtcccggcctacttcttcttcgcctccgcggcgggggacctcgccatgttcctcaacctgccgtacctctaccccaccctgccgtcgttcagggacatgggcgaggcgccggtgcgctgccccggcatgccgccggtccgggcgatggacatgccgctgacggtgcaggacagggacagcgaccggaccaaggtccggatgtaccagttccgccgcatcccggaggggaggggcgtgctggtcaacagcttcgcctggctggagcccagggcactgagagcgctcggcgacggcgtctgcgtgcccggccgcccgacgccgagggtcttctgcgtcgggccactggtcaacgacggcagcagcacggcggggggcggggggaggcacgagtgcctggcgtggctggacgcgcagcctaagcggagcgtcgtgttcctctgcttcggcagcaagggctccttccccgccgcgcagttacaggagatcgcccacgggctggagagctccggccaccggttcctgtgggccgtgaggagcccgccggaagaaccggacacggacctggggaagctgcttcccgaagggttcctggacaggaacagagacagaggcatggtggtgaaggactgggtgccacaggcagaggtggtgcggcacgaggcggtccgcgcgttcgtcacgcactgcggctggaactccacgctcgaggccatcatgtctggcctgcccatgatatgctggccgctgtacgcggagcaggggctcaacaaggtgttcatggtggaggagtggaggatcggggtggagctgcgcgggtacgaaaagttcgtcaaggcggaggagctggaagcgaaggtcagactggtgatggaggctgaggaagggaggatcctccgggagaggctcgcggtggcgagggagaaggcgttgggggctactaaggaaggcgggtcttctgaagtggcattcgcggagttctttggagatttggacaagagcagctctccgtcggtaaacggagaatgcgattgaattgatcactggtgtgctggtgtggcagatggactgcgaacgtatatatactttaggattcaatatcacttagtattttgacagtacgagactaaaatattgcatctgtggtatgggaataaaattggattcaagcagagcgccacttgcgttgcgtgctacaatgtgattgtcagttttaccttattttatgaatcaatccactgatgattgtaactagcaatagcgtattctgatttttagctagaatatgctaccctggtttgtttttttttccttatcacccagcatatatttatttgtcaaactcatgctccctcgaatctctttgggagaaatcaaccgaacaaacccggaaatatctcacatagatcatagtccaagctaacattagaacagatcaggtaacaggatcagccatgatgctcactttagtgcatgatcatttggcgagcatgatatccttcaagaactcctcaaacgccatccgcgacggcccgccatcagccagcgcctctgccgccttctcctttgccaacgccagcctctccctgagcttctccccttcctcagactccatcaccagcctcaccttcttctccacctccgccgcgctcaccagctcctcgtcgtagccgtccatcaccaccccggccttgatctcgtccactacgaacaccttgttcaccctctgctcggcgtacatcggccagcacagcatggggacgccggccgacgccgcctccagcaccgagttccacccgcagtgggtcatgaacgcgcccgtggctgcgtgccgcagcacctccacctgcggcgcccacatcttcaccaccatccccctgtcactcgtgcgctccagaaacccctccgggagcagcgagtccaggtccggctcaggacgcgcgaggaagaacttggtcgggtcctccggcgggctccgcacgacccacaggaaccgatgcccggagctctccagcccgcgagcgatctccttcacctgcgccgcggagacggcgcccaggctgccgaagcagaggaacaccacgctccgttccggctgtgcgtccagccacgacaggcacgcgtgccgctcccctttctccgccgcctcctggcccctgacgataatcgggccgatggggtaaaccggcggcgtggggcgaccagggacgcagacgccgtccctgagtgccctgacggcccgcgcctccagccactcgtaggtgttgatcagcaagccccgagcctcggggacgcggccgtagtgcacgatccgcgaggcgcaggtccgggccgcgcggtcgagcacggtgtgaggcatgtccgaagccgggatcggcgggacgccggggaagtggaggagcgccttgcccatgtctttgaagctgggcccgccctccgtcgtggcgaagtagtggggaaggtggaggaacgcggcgaggtcgccagcgcaggaggtgtagtagaagtaggccgggatgccggcggatgcggccgcgtcgagcgcgtcgccgcagaagaggtcgagcacgagccccggcgacggagggaagggagcggaggaaggcggtgagggaggggactgtgaggcggagcgcgtccagcatccggaggaaggggtccgggtccgggacagggtagtccggcggcgggaggtggtggaaggatacggcggggttggcggcctcgagcgtggcgacggcggatgcggaggaggcgaagaagtcggcagtggacgacggcggggtcgggacggcgattatgacagccaggtcgcggcggaggaggagcttggcgagctccaccatggggatcaggtggcccacgccgaggcaagcgtgcagcaccacggtcgggtgaggactgggctccgccatcagcgtcagcgatgaggacgagccaccgaggtgaattctccccctttatcaacgagatggtggtcgagtagtgtagtgtagcgtcgcaccgtgagggggcactccgaactggtttttagctgatttttttgaagccattataaaagatgaattccagagaaaccattagaaaacttgtcatgactctgtgtccttagataacatttgttttagctttaagcgccactgtcgtctgttgtgttgtttcctttcatgtcactagtgtcacgtggttttggcggtaaacattggcaccatatgacaatggaacgctgcactgcacgtcaatcgtcaaacactggctagtgagtgcccaatgggattttgagttactgactaatccccgtcggaaacgaacagcgcgattgccaccaatgcctcgcctttccacggctaatcgtgcagcacctccttttgaatccctctgtctctcggcacgtctatttcaagatcgtcacgtcacgccctcctatttttgagatggcctcgctccgacctcagaatccattggagcagctgccggggtgcttctccgttctccaaatcatacttgctgagaggatgttgtggcatg

SEQ ID NO: 10172 - DNA, 1123 bp, Zea mays
gtgattcatgggccgatttcacaggaaacatcgagaacgacgacctaccctgtctgcggtctgcctgcaaccacacgcactggaagcatcgtgcgggtgcggcgcagcgagcgagaggagtggaggatgacggcgcccaagcctggcgggggagcgggcggcggcggcggggcccaggacggtgctcatgacgggggtgagcagggggctgggccgggccctggcgctcgagctggcgcgtcgcgggcacgcggtggtcggttgtggccgttccgccgagcagctccgctccctcgaggcagagatcacgtcaccgtcgcgccacttccttaccgttgccgatgtctagccagtggagctgattatcgtctcagactatggactagaacagtctgtgcatgagttgctggagcattctccacattgaagaactggtttccaccatattaaaaatggggagatgagagatctgacagcagtatgtccgagctggcaaaggctgttttggaaaagaagcaagttccagatattatagtaaacaatgctggtacaataaacaagaataacaagacatggaatgttccagtggaagattttgatatggtggttgatacaaatatcaaggggacagcaaatgtgcttcgtcattttgtaccacttatgatagcgaggagacatgggattataattaatttaacctctggttgctccatattgtgcttcaaagtgggcgattgagggcttgacacgctcgttggctaaagagctgcctcctggaattgcagccattgctcttagccctggtgtcgtgaatactgacatgcttacttcatgctttggaagttcagcagcgttatatcaaacaactgaaacatgggcacccaaggcagctacaatgatactaagcctttcactggacgataacggtgcctccttgactgtatgaagtggtgaaattttgtgctcaactgattactgatggggggtctgtatatttttgcgagattatggtgatgtaaaatagtagttataatgtgtgtgcactctgatgtccctagctgctgcctgaacgttattgtttagccttacctctatggcctatgcacatgtcttctttcaaaaa

SEQ ID NO: 10173 - DNA, 881 bp, Zea mays
ttgggtacctcgaggccggccgggacgctacttgtgtaatctcgcttcggcgaagcgcgtagcattccttttcctcctcctcccctttgcggcttctcgcagcgctgcgaatcccaatccgcaccgatccgacgcgaatcgatcgagaggcagggggcagcactaatcgaatcgagactagcgccatgaacccgagaggctatcgtagcaacagaacttctctcttcgatggcattgaggagggtggaatccgagcaacatcctattcttctcatgagatagatgagcaagaaaatgatggagctattgatggactgcaggatcgtgtcagcattctcaagcggttgtcaggcgatatccatgaagaggtggagactcataacagaatgctggaccgaatggggaacgatatggatacttcaaggggttttctgtctgggaccgtggacaaattcaagatggtatttgagaccaaatcaagccggaggatgggaaccctcgtcgcatcattcgtcgccctttttctgctggtttactacttgaccaggtagaagacatgacatgctggaaatggtcatctcatcatctgcgtaccgtgccgtatagatagatacccaccgtcctgagtgccaaagtatatgttgatgtgggtgtttcgtcaactctgcactgtacaacacgactacagcgtgcgtgctgggtcgatcccctatgctctcttgttgcaggattcaagtttgttgttgtccgttccttccctttggcatgtcatgtgtatggtatttagtagcatatgtggctgtactcctttttaaaaaaaaaacaaaaaaaactgtataaagaagctttgattgagcactaaataaaaaaaaaaaaaaaat

SEQ ID NO: 10174 - DNA, 847 bp, Zea mays
ccggccgggacacgctacgtgggttggctcccgccgggccggcgcccggcattccttttcctcctcccctttgcggcttctcgcagcgctgcgaatcccaatccgcaccgatccgacgcgaatcgatcgagaggcagggggcagcactaatcgaatcgagactagcgccatgaacccgagaggccatcgtagcaacagaacttctctcttcgatggcattgaggagggtggaatccgagcaacatcctattcttctcatgagatagatgagcaagaaaatgatggagctattgatggactgcaggatcgtgtcagcattctcaagcggttgtcaggcgatatccatgaagaggtggagactcataacagaatgctggaccgaatggggaacgatatggatacttcaaggggttttctgtctgggaccgtggacaaattcaagatggtatttgagaccaaatcaagccggaggatgggaaccctcgtcgcatcattcgtcgccctttttctgctggtttactacttgaccaggtagaagacatgacatgctggaaatggtcatctcatcatctgcgtgccgtgccgtatagatagataccttgaaaacccaccgtcctgagtgccaaagtatatgttgatgtgggtgtttcgtcaactctgcactgtacaacacgactacagcgtgcgtgctgggtcgatcctatgttctcttgttgcgggattcaagtttgttgtccgttccttccctttggcatgtcatgtgtatggtatttagtagcataacaacaacaaaaaaactgtataaagaagctttgattgagcactaaaaaaaaaaaaaaaagcggcc

SEQ ID NO: 10175 - DNA, 2273 bp, Zea mays
cgtccgcccacgcgtccgcggtccccaccattcagctgccgctgcccccgattgagccgccgccgcctcagattcgccgtcgccacctcagattcgccgccgccgccgccgatttggacgctgtcgccggcgattcagcctccgccgccctggatttggcctccgccgctcccgattcggcgctgccaccctgaaacagcgccgcccctttcccttcccctatgccctatgccctcttgctgcttctcacctaggcgacggggacgccttggatccttcgggcgcctggacgcctaggcgacgcctttaaaacaagggtcttctctgtattaaatattttctgatgtacagtagctaccttgttaattcatgcctccagcatgattctccgttgtgctccatctgtttgttgcttgaccttgcgccttgttattctgccatttggttgaggatagattaatcctcaattgtctgacaattgttcacgtctaatttaggttttttcggcatttgggtttgttcacaagatagctacttttgagaaagcagctggtttccaggcacttatccagtatactgatgccccaactgctcttgaagctaaaaactcattggatggaagaagcatcccaaaatatttacttccagaacatatcggtgcctgccacatgcgcataaccttttctgcgcataaggatttgaatatcaaatttcagtcgcatcgcagcagggattacaccaatccttaccttcctgtgaaccaaacagcaattgaggggattgtgcagcccacggtgggccctgatgggaaggtaaaggagcctgagagcaatgtacttttagcatcaattgagaacatgcaatatgctgtgacagtggatgttctgcacactgtgttttctgcttttggagctgttcaaaaaattgcaatgtttgagaagaatggtggaatgcaggctctaatccaatatccagagaggtgtcggagttcgtgaaggcttaaaatggacatctgcaactttccacagctataaagttgtttttagtaatactctctttcttactagaggcttgctttaaactttcattttgtcatcattgaacttcccttgtgacatgcgagtcctaatttaggtacctttacctgtttaatgtgttgggcattagaatatagtcagcacctctatatcattggttcttctgttgaaaaaacattttgacatctaatttgtgggccttatctagcttattgaaataaatatctttgaaaagtatggcaattcaaatgacatcaatcttgttggtgctcaatactgtttgtactggttagtggtagttgtaattgaactgctttgatgaaacaagaatctctaaatacctttgcacccacacttatcacattatgaccctggaatccagagtatcttaaaatttattctttatggtcaagtggaattgctagttctgtttcccccttagccatggaaatatctcattaatatttgatgtacaaatacataggttcatctgactaacaaaatctttttttagatataactaccgcagccgttgctaaacaagctttggagggacactgcatatatgatggtggttactgtaagcttcatctgccatactctcgtcatactgatctcaatgtaaaggcacatgatgagagaagcagggactacactctttcagaccctaacgtgcagctgcaagctgctgcacaaacgccagttctaaggtctccgggagtggcatggcagaacactgcatcagtaccagctgctcctttttatgcaagcacagcgacttcaactcctattggagttggacaggtggctgcttggaatcctaacatgcaggcagggagttttgcatctgcatcgactgcataccccaaccaaccattaatggccaactccatgcctcactatcctgctattggatcgagttccggtgccccaccagtagcatttcaggcttcgcagcagatgacacagtatagcatgccccctggtgctccgccgcacgcaccaccagctggccaatcgatttactacccgaagtaagcggttttggttcaatattatcagagagcaatcaggcattgttacctgcgacaattgtggtccgcaaatgcaatcttgcgaattttgcaagtgcgctgtagcacttgtaacttgcgagcgcccttcgcaagaatgcatcagcgtctgctgtgtctgtaaaactgtcaaagatagtgtttacctattagcttgcatggt

SEQ ID NO: 10176 - DNA, 1913 bp, Zea mays
ctgcagcgacatgggagcctccacgcgcggaggcggcgccagtgcccggcctggggacggggacggcgacggcgaggcggcgaggacggagttggacgccgcggcgggcccgggcgccgggcccgcgtcgaagaagaagcggtccgtggacgtccggccgaggctgcggatgacggcctctgaccactcctcggaggccgttgtcgtgcagaagctcccgacttcgaggtcgagcaagtcgtccgccgcgtcatcgtcccctccgtcgtcgtcgtcgtcgaagaagaagaagcggcgggagtcggcggcgtcgaagtagaccgagttgacggtcttgtacatctcgtcgcccggcgcggccccgcgccacggccgcggccgcagcctcccgccgccgcacggtgctgctgccgcttcctcgaagcgccccgcggcggacgtggtgcacggccggtcgtcgccgccgccggcatgcccgcggaaggacgccgtctgcggcttggtcgcgcaggacggccacggccacggcggggagggcgcgctcgccgaggagccggcgctgggcttggagtgcttggaggaggagaagatggaggccaggcctcccttcctgcccattcgccggactcggctcggactcggaggccgcgcgccggccgtgggtgttgaatggatggaccgaccagaggtgagcggtgggtgaatgagtgtacgtgagccccgcgagctcaaacggaaggctcccgatgtccggatggtagcaattatcccgagctgcaggcaggcaggcagagagagagagagagagagagagagagagagagagagagagagagagagaggcgtgtgtggagtgaggagggtggaggaaggagacgggtcggtgactcggtgatgctcagctcatgtggggatggggccgtgggacatgtgcccgtatttatgtattccctgttgctgttgccacctcgcaagggcagggcaggagcgaggtcgatggagagttccattcattcattcactcactcatgtcatggggccggccgagcaggtgtgacacctgaggtgtcctgcatttctgtgggagggaagggagcgtgaactggtgaagacgacgacgagacggagaggagtgacgacggacgccattatatcttcatcgcgtcacgcgatgcatcagctccgtcacgtaaactggcctgaaatgattgacaggaacgaatgatccatatttgcgttatttttagttgacgagcgagtctgtggttaaagatggtgacgaagaagaagagactcatggacacctgcagcagcgtctagctgaaggtttattatgacttcacagcccttgcaaccagggctatgagctgccaaaagtgcatcgagagctgcagccgcatgcgttgctgctactgccagttctgcacatttgtttatcctaaaccctatgtgctccattcgatggagcctgcttcatattattgggccgcgatcgttttcttttggtgattcccgagtgcgatcgttctgtcagcaagtgaagtagacgaggaattttttaaaagggctgacttgttatataatatatgcagccttcgctaactctgagaaattccatgtcggttgtcccgaaacaaaaatctcaaccctcagggcatatatgcattcttattaattgagagatcccttaagaaggttaagggttaatttgttggatagagatcactagaggattcatatacgagaaatccaattttgaatagcaaggggatttctccactcactaccgaaatttggctctttgccgagtgtcatattctttgccgagtgttttatttcgggcactcggcaaagagctctttgccgagtgccacgcaaaaaaccctcggtaaaataaaacactcggcgaagaa

SEQ ID NO: 10177 - DNA, 1863 bp, Zea mays
cattgggaccctcgaggccggccgggaagccatcccatcccccaccccacatttccccaataggccacccccgtccccgccggcgggaacgtgctcggtttcttcctccctcgaatcggctgcaccccgtgccgcgatacgaaaacccaccaaaccctaaccctagctgcagtgccactaccgcccgcttgcccggtctccggagaggaagccgacccaagcaaggatgccgtccgggtcagcgacgcaatttcggtacacgcagacgccgtccaaggtgctgcacctgcggaacatgccgtgggaatgcaccgaggaggagctcgtcgagctctgcaaacccttcggcagggtcgtaaacaccatgtgcaacgtcggcgccaaccgtaaccaggcattcgtcgagtttgcagatcaaaaccaggcaatttcaatggtgtcctattatgcttcatcttcagaacctgctcaagttcgcggtaaaactgtctatatccagtattcaaacaggcaagaaattaccaacaataaaggcactggggattcttctggcaatgtcctacttgtaacttttgaaggcgttcagcctaatgatgttaccatagaagtcattcatttggtattttcggcatttggatttgttcacaagatagctacttttgagaaagcagctggtttccaggcacttatccagtatactgatgccccaactgctcttgaagctaaaaactcattggatggaagaagcatccccaaatatttacttccagaacatatcagtgcctgccacatgcgcataaccttctctgcacataaggatttgaatatcaaatttcagtcgcatcgcagcagggattacaccaatccttaccttcctgtgaaccaaacagcaattgaggggattgtgcagcccactgtaggccctgatgggaagataaaggagcctgagagcaatgtacttttagcatcaattgagaacatgcaatatgctgtgacggtggatgttctgcacactgtgttttctgcttttggtgctgttcaaaaaattgccatgtttgagaagaatggtggaatgcaggctctaattcaatatccagatataacaactgcagccgttgctaaacaagctttggagggacactgcatatatgatggtggttactgtaagcttcatctgtcatactctcgtcatactgatctcaatgtaaaggctcatgatgatagaagcagagactacactctttcagaccctaatgcgcagctgcaagctgctgcacaggcgccagttataagttctccgggagtggcatggcagaaccctgcatcagcaccagctgctcctttctatggaagcacggcggcttcaactcctgttggacaaccgcctgcttggaaccctaacatgcaggcccctggttttgcatctgcatcgacagcgtaccccaacccaccattaatggccaactccacgccttactatcctgctattggatcaagttcaggtgccccgccggtatcgtttcaggcttcacagcagaggccacagtatggcatgccccctggtgctccaccgcacgcaccaccagctggccaaccaatgtacttccagaaataagtggtttcgattcaatgttatcaaagagcattcacgcatattacctgcaactattgttgtccgcaaatgccatctggaatttttttggaagtgcattgtaactcttgtaacttacgagcgccctacgcaagaataccccaggctggctggctattaaaccgtcaaaaatagttttaacctattagcctgcgtggtatattgttatctcaatgccgagttgttttaaaaaaaaaaaaaaaaaagcggcc

SEQ ID NO: 10178 - DNA, 897 bp, Zea mays
ttttttcttgcggaccaacgcgagacaccgaggcgaagggcggtcggggccagggaagtgcggaaggcgtcggtcggcggcagctctgctcggtcacagcgcttgaggggcggtgtagaggccgccggagggagtgaagagggagatggctccggccagcgggtggggccgggcggtggggaacacgcggtcgttcgtgggcaacgcgctgggcggcctccgcgggtggagcaacctcgcctcctggaccgtcgccggaaccctcgcctactacctctgggtgaagcccgcgcgccagctccagaaggagcaggaggagcgagccgctttggctgctgcaacggatccttatcgttacgtcgagaagcggaaaccgattcctgatccacaggacactggccttatctatgggaagaagagggagcctaccaaatctcaagattagctagcgccctgggcacatcttgtaccaaatgtgccgccagtttatgtgcaacaataccaggaatggtttctgcgtgtctgctggatacatggtaaacgttttttttcatgaaactgttcctgctttgtgcgagcaaaaagcagctgcagatggattttcagtctgggtacttgagcggttgtgccctggaagtgttgttcatcttcactatcgtctaggagagatgaagatgctttcagaatagaacaagagagagagagagagagagagagagagagaatgatttctgtactttttttatagcaagttaatcatgttggcgtgtttatgtgtcacactatcaatgtacaccatggccaggggctttatgttttttttccttcggcgtactgttactgctaagtaattgtattccatgaactttggagctgaattgcgattgaatttagctt

SEQ ID NO: 10179 - DNA, 1896 bp, Zea mays
cattgggtacctcgaggccggccggccactccggcaattcccatttccccttcccaacaggccaaccccctctacctatctttttcctcagcaaccgtgctcggttcctcctccctcgaaacggctcccacccccgcgccgcgataagaaaacccaccaaaccctaaccctagcagcggtgccacaaccgcccgcgttcccggccggagaggaagccgagccagcaaggatgccgcccgggtcggcgacgcaatttcggtacacgcagacgccgtccaaggtgctgcatcttcggaacatgccatgggagtgcaccgaggaggagctcgtcgacctctgcaaaccctttggccgggtcgtaaacaccatgtgcaacgtcggcgctaaccgcaaccaggcattcgtcgagtttgcagatcaaaaccaggcaatttcaatggtgtcctattatgcttcatcttcagaacctgctcaagttcgtggtaaaactgtatatatccaatattcaaacaggcaagaaattactaacaataaaggcactggggattcttctggcaatgttctacttgtcacttttgaaggtgttcagcctaatgatgttaccatagaagttattcatttggttttttcggcatttgggtttgttcacaagatagctacttttgagaaagcagctggtttccaggcacttatccagtatactgatgccccaactgctcttgaagctaaaaactcattggatggaagaagcatcccaaaatatttacttccagaacatatcggtgcctgccacatgcgcataaccttttctgcgcataaggatttgaatatcaaatttcagtcgcatcgcagcagggattacaccaatccttaccttcctgtgaaccaaacagcaattgaggggattgtgcagcccacggtgggccctgatgggaaggtaaaggagcctgagagcaatgtacttttagcatcaattgagaacatgcaatatgctgtgacggtggatgttctgcacactgtgttttctgcttttggagctgttcaaaaaattgcaatgtttgagaagaatggtggaatgcaggctctaatccaatatccagatataactaccgcagccgttgctaaacaagctttggagggacactgcatatatgatggtggttactgtaagcttcatctgtcatactctcgtcatactgatctcaatgtaaaggcacatgatgagagaagcagggactacactctttcagaccctaacgtgcagctgcaagctgctgcacaaacgccagttctaaggtctccgggagtggcatggcagaacactgcatcagtaccagctgctcctttttatgcaagcacagcgacttcaactcctattggagttggacaggtggctgcttggaatcctaacatgcaggcagggagttttgcatctgcatcgactgcataccccaaccaaccattaatggccaactccatgcctcactatcctgctattggatcgagttccggtgccccaccagtatcatttcaggcttcgcagcagatgacacagtatagcatgccccctggtgctccgccgcacgcaccaccagctggccaatcaatttacttcccgaagtaagcggttttggttcaatattatcagagagcaatcaggcattgttacctgcgacaattgtggtccgcaaatgcaatcttgcgaattttgcaagtgcgctgtagcacttgtaacttgcgagcgcccttcgcaagaatgcatcagcgtttgctgtgtctgtaaaactgtcaaaaatagtgtttacctattagcctgcatggtatattgttggtgagatatgttggagtagttttgatgccccaagaggctctcaaaaaaaaaaaaaaaaagcggcc

SEQ ID NO: 10180 - DNA, 1798 bp, Zea mays
tccccaccattcagctgccgctgcccccgattgagccgccgccgcctcagattcgccgtcgccacctcagattcgccgccgccgccgccgatttggacgctgtcgccggcgattcagcctccgccgccctggatttggcctccgccgctcccgattcggcgctgccaccctgaaacagcgccgcccctttcccttcccctatgccctatgccctcttgctgcttctcacctaggcgacggggacgccttggatccttcgggcgcctggacgcctaggcgacgcctttaaaacaagggtcttctctgtattaaatattttctgatgtacagtagctaccttgttaattcatgcctccagcatgattctccgttgtgctccatctgtttgttgcttgaccttgcgccttgttattctgccatttggttgaggatagattaatcctcaattgtctgacaattgttcacgtctaatttaggttttttcggcatttgggtttgttcacaagatagctacttttgagaaagcagctggtttccaggcacttatccagtatactgatgccccaactgctcttgaagctaaaaactcattggatggaagaagcatcccaaaatatttacttccagaacatatcggtgcctgccacatgcgcataaccttttctgcgcataaggatttgaatatcaaatttcagtcgcatcgcagcagggattacaccaatccttaccttcctgtgaaccaaacagcaattgaggggattgtgcagcccacggtgggccctgatgggaaggtaaaggagcctgagagcaatgtacttttagcatcaattgagaacatgcaatatgctgtgacagtggatgttctgcacactgtgttttctgcttttggagctgttcaaaaaattgcaatgtttgagaagaatggtggaatgcaggctctaatccaatatccagatataactaccgcagccgttgctaaacaagctttggagggacactgcatatatgatggtggttactgtaagcttcatctgtcatactctcgtcatactgatctcaatgtaaaggcacatgatgagagaagcagggactacactctttcagaccctaacgtgcagctgcaagctgctgcacaaacgccagttctaaggtctccgggagtggcatggcagaacactgcatcagtaccagctgctcctttttatgcaagcacagcgacttcaactcctattggagttggacaggtggctgcttggaatcctaacatgcaggcagggagttttgcatctgcatcgactgcataccccaaccaaccattaatggccaactccatgcctcactatcctgctattggatcgagttccggtgccccaccagtagcatttcaggcttcgcagcagatgacacagtatagcatgccccctggtgctccgccgcacgcaccaccagctggccaatcgatttactacccgaagtaagcggttttggttcaatattatcagagagcaatcaggcattgttacctgcgacaattgtggtccgcaaatgcaatcttgcgaattttgcaagtgcgctgtagcacttgtaacttgcgagcgcccttcgcaagaatgcatcagcgtctgctgtgtctgtaaaactgtcaaagatagtgtttacctattagcttgcatggtatattggtggtgagatatgttggagtagttttgatgcctcaagaatctcttacgcatctttttttttttaaaaaaaaaaaaaaaaaaaaaaaaaaaaaaaaaaaccaaaaaaaaaaaaaaaa

SEQ ID NO: 10181 - DNA, 2318 bp, Zea mays
ccggccgggaaagttgaagcggaactgcagttctgtctgagtcctgatcctgactcccgaggctctcctccaaaaccccctccttaaaccctagcttccgtacgcctccgcgctcccccatggcctcctcgtcgcaatcgggcggcgccggaggcggcgggacggttgcttccaatccccgcgtctggattgtcgcgagcatcgccgtcgcgggcgtcctcgtcctcgcggaggtcgcgcgccgccgccgccggtggctgcggggcatgtccggcacggcacccgacgctggatccttctgcgaccgctttgagcttcaccctccggcgcagccgcctcctcccgcggctcgccacattctctcgggtctgaccttcgccgctagtgacaacttcgagatcgagggctacgtagccgggtttgggaacccagactggaagaaaactcatgaggcggcgaggcacactgctgtggctgtcacaatgctgcggaaacagggggccacctgcgttggaaggacaatcatggatgaactaggctttggtgtcactggagaaaatttgcaccatggaacaccagccaaccctgtttcttcttcactcgtccctggtggatcatgcagtggctctgctgtggcagttgctgcacaacttattgactttgcaattggcactgatacaattggtgatgtaagaatcccagcggctccctcggggccgcccgggtttaggccttcctatggtgttatatctactcttgggaccatagcaaattcacaaagtctcgacacaatcggatggtttgcacgagatccatgtattcttcatcgtgttggtgaagttcttttaccagccgctgtaggtggacttaagcaaacaaggcaatttgtttttgccgatgactgctttcagctgctaaaggtctctaatcagaaaactgtgcatgccataaaaaatgctgtccaggcattacgtggatatcagccacctaaacacatcaatattggccaatatatttattccaatgtacctagcctgaaggagttttgcgaaccagctacaaagttagaagaaggaacatcagccctgaaagcaatctccacagtgatgttgttattacagagatatgagtttaaagcaaaccacgaggagtgggttaacactgttaaacctaagcttggccttgatatctctactcgtgtgctacaagccgtgaattttgcacgggaaaacatcaaatctttgtacgcaataagaaatgaattgcgggctgcactcaagaatcttctaaaggatactggaattttagttctaccaaccacagctggatatcctctgaagagaaactctaaagaaagactatcatctggatttgaggatagaatgtacaaatttgtaggcgttgctgcactttctggctgttgtgaggtcactattcccatggaaaatctggatcatcatgtatctctttcatttgtagcagcacatggatcagacaagtttctactccgtaatatcttggatacatattctctcatccaggaccaagtagttttggcatccaagttggaaactgcaccagtaaccaatgttgatgttgatgtcaatgcatcagagcttctaaaagaaaagggaaatagcgctttcaaaagaagacagtggatcaaggcaattgagttttactcagaggccatcagtttgagtgacacaaatgcaacatattactgcaacagagcagcagcttatctggaactgggccgttttaagcaggccgaagcagattgtgaccgggccttactgttggatagaaagaatgttaaagcatatctacggcgtggttttgcaagggaagtaactttgaattacaaagaagcacttcaagatttcaggcatgctttggcattggagccacagaataaaacagctcttgcagcggaaaggaggctgcagaaactcctgaagtgatgtggggagcagcagcacatccgacttgtaaattattttgaagacttgcctggttgaaggcaattttgatcggcagcatgtgaaaggaagatgcgatctgctggataagagtcattaaactattttttgtttgccatcattcgaaaatttgtatctcacgacgattgtcagcaagttttgatatagcttcttgctatgaccgtctattaagcgaaaatcttgtatatgcattgtatactacttcgatctgaaggccgagaacgcgagaacccatgcgagcgcttggctctgctggagtgtatgattgtgtagtgcaggatctaatttgggaggcgttgagacgccccttattct

SEQ ID NO: 10182 - DNA, 1203 bp, Zea mays
catgataggtgtgtcatttagcttttgttctttgttcctcttgtttcttttgtaaaattatgctgccaacaggcatctgtaaaatgaaagttcttctggcacatagtgatattattataacattctttttcagaatataaaccaatttttacaacaagttcatgtgcctacgaagagagagagagagagagagagagagaagaaagtcccattactcccacaccaaaggccaatcctttggtgtttgttgcaatcagctccatagaggtctctatcacaaacaatgatgagccgattgtaatcaaagatctagctccatggacaacccaatacggcttggtaagtgtcgttgatgacgttattattatagtaaaccacgcgcaagcagatcaaaactgacatcctgggatctccagctaacgaagcaagcacagcacagcactctgaattctcttgttcagcatgaacctgacaatacaacagcagcccctaagtcatcgtcgatacacaagatgcgattgcgaaaggtacaagccgatttccaccatgggcaacaagcaaacgtaaggtttgcctgccctctagggtcaccttggtgacacgcccaatcaaggaactttcagccctctttacatctagcaaggcgttcgctagctacatcgctcctccatagcatgccctcacgaaacagggatctctccagcacgtccaccaccggttcacttcctcatgtgttcaggaacgatccgatggacaagctcgattgggagcccttcgagttcggctgctgtgaagtcgaacagcgctggcagcggtcgtccacttggcaagcagaccttggggtcccgcagctcatcaaagaatggatgggcacaagcatcaacctgaaaatataattaaatatcttttgatcagaaactaccgagttgcaaggctctcagacttgtccaaacatagaaaggccgccgactcatgttaacatggtctgcttcttataacaactgccataaaactggtttaactgaagggaaacataagagcttagtatcaatagcgacatgtctatactaatttggattcactagttcatcagttacaatctcaaatttgttcttacagcagtgcagcgcaggtttggtgagtactgaagtagccttgacacgagatcaacagcttcaggtggcatgcgcttaccaaaaagct

SEQ ID NO: 10183 - DNA, 2548 bp, Zea mays
tcaacagagagtgacaacaatcaacaggttaatggacatttttccagccatcgtgcttgagtgaatgtttttttgcgtgtgtgtaggtgtgcgtgtgtgtttaattgatataaaataacccaaccaaacatctcctaagatttccataagacagagaggtgaggaatagtattagttctcaaatgaattcaatcaactaaatatcaccatcatatcaacattaataatagaacaataaaattttcatgatagagaggctggtaaactttattttttcatttgattccagtgtagaaaatagtaatataagcagtaaattttttcttaaaaaagagtggaatattcacctttttatataaattagttattcttcgaagcgtcacacacggatgtcctaaagatattcttcaactgcaacacaagcattctgaaaaggttagtaacaatcagattaatgttgtaaaaatatgtgacacgaaaatttaaagaacacgaagtacaatacattggtaagaaatcaaagacacatattaaccaactattagagaacatatacatgtttcttctaatcctggttaggacataggacgagggtttcacttctatcacaatgtgctgcaactttcagagttaatcaaatctgttattcagtgttatgcagcgacaaattccaaatgtataatcccacgatgattcatgtgactccatttcgtctgtaattgatgcgaaactgccgaattgttactgctcccataagttaattgtaccacgcttgatgaagacgttcacgtatcttgtgttcgatttatgtagccgttattcagaccattgcagcgctgagcttcaaggcaattagttttgccccgcgatgtgaggcaggtgatgacacgcgcccttcgggccgatgccgacgcgccaccgtgcagactctaccgaggatgagagcagcgatcgagagacgtggagcgaggaggagactttaggagaggagagaccagagccttaagcggtgacacacccaatgatcaggaccacgcttgcacgtgtcaggtgcctctcctccacgcgtcgcgcgcatcacactgatactgtcatccagctcgacgctatataaagtggtaagcatcttcgtcccccgcgccgccccaacggcccttgcgatcgccaccacgtcagcgcggaggatgcacggccaccagcagcagccgtacccatacgggctgcggcaagacccgctgcggcggatgcgaggtctggacgtgaaatcggcgctccaggccagcccgcgcacgtccacggtggccacggccgcactcgtcgtcccgctgggtgccgcgctgctgtgcgcgtcggggatcgcgctggctgcgaccgtgaccggtctcgcgctcgccacgcctcccctcgtgattttcagcccggtgctcatacccttcgcgctggccgcggggctcatcgcgtcggggctcctcgcgtcgggcgcgctcggcgtcgcgggcgtctcggcgctcacgtgggccgtcgggtacgtctggcaacggcagggcgaaggcggcggcggggtcactgggatggtggtgcagccgctggaccaggggtcgaagcgccatggtgtccaaggcgccgccgcgttcgtggggcaccgccgcctgccacgggacatcgacgttgctggtgaatgatggtttggcggcgtgtgtgcaaacttttctatgctagtttagtttgcaggtgtgtatggattttgatttatggcctggatggatcacactatgtagcgaacgatgtgttcaatttactgttggaataaaactgcagattggtgttacttaataataacgtcctagggaaaattgaaatactctcagcgtcctaaaaaactttatattctagaatttaataaatactgtatgatgtttttggagaatattgttttttacacaaaagactggaccttccagatttattagcgcgtaaaaataaaatttgctacctggcactctttgaaatttttgtctcacctgacgcactcagctcgcggtgttcagttacattcttgtgaagaaacattttctagctagaaaagtcaaatccccttccaatccctattccaatctattactcaaatccccttcaaatcggatccacgttgcggaatgggacgccttcctcccggccagccgcggggctctccacaggtcctgaaagttcgtcaggacagttgcatccagggggctagcccgactgtctctagcaatgttatatatatatatatatatatatatatatatatatatatatatatatatatatatatatatatatatatatatatatcctatattaggagcacttgacttccaataactaaaaggaagcccaggccagacagtgcaatccgacaggtctagacgtctataaaagaaaacccgcaatgctagggatcagtttttcacgccccatatcgattcattagcgatggcggttgacaggtataacggaagcctgagcttccaatagttaaagtaagctcaggccgaccacccct

SEQ ID NO: 10184 - DNA, 553 bp, Zea mays
  misc_feature (534)..(534): n is a, c, g, or t
  misc_feature (541)..(541): n is a, c, g, or t
agctctagcggccagccgggtggaatcttctctctccgtccctcgtccagcaatcaagcgccctgccgctctaggcaccaaaacctcgcgaggcaaccgcccgccggcgccgccgacgtagcaagagggtgagctgaggactagaggagagggaagatgtcgttccgcgcgcgggagatgtacaagaaggtggtgcggcgcttgggtggcgaggggaagctgccggctgagctgatgaagtcggtgaaggacatactgccggacagcaacgtcgtcatggggcgggccaagcgcggcatcttcgcggggcgacacatccggttcgggaacaaggtctccgaggacggcggcaacaaatcaaggcgatcatggaaaccaaatgttcaggagaagcgtcttttcagctatgttcatgatcagcacattagagtcaaggttaccacacacgcacttcgatgtattgacaaagctggtgggatagatgaatacctcctgaagacaccttacaataaaatggataccgagatggggatngtgtggnaagcgaatatcg

SEQ ID NO: 10185 - DNA, 1179 bp, Zea mays
ctcgaggccggccgggacggcccaaagcccaatactgcagccctagcgctagcggcccagctgagtggaagcatctccgcctctcgtccagcgccctgccgccctaggcaccaaaacctcgcaaggcaaccgcccgccggcgccgccgtcgtagcaagagagtcagctgaggatcagaggagggggaagatgtcgttccgggcgcgggagatgtacaagaaggtggtgcggcgcgtgggcggcgaggggaagctgccggcggagcttatgaagtcggtgaaggacatgcttcccgacagcaacgtcatcatggggcgggccaagcgcggcatcttcgctgggcgacacatccggttcgggaacaaggtctccgaggacggcggcaacaaatcaaggcgatcatggaagccaaatgttcaggagaagcgtcttttcagctatattcatgaccggcacattagagtcaaggttaccacacatgcgcttcggtgcattgacaaagctggtgggatagatgaatacctcctgaagacaccttacaataaaatggatactgagatggggatagtgtggaaagcaaaaatcgaaaagatgtattcagatttgggtgagatggaagtaggcttcttccctcctgaggaagaggctaaggttaaagagggctttgacgaggttcgtgctgccaagaaggactttcgtagggaagcaaaacgagctttggcaaagcaaaggcagctagaagcaagtagtgctggtgatgaccaagcgggtgaagtcacgcatacaaaggaaaaggtatcagctgctgctgctaaactctgagcttggcaatcattggatgtccctgggcaaataatgggaggcttgctgcttgatacaaactggggaaggtttctagtgcaataactataccccttttcagggagcaggcggtttatcttaagccagcgtattgtaaacacttgtcacgaggtcgaaattttgtacaatttgaaaattcaagagcctgaattgtggggcagtttgtattgtagaatctatcagagactcagagctaaattggctagaggtatgactcctagctcatttcagtttcatccctatgttgcttaaagattagcaaaaatgccaaaatgaattcatcggtagcttactatgtgaaaaaaaaaaaaacgtgtg

SEQ ID NO: 10186 - DNA, 844 bp, Zea mays
catggccggcccggccgggacgccaacatatatcaccatatctgtttgtctcccttcccttcccttggatccatacagagccgaggaggacggcggcggcggcggcgagaagagatggccgacggcagcagcaactcatcggcgtcggtggccatgggacaggaggtgcaggctttcgttgagaacaagtatggtggaatggtgcctaagaagcctctgatttcaaaggatcaggagcgcgcctattttgattctgcagactgggtccttggcaagcaagctgcaaacagcggcaccgcacgggctgcgactgctatcgaattcttgaagccaaagctaaagaggacgccccatcaccagcttccccctcgcaagccgacctgtgcgtccagctgagctcaagacagtgcgaaaatccaaagggccaggcttacaaaagctccctggctgggagagacgatgaagagcgttatcaagttttttttagttggttgcattggttaggaaggcaaattcaggattgatgagccctgcatttggctttgttcgcagcactcgctgaattattaatttaagcatgtgggggacatagataaaactagactcctgctattatatgcttaattgtggaagtggtagatgacacccatctgtttcaatgtatctttggtcggcagatgaaatgtatcctctctatctacttggcttctccctttctttactagacctcatatataatattcaccgaaaagagaatgaacgaatggatattccaatttgggatggaaatgctaaatcctttaaaaggaacttttttttagaaaaaaaaaaaaaaaaaggccct

SEQ ID NO: 10187 - DNA, 978 bp, Zea mays
ctctccccacatacctcgattcatcgttcatctcccagcccagcccagcccagcccagcaaccgcgaatccgtgttcatctccctactcgatcggcagccgcaagagccgaccctccgctcccccccaaaaaccctagccatcccaggttgctccggccgcatccccgccgaccgccgaccgccgaccgccgacgatgcctcccaaggccaagaaggacgctgcgccgtctgagcgccccatccttggacgcttctcctcccacctcaagatcgggatcgttgggttgccaaatgttggcaaatcaacttttttcaacatagtaacaaagttggctatcccagctgagaattttcctttctgtaccatcgaaccaaatgaagcacgggtgaatgttccagatgaacggtttgattggctctgcaaactttacaagccaaagagtgaggtgcctgcatatcttgaagtaactgacatagctgggcttattagaggtgctcatgctggggatggtctgggcaatgcattcctctcacatatacgtgctgttgatggaatcttccatgtcctaagagcatttgaagacgcagaaattactcatgttgacgatacagtagatcctgttagagacatggaaactattagtgaagagctcagactaaaggatatagagttcatgaaaaagaaacttgaggaccttgataagtcaatgaagaggagcaatgataagctgctcaaaattgagcatgaattatgtgagagggtcataggccatcttgaggaagggaaagatgtccgtttaggggattggaaagctgctgacattgagatcttgaatacattccagctactttcagctaagccagttgtctatttggtgaatatgagcgagaaggactccagagaaaatggtgaaaccatacttcctttcagctgtgcttttgaacagaaactagtggacatgccagaagatgaagcc

SEQ ID NO: 10188 - DNA, 1729 bp, Zea mays
gggtacacctcgggctggccgggacagcacctcgatccatcgttcatctcacagcccaacccagcccagcaaccgcgaatccgtgttcatctccctactcgatcggcagccgcaagagctgaccctccgcttcccccccaaaaaccctagccatcccaggttgctccggccgcatccccgccgaccgccgacgatgcctcccaaggccaagaaggacgctgcgccgtctgagcgccccatccttggacgcttctcctcccacctcaagatcgggatcgttgggttgccaaatgttggcaaatcaacttttttcaacatagtaacgaagttggctatcccagctgagaattttcctttctgtaccatcgaaccaaatgaagcacgggtgaatgttccagatgaacggtttgattggctttgcaaactttacaagccaaagagtgaggtgcctgcatatcttgaagtaactgacatagctgggcttattagaggtgctcatgctggggatggtctgggcaatgcattcctctcacatatacgtgctgttgatggaatcttccatgtcctaagagcatttgaagacgcagaaattactcatgttgacgatacagtagatcctgttagagacatggaaactattagtgaagagctcagactaaaggatatagagttcatgaaaaagaaacttgaggaccttgataagtcaatgaagaggagcaatgataagcagctcaaaattgagcatgaattatgtgagagggtcataggccatcttgaggaagggaaagatgtccgtttaggagattggaaagctgctgacattgagatcttgaatacattccagctactttcagctaagccagttgtctatttggtgaatatgagtgagaaggatttccagagaaaaaagaacaagtttctacccaagatacatgcttgggtgcaggaacatggtggtgaaaccatacttcctttcagctgtgcttttgaacagaaactagtggatatgccagaagatgaagccgccaaatattgtgctgaaaaccagataacaagcatgatcccaaaaattatcaagactggttttgcagcaattcatctgatatactttttcactgctggtcctgatgaggtaaaatgttggcagatcagacgccagactaaagctcctcaagctgctggtgcaattcacactgattttgaaaggggtttcatatgcgctgaggtaatgaagtttgaagatctgaaagaactgggcagtgaatctgctgtaaaggctgctggaaaatacaagcaggaggggaaaacctatgtggtccaggacggggacatcatctttttcaaattcaacgtgtctggtggcgggaagaagtgaagaatgtatgaagatggtagcatcaacagtgttttacgtcttaccccgaatttctcattcaacagtgtttacaccttgccccgtatttccacatttttgaggtcgcttgccagtagctctaggttccggtatcgaaaacttgtacaacaaggctccagactgttgaaggatttgtattaataacatgcacaattgtatgtcttgtgcttgagctctcgctgttaccagaagcttagaatcgtttgagttctgtggaaaagttttgcgtggtttattgtgtaagctggtctaactgcaaatgatttgatgcttgtggcgggaacaaatatgtatcaaccgtgaagctagttgtgg

SEQ ID NO: 10189 - DNA, 843 bp, Zea mays
attcttagaaatgttattgatttttgcgggcagttttttccactgaaatatctgctacttttcgtcgtatcagccaatctcaatcgttaggctgttgctttcagtgtgcaactgcccgttagaatgattgattgaattgtcatatacttgcacactgttacatacaacaacacggcatctgcaatggaatcatgcgtctgatttgtttgtttggttgtaggctggagtggacacccggtctgcgtgaagcggtaccatttcatcatcgagaacgacagtagccacctttctggccgccggcgcacctgctgcctccgctgcggaacacccatggccgctaaaggcttttgtggaccttgcgtggtgttaatggatcttgttgctgaccactgatgtgatgttaatctgttctccttgcagttgcacccatttcccattgtgtctgatgtccatcttctgttcgaagcatatcagacttttcatggctgcctaataaacaccataacaaaatcctagcaaatggtgccagaacagaggagctggcttctaacaaatccaaatcgtatcgaggacatactcctcacctttccagcaccttgcggcagccgcgagctcgagctagcgccagcctcgcgccctaacccgcacggcaccgctaggcggcggccccgatcagcgcgattgcttcctggggtccaatgaggcgtggagagcattgggatggcgtcgcgcgtggagctgctcgaggaaggaagggggagagagagagagagagagagagagggcaggctgaggccggtgcgggaagaatcagcaatatcccggccggctcgaggtcccaat

SEQ ID NO: 10190 - DNA, 5945 bp, Zea mays
tagaatttatattgcagatttatagaaaaaaatcaaatttgtggcaactaccctttttttttttttttttgtagaagggtatacttaaaaaataccgttatcacttgtctctgtgacttgagaaagtcgcctataaagatttacagtggacacgtttcgagtggagggattctgtggtctgtacacaacgaatcgaaataaaagcattctagggtccacggactatgagggcagttgtgtaatttgtccctacacaggatcactttgatgtgccgtactggacctctcatcgagccatggatacaaaatgacgacactgccccgatcctttattccctcccatttctcgcgcctccttttcggaaagctctcgaacccaaccacccaccccacccacgattaaccctggttagcgctctgccacgacctgacgagcccattccaccatagcatgcatagacccactccactgtacgccacgcacgattacgtgggcccgacatttgctccgtcccctctggtgcacaaagaccaggcgcacctgatcgtgcttcacctcgaaggaatcgaccccatcaccatcctcctcgttatctcgcagctaccgccgccgccgcaaaccctaacctgagttccgatccggttaatcgacgacgaggaagacgacggtgcgttgcagatctgaggggatctgacgacggcggcggagggggagatggtggtcaacggccggccgctgaagagggcgagggcgcgggtcgaggccagggacttcgcgaggttcccggcggccggagactgcggggcggccgggacgttcagggaggcggtgagagggttcctcgcaaagcatgcgaggctgctcccgttgccgtccatcttctctccggcggccgcggccgccccgccgcacctgctgatgtggagggtgtccctaagggtcggggaggccggggaggaagagagcggcggcggggtagagctcaacgtcgttgaggaggatgtgctccgatcccgatctgtgtattgtgaccagtgcagagtcgtgggtgagttgctttcctcactttttcgtccttttttcctccgatttttttttgtttttttttcaatggacgaacccgttcgtttttttcttcttacgatctgctcctctgttactgttttcttgtcgtcgatttaagtttttgaaatccaacgactgtcttatttcttagaaattttattgatttttgcgggcagtttttttcccactgaaatatctgctacttttcgtcgcatcagccaatcccaatcgttaggctgttgctttcagtgtgcaaccgcccgttagaatgattgattgaattgtcatatacttgcacactgttacatacaacaacacggcatctgcaatggaatcgtgcgtctgatttgtttgtttggttgtaggctggagtgggcacccggtctgcgtgaagcggtaccgtttcatcatcgagaacgacagtagccacctttctggccgccggcgcacctgctgcctccgctgcggaacaccccccgccgctggagaatcaaggtgagaggcacatttcagaaagaaaattatataccttctcacacaacagcgaatgggggaaatggaacatgcttgtgcgttcgatgtctataatcccgaatgttaatacatgaccaactttatgccaacgtgctgtgccattgatgcctgtaatgatctggatcacccaatctgaatgtaagatgagtgcttcatataggtctgtgtttggatggggcgtgcttgcttgcatttgtaatataagatgagaattcagaagtgtttctattactatattcataggcagcacatagaaaatttctcggaatgaaggattcgccaagtaaccttgtgatgctccgaatatgcaacatactcttactctgaatgcactgccgtctccaggtgtgctctgtgcaatttcgatatggatggggaggagattgaagagtgtgcatacctgcatctggatgaccccacccacttgctgcacgctgtggtgcatgcaaatggttatgggcatcttctcagggtaaatgggcgtgaaggtggctcaagattcctcactggccgtgacataatgagcctgtgggatcgcctgtgcaaggtgttacatgtgaggtaaatggaatttccgctggcccaaagaacataacagttgtttgattgggattggtctctttccatgatgcctttctccaacctaataactatcatttccattactgcaggaaggtaactgtcatggatatatccaagaaacatggaatggactacagacttcttcatgcagtcataagtgggcacccttggtacggccaatggggatacaagtttggtgccggcagctttgctctcacctcagacacctaccgaaatgcagtagacatgctttccagcataaacctggcgctgtacttctcgcaccgcagccaaattaggactccattgcagaacacaatcgctctttattgggcgctctctaatcgccaactagtaaccctccgggatcttttccgcttcattatgcacctcctccatcaaggtcaaaagatgtcaaaaccctcagcagacaagcacaaggagcttacatctaatgagctgtgtgcatggactaaagaagatctacatagagcagaaggtgcaatgctcaaggttctccaggtcgtccaaactggacagtgggtatcttggcgggcactgaggggtgctgcgtcgaaggctgttgattcgcaagagctgcttgattattctctccgaggactgggtgggaaacaactggataatggcctttgtgttgctgtccgttgcaatgccggtactagtgcaatcgagtacaggctgagcactgattgcttcctccgttcggtctcctgctgatcctgctccggaaactttcctggctaaattgtttcatgacaatcaggctggaatcttcctccgttcggtctccagcaaatgcagctacatttggaccttctgttgaccaactgttgcatgatctaaggttcctctacgatgctttgctgaacccggagtccatcctaatcaaaaaaaccagaggtggttggtgcatcagcacacagcgcagcagcaaagataattgattgcaagcagttcatcaaacattatgatgagcatgctctgcggactccttcaaacccattcctgctctgtgtgaggtgctccattgaactgcttgatcacccaaaagattacacgacacctccagaagaacttgtacttctaccagcaagtgctaccctaggtgacctgaaagtacaggcttcaaaggctttccaagaaacgtacctgatgttccaaagcttccagactgaacagctccctgactttccaaacttcagtgatacaacccccgtgaagcatgtgcttggatcaggccagttgcttcgagtaaggggacgttgcactggggattacaggagaattgtacagttcaggatggagaggggtttggagaactggacggtggactgctcatgtggggccaaggatgatgatggggaacggatgctagcttgtgacatatgtggagtctggcagcataccaggtgctcgggaataagtgattttgaggaagtccctgaaaatttcatctgcagaaagtgtgctagtccacgcaagggagacggacgtgggggtggaggtagcaacggtggtggaacaatggaggttactgcgtctgggaggtgcaaggatgaaattggagcatcagttggtggagcaggcaagtatgggcgcatggcaacagttggatgactgtacataatgtagtgaaacgtaaatagtgagatggagagtagtaaggtgcacctaaaggcttttgtggaccttgagtggtgttaaatggatcttgtcgctgaccactgatgtgatgttaatctgttctccttgcagttgcacccaaaaaaaaaaaagtctgatgtccatcttctgttctgcatcgcacaattacataattgtcagatcaaaacatgaagctaaaattgctgcaatacataaaacatagcaatcaaccatacatcaagacttcctaatacgatttgccattctttggataggccatttcatcgcagttaggctatctccaacatttcacctatttgatctcttatccgaccttctattctaaactctactctatatgcaatgttgtctacggtgtaaaaataatattttgtactctatatatgcagagttgtctacagtgtaaaaacaatattttgtacggtcatatgcactcccgttttaaataaaatggatttgatggacaaccctatattgaccaagaatgacaccccactttagtgtcaataaccacaagcttcacagattcaaactggaaaaataagtaaataacaatacgctatcaagataatggttatcttgcagaaaaaatccatacggtgtttattatcaatacaaacttccaaaggttagactaatgtaaagacggtatagattcaaactgttttacatcagtttgggcctgtcctttcgaagtaaaaacttaacccaactggactaatgtaaaacacagaacttacaaagtgtatcaaaacaagtaattaacaatgttcaaacttccatttcatgtatgcaaggttaagacttaattagtatacaaggttagacttaattaccgaagcatatcagacttttcatggctgcctaataaacaccataacaaaatcctagcaaatggtgcctgcaaatatcaataaaaaacttcgattgtaagaagcacatggaaatacaagtgagacaaaactgaaaagcggagttgatgaggggataactagtgtcaatatgtcagtaaaatcaccatactaagttatacatgttataaaaactatttcaccctgtgatttgttaataaggctccatgaacaaatagatcttaccaaatacatatgtagattaaaaccatgtgtacaagaatatctgaagcgtgatagggcttctagctgagttagtcagctggtatgactagcactcctaacgtcctgagtttgactccccgttggagcgaatatcaagttaacaaaaatctcttcgtctgttccacaccaaaacacaggtctaaagctcggtccaggttgtggtcattctcatatgggctacggtgctgctgtgtatgagtaggacagaggttcagaagttttctcgacctacgtgagaaggtattcttcttaaatgaaatgcctagaggcggtcttaccccgtaggtcgagtttaagaatacatgaagcatgatttatgatctagaggcaatagagctagttcaacttatctggtgcacattatgttgtaatgtagcccaaacatttccaaacccaaatcaagccacaaagttggagtatcagttgactatcacatatacacatttaaggttcctctcataaaaggtatatagaccatctgttctaaaattggcagtgaagataggtgctttaaatatcaatatattcataaactatagtacccactaattttggatagtagttagcagtacactgcacgggacattgcaaaggtcaaatgaattacagtacctcttatattattttgctgttacaacaagaaatttaataaaatggtccaattcggtagcaaagtatgctctactgatcacagtgggttaattagggcatgtacggttcatttagtctagggactaaagtttagtccctactctgtttggtttcagagactaaaagtgtacataacttattaaatgacttgtaagaagatcaaaatatcatttatcattcttctaccactactattctcctgcggcgacggaaataaatgagagacaaccggtgtaatcaatatggtttagtccattttagtcaccccatgatgaacctagggactaaaa

SEQ ID NO: 10191 - DNA, 2478 bp, Zea mays
ctaacctgagttccgatccggttaatcgacgacgaggaagacgacggtgcgttgcagatctgaggggatctgacgacggcggcggagggggagatggtggtcaacggccggccgctgaagagggcgagggcgcgggtcgaggccagggacttcgcgaggttcccggcggccggagactgcggggcggccgggacgttcagggaggcggtgagagggttcctcgcaaagcatgcgaggctgctcccgttgccgtccatcttctctccggcggccgcggccgccccgccgcacctgctgatctggagggtgtccctaagggtcggggaggccggggaggaagagagcggcggcggggtagagctcaacgtcgttgaggaggatgtgctccgatcccgatctgtgtattgtgaccagtgcagagtcgtgggctggagtggacacccggtctgcgtgaagcggtaccatttcatcatcgagaacgacagtagccacctttctggccgccggcgcacctgctgcctccgctgcggaacacccatggccgctggagaatcaaggtgtgctctgtgcaatttcgatatggatggggaggagattgaagagtgtgcatacctgcatctggatgaccccacccacttgctgcacgctgtggtgcatgcaaatggttatgggcatcttctcagggtaaatgggcgtgaaggtggctcaagattcctcactggccgtgacataatgagcctgtgggatcgcctgtgcaaggtgttacatgtgaggaaggtaactgtcatggatatatccaagaaacatggaatggactacagacttcttcatgcagtcataagtgggcacccttggtacggccaatggggatacaagtttggtgccggcagctttgctctcacctcagacacctaccgaaatgcagtagacatgctttccagcataaacctggcgctgtacttctcgcaccgcagccaaattaggactccattgcagaacacaatcgctctttattgggcgctctctaatcgccaactagtaaccctccgggatcttttccgcttcattatgcacctcctccatcaaggtcaaaagatgtcaaaaccctcagcagacaagcacaaggagcttacatctaatgagctgtgtgcatggactaaagaagatctacatagagcagaaggtgcaatgctcaaggttctccaggtcgtccaaactggacagtgggtatcttggcgggcactgaggggtgctgcgtcgaaggctgttgattcgcaagagctgcttgattattctctccgaggactgggtgggaaacaactggataatggcctttgtgttgctgtccgttgcaatgccggtactagtgcaatcgagtacaggtgagcactgattgctttcccttcataaaattgatgaacttgatccggaaactttcctggctaaattgtttcatgacaatcaggctggaatcttcctccgttcggtctccagcaaatgcagctacatttggaccttctgttgatcaactgttgcatgatctaaggttcctctacgatgctttgctgaacccggagtccctggtggtcttcacaaccagaggtggttggtgcatcagcacacagcgcagcagcaaagataattgattgcaagcagttcatcaaacattatgatgagcatgctctgcggactccttcaaatccattcctgctctgtgtgaggtgctccattgaactgcttgatcacccaaaagattacacgacacctccagaagaacttgtacttctaccagcaagtgctaccctaggtgatctgaaagtacaggcttcaaaggctttccaagaaacgtacctgatgttccaaagcttccagactgaacagctccctgactttccaaacttcagtgatacaacccccgtgaagcatgtgcttggatcaggccagttgcttcgagtaaggggacgttgcactggggattacaggagaattgtacagttcaggatggagaggggtttggagaactggacggtcgtctgcccatgtgggcccaaggatgatgatggggaacggatgctagcttgtgacatttgtcgcgtctggcagcataccaggtgctcggggataagtgattttgaggaagtccctgaaaatttcatctgcagaaagtgtgctagtccacgcaagggagacggacgtgggggtgggggtagcaacggtggtggaacaatggaggttactgcggtctgggaggtgcaaggatgagattggagcatcagttggtggagcagttatttattggcgcatggcaacagttggatgactgtacataatgtagtgcaccgccaatagtgagatggagagtagtaaggtgcacctaaaggcttttgtggaccttgagtggtgttaaatggatcttgtcgctgaccactgatgtgatgttaatctgttctccttgcagttgcaaaaaaaaaaaaaaaa

SEQ ID NO: 10192 - DNA, 1023 bp, Zea mays
ctccgacgaccttgaatattactggccatttaatttctacttccaagcctgaatgagctagagatccatctgcttctgtacgtgctcgtcaggtacgctcgtaaaaagaaaagaaaaaaaaagaagagatcgagatcgatctgttgacgacgcccccgtcgccgatatgggcgacctctctgtcggccacagccgccgctggtgcggccgtttcgcggccgtcctttgcctgtgcgcggccttctgcaagccagatgaactcccgatggatccactgccgaacttgccgccgacgaggtcgctgcagtgcttcgaggacgaacaggtgtacagctgctgcgagggcgcgtacaggctaaacccatcgggaatcatcgccgttcccgtcggcgcggtggactactactgcggcggcgcgtgcgtggtggagacggaggacgtgctcaactgcgtggccagcgccctggacggcttcgccttctacaacggggcctccgtggaggacgtgcgctacgcactcaggcggggctgcagccacaccgccagaagaggcgacttcaacgatttggagccgcatctgggcgactaccctgacatctatggcgacgatgatgaacacagctttggcagcaaggttgttgcagctcctctgaggttgctcgcgtttcttggcggtgcggggctgttcttcctgggcccttgaacgaagatataaaagaactagcgatgtgatccgcgtaaatatatactccgtatatagcatgacatgagtatctagtttgtcttatatggtaaaccatactaaattttcttgtatggcattaaaaaaaattaagactttatttagttatttgactagttgttctctctggatcctctaatcagttcgaactctataagcttttttttccaaaaaaaaaaaaaaatcgcataatatgctaaggtgagatcttgatgtctttcgtttttttaactcgataaagttgttgtgagtctctcttataacattatttttaatgctaa

SEQ ID NO: 10193 - DNA, 2485 bp, Zea mays
gcagtgctcattgcagatcatgatcatcaagttctcaagtttatattgaataagattatgaacttcattaactgaagctagcagaatgcacgcatgcatggtttttgcggccctgcccttgtccttgtggacacacggtatagcatcatcgttcctgtaatcggtgcgcgcgcaggtataaatacagttgttgtgcatacaatttgtaggtgttaatatgaacatagttttatagatttgctccgtgtgaggacttgttcgtctgcataaggattggaaaggattaagagaaattaattttttttctatttaattttagctagctagaaagagatgtaatccccttcaggctttgcttgaatactctattatccacctccataatccacatgcatgtattgaggtggttaatttacaccacaatccatcttaataaatgtggatttagatgaataatagagtatccaaacaaagtcttagttgtactggtcgatcagcctctgcccgcactttacggctgaatttccctttcctttttttttcttctgcgacgtgcagaacatctcccatctagcctccatgaactacgacgtgacgacgaagcacggtgttaatgtcgatttggtaccaaacactaaaatgaaccatctagcggtgctttctacgggactcctgcggatggtccgtggttcggcgtcggacggtctgtgacctcgctgtaagagcgcttccttctctgtgtgatttagaatggtccgtgtctggaactcgaacggtccacgatgacgtaaggtctttttcgcagaaatatgaaccgctttccaaaggagccgctccctgggatggagttgttccgtcttaactggcttcggaacctacctaaaagcggaatgcgcgcccaatcagaaccacatgtgtggttgtggcggtgagacgaagtgtgttctagagggaagcttcttcttcgcaacatgcattgtcggaaagatgtgatggtatccatcgttgtaataatctctcacaactaactgcagatatatagggcatgtttggttttcttcttagatgagccaagttgtatctttaccgtcaggttcccagtacatgcacatggatggtgtttggttatgaaactcatggatcggagcctggaaagatcgagtttgtttgtttccggttgtttgtctcatacggcatgcaaagcacacgcgtcgattcgcactgaacaagcacacacagcccacggaaaccgcaacggcttacgtacggcagctgaacgtgcatgccgccacgtcacgcaagctacacagccatgcaccacaagtcaggctgacgcgcggcggcggcgtgctatcttgctcgggtgaccgccgccgccgtcgacgcccgccgccgccggtactcctctcggctggacgacggctccgccacgtcggccgcgaagcgcaccttcttgttcttcttcgtgcggcgccggccctggtccgcggctccgtcgccttcgccgagtatcatgaccctgaggtccgcctccaggcggcggtggaggcggtaggagacgaggatgacgctcgtcgacaccacggcgaccgccagcagccccaggcagctccccgcgccgctgctgctccgccgctccatcgcgatcagcgaggcgggccgccgccgaccttccgctaggcagctggcttccaccggaccacagccgcacagcttcaacgacgatacacgggtatagatagatcgatggaacgaacgaccgtccggctggcgatctatcttggctacctcctactcctggcatgctgcgagacaaacgagaagggaaaaaagagcgtggcgatggcgactccggctccgatcgaggtagtcgtgacatgcatgcatgcatgctgcaccagcagcttttgttttattttggtttacgagtcaaagtgggttgggacaaccgcgagcccggccggccggccactacacgtggttaattcacccgcacacaccgacctgtgttttgcttttgtcggtcagcaggtgtttagagaagaaactgaccggattaataggataaaaagtcgtactattaagaggggtcaatgaacttgaatggtgtaaaacttagtgcctcgtagagcataaatggtattatgtgcatgagggctaacagcgctacgggtttcaaaattagaatccttttaaactagcgcaaaatattttttctctgtggatggcggatcgtccgggcctgatggccggaccgtctgtgactttgctagagaggtcagctggtcgtctgtctctatctctttttggcggaccgtccgagccaggaggccggaccgtccgcataagataaattgagttttgacagggacgatgtgtttttgagactttgtactacggaccgtccagagtttttagccggacggtaagtggttcatgtgcgggccgtccggccatgaatggcggacagtccgctcgaattact

SEQ ID NO: 10194 - DNA, 2146 bp, Zea mays
cgcaatcatcttcgttttcatatcgtgacgttccctctctctttcttctagttgggtctataatatacaaagccaacgttatagtaactcaaagaataggtatataactcaaggaaggacgagttatagaagcactaacctcgagttgttgtatgcgatgctgtgagctgtcatgccgaggtcgaatggctggactcgagcccgtgctccttgctctcacctgagacagagtgggagtggaggacgagtcgattgccccgtcggcaatccagtaccgcccatgtctcttgcctcctccgaccctcatgagcacatcggggtcgatcggctcggtgctcggatcatagtctgggccatggacctcctgcgcccatggcggtgtagtcatggaggcggctgtagacggcggggttggtgtaggcctcgggcccgtcatccgggttgtaggtgacgtcggacgtcgccttacccttatgggccatagcataggccgagaaggtggaacaaggcctgccaccatgtgacgccgactgcaacgaaaaccaacgagatagttagaaataatatctaacttagtgctatatatctaaataaaaaaggtggcgtacccatgcttcggcatattggcccaggctccggctgccttggtggtgcgaggggccttgcatcatcaaacgccgttcccggctagctgtgtgcgcctcgtcccactcagccgaacaccacctatccaccatctgctcccagcacagaggatgtgcggcgcaccaatgtggaatcacctgcaaagtaaacacataaagtgcatatcagaagataaaataaaattcatgcatggagtactggtaccaaacatgcatgactttacctgcaggtactgctccctggtcaacgacatggttcgggcttgaggtttggtcaccttctccccaaggacggagccgtggtaggtgatgatggcctggatgcgggcctcatagtgcatgtccacgacgagcttcttacagctcgtggtggccaccacatccgccctagcctcgtatccagcatcgcatctgaagaaatcctgcatacaaaaacgatgtatccatacattatttcaagaatttgcaacgaatgcgacatattttacattatactaagacttacccacagctcttgcttcacccgctccgccttgttattgaattccctgccgtcccggtctactgcatcgggggcgacggcgtagtggtcgaaggtgaaggctgggcccgtcactccggcgtactccacaagtccagggaagtgttccctgcacagcaggccgaggatgttgttgggggggcgacgatgacccccagcataatccaaaaccgtccaagacctgtccaagtgataaataaaaagtattagtttatattatgattttgaacacataatatgaacaagaatgaagaacataaagttacatacctctccccttccggccgaatcagcggccgcctgtcccgaagtatgggacgcggcgggagactcgcggggcctcgcaggtagatgctcctcgaactagagccgcctgaacctgaggcgtcctggtgctggtcgtcgtcgtcctgtggcgccgcctgctgctgcgctgcctgctctgcctcgtcctgctgcgctgcctgctctgcatcgtccgccgtcctactcctcctccccctcctcctcctcaggaaaccgcccaccatatttgtccaacaacctgcaattaagagtaaacaaataagcacatataaaaagatgtatttaaaaacaggtgcgaaataaaaagtcatatagcattacatcgattaaaaataatcttcatatgtgtcggggttagccggatcataactctcatcatcactatcaagcatttcaatctcaacatcatcggaagacgcaacctcatcattgccttcaaggattcctaagtcattatcattttgcacctcatcatcctcctcttctacaaccatttcaatatctacgtccattccgatagcttcagttaagtctatctcaaatcgcccttctagcccatcttcttggaagaactctccatcatatgtgtccgggtctaagttgtaatcttcatcgttaggaaccaggtaacctccccgtgcggcgataccttaga

SEQ ID NO: 10195 - DNA, 3740 bp, Zea mays
accgacgtctgtcagcatttactctagttggggcaatgcttatcggaccccggcaaggggggcttggcaacatgaactacacggattattccgagccacttaatcctagtagactcgcgctcacaattctgacagaatcattacgagctagctagcgtacgcccattattacaacaacacaggtgaccctaataatcacgccctgataccgacgacgattacgcgagatctttcactatcatgcatatatatagacacacgagaagttcacaataatttcgagctgaaccaacggttaatttatcggacggcggctttattaagctagggagtagagtagggagagagagagagagagcagtagcagcagcactatgatggtgatcgctttaccttctctctcgtcttttgcctgccctttcctttcaccgtctttcttgcctgcgtcgctttcttcgtgtgttaccgatccaactgacaaaagccgagcgattgcgccgtgcgttacggtacgagaggagcaaaagttttgcctccaatacaaacaattcagctctataagggctaatttggttattagggatcccgaggggatccatggggagaaatctcctttcaatttaattttgaatagcaagaggattttttctcaaaggatcccaatcaccaaatcagctctaaaggagtatgtttatagagaaatgctgacaaaaaaatatgtagtgctactgtgctatactggtaatatatacacatacacgcgagaacacatacatagtatacgaaaaacatttttttgttgcacaaatagcttggaaagaaagttaaagtgtgtgctcctttcgtggatgctacagctagctagcaggccgtggccgacgtgaatggactagtgccggacctagtatccgatgcaaggttggttctagtcaaaatcttcatacgtaatatgataaaaccaaaaaaaagaaactcaatatgcgtgactatgaattaaataaattgccacattttgtcccataacgttcaaagcaggctgttagcttcggattaaagttggctgtttaaactgctgcaacatttatttatttttcctttaaattcgtctttttagacttcatgcctcaatttcttgagaataacagcagaatctatttcattctaggttcacaaatccacaacctctacgcccaatttatagtccactccccccttctcccatgctcaaaccatgaagagttgaagactaagaccatgtttggttcctctaactaaattttagtccctcacataacaaatgtgaagacctgataaatgctgctctagtagttatggatggcagcagcatgacacctgatgttaaagaggaagtagaagccggtcccgcatttcctacgagcatccaccagctcttgccatgacagctgcaagtttgggatcaagcattcctctgaacccaagaaatattggcctgttagtagcaagcaattgcgccgtgcaagcactaggaaccaggaactcgaccagattcaaaacaataataaaactatctccagcagcttatctatctttatctaattatcttcatattcaaacttcactctgtaaatagtacagtctacagtgcaaaacagtattttaggtgaccatataaatgaggaaaacagaccaagaaagaaagaccaaaaactcaagatttcttacgtaaaaagtggtagcagtactgctctaagcctgaattcatcactgaaagcatcacttgaaaaaagcacctgatcattctgaaagcaatccccacgtgcaagattcgtcagctgaagcatctgaacttgtggctggaactccgccaattgatgcagaatgctgccattagctatccaggacattgatgaatctgacgaacacattgaagaggataccactgcgcctgctgacagtccatgcgaagttgaggaacggtcacctgtggatcctgtgcctgatcgaccagaaaatgagtgtgcaagttcagatatcaggactctgactgtaaaagcctctaagaagcacgagcaacccttgcttgggactaaatcagagggccacattgagtatgacgagagacaggctcaagtcagaaaactggaagaacatcgcatctgacatctactcatacagcagttgacagctccagtggaccaaagacaccaagaaaacatgcagatgttactgctaccaccaagttcagtaacccagagacaaaaatcaggcctacagttacatcagttgtgcaaaatgttaaggagatcagatcgccctcagcataaactgtgccatctccatcacttccttcagggaaacataccgacagcaagatgacagggaacaatgttggcaacaatgctcaaatcctgcccaagatgcagatcacgccaaggttcactcaggccccccgaaactgtctcgatctataaacatgtctagcaagtttctctcgagtgtaatgttgagaagagtcagaaaagagaaaattgctcccccaataaatagcagcaaaaaggtttctggaacagaaaattctagtcaacttttaaagcaatactatctacagtggcatagtaattgaagtcagaggaacaacgcagaaatttcgaagatgcagagcaacgaggacaaggcttcttagataccagcccagattcagtcacgccaggttcactgatgtggcgcctgctttgagaaatcacatgaatatccagaatgaggtcaccccatgttttatttctttggatgaactgattccagatggctaagctagccgtgtacttgtatggattaaccaactccattctctggaccaagcaaaaatgtagggagtgagagggtgatgcttgacccattcctcaacgctttctcagaattattgcttcctcagtgaagtcaacgatctgcggaattgctttgcaagttcttggaagaaccttgacatctgaaggttttgttctgccgaccgcagacttgaaatgtctcattgctacttacttgaatgtcaaacctctcatcaagtgcggcaacagcagcttccctgcagatgagctttatgtcggcgccagtgtagccttctgtgagtctagcgagttcatttagattcatgtcggcactgcatggcatgctgcgtgtatggatccggaaaatatctgcacggtcagcttcatcaggtggttgcacatccagcaccctatcgaaacgacctaggccatcagtagtgcgggatctctttggcagatcaaaggagcagaacgagcattatatgtgtgatccaagaaataaatttaagcgctgagtaaataacaattgaaccaataacctggcctcagaagtgcgggatcaattttgtcagggcgatttgtagctgcaataacagtaacaccaactctctggtccaaacctgttgccacaatagtaaattataaagtttacagaccaataggagcatgtaatgatgtaaataataaaataagtgagagaagatcgtcagcacattgaaactgcacatggctagaactgaacaacattgactacaaatatcataatcagatgattgatgcttggtttatgtccaggcaacaaaacacattattgttatttgccaacctctaatgacagcttaacacactttagagagtagtaaagaaataagctgattagaataaaacacgatagtaacttatacatcataaaagtgggcattcgctgcaggc

SEQ ID NO: 10196 - DNA, 1364 bp, Zea mays
gtagcggggcccccctcgaggtcgccggcctcgataacctttttttttttttttttatttttttttttttttttgaactcatatccttcttcctctttttatattccttcaaacatagaaatttacagagcatgatatgagttggacaatgtcatatacctttaaagaccttacaagtagtacacatgttgagagcaattggatcctccagagtctgatctgctcgaaggtagtacaaagccaagagtacaaaaataccaatccatgtaccagtggtactgctcacctatttataggtctgttgacatacacattcatatagaattacataagtaccgcccttgctatataaaaggccaatacaactggaagtggtatctccgtctttttgtatatcagacatgtcatgtacatcttctcttagtccttcgtccttccatgatccaaaggtggtgctttttcagatataaggctttgtcccattttcggtattatttcatcatccaaagcagatatccaaaacctttgagagtcgctttctgaaacaaactaaaatagtaggtttttttttacttgttgacctttggcaaagtgttctccctaacagtaatcatgcctcaaagctgctcgagttcctgggcagtgacctatcccttggtataagtggatgagagattcacttcctaagcgcatagatgccagttcttctatgatgaataggatctaagagctggaagctttaggcctctcggttgtagatgttgttggtaactggactcaacaccaagttctccctctccgagagaagacggattacacacgtgggagtatggcggggagattgatgcttcaaattctaagatccaggccattaccatgccaaaggataaggctcaacttcattaaatcttttcatccattatagcgtagccacctcgcaagctggcgttccagcgggaaaatgtagtgaatcctgacgagtgcagcgacagcgactaggctcctgagctgcggtgtggaaggaagaagacgcgaaagtagagatgccacagccacacacatcatattagagggcatgaaatatgctagcttcggcgtgtcgccggtacgctacacggatcagagtctgattagatctacaagaaactgcttctgtccgcgccctttttcctcaagatctaaaagaaactgagcgatgaaaaacggagaaaacctagtagcaggggcatgaagaagcgagccccgagctaaggtagctcacccctgacctgatgccgagtcgcttgcgcatcgatccaaaatgacaccgacgacagaggagaaatcgaatggagtgacttttcgattaggatgttctaggtaag

SEQ ID NO: 10197 - DNA, 1017 bp, Zea mays
tgggaccctcgaggccggccgggatctcattcgcagatcgcaactcgttcgaccagaaacagacctgcacggctccactccaactccctcccaagccccaagccggcaagcccccaaccaccttccttttccacatccacaccgccccgggtttcctcacgcctccgccctcccaagtcccacccgctcactcccgtccctatccaccgcgatggcctcccgcctcgccgtcgccgtcgccgtcgccgcgcccgcgtcgtctccttccccggtcggcaccgtcgccccgccccgcgtcgccctccgccgaggcctcccgccgacgtggcacgctctccgcgccctccctcgatcccgtggcgcggccgtcgtgtgccaggcccagggcggccaggacaccgccatccaagttcctgatgtgagcaaatccacatggcaatcacttgtggtggagagcgagcttcccgtcctcgttcagttctgggcctcatggtgtggaccgtgtaagatgatagaccccatcgttggcaagctctcgaaggagtacgaaggaaagctgaagtgttacaagctaaacactgacgagaaccctgacatcgcgacccaattcggcatccggagcatccccaccatgatgatattcaagaatggtgagaagaaggacgcggtgattggagccgtgccagagagcaccctggtcacctgcatcgacaagtacgttggtgggaggtgaaatctcaatctgggccactagccttggacttccatatgtagacggatgggtatgtgtataccgttcatatcgaactgctgttgagtagttgtatgtagataataatgtgatgctcactccaataaatgcgattcaaggatgggcaagtcatctggatgaaaggttgcttttggtctagctttttaggttctatgtttcattcattgagttgtggtctgtatgtagatctgataagtcatatgcagctaattttcctcaaaaaaaaaaaaaaaaaacccgcggcc

SEQ ID NO: 10198 - DNA, 960 bp, Zea mays
gcacgacgtttagggaatagcaccagcaactcccgccaacccgctcccagcaactccctcccgagttctcaaccaaccttctccttcggtccttccacaccaccccggtccccgatttacccacggcccacgccttctccctctcatctccccgctcactcccgtccccatcccacgcgatggccttccgcctcgccgtcgccgtctccgtcgcagcgcctgcgtcgtggccttccccggtcgccaccgtcgccccgccccgcctcgccctccgccgaggcctcccgccgacgtggcgcgcagttcgcgccctcccgcgttcccgtggcgccgtcgtggtgtgccaggcccagggcggccaggacactgcaatccaagttcctgatgtgagcaaatccacatggcaatcacttgtggtggagagcgagcttcccgtccttgttgagttctgggcttcatggtgcggaccgtgtaagatgatagaccccatcgttggcaagctctcaaaggagtacgaaggaaagctgaaatgttacaagctaaacaccgacgagaaccctgacatcgcaacccaattcggcatccggagcatccccaccatgatgatattcaagaacggtgagaagaaggactcggtgattggagccgtgccagaaagcaccctcgtcacctgcattgacaagtatgttggtgggaggtgaaatatcaatctgaggcaactagcatgggtgggtatgggtataccgttcttattgaactgctgttgagtagctgtatgtagataataatatgattttcactccaataaatgcgatttaaggatggcaagtcatccggatgaaaggttgtttctggtctagctttaggccccatgtttcattcatctgctaagtcgtatggagctagtggtcctttatctgaatctccatctgattttgatgagttcatggattaggagct

SEQ ID NO: 10199 - DNA, 3083 bp, Zea mays
  misc_feature (1548)..(1548): n is a, c, g, or t
gccacctggattgctgctagctgggtctgggtacatgcatgaaaatgtgatccacttctcccgcgtactggttacatgtgcatctacatggtatctgtactcgtcgctagtggatggcaacgtgcgcccgctgattaagggcgtcgtccagtatgtgtgatgcaccaatgcatctatgtgactagtatgtgcccaacaaacttaaaaggagatgtacacaaaggtatagtatgtaactcactgtgtagcatttggtaactgcattggccatgcacttcaggtcttctctgcatgtatcctttggcgcgaaagctagtttcaaatttaaacctattaacatttaatgccacatggaattgctttgtcttgatctcctaggaaagctttaaattgaacattgcaatttcggacatctggcttatattgactgatgacgccaatagtatgagaatgtatgccatttaaagctcgacagaatacaggctgtagtgcattcagcatactatatatcttatctaattacacttaagtcgtaggtatatttattgaaacatgatattgttctgaatctatatttattgagagtcattactcattaccttcaatgtatgtaactaactggcatactggaatagtgagatgtagcaacaaaaacattctcatatttcaaaattaggatattaggtagtgccattgttagggttctgactggcagaatgttgtttctacattattctgtggtaattttagatggatttatgccttttcatatgtgaaaagtgactgcaatagagctgttagccattcattaaggatgtaaaagtgctagatttagtgcaagggtaagtagatctgtatagagtttgtggttgctgtaataagttaggacctctatttgctttctcgtaaagactgttgtatgtggtaccttagttcttctcaacccaagtggagcctgaaattgccttgtgtgcaagtgggccatatggagtcatgagcactttcatttgccacaagtcttttactcattatattgtcctaccttgttgataccaagatgagactctctttggaattgcgcacagttcctaatttcgagtttaatgtagattcagatgaatttgttcaggcctgtgctattgaatgcgtaccataaccatgcttatttgctttgtctgctacaattattgactgccttatgttttcttattcaattgcatcttaagtagtctccaatgcaaatttcatgtatgaaattatatggttaagctggaatgttaacaattgtatatcttttcagcacctggagattatttgctgtcatgccttttgtgtactggaaatgtggatgcatcagtaggaactgtatatcaactttcaaaaccttaattgcagttcttcaagtcattgctcattaggcctggatcatgacttcatgctattttttgctgaatcactcttcagcttgtgatatttagaacactggtaaaacttagcaaatgaaactagacatatttaaagcagcatagttcataatgtatgcgtgtntgaactctggacgatatattcgaagaatatgttagaaacacaggaaagacagctgacaaaaaaaggaacatatgtatttcaagtcaagatacatttctcctgaatcatgcttgtagaatggttacgcagcaactcggctccagactcattggccttattaatctcattgaatagtttatgttttgccctgttttatagtgattgatgtacaagctcttttttttttaaaaaaaaagaagttgacgtgccaacttatatatgttctgaacttcattcttttccagttcctgatgtgagcaaatccacatggcaatcacttgtggtggagagcgagcttcccgtccttgttgagttctgggcttcatggtgcggaccgtgtaagatgatagaccccatcgttggcaagctctcaaaggagtacgaaggaaagctgaaatgttacaagctaaacactgacgagaaccctgacatcgcaacccaattcggcatccggagcatcccccccatgatgatattcaagaacggtgagaagaaggactcggtgattggagccgtgccagaaagcaccctcgtcacctgcattgacaagtatgttggtgggaggtgaaatatcaatctgaggcaactagcatgggtgggtatgggtataccgttcttattgaactgctgttgagtagctgtatgtagataataatatgattttcactccaataaatgcgatttaaggatggcaagtcatccggatgaaaggttgcttctggtctagctttaggccccatgtttcattcatctgctaagtcgtatggagctagtggtccttatctgaatctccatctgattttgatgagttcatggattaggagctgtggctaaaggtaatgtgtaatgttgtgttggtgatagtatgtgtaactgtgtattgccggtgatttttgtggctattggttagtgctgctcagggtgtcaggcggcccgctagtagtgagcccatgtgtcaatggaaaatccattgcccttttttcacacatttatatttcgtccttccttctgtcttttttctccacactcatttatttctcacacttctatcactcatcttcctgtactggctaacgttatccctctccgcatgttctactgttgttgcatcttactcgtttttctttacggtttgtttggttaatcaaacaagcccagatgtgagcttgagcacattcaacatcgagccacccttcgataagcccattcttgcccatcactgtgtacccctccccttctgacattgttgccatcaatgcagccccatggaggaggatggctcctcgctagatgttggccgaccctcgactacggaggtcgtagttttggtacgttgttggggtgaggttttacccctcaatgcatctgtttagagaggagataggaggaaataattcttattgcttgtcttcaataaattcgtacaactcttcttatataggccatagccttaaacaatctctcctagaaacaaggaccgataacagactcctaga

SEQ ID NO: 10200 - DNA, 1734 bp, Zea mays
agttggcccatataccacgggtctctcgaagctcgtttgcttctctcgcgctccgcctctcccttgacatggcggctgcgacggcggcaggggccgccgccacggccgccgccgtatccctaatcgcctgctacatcctcctccacaagagtagagccaaactctcgtggttccctacggttgggttctcccgcgcgagcggccggcgggtgcgacggaggggtctcgtggaggccatcggcaacacacctctcattcgcatcaacagcctctccgacgctacaggatgcgagattctggggaaggctgagttcctgaacccgggtggcagcgtgaaggaccgcgtggcggttaagatcatcgaggaggctctagaatctggagatctcgtatatggtggtactgtaacagaggggagtgctggaagcacagcaattagcttggctactgttgctcctgcctatggttgtaggtgtcatgttgtaatacccgatgatgctgccattgaaaagtctcaaataattgaggcgcttggagctactgttgaacgagtgcgccctgtttcaataactcacagagaccattttgtcaacattgccagaagaagggctttagaagcaaacaagttagcagctgcacagagagaatcaagcgagaaacaaactaatggtttaacacatgtcgattctgagatgctggatgacaaattagcggttatgcagagggaatcaaacaagatgcaaaatggtggtccagcacatgtcaatactgaattttcacactgtgggaaatgcgatgtgaattctgattcaaagggaggtttttttgctgaccagtttgagaatttggcaaactatcgagcacattatgaatgtactggtcctgagatttggaaacagactaaaggtaacctgcatgccttcgttgcagcagctggtactggcggtacaattgccggagtctcacgatatcttaaggaaaagaacaggagcatcaaatgtttttaatttaccagaggggtgatgtacacaaaagaggaggccgaggggaagcggcttaagaacccttttgatactattactgaaggaataggaatcaatagggtcactaaaaatttcatgatggcggaactggatggagcctatcgaggatcagatagggaagctgttgagatgtcaaggttcttgctgaaaaacgatggactatttgttggcagttcttcagccatgaattgcgttggcgctgtaagagttgctcaagatttgggtccagggcatacaatcgtgacaattctttgtgacagtgggatgagacatttaagcaagttcttcaatgagcagtatttggctgatcatggattgacaccaacagctactggtctggaatttcttgataaatgagcatttcacagggacttttcaatttcaggaagttggcatcctccctgtgactgcgatgataccttgacacaagggtgaacgctgaataggtcaaagcatgaatatatgccatacaaatggtgaacctgatgtgttttaagtactaattgtagtctagtataggcattgccattggataggattgggatagccagtgttttgatccttgttttgatatatatctattgaggctcaggctgttaccagttagaatgctgcactgagcatctttgctgtaaacaactgcaacatatgcattttttttgttaaaaaatgtttcaagaacaaaaacccc

SEQ ID NO: 10201 - DNA, 1257 bp, Zea mays
tccgtaacaccgcctaatcaagcaaagaggcgacttcgcacggctcggcgaatggagattatcacacgggccatctctacgccttgtgctgaacccagaggcagcgagagcgagtgcgagacaccggatcccgtccgcccccggaccaagaatcccaacctcacagcgatggcagcatcccgcagcgaggaacgtgatcagaatcagccagtggtgcttgtgacggggtgctcggagggcggcatcggccacgcgatggcacgcgccttcgctgcggccgggtgcgccgtcgtggccacggcgcggtcacgcggttccatgcgcggtctcgacggcgacccgcggttcctgctgctggagctcgacgtgcgctccgacgagagcgcgcgcgccgccgtggcggatgcgctgcgggagcacggccgcatcgacgtgctcgtcaacaacgctggggttcacctcgtcgcaccactcgccgaggtgcccatggagtccttccaccaggttttcgacaccaatgtctatggtgcaatgaggttaattcaatctgttattcctcacatgatggaaagaaggaaaggaacaattgtgaatgttggaagtattaccgctctggcacctggaccatgggctggtgtgtattcagcatccaaagctgctcttcatgcattgagtgactcgttaagggttgaactaagaagcttcggcataaacgtgatgaccgtcgccccaggagggacgaggtcgaatcttgggaattcttctgcagccaagtatgatcagatgcacgagtggaagtactacaagaaatacgaggaagggctccgagccaggactggcatttcccagggccccaggtccactccagcagaagagcttgcaaaggcggtggttgcatcggttctaaggaagaaccctccagcttggttcgcttacggccagtactctgccattctgtcgattttgtattatgcaccgctatggtttagagattacctctataagtttgtcatgaaatgttagtccctggaagaataatggctgtatggagtatggaccaaagagagagctggacaggcccagttcaattcatttcattgtactgacagcctgttacgtcgtactcctatattgtactatagaactatgctctgtacctgctggcaacttggcatactgcagcttctttcagggggcagattcaggttcaaaaggcttgatgtcctcttcactaaaaaaaaaaaaaaaaaagcggcc

SEQ ID NO: 10202 - DNA, 1274 bp, Zea mays
gggtccctcgggccggccgggaaattcgttctgactccaccgtacggccgtaacaccgcctaatcaagcaaagagtctacttcggacggctcggcgaatggagattatcacacgggccgccttgtgctgaatccagaggcagcgagacaccggatcccgtccgcccccggaccaagaatcccaacctcacagcgatggcagcatcccgcagcgaggaacgtgatcagaatcagccagtggtgcttgtgacggggtgctcggagggcggcatcggccacgcgatggcgcgcgccttcgctgcggccgggtgcgccgtcgtggccacggcgcggtcacgcggttccatgcgcggtctcgacggcgacccgcggttcctgctgctggagctcgacgtgcgctccgacgagagcgcgcgcgccgccgtggcggatgcgctgcgggagcacggccgcatcgacgtgctcgtcaacaacgctggggttcacctcgtcgcaccactcgccgaggtgcccatggagtccttccaccaggttttcgacaccaatgtctatggtgcaatgaggttaattcaatctgttattcctcacatgatggaaagaaggaaaggaacaattgtgaatgttggaagtattaccgctctggcacctggaccatgggctggtgtgtattcagcatccaaagctgctcttcatgcattgagtgactcgttaagggttgaactaagaagcttcggcataaacgtgatgaccgtcgccccaggagggacgaggtcgaatcttgggaattcttctgcagccaagtatgatcagatgcacgagtggaagtactacaagaaatacgaggaagggctccgagccaggactggcatttcccagggccccaggtccactccagcagaagagcttgcaaaggcggtggttgcatcggttctaaagaagaaccctccagcttggttcgcttacggccagtactctgctattctgtcgattttgtattatgcaccgctatggttcagagattgcctctataagtttgtcatgaaatgttagtccctggaagaataatggctgtatggaccaaagagagagctggacaggcccagttcaattcatttcattgtactgacagcctgttacgtcgtactcctatattgtatatatagaactatgctctgtacctgttggcaacttggcatactacagcttctttcagggggcagattcaggttcaaaaagcttatttcctcttcaaaaaagaataaaaaaaaaaaaaaa

SEQ ID NO: 10203 - DNA, 4927 bp, Zea mays
gtgaaacgggagggcaagaggctaaacagagatcttttacgaattgcacctgtttatataggaggctcctctgaaaatgaaaagtcatatcgtggttgggaatctgttgctgggctaagtgatgttattcagagcatgaaggaggtggtgatgttacctcttctctaccctgagttctttagttctctaggtcttactcctccaagaggtgttctgctgcatggccaccctggtactggtaagacacttgttgtaagggcactcataggggcatgttctcaaggtaacagaagaattgcttattttgctcgaaaaggtgctgattgtttgggtaagtatgttggtgatgctgagagacagttaagacttcttttccaggtagctgaacgatgccagccttctatcatattttttgatgagatagatggtttagcaccttgtagatccagacaacaagaccaaacacataattcagttgtggcaaccttgctctcgttgcttgatggtttgaaatcacgaggctcagtcgtagtgattggggctacaaatcgtcctgatgctattgatcctgcccttaggagaccaggaaggtttgatcgtgagatatactttccactaccaaccttcgaggatagatctgctattctgtcactgcatacaaaaaaatggccaagtcctatttcaggtgcattcctgtcatttgttgctagccaaactgttggatatgctggtgctgatctgcaggcaatttgcacacaagcggcaataaatgctttgaaaaggacatgcccattacatcaaattttacaatatgccgagaaaggagttcctcatgggcgagttcctctaccaacagttcttgtcgaggataaagattggctagctgctcttgcagctgctccgccaccttgttcaaaaagggaagcagggattgcttcaaatgatttggtttccactcctctagattcctgttttgtaccaagcctttttaaaccattggtacaccttcttatttctatgtatttggatgagcgtgtatggttacctccatcccttcttaaggcatgttgctctataaaggaagtggtattctcatccatggaaaagaatactgtaccccacactttatggccaacttatcttagttctttgatccaacaaaaagatattgcagatagaattggaacaatcttgtcaagctgtggccttatatctgcacaactaggaaatcgtggttcaatgttgctgagtgatgttaaaacacaggagaatttttgtggcagcagattaaatcccactggtttgcatatgaaaggagggctgccacataagttatcaggctttcgagttttagttgctggagcaccaagatcaggccaacaacacctaattcgttgtgttcttcatggttttatgggccagattgtaatacacaagcttgaccttgcaactatggtgcaggaaggaaatggtgatatccttagtggtctgacacacattctcttgaaatgtctaaaccttggaagatgcatcatctacatgcctagaattgatctgtgggcagttgataaggcccataatcaaatagaagataatatgctcaatactgggtcaggtcgtttagcatcctccaccgctgatcacaaaaaatgttcagaagtttggaatgcattgattgagcaaatggattcattgttagcttctgtatcaataagtgttctgtccaccagtgacatgaggtttcaagatcttcccagtggagtaagaggtttcttcagcacacatgttgtggatcagtgccttgtttcttcagaacatacaatacctagattttctgtgaatattgacaaccactctaattgggatgagatggttgattcatgtgctttgcagttatcacatgacttgattcgacatcatgttcaatttttgcatgatgaatctcataagaatgataatcatcaacaaaaagaagtgtttgcttccatgaatattagtgcagaaggtgaacttaagtccagtgagaatgagcgacccttgtgtggagttgcttctaaggagaatccaattcagctggctgcaggcagagctcagcaagagcctccaccatccaatgtggaagataaagtagaaaatgatcaatttttttttgaaggcatagttcaaagaaatccttctagtagacttgtaaaaggcagcgagtcatttgctattgttgcttttggaattcagatactgcagcatcctcagttctcaaaactttgttgggctacgtcaaagctacgggaaggcccctgcactgatataaatggaccatggaaaggctggccatttaattcctgtttgttgcagagcagcaccttacctggtaaatcactaaatggaggggacaatgttgtaaagggaaaggaaaagtctgtctgtgtgagagggctggttgctgttggcttattagcttatagaggtgtctatgggtctgttattgaagtttgtgctgaggtgagaaaggtgttgggactgttagtcggacagattcaaactaaaattttggaaaagagaaatcaattccggtattttcgaatcctatctcaagtagcttatctagatgatattgtgaacagttgggcatacacctaccaaagaacacatgttgatacccggacaggaacatcccgcatgaagagttcaagtgccaaagaatgtcaaaggaccaagtatgctgcaggaaccaatgtacaagttgctcctgttgccatccctgctgaggttcaagacattccagcccaacacactcaggatcatgaagttgttcctggtcctactgaggtgcaaggcaatccggttaagcatactgcagaacaacctggaagctattcgatggactgtgaccttgataatcatgtgaactctgtttccagcaaggatgcagtagaacacgatcatgtccattcagctttacctgatgtgcataggggcaatacacatgcagatacagtaacaaatgacggagaacctattggagcaaacaacaatgggaaagtgtccaggttaacctacggtgaagataaattcagaccaggtattcaaagatctgaaaaccacacagaatctatggaaggtttaggctgtttgcaaagggcaggagattccgttggatccccagcaagtattaacaatacagaattaccaaagaacaatgtttcttctgaagctcatattgatgataatgagttgaggagaaatgatcttgtgaatgatgttgaatcaaattcgatcgatggtaaacatgacaccatgatgaatctttcagttccaaaaatttcatgtctctacaaatgttgttctccatgtttccaatctatttataagatggttcatggtattatttcaaatactctaaggcctaatctgcattgcttaacagctgatgatatgcatgacattctgtcatcatggtgcttgaatctattagggtctgttagaaagttgtacagctcacatgatgaggccagctgcacagaagattttgttagaatgtccaataaagaaacccacttagagcattgtgcttgtcagagtgatatctatctttcaagagaatgtgtatgccacttggaaagcaatggggatgttgaaactgcaaatactgattgtcatcctctatcaggacaaagcttaagttttttctttaaagatggtgtatggatgccgttggatctcaccgcggaaacaaaacttcattgcagcttcaggagattctgtgtttgctcgatattaggaacagtttctatgctcagctagatcctcagttcatgatattgtctgatgcagttgcaaaagtacatatagtactctaatgctctaagtgtggctccagttgtgcacataacacaacatcatcaggatgtctttggttgattggaacttctcatccttgatgcaacttttgggcaagcttttattgcacataaattgcctctacctgttatggtcattagtggaaaactggctgttgtagttgcttcgtagactgaatatttaaaaagaagctaagatattagtcttcattttttttccaacgaagttacccatgtaggttggactgttgttgctgctggaaatttcacggttagatgatgactgagtgactgacgccatttcagttctcattgtaatatgtattatggcccaattaagcatcaagttgaaacatgattgaatcttatactcacattttgtgttgtaaaactattctggtcagtggtatgctttctaatggacaactgacattcagcatgataaatctttataggttatataagaacacactgtttagatgaggttggaattatatttttgtacttgcttataggagtgtgaactgtgaacaagtttttagtagaggccattggcaatagaaataaatttctaattgctgttggttgttgttattgtattgtgacttggcatgacctttagagttttacctctaagatttatctctttttttttggaaaagtatacagataaggcagtgaactaagctgaaatttatttagatgtttaaaggtttagcatattattgaataattcatatattatttgttctactacattatctacacacataattatctctacatttgcaacgtaaatcgcagtagtgtttgctaatgctacgtttgaggacattttttttatatttttgagggatacacaataaagtctaaagtgatttagaaaatgccgcgctaggggcggtcaatctctacttagcttctcggtttcaatttataattcatttaaccttaagtttgatcgacccgtcttattaaatttttttcataattattgttaatttttattgtgatgttgtttagcatataatatacttaaactttgttttttttcttgtttttttttcaaa

SEQ ID NO: 10204 - DNA, 1830 bp, Zea mays
tcttcctgttttaggcaaattttggtacctattgtaatactgatgacatgtgatcatggattgtttctcatgaatactaaggctttttgattctgtggaaagtgattttatgagagagatggttagtgattctctaggaaaaactctattgtggaagtgattctatggaagaagtgaatcaggataagctaatttttttcggttcccgcgcccttagttcatttcagaatcagcctagaatcactttacttctatgtaaagttgtaactataactatcaagctctgccaaacaggctgtgcatattttctttttgaacaaattctgttttctcacctctatggcagcattgatacctacatttccaaaaaaaagaaaagaaaagataacatcggatgacaagctaacattttgttttatagtccaccagtgacatgaggtttcaagatcttcccagtggagtaagaggtttcttcagcacacatgttgtggatcagtgccttgtttcttcagaacatacaatacctagattttctgtgaatattgacaaccactctaattgggatgagatggttgattcatgtgctttgcagttatcacatgacttgattcgacatcatgttcaatttttgcatgatgaatctcataagaatgataatcatcaacaaaaagaagtgtttgcttccatgaatattagtgcagaaggtgaacttaagtccagtgagaatgagcgacccttgtgtggagttgcttctaaggagaatccaattcagctggctgcaggcaggcctcagcaagagcctccaccatccaatgtggaagataaagtagaaaatgatcaatttttttttgaaggcatagttcaaagaaatccttctagtagacttgtaaaaggcagcgagtcatttgctatcggccctcctggagttctcgtcctgcagcatcctcagttctcaaaactttgttgggctacgtcaaagctacgggaaggcccctgcactgatataaatggaccatggaaaggctggccatttaattcctgtttgttgcagagcagcaccttacctggtaaatcactaaatggaggggacaatgttgtaaagggaaaggaaaagtctgtctgtgtgagagggctggttgctgttggcttattagcttatagaggtgtctatgggtctgttattgaagtttgtgctgaggtgagaaaggtgttgggactgttagtcggacagattcaaactaaaattttggaaaagagaaatcaattccggtattttcgaatcctatctcaagtagcttatctagatgatattgtgaacagttgggcatacacctaccaaaggtcggccagagctttatgtttttttttttatttctgttgattctgtcactcctttcttactgcttaatatcagcaaaaaaatattggtgcatgatgctgatgtagatgattggcgcaattgtgttaacatttttatttatttattccaatctacagaacacatgttgatacccggacaggaacatcccgcatgaagagttcaagtgccaaagaatgtcaaaggaccaagtatgctgcaggaaccaatgtacaagttgctcctgttgccatccctgctgaggttcaagacattccagcccaacacactcaggatcaggaggttgttcctggtcctactgaggtgcaaggcaatccggttaagcatactgcagaacaacctggaagctattcgatggactgtgaccttgataatcatgtgaactctgtttccagcaaggatgcagtagaacacgatcatgtccattcagctttacctgatgtgcatagggg

SEQ ID NO: 10205 - DNA, 2662 bp, Zea mays
ccggccgggaaaaaaaaaaaaaagcactcgcactcgcaccacccaaaccgagctcgaggacaggagacacaccaccacgaacaagaaagaaccgtatagatctaaggatctttctgacgatcggcatggtcgggactgccgtgttcacggctctcttcggcgctggatactggctgaacgtccacagcttctactatttcctggtcgttcagatggtttccggcctgtttcagtcggttgggtggccgtcggttgtcgcggttgtcggtaactggttcgggaagagcaagagggggctgatcatgggcgtatggaacgcgcacacttctatcgggaacatagctggctcgctgcttgccgccttcctcctcgagttcgggtggggctggtcgttcgccgtccctagccttgtcatggctcttgttgggttggtggtgtatgtttcccttggccggttagccctgaggtgatggagatagacattgctggcagtggtgaattgaactgtgagaaggacactggcactgtgaaggagccccttttggaaccaggccaacaagttaagcataaggcagtggggttcttggaggcatggaggattcctggagttgcgccattcgctctttgcctcttcttctccaaattggttgcatataccttcctgtactggctacccttctacatcagccatacacgcatcggtggcgtgtacctctccgatgcaatggccggcagcttatcgacgatcttcgacgtcggtggcgtgttgggaggagtcctcgccggccacatctccgaccgtctaaacgcgcgggcgatcacagctgccagcttcatgtactgcgcgatacccgccctcttcctgtaccgcgcgtacgggagcacgtcgatggcgtggaacgtctgcctcatgttcgtcaccggaatgttcgtgaacgggccgtacgccctgatcacgactgcggtgtcggccgacctcggcacccacagctccttgaacggcaactcccgggcgctggccaccgtgacggccataatcgacgggacggggtctattggagctgccattggaccgctgctgacagggtacatctcgtccaagagctggagcgctgtgttcaccatgctgatggcggcggctctccttgccgggctcctcttgaccaagcttgtgtgcgccgagctgcaagggaaaacacctaccagtgcgagcaaggacgttgctgatgcgcaaggtacttattactcggatgaagtgtaaatccaaagctggttgcgctgaatgcctatctaagatagtggccggttgctgcttccactgtctttcatgatggctaccagtctgaagactcaggagggaaacagatttggctgctgagtgacttgctcaaatgccagttcagatgattttgcgtgtgtgtgttggtatagagacaatagaagatagaggtgtgtgcttggattagttttcagattttacttactagataggggtgaaaacacctcaaaagctctagagcccaaatacaggcacattttaggcaccttgtaaatatgtttgttgggcaataaactcgggcttgcactggctgcattgccagttacgtaattgtatgtgattgttgttagatcagggtagatcgaagggaggacgaacggccctgtcaagggcgtcagtgcgcaagacagcggggcctgtcttgcggggcctcgttcgtagtagcctcgaccgctaatggcgtcggccgtcggggtttttacctcgcagcccgtcggggttcgtacaatattgctgtgacttgctgcagctttaattcggctacgacttttacaatattcggctacgacttttacaatattttgtctctatagattgtagccgcagcagttcgaacagttgtaacagcttaatttagaatttggctttcttttgtacgttaaaacagtgcgaagatggttagggggaaatttgaagtggagcaccagggaactgttggctcaagaaacgttggcgtgcatctttgttcagttcaatttttctttattacattgtttagaaaattttgaaagttataggcactcgtttgctagaaacagagccacacaggtaccatggctgcatcgacattctgcaggttggacgttggagggagaaacaaaaaaacaaagccattctctaatctctgtgaccctgttgtgttcgaggctaatgcaatgcaacaccggttgtgaccctgtggtaagctatcagcagtcagttgttctagaacagaactcatctcaactcagttcagatggcaaaaacagagaacttgggtccgtcagaccgtcagttggtggagatggcgaggatccacctcatccaccatagcccaacaagagcatggctgtggttcttgagcatgtttagccacttcagggagaccctcgtctctatgacctccacggagctacagctgcaagagtttgtcgtttcaagcatgtgcctataggagagtggtttcctaagcagagagacaccatagccgacccttattagttcagcactctaactcatgagtccttctacgttgctcagaggacagcccgtattactctgagacaacactggcttctagaccttcaagttggagagagacagctagcccagagatgagagcca

SEQ ID NO: 10206 - DNA, 1835 bp, Zea mays
attgggtacctcgaggccggccctcggaagaccttcgcatagtcaagagcgctctggacccgcagacgaaggtggcccgcgcgcactggggaccggttgcacgccagcagaaacgctctcaccaccggctggctgccgttcaacaccgccgacggctccgcgctgctcggcgagatagacgtcgcgttcctcgccgcgtactccgccgggatgttcttcgccggccacatcggcgaccgcatggatctgagggtcttcctgacggtcggcatggccggcaccgccgtgttcacgacgctcttcggcgctggatactggctgaacgtccacagcttctactatttcttggttattcagatggtttctggcctgtttcagtcagttggctggccttcggttgttgcggttgtcggcaactggttcgggaagagcaagagaggattgatcatggggatatggaacgcacacacctcggtcgggaatatagcaggctcgctgctcgccgcgttcctcctgaagttcgggtggggctggtcgtttgccgtccccagccttatcatggcgctcgttgggttgatggtgtatgttttcctgccggttagtcctgaggccatggagattgacagtgacggcggtgagcttaactgcgagaaggacgctgtgaaggagcctctcttggaaccaggccaagaagtgaaacatagtgcagtggggttcttagaggcatggaggattcctggggtcgcgccgtttgctctgtgcctcttcttctccaaactggtcgcgtataccttcctgtactggctaccgttctacatcagccatacacgcattggtggcgagtacctctccgacgccacggcaggaagcctatcgacgatcttcgacgtcggcggcgtgctgggaggggtcctggcgggccacatctccgaccgcctgaacgcgcgcgcgatcacggccgcgagcttcacttactgcgcgatccccgcgctcttcctgtaccgcacgtacgggagcatgtcgatggcgtggaacgtctcgctcatgttcgtcacggggatgttcgtgaacgggccctacgcgctgatcacgacggcggtgtcggccgacctcggcacgcacagctcgctcaacggcaactcccgggcgctggccaccgtgacggcgatcatcgacgggacggggtctgtcggagccgccatcgggccgctggtgacggggtacgtctcgtcgaggagctggagcgccgtgttcaccatgctgatggcggcggctctcctcgctgggctcctcttgagcaagctcgtgtgcgccgagctgcaagggaaaacgcattccagcgtgagcaaggacgcaggcggtgaacatggtgcctactcagatgaagtgtaagtctgaagccctggttagtaagcccacgttcccgacctgaagatgaaaaggcagagatttagctgctgagtgacttgctcaaatggcaattcagatgattttcttttgttttgtgtggtagaagatgtaagtgtgtgcttagattggtttttcaggtttactagactctagagcccaaatacaggcacattttaggcgcctttgtaaataaggtcgggctcatactagttaccattgctagttgctcaattgtatgtgatgtttagggtatatgtcaaatggagggcgaaccaccttttgtacactggaatggccaactctgcatttactttgaatgttggccttctttttgtacgtgtaaaccgtgtgaaggttcagagaattttgaattgaagcatctaggctgaccgctagtgtttggttgcgccgggattgccttgctc

SEQ ID NO: 10207 - DNA, 1321 bp, Zea mays
cattgggtacctcgaggccggccgggcccgcaccacgcaaaccgagctcgagaacaccaccacgaacaagaaagaaacacggccgcggcggggcggggcggggcggcttctccttttccaactcgctgcccgttgcgtgattccgccgcgtcgcgtcgcgtgtgcatttgcgcgcgcgcgcaggagccgccgctccgatcgccctgaaaaaggtgccaattgttactgattccagataggtgttcctgcgctggcactaactgcgccgcgaccttcctcagcaatcttatgctcatgtctcactctcaacagatggcgaatagtaggaagcctcctggcctcaggttactcggaggcgccggctcactgagaacgtaccagacactagtcctggtcctcacgttcttggcatacacatgcttccacatgactcggaagatcccaagcatagtcaagagcgctctggacccgcagacgaaggtggggttctcgcactggggacggttgcacgccagcagaaacgctctcaccaccggctggctgccgttcaacaccgccgacggctccgcgctgctcggcgagatagacgtcgcgttcctcgccgcgtactccgtcgggatgttcttcgccggccacatcggcgaccgcatggatctgagggtcttcctgacggtcggcatggccggcaccgccgtgttcacgacgctcttcggcgctggatactggctgaacgtccacagcttctactatttcttggttattcagatggtttctggcctgtttcagtcagttggctggccttcggttgttgcggttgtcggcaactggttcgggaagagcaagagaggattgatcatggggatatggaacgcacacacctcggtcgggaatatagcaggctcgctgctcgccgcgttcctcctgaagttccggtgggggctggtcgtttgccgtccccagccttatcatggcgctcgttgggttgatggtgtatgttttcctgccggttagtcctgaggccatggagattgacagtgacggcggtgagcttaactgcgagaaggacgctgtgaaagagcctctcttggaaccaggccaagaagtgagacatagtgcaagggggttcttagaggcatggaagattcctggggtcgcgccgtttgctctgtgccttttcttcttcaaaactggtcgcgtatacccttctgtactggctaccgttctacatcagccatacacgccatgtggcgagtacctctcgacgccacggcaggagcctatcgacatcttcgactcggcgctgctgggagggtctgtggcc

SEQ ID NO: 10208 - DNA, 1621 bp, Zea mays
tttacagttagtaaagagcaggggtgagggaggccgttttttttttttttttggcaatgaataaaccccattgaatgggggaaaatcagaccaagtaatacacacatttttacaaatgttaactatggcaactcttcgacaaaaatcacgatttccccccaattgcaagtttgcagccctactaatagtacatctcatcaagcttggtcattgttttcttacatcggtgattgcaggaaccttgtctgggtagctagacaaatccacatcaagcaattctgtgagatcataaagccctccaggatcgactttgtccttgattggggttgtcattgtctcttcctgatctgcctggttgcatgatacacttgatgtcactggactgtttgaagccacaacggtaatgccagccaactccacaccctgcccacttgtggcagtgctccctgagggaaatttcgtttctgcattgtctccctcattgtgattgtagagcacatattcattgtatgtaggagcaaactggtgaacagtgtcatggtagaaatcattgaatttcaaagcatgaagaaggctttctctgaaaccacctgaagggcgggcattcggacctgcatattccttgtaggggaaggcaaataagtggccaatggctgctattagcatctcaacacacaacacaaagttctgaagatcagcagccttatcagcattcttgataaatcgagattttgcagcaaggaaaaccaggacaccctgccaatatgtgagaaacaccactgattttatcatgatgaattttgggacaggattatatggccgaagtagatctctgcaagccgcatagaacaatgcaagggcatacaaagccatcgagtatgagattgtatatatgatagttatgtagagataggattggttgacactgaagttgccatctttgtattttcctttcgcgtaaagtatgaaagtgataacaaccaaaataggcttgagaatcacaaactgcaagcaaccttgtttgcatcttcgtataaaacgcccatctagaggaatagctggataacagcaagtcatcagaatccacgacggtttcagggttcggccactgagcttaccaccacagcaccaggacctcccacccatgccaagcagagtgagagaaaattgtagatgacccaagcatcatatatctctcgaatagaattaaaatatatcgcgttgtcagggaggataagggaaaggaatgacatcacagcatataccgggaccatgaatatgatgcggacgatgaaccgctggtagatgggctcggcgtagtggaggaggtggcggtagatgtgcgcgagcgcgaccacgctcgccgccgcggcgcacaccagcgccgcagccgtgtacgccgccgacgcccactccatcgggcccggccaccaccaccggcgctcctcccgggtcccgccgcggcgcgcgcgcagcagcagcagctaggcggggcggggccgatcggacgaggaggaggcgaagggggagtccagcccaggcaggcaagcaggctctcctctctctgggtcggcttggtgcgggtttttcgattaggatgttctaggtaatggtctcgtgc

SEQ ID NO: 10209 - DNA, 2608 bp, Zea mays
aaaataaaataaaaaccgggcggcagccggcagagctacgcaggcgccgaggggaagacgacgcggactcacaaggcgaatatcccccgtccgggacccacccgacagcgacccaacacccccaatcatcatcccctccgcctctcctccactggagagagtgccctcgcctcgtctccctctcccctcgccgtcgtcctccctcctccgctcccaccgaggaggggaccctctataagaaggcaggagcgacgaatccgatcgtctgtcgtgtgggagagccgcggccccatcctccgtgtgatgaagttcgggaaggatttccggaaccacctggaggagacgctgccggcgtggagggacaagtacctcgcctacaaggccctcaagaagctcatcaagaacctggtgccacgcgagcccgcagcggcccctcctctccctcctcctgcccccgccgccgccgacgccgaggggccgggggctcctgccgccgcgcacgggaacgtcaacctggccaactggttcgccagcatcctcgacgcggagctgcacaagctcaacgagttctacatcgagagggaggagtggtacgtcatccgcctccaggtgctcaaggagaggattgagcgcgtcaaggctaagaagaatgacgcttttacatccaggagtgagtttaccgaagaaatgttagagatacgtaaggattttgtgatcatacatggtgaaatgattcttctgcaaacctacagctccctaaattttgctggactagtgaagatactgaagaagtatgacaagagaacaggcggtgtgcttagcctgcctttcactcagcgtgtccgtcaccagccatttttcacaaccgaacctttaacaaggcttgtccgagaatgcgaggctaacctcgaactacttttcccgatcgaagcagaggttcttgagcctagttcatcctcgaatctggaaccgcatgatgtggctaggtgtgacccgacatcgtcccgcgatgtggaaaccgtcgatgtttaccgaagcacactcgcagctatgaaggcgatacagggccttcggagagccagctctacttacaaccccctgtctctgtctaggttcttccacggcgaggatggcgaaccctgctcgggtgccatcacttctgagagctcactgtcagattcctcaacggactcccagattcaggatgctgggaaggatgataaggaggtgcaatcaaattcgagggaccagaatgctgcccaaggggaacagaatgcacaaggcgagccgactgatgaataaacagtttttttcccacacgctgttcaataagacaataaccattgataagtgtaaatgctaataatcttgctggttaaccctcttttgaagtgacacatatgcaatgactccctggtggcgcagtttcatttttcttctttttccttaattaatgggtaaagagtatatgggatgttggatttatcatgttcctatcgtgttgacagcatgccagttgccagaagtttgacacttgataagagctatgatcgtaatcagcatgttggatctattatgtttttgttgtgttgacactacagggaccaccatgtcagtacttcataagcgccatgtaagttttgacggttacaattggttgtttattcgtgcacagaataaccgacattagggccttgttcagcagaaccttcaggaaatccgtgactatttgagagccgaatatttgtagcttcaacaaatatatgtatgactcattttgtttatagtttgaatcaaacacaaaaaatttaaaccactttatttgtctaaaaaaatgtagatccaacatggatctgtaagctagtgccaaacaggccctatataggtgtgtaaactcggaaaatactccatcagaaacccagaatattgtattagtatggagtccccttgacacctaaagttcaccttgagcaacaatttacagttagtaaagagcaggggtgagggaggccgtgtggcagcagcttttgacaatgaataaaccccattgaatgggggaaaatcagaccaagtaatacacacatttttacaaatgttaactatggcaactcttcgacaaaaatcacgatttccccccaattgcaagtttgcagccctactaatagtacatctcatcaagcttggtcattgttttcttacatcggtgattgcaggaaccttgtctgggtagctagacaaatccacatcaagcaattctgtgagatcataaagccctccaggatcgactttgtccttgattggggttgtcattgtctcttcctgatctgcctggttgcatgatacacttggtgtcactggactgtttgaagccacaacggtaatgccagccaactccacaccctgcccacttgtggcagtgctccctgagggaaatttcgtttctgcattgtctccctcattgtgattgtagagcacatattcattgtatgtaggagcaaactgcatgagaatggggtttgatcagacaaaataaatgctacaatgttattagggtattagagtgtgaaagataaaggttacctggtgaacagtgtcatggtagaaatca

SEQ ID NO: 10210 - DNA, 1826 bp, Zea mays
caggccggccgggccggggtttccctctctaccggatcccccccctccctcctcagcttccattccctctcctccgttaattctccgctctccatttattcctttccagttccgccgctccattcccagctccccccaccaagggcaatccctctccgacatccaatccaatacaatcacgcctgcgcacacgcaaccccagctcaagccccaagtccaaaccctaacccggcggcggaagatatggccgacacggggcgcgacgccttccctgacgaggcggagcccgcgttcaccctcgacgagtacatggaggacatcgaggccgtggagctggaggcggatttggtgctgggcggggacgagggcaaggagtgcacctacgccggcggatacctcaagcgccaggccgtcttctcctgcctcacctgcgtgccggatggagtcgccggggtctgtaccgcctgcagcctcgcctgccacgacgggcatgagattgttgaactttggacaaagcggaagtttcgttgtgattgtggcaactcaaagtttggtggtcacctttgcaaactctgccctgagaaagattatgagaattcagcaaatacttataaccataacttcaaaggttcctattgcacatgtgggcggccttatcctgacccagaagctaaggagcaagttgaaatgatacaatgctctatatgtgaggactggtttcatggggatcatattggtcttaactctattgaagagataccaagagatgaggaaggggagccactctatgaggaattgatatgccacaaatgctcatctgtctgccatttcttgaaattgtatccagatacaatttgggcttctggtaagccaaatctggcagtggaaactgatgcaagtgaccctaatgtgatgaaaaaaccttcagggcatgctgaccctgagaaacatgaaaatggtgctcttgttgataatacggttggcgagaagacctccgttgagaatgattctacaaaagctattgcagttcctgaggaggccaatttgggtagcagttctggcaacaactgcaagttaggagtggatgtgaatacaatgccagctattacagataaaagtgagccttttttcatgtctaaaggttggagggagacactatgcaggtgtgaaacatgcatcaacttgtatgcacaacgaggtattgcatatcttattgacaaggaggattctattgaggaatacgagaagattgccaagcagaagagggagatgaaactggagcagcagcaaggagctgagacaaattttctgaattcacttaatcatgttcagaagatagagatgataagtggcatcaatgacatgaagaatgagtttcagtcctttctggagtccttcgatgcatcaaaaccggtaacatctgatgatatacattcattcttcgagaatcttgctaagaagaagaaacagaggttatcttagcttttgtgaccgcatcggaccccacctgaggcaatcgttctgctggacagaggtcctagtttgttgggctagtaaatgtaatgttatcttaggtggtacttactaatcgggccagtaatgttgaattctagctggaacgcggtaatgtttgatgcaccgaagtcgcttgcagtaggttccgatggcccaagccaccaaaaacttgtttgctccatgaacctcgcaatcctgttaggtgataatataatatacattgtgttgccaccgtgctttttaaataaaaaaaaaaaaactagagggggggcccggtacccaaaaaaaaataaaaaaattatatataattt

SEQ ID NO: 10211 - DNA, 852 bp, Zea mays
  misc_feature (827)..(827): n is a, c, g, or t
ttttttttttttttttgatcaaatgacgttggattgataagggggagtgttaagaaaattataacattttctatgatcaacccaaggggtatctgccaagggacacatccattgacattgcacccctacacatgtatatatatcaggatgtttcctgtaataaagagggctgtcatttattattctctctatctctctccactgattttcaacaagttttatatgtaggtgcacagccacagcgcgaaatcgacgccaccgtggccatgtcagcttgtgattttacagggttaacacacgccgcgcgcggctcctgtttatacctgtgcctctctgttaattaacctgcccacaacttgcagcaccagtccacgtcaggtcttctgctattgatcctctgtgttgaagatctcctcggactccatgggcgacgaccagtagtgcagaagggattccacggtgagacgtcgtgtggcgctcaacattgagatgaagaagcggcagccatcgatcttgtactgttccagaggatttctgtgtccaaaactccgaacgttcacagcagaactaagcttgttcatgtttaccaaatggtctttccataatgtatcaagagtcttcaatagtacttccctctcaattccacctatatatgcatcgtcataacgggactcttgcacggcattcaagtaggtagctattagaaaatccccaaaatatttccggagcagattcacagtgtttgtatatctccctttctttgacgtatcatcaacacaaatggacaaccaccgcgttattgaagatgtttttcttcgaattccccnccggacggcgtgggcggacgctggg

SEQ ID NO: 10212 - DNA, 3372 bp, Zea mays
gcggggttgatgaagagcaactccttatgaacctccccaaagatcttaggagggatataaaacgacatctttgtttgaaacttctcatgagggcatgttctcatctcccccttttatagtaccttgagttcagcctagcagaaactttttttttattttgatgtatgtattgatcttcctaattttttttaccttgctgtgttcatcgtttccaggttccactgtttgaaaatatggacgaacagcttttggatgccatgtgtgactgcctaaagcccattctgtacacagaagggggctgcgttattcgcgaaggagatccggtgaacgagatgctctttgtcatgaggggaaacctaatgagcgtgacgacgaatggtggaagaaccggcttctttaactccgatgttctgaaggccggagatttctgcggcgaagagctcctcacctgggctcttgaccccacgtcaacatccagcctccccagctcaacaaggacggtgaagacgatgtctgaagtggaagcctttgccttgagggctgaagacttgaggttcgtggccacccagttccgacgactccacagcaaacagctccagcacactttcaggttctactcgcagcagtggaggacctgggccgcctgcttcatccaagctgcctggcaccggtactgcaggaagaagatcgaggattctttgcgtgagaaggagaagaggctgcagttcgcgattgccaacgacagctccacttcgctcagcttcatggcagcgctgtatgcttcgcggttcgctgggaatatgatacggatcctgaggagaaacgccacgcgcaaggccaggctgcaggaaagagtgcccgcgagactgctgcagaaaccggctgaacccaacttttccgcagaagagcagtagtatttcgcttctctgacttctcgttttgcagatacagatatgggaaattgtttgcgtgacttgcaagcccgaggatggcatgcccagattaaaaagaagaagaagaaaaaggggaatgaaatctcgatagaatgaccactgagtgatagtaatgtagtgattgatatacagtacattactgttcgtttaagaacgtccaagtggcgtttgtatgtgcttgtgtaatagcatagttagataggagtgatagtaatgtagtgatatacattcatccaccgaagctatgtgtgtatagggatcgaccatttccgtgcttacactcacgcactgtaaacgcagctggtgactgctaagtggcatccataagtgcgcgcaagagatcaacagaaactggctagggtagttggcatgtagtgcttgcacaggaagaaagcgctgaaatggctccatgatttcaatccaacctcttcaactcaactggcctatgccttggcttggctgtgcagagcgtggcctatgccttggcactggttacttccccggcacgcgcgcaagttgcgtcgccgtggcgggaaaccaaaagtggcgcctcccacctgcctcgaaaacatcggggcatcgctacgtgccctcgagaattgccaccgacaccgggccccatccgtcatcaaaccggcccaccccccactttttcagtcacgcagactgactcaaatctccccccagcaagtccccccccccccccctctctccgacgattccctctctaccggatcccccccctccctcctcagcttccattccctctcctccgttaattctccgctctccatttattcctttccagttccgccgctccattcccagctcccaccaccaagggcaatccctctccgacatccaatccaatacaatcacgcctgcgcacacgcaaccccagctcaagccccaagtccaaaccctaacccggcggcggaagatatggccgacacggggcgcgacgccttccctgacgaggcggagcccgcgttcaccctcgacgagtacatggaggacatcgaggccgtggagctggttacctacctcttgcccgtccccccctcctctgacagctatttcgttgaggtggatttttgcttgacgctcagcctactgctatggctttttgcggaacgctgtgcaggaggcggatttggtgctgggcggggacgagggcaaggagtgcacctacgccggcggatacctcaagcgccaggccgtcttctcctgcctcacctgcgtgccggatggagtcgccggggtctgtaccgcctgcaggctcgcctgccacgacgggcatgaggtgacccacctcaccccacttccaaagcagtactgttgggtctgattggctgcctacattagcctatgctcaggcttgtggagtgcagtctgagtctgcccttgtttggtcgcctgcagaggttcttagagcaactccaaccaagatcttacttgaccctgaccccattttgagagttcaaactcacgaaaaagctcttcaattgagctcctatttagcctccgatggatgaggggatctcatgtgaatgaggtcacttgaacatcttgtctaactatacctgctcagctaaaagacatgagggattgaacagctacagaatggggcttataagcaacataggtatcatgcggaaacactgcagcgtgctcggctggcagccctaccctaccctacccattgttgtaaacccctatggctttagtatcttgttccagcctgctatgaagccctatggttacatttcattttttgccatcgatgggttgcttcctttgcctgccccttcaccgactgtttgatgatgaatggaatgagaagctctttgtttagcagtaacccgcacaagaaacccacatgcggacctctgtagcacatgcagtccatgcctttcactgcaatgctggctgcctggtcagtaccatatggatttgattgctttgaactggtctttatgatgacctaattgcaccaaagaaacaatattagtgactgtttcgcaccattttcaagttctgtgttaaaatgccccctaccctgctagttacccatgatgcaattgtctttatttaaggtgggaaattgtgtttatatatatgcatgctttagacaatttgttctatagctttgtacaccatgactatgaacgatgattgcaggctcattttctccttagctatatttggtatatagcagatagtgtagtttatctggagttgctgaattggtattggtacaccgcatttgaccgtctaagttttgttaacatgctctcacatatgtggtaaagtgacacaattgctcggtgtatgtaattcatgtgattgtttgtcagttgtcactatttgtttcatttttattttaacattttattctattcagattggcttactcatt

SEQ ID NO: 10213 - DNA, 1242 bp, Zea mays
  misc_feature (54)..(54): n is a, c, g, or t
  misc_feature (57)..(57): n is a, c, g, or t
  misc_feature (78)..(78): n is a, c, g, or t
  misc_feature (94)..(95): n is a, c, g, or t
  misc_feature (176)..(176): n is a, c, g, or t
ggggtcaatatatgcaaagaatctgaagcgtgggatttccattgaagctgtganatntacgctacccataaaattcanctggcaccacccagannatatattctaggaaagtatgtctgttactctcaacatatttctttacatatagctggctcttcaacacctccctactgtgnacattcatgtgcattgctggcaggaacaaagaaattttcaccattcttcctatggtacatattttccaattctgcaactgacttgactatcttgccgactaggtcatgtttgccattgctactgaagttaaagcactctacaattagggggttctccttacttccaatctgttgcagattcagactcactggcctccacctaggattgagatcattctttcttacttctgtcttgcaaattggaacaggcattccactatctgatattccagatattagcaaaaaagtatcactctttgttagaagatccttgatttcaagatccgaacagcggaatatcatctccattattgcttttgaacctgaactttcttcagcctgaacagttagctcaccaaaattattaggatttggcaagttatgttcagaaacaccaagcttcagagtcagcagtctgtcccgtttggtgataacctctgacaaaagacaggtagcctctccaagaaactcttgttcctctagcttaagcatcttttcactgacatcacggaactgctggtggatgtcaaagacctgaaacaccaattgctgaagaacctcaaactggtactgcacactgattttggtcgtccaaaatgggttcaatgaatttaaaattacttcactgcgcccaatttcttctagtgtaccatctctctttttggaatacacaaccaccatgggattactcttgggaaaatattcttgatcacccaaatttgatgcagagagagataactcgatctgcgtggacgcgccggcaccacgggagcggagaaagcgatcggccgcggcggaggctgcggaggcggctttggcggtggcggagccgacgggatgagcaccggcgtggctcacctcatcggagcagcagttccccatagccggcgggaccgtccgcccgtcagtcgctcgccggcgaggcggttgagatctcggatgggagagcgcgtggagatgggagttgccgcaagtagccagggccagcgaaaagagcaagtggagtcgcagagacgacacggagacc

SEQ ID NO: 10214 - DNA, 1124 bp, Zea mays
cgttaattctccgctctcctttattcctttccgttccgccgctccttcccactcccacaccaaggcaatccctctccgacatccaatccaatacaatcacgcctgcgcacacgcaaccccagctcaagccccaagtccaaaccctaacccggcccactccagtgtggccgttcgttcccctctgttccgcgccggcgcgccgcccaactctgagcgatggaaggcaccgtgctgtgcgcggccaaccacgcgccgctcacgcccatcagcttcctcgagcgcaccgcgctcgtctaccccgaccgccccgccgtcgtcgccgccggacacgccgccgcgccgccgccgcgcacctggcggcagacccgggaccgctgcctccgcctcgccgcggcgctcgcggggctcggcgtcgcgcgccgtgacgtggttgcggtgttcgcgcagaacatcccggccttctgcgagctccacttcggcattcccatggcgggcgccgtgatctgcgcgctcaactcgcggctcgacgccggcatggcgtccgtgctgctgcagcactcggaggccaaggtcgtgttcgtggacgccgcgctactgggcgtcgcccgggaagcgctccgcttcatctcccagcaggccggcggagcgagcagggtacccgccgtggtgctaatcaacgaggcgctcgacgagccgccgccagcggcgacaggaaacgacaagatcccaggcgtcgatcggtgctacgagtacgaggccctcctcagcaacagcagaggcggcgatccagagttcttgatccggtgaccggacgacgagaacgagccgatcgcgctggatccgcgtgcagggggcggtgaatcgcggggaggggcgctggatctgcgggcggtgaatcgtgaggtggggggggttggatccgcgggcggacggtgaatcgcgtgcgggctgacgtgagcgctgagcgggattcgcggcgtggacgttgaggcgggggcagtctacactttactcttaatagttagtagagatttggggttctctctgtacatttactctctcatctctctgtaatgggctagctctaacaccaaggctattaatatattgctccatcctatttt

SEQ ID NO: 10215 - DNA, 2546 bp, Zea mays
ggatggcttccatgttgtatctgcgtgatgctaactcttgagggcgtttagtttgtgaatgtgataatgcagtagcgccggatcttttcttcgcgcccgtggcccgccgcgcccccgctagcagttacgtgttcgcgcgcaagccgccaccaccaccagtctgtcccgttccccacctcaccctcttcttccctatactcgggctacacctgcgaccactgctcacccgtcgcggccatgactcccgcatccacctcccctctcgccgccgccgtcctgcccacgaacttatcttccttctctcgctgcccacctcgccgcctcccgcgcatctcctgcctggcagcgcccgaacgcgggggcaacaatgcgtcgaacgcctcgccggcaccgcagcagccgaggtggggtgccgcggtatccgccgcgctcgcggcggccgtggttgccgcctctatgccagcttacgcggacctgaacaagtttgaggccgagcagcggggcgaatttggcattggctctgccgcgcagttcggctcggccgatctcaagaaggctgtccacgttaacgagaacttcaggcgggccaacttcacatccgctgatatgagagagtcagatttcagtggttccacattcaatggtgcctatcttgaaaaggctgttgcttataaggcaaatttcactggtgctgatttgagtgatacattaatggaccgcatggttctgaatgaagctaaccttacaaatgctgttcttgtacggtcagtcctcacacgtagtgatcttggaggagccatcattgaaggtgctgacttcagtgatgctgttattgacctatcacagaaacaggcattatgcaaatatgcaagtgggaccaaccccatgacaggggtgagcactcgaaaaagcctaggatgtggcaatagccgtcgaaatgcatatgggagcccttcatcccctctgttgagtgccccgccacagaagattcttgaccgagatggtttctgtgatccagctactggtatgtgcgatgcaagctgagaggtttgatccaacatggaaactggtcactggatggtgtacatacattggagattgagtaagagcagaacagtgcagagaaacaagtcgtttttcttttcctcttgccattgttgtaacattgcaacacggaatcaggtaaaattcaggatgtagatgagatatgcacgctgagtactgaatggcatgtatagcatagtatgtatacgaaaatagatcatatcaatcatgtgcttcatgcttgaaaggagtggcccctgccttgttctaaagccaacatagccaaaagcagaagtttcaacagaggagtgtctcagcaaataaactttccactccatttcacaaacattgctgatgcatcggcagcaaccagagctgccgttctggatgaaccgcacaaatagacgtccatcgacagcttgactgtttgtgcagattgtcaggtcagttgctgaagtctagagatggcaatgggtacccgaaacccgaatacccgacggggtttacccgatatgaaggcgggtacgggatgatttctctacccgcgggtatgttaatgggtaaaaacctctacccgttgggtagacgggtacgggtatgggttggtactacccatacccgtctacccgtgggtaaaatatacccgcatcaatagcactataaacatctaatagagtccaacttagctagaataaaacccttctctagttatcatttgtttagataccaagttatgtaatcatatgatttgttatatgtaaaattgaagttgtttttatatgtttatttaatattttgagtgattggtatattggaatttaattcttttctagcgggtacgggttacccgacgggtaaaaatacccgggcgggtacaggtatgggtaagattttatacccgcgagtatatatgggtaacccgacgggtagaattttttttgatgggtacgggcatggaatggtattacccgacgggtatgtacccgttgccatccctattcgtgacgttgagaggataagcttatggaaaataaaaataggatttttcttctccttttttaacaaaagcatatgaatatttatgggtcctggcattagggtctaaaagatgtataaaagagttgaaccaaaacaggattgacttcgatattttaaactatgtcaaatctaatttaaaacagataaacctcatatgttctcaatattgggatttgatttaaaacgaagagtaaacgggccaatttaaagcattatcgattaattttaatttgcattcgtttcgattaaatttagacgaattttgctcgctatccgaacattcaactataaagtaattcgattaataactctacaccttattattattgttattattattattattttgtacatgaacttggttgaaattataaactcgaactatttcccaaattgcactcacgctctcgaccaatctaaacagcacgagcctcgacattttgaaggttactactgtagaactc

SEQ ID NO: 10216 - DNA, 3567 bp, Zea mays
cgtccgcgcgcgcagccgccgccgccagctgcaggctgccactgccagcggccaccgccgccgaggtcgaggtgtccggggtgctcgccgaggccctgggcgccgcggcgtccgcgtccgcggccgtgttctccgccctcgaggccgtctcgtccgccgccactgccgccgccgccgcgtctgccgcctcctccaagaaaccggcggcgacggcgacgctcatgtccttggtcaccaggagcggcaaatccgccgcctccgacgaggacagggagctcgccgcgctggagaagatggagcggctcgacgcgtgcatcgccgagatggaagccgggagcgacgaggtgttcaggagcatcctgcacactagggtcgcactcctcaacatccgcacccagacatgctgatcgttttggacatccatcaaaaccacactccagaatgtcaccaaaatgcaagtgtacatacatattattggatgaaaaaaaggctctcttgtttatttggctcttgtttaaatgcatgcgttgttcatgtgtgaactacgatatgcatggttacatttcatcgaacaaaaccgcgcgaactcgatcgacattattcgtgttcataagcttaaaccaatcgcgcgctttgagcctttgacagttgacacacggccggcgcatatgcaaattaaatgcgtactgctttgtctcttctacgcgtacatatcttttgctgctatgtttttataattagatagggtatgtattcaaatattcaacaaacaaaaactatgtatcaagaaaaagctaaataaactagcataataatgtaaaacacggtaccttgtaatttagaacgcgaaaaaaacaaaaaatatatacgaaggaaacggactggagaagaacaggcggctccattaacacagactgctcatgttgagatagtctgcaatgcaatttcactaatatattcttaattagcgcaaccatgagtccatgactctgatctggatctagatcaagctcctgatgacacatcgctattgcgcgttccaacgggccggagacaaaactgatcaatgcgccactattctattgaacatttgcccaagatctaagagacattgagcactaaataaaaaggtggtggccactgagtcggccatcgatcgggcacaaccctatgcacagctcttgcatcgaagtgtggctggctgtgcttccacctgtctgtgtccttccctgtcttcgtctcacttcagccattggatttagatcgaacgtatcgcctgtcttcgtcttcctcactccgatcccggcccccgcctactaccgccctccttcatcgtccaccgccagacttcttcatatatataaccttatgaaggatctcgttattttttttgttagatctagctagctaggcatgtaaacgtattgtgaacttcaacaataaccttaatcaaatctttattcctttagatcttatttgtttgaacttgttgccagcttcttaataataagtgtgaaaagccagaagctgaaacaaacatactatggctttttggttgtttagctttctaaaaaaactaggagatcaggaaaaaaaactgagtttatatgggaagaagttgagaagccttggtgttattaggaagctaataacatcactaaaaagctatcatatattaacttctcgaacaaacaagatgcagcttttcagaaaagcttcaaaaatgcagcgcgcctcaaacaaacaagctaggccttaataggacaaacaacaagctactccttccttttttttttatttttttggaggtcgtctgcgagacattgagccatatagcgtaaatggacaatgtggtctatttcatagattgatggtcactagaatatgccatgcttaaattttctagtgcttgtgtgtctttattatatttgttagaaagttccccacgaaggtttcgaatccctctctggaaattaaagacggtggttggctggcatgcatcttgaatttcggtcagtaatcaaatagtagcggaagataccctcttattatcgtctagctagctagctagtacagtacgtagtagtactaattaaaggatgaacatatatacatgcatatatatatggttgttgttggcatgcatgacttgcttgtttcaataatgaagctagcacaatatcctcttatttgcatataatctctctgtctccatatatatatgtcgcttattcatgtctagaaaatctctccgcgaattgatctgatctggcggctgttagagatcgatcgagcgcgcgccggaagggaagagattcgatccagaacgcgagcgttcgtgcgcaaacgaccagctcatcaacctctgcaaacccgcctgcatgcagtcgatcggtagcggtaggagagtggatgaatatggagctgcaggcgggcttggcgacaaattaaacccattcgtgcaataataacaatcattactggtatgatgatgatgatgatgtacagaaatgttgtgtcgatctgaaatcatctccaaatcagctcggtagtcttagggtctgtttggttgggctgtggctgtgaaaaaagctgctgtgggctgtaagctgtgagaaaagctgttgtgggttgtgagctgttaaaaagctaaaaagtgtttagtggaaaccactaaaaatcgctaaaagttttttcatatatattttcacagttccatctaaaagccgctaaaagcaggtcaagaggtgctttcagttttgcactgcaagaaagtcggcttttaaaaaaaactgcttcctagatccagccctttggtttggcttttggcttttagggggtaaaagtcaaagccaaaagctaaaccaaacacacccttagcttctccgtgctagatagatatatgacccaccagctagctagatatggattggtgtcaccacgatgggcatgcatgacgttcgtgcgtgtgtgtggtcatgcactgctgcatcgacttttcccttccagagatgcacaactgccgggctcctgcgcttcatcgtcatcgcatggcaaacacctcaccatgcatgcatgtcctggcattgactccaccaacggcgcagactctttgctccttgctccgtccaacctgtcgtcgcgggtcatgtcccctagctacctggctcactagctactgcgctgctggctgccgctactacccgcccatgcacacgtgcacacctcccctcgctctacgtcgtcgtctcaaacgatctatcgaacaatcgagctaccctagcttgcaaccacaaccaaagctagctagttagctagctagccacctacctgcatgcgacgactaaagagcatggctcatgcgacgactaaagagcatggctcccaactttggaaccgccaacgaggacgatcgagatggccagcgccgtcgcatccgcttgctcgacatatccctactccggcaatatatttagagaatatagatgtcgagacgggtcatccagcacagacactacccgaactcgctttggtccggtcaaaatagtgccggacccgacacgaccc

SEQ ID NO: 10217 - DNA, 1045 bp, Zea mays
ggccggcccatctattttctaaccctaattccacctggcacctgtcccggccgccgtgagccattgagcccacgaccacgagctccagagtggccgtcgccgagtctcgggctcttggccattggggccctcctcgccggccgccacccacccccacccccacgcgcccggcggcgtgctctctgctgtctgctctgcacccaggaccttcgcccacaggagctcagccctatccctcgacggtgctcgcggccggcgcgcggcggctcgacccttccccatctccagctgcacgcggtctccaccgcctggaatccagggcctccgacgccaccccacctccaccgcctggaatcgaggaccgtcggcgccgccgtcccctgcctgctgcctcgactcaactgtgtcagggtacttgcaaacagtgacaaaggttctgccttgccttactgtggagccatggctgcaaagatacgcgtggtgatgaagtcttttatgagccaaagcaaccaggtcgcagggcttctgccattcacaaagaaggtcggactacctgaatcgcgagccttgtacaccgtgctgcggtcgccgcatatcgataagaagtccagggaacagttctcgatgcatgtcaagaaacagtttgtggaactgacagccaaaccgcacgagctccacaagaagttcttctggctaaaacgcctgcgcatacctggggcccagtacgaggtacagatttctttcaagacacgcctggatatggcgagcctaaggtcccaggctccttgatggctcacgatgatcgttcttatcgtcccgcgaaagtttgaagtgctgagactggtactcagaacttgtatccatcaacatttcatatgaagacatgcttattttgatgactttcgaaaaatgtagctgctaactatttccagtgcagttttgagtgcttatggcttgattcacacaaatgtagctgctacgttcagaaataaaaaaattatggaaatacagcgcgatatcgctttgatcaaaaaaaaaaaaaaaa

SEQ ID NO: 10218 - DNA, 1032 bp, Zea mays
cattgggaccctcgaggccggccgggtccggcccatctattttctaaccctaatcccggccgccattgggatcctcgaggccggccgggacgagctcccgagtggccgtcgccgagtctcgggctcttggctcacgcggcgcggctcctcgggccccacccacccccacacccacgcgcccggcggcgtgctctctgctctctgctgtctgctctgcacccaggaccttcggccacaggagctcagccctatccctcgacggtgctcgcggcggctcgacccttccccatctccagctgcacgcggtctccaccgcctggaatccagggcctccgacgccaccccacctccaccgcctggaatcgaggaccgtcggcgccgccgtcccctgcctgctgcctcgactcaactgtgtcagggtatttgcaaacggtgacaaaggttctgccttgccttgctgtggagccatggctgcaaagatacgcgtggtgatgaagtcttttatgagccaaagcaaccaggtcgtagggcttctgccattcacaaagaaggtcggactacctgaatcgcgagccttgtacaccgtgctgcggtcgccgcatatcgataagaagtccagggaacagttctcgatgcatgtcaagaaacagtttgtggaactgacagccaaaccgcacgagctccacaagaagttcttctggctaaaacgcctgcgcatacctggggcccagtacgaggtgcagatttctttcaagacacgcctggatatggcgagcctaaggtcccaggctccttgatggctcacgatgatcgttcttatcgtcccgcgaaagtttgaagtgctgagactggtactcagaacttgtatccatcaacatttcatatgaagacatgcttattttgatgactttcgaaaaatgtagctgctaactatttccagtgcagttttgagtgcttatggcttgattcacacaaatgtagctgctacgttcagaaataaaaaaattatggaaatcaaaaaaaaaaaaaaaa

SEQ ID NO: 10219 - DNA, 942 bp, Zea mays
  misc_feature (22)..(22): n is a, c, g, or t
ccggccggggccgtgagccttngagctcacgagccacgaccacgagctccagagtggccgtcgccgagtctcgggctcttggctcacgcggcgcggctccccaggccccacccacccccacccccacgcgcccggcggcgtgctctctgctgtctgctctgcacccaggaccttcgcccacaggagctcagccctatccctcgacggtgctcgcggccggcgcgcggcggctcgacccttccccatctccagctgcacgcggtctccaccgcctggaatccagggcctccgacgccaccccacctccaccgcctggaatcgaggaccgtcggcgccgccgtcccctgcctgctgcctcgactcaactgtgtcagggtacttgcaaacagtgacaaaggttctgccttgccttactgtggagccatggctgcaaagatacgcgtggtgatgaagtcttttatgagccaaagcaaccaggtcgcagggcttctgccattcacaaagaaggtcggactacctgaatcgcgagccttgtacaccgtgctgcggtcgccgcatatcgataagaagtccagggaacagttctcgatgcatgtcaagaaacagtttgtggaactgacagccaaaccgcacgagctccacaagaagttcttctggctaaaacgcctgcgcatacctggggcccagtacgaggtacagatttctttcaagacacgcctggatatggcgagcctaaggtcccaggctccttgatcgctcacgatgatcgttcttattgtcccgcgaaagtttgaagtgctgagactggtactcagaacttgtatccatcaacatttcatattaagacatgccttattttgatgactttcgaaaaatgtagctgctaccttcagaaataaaaaaaaaatcatggaaatacagcatgatatcgccttgattcgc

SEQ ID NO: 10220 - DNA, 1040 bp, Zea mays
ctattttcaaaccctaattcccctggcacctgtcccggccgccgtcgagccattgagcccacgaccacgagctcccgagtggccgtcgccgagtctcgggctcttggctcacgcggcgcggctccccaggcccaacccacccccacacccacgagcccggcggcgtgctctctgctgtctgctctgcacccaggaccttcggccacaggagctcagccctatccctcgacggtgctcgcggccggcgcgcggcggctcgacccttccccatctccagctccacgccgtctccaccgcctggaatccagggcctccgacgccaccccacctccaccgcctggaatcgaggaccgtcggcgccgccgacctccgtcccctgcctgctgcctcgactcaactgtgtcagggtatttgcaaacagtgacaaaggttctgccttgcttgctgtggagccatggctgcaaagatacgcgtggtgatgaagtcttttatgagccaaagcaaccaggtcgcagggcttctgccattcacaaagaaggtcggactacctgaatcgcgagccttgtacaccgtgctgcggtcgccgcatatcgataagaagtccagggaacagttctcgatgcatgtcaagaaacagtttgtggaactgacagccaaaccgcacgagctccacaagaagttcttctggctaaaacgcctgcgcatacctggggcccagtacgaggtacagatttctttcaagacacgcctggatatggcgagcctaaggtcccaggctccttgatggctcacgatgatcgttcttatcgtcccgcgaaagtttgaagtgctgagactggtactcagaacttgtatccatcaacatttcatatgaagacatgcttattttgatgactttcgaaaaatgtagctgctaactatttccagtgcagttttgagtgcttatggcttgattcacacaaatgtagctgctacgttcagaaataaaaaaattatggaaatacagcatgatatcgcttgattcaaaaaaaaaaaaaaaa

SEQ ID NO: 10221 - DNA, 841 bp, Zea mays
ctcggccccggttttgaaaaaggaacggcccatgttcagggagaaggctccgactgggctaggaggcgctaggctatcgccgcggccgccgttctctcacctgctgcatcgctgcttccgcctccgccctacaaggctacaccagatgcccagattttcgtccggttcttctccggcaacgagcagccaccaggtgtcttggtatttgcaaacagtgacaaaaggttctgcttcgctgtagagtcatgtctgcaaagatacgcgtagtgatgaagtcttttatgagccaaagcaaccaggtctcagggcttatgccattcacaaagaagattggactacctgaatcacgagccctgtacaccgtgttgcggtcacctcatatcgataagaagtccagggaacaattctcgatgcatgtcaagaaacagtttgtggaacagacagccaaaccacacgaacttcacaggaagttcttctggttaaaacgcctgcggatacctggggctcagtatgaaatccaaatttctttcaagacacgtctcgatatggcgagcctaaggtcccaagctccttgctgactctcagatcttccttaccgtcctgaatgtttgaagtgacttgtatccatcgacatttcatatgttatgaagacatgcttattttgatggcttttgaaaaaaaatgtacctgctaagtcttcattaccttgacagatcactagtcaagaaaatgcagcatgatatgacttgattcacaaaactttatggttgtactgtttccgatgcagtttaagcagtcatcatgctgaatcccttttaaattcgaaaaaaaaaaaaaaaaa

SEQ ID NO: 10222 - DNA, 808 bp, Zea mays
cctcgaggccggccgggacaccacaccccgcacagccaaaaaacgcgagacgccggatacgaaacgcgccgaaacccttacgcgcacggcgcaccgcgtcctgctctgccgaacacacaccacacaccccgacgggcagcaaagcaagctgctctcgcctcccccacacccccccgcctccgccgagctccacgccggccggggcgcccccgcacgccagacgcccagcccaagagccagccgcgcgcatctggttggggccagctcctgtcgatcgatcgcggggggcccaagggaacgtgttcttccaagatgctgcagctgctgatggctctggccttctcggcggccccgctgacgctgtacgtgccgccggtgcgcagcctcagcctcttcgtcgaggccatggaggccgtctgccgcgactgcgcgccctactcccacggcgccgtcgcccgcttccgcctcggcctctcccgcgtcctcgccggcctagcgcgcgccgtccgctaggcacccccgccccgccccgcatcgccgccgccgccgggtcccttctttcctctgtcctcctttctacccataccgagcaggtggtttctagcgcaggcagcacagctagcaatatactgtactatacatgcaggactagcgcgaaatctttctgttttttttttgtttgaggtttgggtgtagcatgtagggtgaggacaggttaataaatcaatccgaatgaaggggagattttgcaaaaaaaaaaaaaaaaatccggcctgtgttggggtgtgagaggtatgaattccatgtg

SEQ ID NO: 10223 - DNA, 5408 bp, Zea mays
  misc_feature (878)..(878): n is a, c, g, or t
  misc_feature (4310)..(4310): n is a, c, g, or t
ataggtttgatccttgatctggaataacaattaaacaacagaaaaggtgatctttataacagtaccaaagcaaattagcaattcaactatgtacttacttctaatctgaattccggattagtttgaagaaagaaaaggtaaatttgtactgccaatgactctgtagaaacaaaatgatctatctgagaggggatgtgcaaagtaccttgtcctttgataattgtagtacggatggcgcttcggtattttcagcggaaggatgtactacgtgtgcatagtgtcctgaagctatgtagtcaaatcctaaattttcaatggcttctaagaaagaccctgtccaaacagcaacaaacaagacatcatagtcagaaaactgcactgcaatgcagatttggatttccatagtggaacatatgatatcgccatccaaatacacaattcataccgaactttattctcgtgttgcacagaacatcgggatttggtgtacgaccacagcgatactcattgatcatatgtgatacctagatatcaaattcacagtatttcttctcaaagcaaaggctctaaaaagtgttgtgtgcaaatctatgggggggaaaggctcaaatgaagcttactcaccacatggttccagtattcatcggataggtggaccacctccaatggcacatcaatctacaaaaccaaacatgagacatcatcaggccatcggtccatgtaaccaaaatcactccaagtacatatgctaaagactagctactcaatgacatgccatgttccatcagaaatttgaacaacaccttgtcacaaacagcttgtgcatacttcaaatcctcgtcccatgggcactcggaccagaaattcctgaaatcttnctacagattgtaggagcaagtttatcagacatcctgaagcacagcattccaggagcagcttaatgacaaacagggattctcctaaaccccatacctggaaccaaatcttcaggtagaacgcggtgcagcgatggccggcggcgtggaggaggcgaagcgccacgctgctatccaccccgccgctcaccagcaccgccacccgcaacggtgctatgcctgccgccgcgcaccgggtaaggtgcttgtccaacgcaacctcctcccccttcaccgcggcgctgggcgcgccggcggcgggcgaggacgagagcgtgcagaacggccacggctgaaggcgtgagcggggcaggggtttatggtttagcagagagccacggcggagaagcggacggagggcggggagggtggagacgacgacgcgcaccatattggggggagcgcctcgccggccgcgtagcgcttctcgcgatactggattggggacagtcgagtcgttgccaagggctcgtttggattgagaattctaaggccttgttcgtttgcgtcggattggtgggtcggaatgattccgagccgtattgtttctctaatttatataaactttgattagccggaacgattccaggtgcaatccgatgtaaacgaacaaggcctaaagggtttggatggaaaaactatgaagtcatagttttagttagcagaaatctaattcgttaaaatcccgttcagtaaaacagaagaattataaatttctaaaattatagatatgaaaaaaagacgaataagaaaagtttttttattagacgcatgcaattggcgaaacattttatttaaacaaatgtagaaccaaaatggatggttttgtgcttattaccggttcttcctcccgaattgagacccattgtttatagatctagggataaagtagtgacttcagatattaatgaactttataagagagttatccgtcggaacaacctagaagacttctttggttgataaaaaaatgaaggaaacttttcggtcttgttcgttagctctcaatttatatggattgagtgagattgggtgagtttaaatttcaaataagctaaactttttcttaatttttttctaatctcattcaatctatatgtaataggaataaccaaacaaagctctcataggatttaatcccacaacctagattccttaggaaaaataaaaagaggttaaacctcatgcaaaaattcctttgattggatgcacccatctcaaacaattattttaaactttttaatccccttatttttttctgtggtgtagccctttagttttgaattctgtagagttagaaaatacatgggttctattttcctgaaaaccggtgttccaaagaagccctagaattctagagcttgcaaaaggcaagacgcggtatccaattcccctctcgcgtacataaacgacggagaaaaggacacaacccagcccgccctaaaaccctcccaccatcatgtcgctctccacactcagccacccggccgccgccgccgccgggagcggaaaatcccttttcccggctggcccggcggcgcagtccgtacatttccccaaggcacggctccctgtccccgccgccgtctccgccgctactgcggctgttcacgcggaggatagggtttcgtcgctgactcaagtctccggcgtgctggggtcgcagtggggcgacgagggaaagggcaagctcgtcgacgtgctcgccccccgcttcgacatagtcgcgcgttgccaggtgagggggacgcgtttcggtcttgattgtgctataatccatgccttgaggagttgagttgttcggtggcgttgccgtgcttttgccatggttaaagtttggtcgttcacggagcaaatcgttggaatttcgtgctattttgtggattagggttgatgatgattgataaacgatcgatctgtgtttagaattcaccttagggataaccatgatttacgtgacatttgctaatgagggtaaaactccaaccttataatcgttttgaatatgataattttttataccttcttgatgttggctgcacctttggtctcttacaggagtattaggatgtttgatcttgaccgttaaacacttagtatatgactaaaagatatgcacctgtcataatttcctttttactatgctaaaatgtgcatacatagtgtagatgaatcatagatttgtggttcaaattgatagattatccatgtgatggttgattcaagcaagaaaattttcctttttatttggtcacataagaatttgtcctgtgtggttggctatattatggagagacttataaaatgcgaagcttctatgttatgttaagccctggtactgcaagttgctctgtgctcttaaagaaaatacttgtgacttactaaactagttcaagcttgagatttcaccatgttttgcatcctagagcaatatatacacatctagtttttcattaacatatactattacttctgctccttgtggtcataacgtgccccttactaatttgctttttgcttgatttatgttgtgaatgtttctagtctcttcgaacacggcaagtcagtcagtgtcagttagctactacttagtttagtagccttatctgagttctaaccacattttcatcaggggggagcgaacgctggacataccatctacaactcagaaggcaagaagtttgctctgcatcttgttccatctggtattctccatgaagggacactgtgtgttgttggcaatggagcagtgatccatgttccagggttctttggagaaattgatggtcttgagtccaatggagtccgctgcgatggaaggatactggtatccgaccgggcacatctgctgtttgatctgcaccaggctgtggatggacttagggaagcagagcttgaaaattcatttatagggacaactaagagaggcattggtccttgttactccagcaaggtaactcgaaatggactgcgggtttgtgatttacgacacatggacacttttggggataagcttgacatcttattcaaagacgctgcttcgagatttcaaggctttcagtacagcaaaagcttgctcaaggaagaggttgagagatacaagaagtttgctgatcgcttggagcccttcattgctgataccgtgcatgtgctaaatgaatctatcaagcagaagaagaaaatcctggtcgaaggcggccaagcaactatgctggatattgattttggcacttatccatttgtgacttcttctagcccttcagctggcgggatatgcacaggcctagggattgctccaagggcaattggcgacctgattggagtggtcccgctgttatttattattgcggtcctcttccatgctctactgcttatatatcatgcatgctttgcgtncaggtcaaagcttacacatctagagtcggctctggccctttcccaactgaactatttggagaggaaggtgatcgccttaggaaagctggaatggaatttggcacaacaacaggtcgcccaaggcgttgcggctggcttgacattgttgcgcttaagcacagctgccaaatcaatgggttctcatcacttaatctgaccaaactggatgttctgtccgggttgtcagaaattaaggtgggtgtttcttatacccagactgatggacagaagctgcaatccttccctggggatcttgatacccttgagcaagtacaggtaagctttgacatgcacatgtcactgtgttttcactgcataaagcccctttgaatagaaacacagcattgtttggagaatgtacattattttttccgttttaaggtgcaatgtaatatccttatcccaaaaaacttgtggtgttagtattgataatttatacaggtaaagagactaagaatgcatatatttcatctcttatatgccttgccttgtgtttcaggtcaactatgaggttctgcctgggtggcaaagtgacatttcttctgttcgaagatacgatgaacttccccaagctgcccgcctttatgtggagaggatagaagaacttgttggtgttcccgtgcactacattggtgttggacctggcagagatgctctcatatacaagtaaaagcaactttatttggtccttggttgggcggaaaccaggctgggactcgggagcatttgcattttcttggcgtggtaacttttgatacggtgaagtcactgactcgtggagtgatgttgctcaataatcattaatcagaaccttgtcctaatacagccgctgagacatcagctaaggcgaataagggaaggatgagtcatttgcaccatgtttgaccaccaattgttaggtggtccatatattttgtacttattgtgagactttgtgctatggatctcaactgtataccttgctggtgcatggctttgggtttacatggttgaaaatgagattggtgtactaattgtctatgtttaaccttgtcaacgcactgaagctagcgaaaaatg
